United States Patent 9,328,346 (POLYCOMB-ASSOCIATED NON-CODING RNAS) - sequence listing, part 144

SEQ ID NO: 192242 - RNA, 31424 nt, Homo sapiens
ggcccgcgcccggccuccgcggcgccgccucccagcccagagcccagcgcucaggaaggugcgggcgggggagaaagcaacaccauuguuuuucaggcgccuccauuugcccccgagccgagccguggcuuuccggaugaucgggagacgcggucuggacgggccgggaaaggagccgggcgccugcggagaccccgccucagcgaguacgcccggccgggcgggcugggaggaugaggacggcugcccuggacuuccgccgccacaggaggguuuucggccggacgccgggagggagcuccaggcugugaggugaggagcccggagccggcgagacgggagacgcgcgugugagggagaccgagggcgcggagggcgggcucccccuucccuggcccacagcgaccuucuccuucccuuucugccgauccagcucggucccuccuccgcgaaaggcugggagcucgcuccgccccugcggggcccuccuccgccucacucacguuaguucauucaucaggcaucuccuccgagccuccgacgcgccaggugccgccgugacaaagacggacgcggccgucugguuggagacgauccgaguggcagcccgggugggcgccggugcucgggggggcgggccugaguaguccugggcgcugcaggugugugaugggcgccgcagggggccgccgagcagggcgggcggggcccaccccgggcuccagaugccggagccgcccuggaagcgauccggugguggggagcgcuguaaugcguccagcccgacgccgccacggcccccauauggguuucuguguauguuguuacuuuggaaagcaaagagauucagagcaguggguguuucuggaaccacucaguuguuccguagcuuuucuggcaucacuugucuuucugugaaaugggagugaggcccgagucccccuucccaccuugugagcuguuggagguuaagacgcggccacgcuggacaaccucgugcagaugggggaguggcaggcacugccgguccuaaggaucacagaggccugauggcagagaaggggacugugaguguccccaugugcccuuucacgggcccagcguucuaaagugggaaucauaaacaccagguauacugguugcuggucucuugccacccuaguuguggcaaaagugucggcuaguugucugcacaccagcggggagguguagggaccccugagucccaccuuggggguguggcagcugcaguguccagggguucuuugagggcugagcugugcagugacggacccacuuuucuguccuggccgaggaagggcuuuggcgagugugcaguugccuucaaugugguuugaagagggcaaggauagagaauaggguggaggcgagguugaaggucagggcagaauuggcagaaggcucauaggaaaccacugauacuucuagaugcaguguuauuugucccugguagacugcauguagcugucucaugugauguuuucccuugccucccauugcagacucugcugggcaaagcugauucuggcuggguuguccauccagcacgcagcaccaucagcccucugccaccagaaggguggauuuuccauuccuggaugugcuugaaggcucauccgaugcaugucuuugucauuccagcuccauuuguaaaggucuuaauaacaagaacagugacuucggcuccggagcuucaagauaguggccugcuuggccugcccaucucggaucucuccaggaggacccagccacccaagguaccagagcgucuugauuacaucugcauguggcgcuguugguuuccugggaugcucaaaacagcagugucacguugaaaugccaccacuuucucccagauuuccugucuuguucauccagucacccacuuaacgggaauccacacguaaugguacugauggggggagggcaucuuucugucuguuucauccuguguguaaagaccagccacaccaacacucccuaccuuucccagggcuucuccaaagggcuggucucugagggcauugacaguuuccuugucacugucccccagaaaugaccacaggagaccagaacacugaagccagugauuucuguuuggaaauagggucgucuucugcugcugacccccaucaaaucccaucaugcccacagcccugugcccccgagucuuggcuccgaaggaaagugaggagcccaggaaaaugaggagcccaccuggagagaacccuagcccccagggggagcuucccagccccgaguccucucggcgucucuuccgccguuuccgcuaccaggaggcggcgggcccccgggaggcccugcagcgccucugggaccugugcgggggcuggcugcggccugagaggcacaccaaggagcagauucuggagcugcuggugcuggagcaguuccuggccauccugccccgggagauccagagcugggugcgggcgcaggagccugagagcggagagcaggcuguggccgcgguggaggcacuggaacgggagcccgggagacccuggcagugggugaguagaagagguggggcugggacggguagagaucugguacuuagacacuuuggcugggccaugcaugugcuggcuggggaaugaggaguuccaucgagagccauuuacuuugguuagguccagacuagaguuuccuaagaaagccaguuuuacucccugaaggcucuaauuugggcaugauagugucgugccccuuuacagcccaguccaaggccuaaguugagccuuugauggucagcuguggaguggauggucaccaggcccagggagagaugggaccucuuccccuagcccugaaaagcugucucugggauugcagcucaagcacugugaagacccuguggugauugaugauggggacagcccucuggaccaggagcaggagcagcugccgguagagccccacagcgaccuugcaaagaaccaggaugcccagcccauaacccuggcacagugccuggggcucccaagcagaccaccaagccagcucagcggggacccagguaugcagcccaggggaguguagcaggggugaucuggggaagugcacaccccauacugugcacugggugugguuuuuguuaagcugauggcuuuuacaucagcaguguucucguguccccgaggugcugugagcuguugucagggucugagucccuuccuagagcaauuaaaugagaaccucaucaggauguuuguccucuucaugguucuagagccucucagagcuaacgcuucuguaggugggugucacugagguggugcccucucaucucuucgagggugcaucucugcaggauuugucaguuugaugacagcuggggacugccaguguacagcuggggccugcugcaugacuggagcauggccauuucuugucucuuggaaccucuguuuccuuggcuaaacaacuccuguuuacaggaguauugugaugcugcgaagagauguagaaauacuuaggaggacacaggguggugucuaguguguggggccagaacaucagcuacacauaguuugaguauguauaugaaguacaugguagcuacaggaaaguaguuuuuucaucagauaaacuuagauuugaaucuucugguuaugaccugaggcauguuucuaaacucugaaagccucaguuucuuccucuguccagcagagauaguaauuaccuuuuuugggguuuuuggacaauuaaaugagauacaaccuacaaaagguugaacacaaggccugaggugcccaaaacuuuaaguacauaucaugggaaaccagcgcccuuggguugaaggaagucuggcccguggguuccucuggguggacuugccacggugcuuuauauguacaguggaaagagagugucuggggggccaggggggcuuucuuaugacucuggguggacuugccauagugcucuauagguacaauggaaagagagugucuggggggccaggggagacuuucuuaugacuugcagaaguuguguuuggcauuaugauaagcuuuucaguaauaaaaccaaaaugccuauuaaauuucuguguguggaaaaacuauauugacuucuguacaaaucacauaaacucuucagccuuuucuugcuuauaaaucaaguuugguguguuguuggcugccauaacaaaguaccacagacuggaugccuuauguaacagaaauguauucucucacaguucaggaggcuggaagucugaagucaauguaucagcagccuuggguucuucugaagccucucuccuuggcuuguagacaugccuaauguuaacacuaagagaaguuugcagauagacauuuagaaggagcuagggguugggcgcgguggcucacgccuguaaucccagcacuuugggaggccaaggcgggcggaucaccugaggucaggaguucgagaccagccuggccaagauggugaaaccccaucgcuacuaaaaauacaaaauuaguugugugugguggugggugccuauaauuccagcuuuucgggaggcugaggcaggagaaucacuugaaccugggaggcggagauugcagugagcugagaucacgccauugcauuccagccuggguaaaaacaguaaaacuccaucucaaaacaaaacaaaaaaaaaggagcuaggaggggaagucucuuaugccacuggcucucuuugggacccguaaaaacccaugaauauccggcccugaaagcugacaacaagcuuugugccaggacucuugaugacgggcgguuuucuuucagggaaaggaagaggaagauguuuacacuaagagaaguuugcagagcagguguaacagacaccuucucucucugggucucuuuauguggucuuuccuuugugugugucugugucuuaaucuccucuucuuauaaguacaccaguccuauuggauuagggcccacccauaugaccugauuuuaucuuaaugaccucuuuaaagacccuaucuccaaauacucagucgcauucugagguaccuaaggguuagggcuucaacauaggaauuugagagggccauaacuuagccuguaacaacagguauaagggaagcagccagucgcccacauaaugcacgugcaaguagcuuggguuaugcaggaaguggggggcugugagaggccuuguaguggggucugggaaggcaugcagguggagaggaagaaguuucaggaacuacaguagccugugcaguugcuucuugauaaaguucugagauaagccagcaaccacagaugggcuuuaggaaaacagggccagcucucccauuuccaugagcaauaaucaauaggcaaaguagguaugaugagaguuagcaaucaggaaaaccuuaacuauugggacaguucaucauuggaaugcacuaccuaucagagcuguauaguuccucaucuugaagaucuuccccaaaagcuagauuuuguguagggucugcaacucuccgaagugauucuugaaaggguccauguauucauuuaucggggccaaaaguagggugggacuacauauucauauauauauauauauauguguguauauauauauauguauguauauauauguguguguauauauauguguguguauauauguguguguguguguauauauguguguguguguguauauauauauaugcguguguauauauauauauacauaugucucagccucccaaaguguugggauuacaggcgugagccacugugcccggccaacaugauuuuaaacuuggagaagggagggcuagggaugggaaggaguuagccagguuacccaguuagggggcaucuccauucauauauauaugaauaucugggauagcuacauaucccagaagguggcaggugugaggaagcagaacuaaaacaccaccuccuagccaggcaugguggcucaugccuauaguuccagcuacucagggggcugaagcaggaggauugcuugaggccaggaguuugagaccagccugggcaacauagcgagaacccaccucuaaaaaauaaaacacccccucugggagacaucggucaaagaguacaaaguuuccguuagguaagaugaauaaauucuggagaucuaugguacagcauggugagguugaugaaaaauaaugcaucuuauacuugaaaauugcuaagaaaguaaauaagaaauguucucgucacaaaaauauaugagguauagauuuguuaauuagcuuaauuuaaucauuucacaauguauaguuaucacauuguacaguuuucguauacaaaauacauacaauuuuugucaauuauagcuuaauaaaacugggagguaaaaguaaguuaaauaaagaugaagauagaaacuuaaaauggaacauacacacagaaaaauaccaccuccucaaaucuacgcccauccagccugagcuuccccuucagacacagugaagaggcugccuuccacugagaccccuagaauggcacugccaucugugugggcuccuggccccguccuuuguuccacauagccacuccugcagcugcuguuuccugcaggcuuuguauuccaggucugaaaggccagggacacuggccucugggguuugcuuugauaaugacuuaacaugugaccugggguuaaccaguagacuauagcacagcucuccaagucuuaaucugagaaaggaguaccuuuugaaacagagcucauuuuuacauggcugcacuguuggcaggggauguggcucauggcagaagccugaacaaaggguaguuuccaauuccaggagagaagaguggcagagucccugguagcccaaaauaaggcuggugagauggucccaaagccacacuuuacauuuuguaugagggucuuuaggacacugugucaaaugcucuuucaggaguaccuacagugguaacaguuuuucuuuuuuguuuaauuucugucuucaaauugacaaaaaaaaauuguauguauuuacaguguacaguguaauguuuugauaucuauacacauugugaaaugauuaaaccaagcuacuuagcugggcaugguggcacaccuguagucccagcuacucaggaggcugaggugggaggaucccuugagcucaggaguucuguuccagccuaggcaaccuagugagaccagucucuuaaaaaaaaaaaaagucaagcuaauuaauauaaugcauuaccucauauaccuauccuuuuucuguguguggugaaaauacuucagaucuacccucuuagcaauuuucaaguacacaguacguuguuacugccuauagucaccauguugugcaauaggacuccugaguuuacuccucucaugucacugaaauuuuguacacuuugaccaaugucuccccaguccccucauucccuagccucugguaaccagcauucugaucucugcuucuaugaguucaacuuuuuuagaguccacauuuaagugagaacaugcaguauuucuuuuugugucuggcuuauugcucguagcaugucuuucagguucauucaugucgucaaaaaugacaggauuuuccuucuuuuuuuauggaguuccacaguaauucugauugccaacagcccuuacuuuuuuuuuuuuuuuuuuucauuugagacagagccauguucugucacccaggcuggagugcaguggugcagcuguggcucacugcagccuccaucucucaggcucaagcaauccuucuguuucagcuucccaguuuuuuuauuuuuaauagagaugcggucucccuauguugcccagacuggucuugaacuccugagcuuaagcaauccucccacuuuggcuucccaaagagcuaggauuacaggcaugagccaccacauccagacccuaagaguccuuauagauuccucaacucuacggcuuuuucuuuuucuucuucuuuuuuuuuuucuuuuucuuuuuaagaaacaaauacucuguguugucccugcuggucuggaacuccugggcucaagugauucucccaccucaguccccaaaauaagaauagcugagauuacaggcauguaccaccacacacggcugaacuccauagaguuuuaaccuuuauuuucccauaguuuggauaacaaugcugagguccggggaccuacccgaggugaaagaguucauuuaauugaccgugcuaucaugaacccaggcacacucuguuacagccccccuuguuauaucuggaaacaaagucgcagcaaucuuugugguuuacagaguacuuuucaugugcgucauuuuguaauccucauuuuacaguuaagaacagagacugggguuuuaugaaaagcaccaugaaacaguucccuguuggugccucucuugugauuuucuuugcuaccaaaauggaaaugaagagccgcaggaagcucagaagguaucagcaccaggccuggcccuggcccacuuuaggacaccauuuucugaucucuuucaguucugcaagaugcuuuccuucuucaggaagagaaugugcgggacacacagcaggugaccacccuccagcuacccccggugagugguuucuacaggaguccuugaaaauccccuguuugccucuguaggcuacagggcagcuuucuuaggaccccagccagcuuucugacugccacacaggauguucagucccagcccagaaaagcuaaaauaggcagagcgugagcuuaagagacgccccauuucuccuccuucccuguggucccagccgcccacugggucuacugucaucaggccaccuucaggaagcuuugugcagacgauagcaggaaacaaaggcccaugaguccccauugaugggccucucagcaugucuaaguuccccucuugugaaaaaggagaucucucugcucuuuuauuuuacagagaauuuuucaauuuaauaaucaucgcagcaaugguuauauuuuagaaauguuaggaaguggagggaagaaagcacagauaauuucaguccugucacagaucuacguggugagucauuccagaauuuccucgaauguucucguucguguuuuuguguaagacuugcuuacucgggugcucugaggagucagagucagggcugggggcugguccagcaggugaucuuacucgccucucucuagcccaguugcugucuuuggccauguuuucuggccauaucuccuucacuuucccuccuaacacuuuccacuggcuggcacaagauuuaguuaugacagcaucauccccucccaugggaacaggauguguggcuccugcuuuuguuuaguugcuccuuacccaacagaaaacugugaaaaacaguagacacucuuauuaccaugucucagcagaaugucggaagcugagcaguuugcuuucugcacaguucauuugacaugacuuuauuuuauuuuuauuuuuagagacagggucuugccuugucacccaggcuucaaugcaguggcacagucguaguucacugcagccucaaacuccugagcucaagccauccucccaccucggucuccugagcagcugggacuacaggugcaugccacuacacccagcuaaguuuuguauuuccuuguagagacagggucucgccauguugcccaggcuggucucaaacuccugaccucaagugauccuccugucucagccucccaaagugcugggauuacaggcaugagccacugugcccagccaacaugacuuuaaacuuggagaagggagggcuagggaugggaaggaguuagccagguuacccaguuagggggcaucuccauaacuugcuuuugccccaccagaaauguggcacacgccuguuuacccugaugcucaacacauacaugucagcaucugcuguguacugugaccauuuccaaacacaaaggagguaaaaccaguauuucuuauuaaaauuuggacauuuaaccaguauaacacauaaggggaugcuguuaauccaguaccuaaugagguuuggucuucaucuuucaauuccugcagucccuaguaaaugccauagcgagcacaguacagagauuuugauaagucaguacuguuguauuacucugauaguuucuucccagugauaguuucuucccagugcacuaaaagucaccaucaugaagauguuguuuauaaguguuuuuuaauuucuguuuuuaauugugguaauauacacauagcguaaaauuuuccaucuuaacugucuuuaagugugcgguucagugguguuaaguauauuuacauuguuguacacccaaucuguagaacuuuuucaucuucccaaacugaaauucucuauacguuaaauaauaacuccucauuuacccuuucccuuagccccuggcaaccuccaugcuacuuuuagucccuauuaauuugacuauaaauaccucauauaauuggaauuaugcacuauuugccuuuuugugacuggcuuauuucauucagcauaauguccucaagguucaucuauguugcaguaugugucggaauucccuuccguguuuuuuuuucccccgagauggagucuugcucugucgcccaggcugaaguguaguggcucgaucucggcucaucgcaaccuccgcaucccggguucaagcaauucuccugccucagccucccgaguagcugggauuacaggcacccgcaaccacgcuuggcuaauuuuuguauucuuaguagagacgggguuucaccauguuagucaggcucuugaacucgaacucuugaccucgugauccaccugccucggccucccaaagugcugggauuacaggcgugagccaccaugccuggccaugaauucccuuccuuuuuaagguugaauaauacucccauguguguauauaucaccuuguuuauccauucaucugucgauggacauuuacauugcuuccacauuuuggcuuuugugaauaaugcugcuaugaacaugguacacgugaaguuuuguuuuucuuuuuaaaugaaucuucucauuuuuacguaauuguagauucacaugccauuguaagaaauaacacagagagauccugugaacuuuuuaaacccucaauaguaaaauauagaguaaaaaucuauauucuauaaauauaguacaaugucacacccaggguauugacaaugauacaugcaagauagagaacaggugcuucaccagaaggauaccuccuguuaccuaauguccacacucauuucuuuccuacccucacccucucuucagccucuggcaaccacugaucuguuuuucagcucugugaugucauuucauuucaagaauguuauauaaauggauucauauaauauguaaccuuuggggauuggcuguuuucauucagcguaauucuauggagcuucauucagguuguugcguguuacuauuccauugcuuuucguugcugaguaguauuccaucacauggaaguccaacaguucguuuaaccauucacugguugaggacuauccggguuguuuuggggucauuauuguauaaagcugcuguaaauauuugugugcagguuuuuauauacacaucagucuucauuucucugggauaaaugcccagguaugcaaucguugguaaguacaaaaguugguaaguuuuguaagaaaguacucuuaucugauguuaauauagcuuuucuucuuucuuuugauuaauaauugcauaauauauuuauuccauccuuuuacagucaaccugcuuauauuauuauaucugaaguaaguuacuuuuagauaguauauauguguuguuuuauuuuguuugaggcggagucucacucugucacccaggcuggagugcaguggcgcgaucucagcucacuggagcccccaucuccuggguucaagcaguucucuugccucagcuucccgaguagcugagacuacaggcgcgcaccaccaggcccggcucauuuuuguauuuuuaguagagacaggguuucaccauguuggccaggcuggucuugaacuucugaccucacgugauccaccugcuucguccuccaaaagugcugggauuaccggugugagccacugcacccggccuagauaguauauauuuggauaauguuuucuaaucuacucugccaguuacuguguuuugauugauguauguagaccauuuguauuuaaugucauuaccgacauguuagggcuuaaguuugucuuucuguuuuucuggcucuguuucuguuucucuguuuccuuuuuccuauuuuucuguguguuacuugaacauguagaauuccauuucgauuuaccuagugugguguugaguguauguauauuuuuguauagcuuuuuuagugguuauucuaaguauuacauuauauauacauaacuuaucuacugaguaucauuuuaucaguuugagugaaguguagaagcuuauuuccuuuguucgggcaccguggcuugugccuauaaucccagcacuuugagaggccaaggugggaggauugcuugagcccaggaguuugagaccagccugggcaacauagcgaaaccuugucucuacaaauaauaauucuaaaaaaauuagcugggaaugguggugugcuccuauagugccagcuacuugggaagcugaggcagaaggauugccugagcccaggggguugaggcugcauaguaagcugugauugcaucacugcacuccagccugggugacagagugagaccccaucagaaaagaaaaagaaagaaauauaauauaccuccuuuuacauacccucauccuucuuccccauuauaaugcaguuguuuaaauauuuccucuacauacauuuagaaccgcaucauagaguguuguaauuugugcuucaacugucaaacauuauucagaaaacucaaaaggaaaaagaaaaccuauuuauuacccauauuguggcuuacuguuuucuuucuucuuauguuccaagguuccugcuuuuuguuuagaguguuucuuuagccauucuuuuaagauagaucugcuggugauagacuuacauauuuuuuccucaucuuaguaggucuucauuuccccaucauuccugaaggauguuuucaccagaugaaagauucacacuugacaguuuucuuucagcacuugaaaaauauuauguuacuuccuucuggccuccauggcuuuugaugagaaaucugcugucauucaaaaacuuuuucccuguaaggaagguauuauuuuacucuggcuaccuuuaagauuuuuuucuuccuuugccuucaguuuucagaaguuaaauuaugcugugucuuguuauggauuucuuuagauuaaccuguuuagaguuugcucagcuucuuacauuucuagguuuaugucucuuuccaagcuugggaauucuuaagcuagauuuuucuaguacuuuuuuagucccucucucuuucuccucuccagacugcuaaggauacagguuuuagaucucuuguuagaaacuguguaauuuauaaagguaccugagacuguucauuuuuuuucagccuguauucucucuguuguucagauggaauaacuuuauuuuuccgucuucaaguugacugagucuuucuucuguccccuccucagcugagccuauucacugagcuucuuauuucauauugugguuuguacuguucacauuuccaguuaguuauuuucuguaucuucaguuucuuugcugagacuuucugugucuuuacagacacuuucuauuuuuucguuuguuuggagugugcuuauaauuguucauugaagcauuuuaugacagcuucuuugucagauaguucuaacguaucugucaccugaggguuggcaucuguuggugguuaucuuuauucauucaguuucagaucuugguauagugagugauuuucugccugcauauuuuuauaugaugagacucuggaccuuaacuucgguguggcugguuuuguuugguugugcaguguuguuuuugacauagcuccagcaagagaagggcaggugggccaccacuuguuauuaccuggugagagaacgucagguuuccuccuggaucuccgcgggcaucaaaguggggaugcuccucauacacccgagugggaguggaguuccagcucccuacauggucuccacugguggcggggggggggcuuguucuuagcuagcagggauggaggucccagcuccgcauuuggccuucucugagaccaccccagcagggguguuagggcaccucauugcaccuggugaggguggaagucuaggcuccccagucauucucugcugguguugguaagaaggggccacaguuuucuuaugugguauuaaguggaguagagcaguuauuaccuguuuggcugggcugccccuguccagguccuguggcuuuuguuggagcuuuuuuuggucugugcccauggguauuucuugguagcuggcuccuucggcuucaagucaggggaauaugugguagaaagaaaaaccagugaacuuagcacauacuguuccaaggucccuggccauucugccacccucucuccaccuuucagagucuccugugcucauuuuauaugcaauguccaggguuuucauucuacuuaguugggaagcauuagaaaaaucuccucugaagauuuaaucuuaaauagacauguuuaucuaucuugcccaucccuucucgugaaaaauuaacaaaauguaggaagugaaaagauaccacucauccccagucaugugagaagauucugcauggucuagugaacuuccuucuggacuuuucucugccaauuuauuugugugccucacaaauaaaucgaucacaaauaaaaggaucccgcuguagaucaauguccuguuuuuaugcuccuccccagcauguaagcauugguccauaugguucuaaaagcucccuggggauccugcuaaguggccgugucagauucuggaggugacuggagcacugucuguccacccaccuggcccuuggacuuggguuugcuucugugaugccuugacugucuagucaguuuucugucacuuguaacagaauaccugaaacuguaauuuauaaaaaaaauaauugacuucucauauuuauggaggcugagaagauucggguugaggggcuccaucuggugagagcguucgugcuggugggggcucuguggugucccgaggugggugcagggcgucacauggcgaggggcugaguguccugacgcgcuugcuccggucucucuuccucugcuuacaaagccaccaguuccacucccaugacaaccuauucaucaccucguaaaggccacaccuuucaauacugccacaugggggaucaaguuuccagcaccugaaauuugagggccacauucaaaguauagcaaguagauccucaaacaccuaaccaaggcucaaaggaaaaagcauccaaaucuguuguuaauauauacucucaguuuuucccucgggacccccacugcgcgcgcucacacacacacacacacacacgcgcacgcgcgcgcacacacacacaccccucccaggaagucgugcacacacacacacacacacacacacacacacacacaccccucucccaggaagucgugucagagugaugaauucuuuuguauuuuuugucacuggggcaauuaccauuuuuuccccauuuaagaaaccaacaucaaguugacucccacagguccuuguaaugaaauccaguggcuucccgaggccuguuuuggauucuguggaacagccugggaagacaggcuuuuccacacugaccucuuccgagcagcagauccacuuaggggcucauucagauacagccucugaggcuccaccccgaccuacugagucagaguuuuuacuaagaugccugugauucauauguacaggcaagaguccuuguuccaaaacccugacucaaauuuagaauuuuugagguauucucuuucuuuuuauuuuaaacuuuuucuuuggaauuaauuuuaaaguuagggaagauggcaagaacaguacagagacuuccaaauacccuuuccuucacuuuccccguucucccucucucuuccuuacccacucccacccccucauucuauuuuuccccaaaucuucaguuagaugcagacguuugugcccccuuauucaugccaaaggagcguauuuccuaaacacaaggacaaucucuuaaccacaauacaguuaucacauugaggaaauuucacauuaaaacaauaaugauccagcaucguugcuucuuauuuaguugucccaucucuuaacacuuccuccuuggguucucaauguuugucaugcuguggcuaguuuugaagaguggaauaucgugauaggugauacagcuuccuucccucaggugggguuagacucacaguggcacucaggccacgcauuuugcaggagaaccacacugggcugugcacuccccaugcagcacaucuggaggcauugaaggugggguguccugcaugggucacgucagcugugaucacugggauacauauguacaauugacgcauaauuauuccauagguguuuuuuuuuuauauuaacaucuuuuacuuuucaccaacaugauuccuuuaagugcccucugcccucuauauuuuugcuuuuuuuaaaaaaaaaaaaaaaaaaaaaagacuagucaaggcugggcuugguggcucacacccauaauccuaccacuuugggaggccaaggugguugaaucacuugagcucaggagcucaagaccggccuggcaacauggugaaacuccaucucuacuaaaaauaccaaaaaaaaaguagcuggucaugguagugaaugccuagagucccagcuacuuagggggcugaggcccaaaaaucauuugaaccugggaagcagcgguugccgugagccaagauugcaccacugaacuucagccugggcgacagagcaaaaaccgaucucaaaaaaaagagaaagaaagaaaaucacuccuucccagccguguccugggugccuggccccaacacccggggaaaccaucugacaguaacugauaguuuuccagagagguaggcagaugcaaagcauguuuuaaaaauuauucuguuccuuuuuugcuugucacauagauacuaguaauauaaaaguccuuugaguuacuuuucuuuuuuccacaaaaauuuuauuuugugguccuuuccaauuauauaaaggacugcuuuauuuuccugguuuccuaguauuauauggauauaccaucauuuuaaauugaaauuuuaaaaugaaaauuuuaaaaugaagcauugaucuaauaaauacugaaaaccuugacacacaucaacaagacaguggauuaaguaaugaaaauuaggccaggcaccauggcucauacugguaaucccagcccuaugggaggcugaggugggagaacugcuugagcccaagcauuugagaccagcuugaguaacauagcaagaccucaucuuuacaaaaauaaaaaauuagccaggcgugguggcucacuccuguagucccagcuacuugggaggcugagcaggaggauugcuugagccccaaagguugaggcugcagugagcugugguugugccacugcacuccagccggggugacagagugagacccugucuaaaacaauauaaagauaaaaauagaaauuaaaaucagguuuuugacacauucccaugguccaugauucaaaguuuaugaaaaaaaucucccuguuacaccuaaccccagagucccaggaaccucuugagaagcagcuaaccuucggaacuccuagacgcccugcacuugguggccauccggauuccaucaugcacagguguuuuccugcaacaacacacuuugaagagaauuccuucucaguacagagaggccgucauucuuucugugcguguaggaucaucccuugugagguuucuguagcuuacuuaauccgcugucuucuugaugugugucaagguuuucaguauuuauuagaucaaugcuucagugaagcagcuuuuguagacuacguugcacaugugcaacauaaacuugagaaaucccugcacggaagggugggcauguugguaacgugcaacaacauaaacuuuaggaaucucugcauugaggggcgagcacgcuggugaccucuggacauugcccagcagcgcaccauaggagugguggaugugcagccuccccagcacugaggaggaagaccuguuucuccacauccuuggccacccagccagguagcugccauguggauuuugccaaacaagauagggaugagguggauccaagagcagaaauaacaaagcaguguguccacuggcgccuggaccugggguagucggucuccuuucugucucuucuaucugcauguguugcuuugggcucuucccucagccccagcuuccacaccaccccccuccccuagugcuauggucugaauguuuuuguguuccccuccccacagcuuugacauguugaaaugcuagcccccaagcugcuggcauuaagagguggggcacuggggagaugaucagguuauaagggcaaauccaucauaaauggauuagugcccuucuaaaagaggccucagagagcagccuugccccuuccaccaugugagaacacaaugaaaugaugaccaucuauggagcaaggaacugggcccucaccagaacccaacuaugcugguaucagcuggggacuuccuagccuccagaacuguaagacauacauuuauguuguuuaugaguccccagucugcgguauuuuguuagagcagcccaaauggauuaagacagaaaauuggcaccgaacauuuugggugcuacucuaacaaauacaacguggaagaagcuugggaaccggguaauggguagaggcuagaagaguuuugaagugcaggcuagaaaaagccuguguugccaugaacagacaauuuuuucuuuuucuuuuucuuuuuuuuuuuuuuuugagauggaguccugcucugucacccaggcaggagugcaguggugcgaucucugcucacugcaaccucagccuccugaguagcggagauuacagaugugcaccaccacaccuggcuaauuuuuguauuuuuaguagagacaggguuuugcuauuuuggcuagcuaggcuggucuggaacuccugaccucaggugaucugccagccucagccucccagagugcugggauuacaagugugagccaccgugcccagcccaugaacagacuauuacgggugauuucuagugaggcuccaaaagaaaagaggagauuugaaauccucaaccagaauguugguaaaaaugugaacaguaaagcuauucuuaugaggucccagauggaaaugagaaacguguggugggcaauggaggaaaggccauccuucuuauaguggcaaaucacuuggcugaacugugcuuauguauuaguguuuuguggaagguagaacuuacgggccacugcaauuggauauuuggcugcagaaauaucuaagcaagguuuugaaggugcagcuugugaaaugugaaaagagagaagugauuuaaagaugggauuguuacuuaaaagggaagcagaacuuaaagaucgggaauauuugucagccuauguugguaagagugagccagccuguuuaggagagaagauaaagguuuugccauugaaacugaggcuaggagcuaguccaagaaaauggaaaaaugaccccaaaggcaauucagaaaucaucagggcucuucugcccaucacaggcccagagcgcaagacccgcagcaagcaggggaccacagcagagagccccgcuucagucaccccugaagcccuagaugguggggccaucagcgaaguuccagcccaagagagccuugggcuucugaaagagacagagcugccacagagguggggccacugcagagaaccaccucaagggcaggcccucaccaggggcugccauggggcgggaccacccagggccuuggggacucaacuccugcccagugaagcugccaccuguggguuuggaaggcggggucaccucccaacacagugggccuggggagcacagcaucaagacaaaaaggauuauucugcagauuauucucaagccguaaaccauaaugugcugugacccauagguucaggacuugcuggggaccuguuacuccuuuucuuuuuuucuguuucccuuuuuuggaacuggaauguuuauccugugcccgucucaccacuauauaugugugugugugugugugugugugugugugugucucuguguguguguuuuguuuuuuuuuuuuuaagacugagucucacccuguugcccaggguggagugcaguggcaugaucucagcucacugcagacuccgccugccggguucaaaugauucuccugccucagccucccaaguagcugggauuauaggugcucaccaccacgccuggcugcuuuuuguauuuuugguagagaugagguuuaaccguauuggccaggcuggucucaaacuccugaccucagguaaucugccugccucggccucccaaggugcugggauuacaggugugagccacugcgccggccucaccacuauuuggaaggcacauaacuuguuucauuucacagguucacagcuggagagaauuuugugucagguagaauugugccuugaguuucaaccguaacugauuuagaugauauuuaaaugagauguuggacuccggacuuuugaguugaugcuggaaugaauuaagacuuugaggguuauugggauagaaugaauuuguuuggcaugugaaaaggauaugaauuugggggaaccaggggcagaaugcuaugguuucaguguuuauaucuccccaaaauuuguguugaaauuguaauccccaagaugaugguauuaggaaguggagacuuuuggggagaugaucugguaacaagggcaaaguccucaugagugggauuagucccuccuaaaagaggccccagagaacucccuugcccucuccaucauguaaggacacagaagacaccugucuuuugaccaagaagugggcccucaccaggcacccagccugcuggcaccuugaucuuggacguccagccuccagaacugugaggaacagauuucuguuguauagaaacugcccguccuacagcguuguguugucacagccucaguggacuaagacugagacaccuagcucgucccggacugaggcaucccuguucuccugugcuuucagagucggguuucuccauucaaggacaugauuuuaugcuucucugaagaggauuggucccuucuagauccugcccagacuggcuucuauggagaguucaucauuggggaggauuacggggucucaaugccuccaaguaagacuuaacuuccccccacaccucaagaccagggaacugggcaggggaguucucacuuggaguaagagucaacuucgucccauaggaucagggaagcggggccugcaucagaucucucuguucacccccaaccuggacaggaggucauuugcacacagcggcccuacaggcaguguguccgauugaccaucaccugcugucucgccacaucaggcuuaucagaaccaaauagaacaugugcuguauguccauuucucuuccaucguucuuaccguuuugucccuuuaugucugcuuuacacccgaaagccucagagagacccccaagcccauagcucucccugcgugugcugcccccacugccccugcacugccagcucuggccuuuucacuucucgccccugauggugccaugcccgcugggcaucccuccgccuucucucuucuggaccagcccugguugcugcaggaucagauuacuaauaaacauguacccugccuuuuucuuugaacagacgaccuagcugcccagccagaucucucccagggagaggagaaugagccacgcguuccagaguugcaggaucuccagggcaaagaagugccccaggucuccuacuugggugaguaaugauuccagaacugaguggacagaguagggggaaggguugcuggcagccggaggugagcccacucucuggcuucucucugcggccccuaauugccuucuucauuuccccagacucuaugugggucuugcaugucuugccuugucccugacuuuucauagaaagaauggaggaucuuaauuuugccaggcauuggaauuguacucccuuggccaaggacugggaaauaauaggaaugucuuucuccucugccuguaaguaacaucugguuugugcugacaaugcagcagccccuccaggagugaagucagauacucaugacaagccuaguugcagagggagugucuccuaacugggcaccgagcgcagcccuuugaggugccucaccugucuagucuucccaucugccugguacaggggugcugugaggacacugggguguggggaggugcuggggcucagcagcagcaguuuccagcccuccuucaggcugugucgccagcacuugcacccaugaucuccaugccauggugcuucgaagcaucugcuccuucaggaggaaauagcuuuguacagaaucaucagcagcuccacaccuucuuccccuuugggaccuagagcuggcaugaagcagacaagguuuugacacaccauccccaccuggaacaagcguucagagacuugguguggugcaguagcuccuguaccaucucuacccuguaggcucugcacaagcuguuugugcaggaugugcggagugugcaggagccuguggugaugacuauagaaaacccaccacagaaagugggaauaaauauggggcugggggaagugcuugucucuggccauagaguggguggaguagaacccggaucuacgucgauucugucuagcgucagagcucauguuuguggaguuggcccauuuugccuucagguucauucacucagcagacacuuauugaguggccacccccugccaguccccaggacggagcccagggccgcccccagaucguagccuggcaucuauucggauagcacccucccagguagugcuguaggugcaaaacaaaucaauuuuuccauuuccuccucuggaaagacucuccaagucuccagccauuccagguagaagaaagaaggaaacgugaggagcugcaggugccagaguuccaggccugcccacagacgguggugccucaaaacaccuacccagguaaagaagggucagggagguauggguuugucccugugugucuguggugugucgcaugaauguauguaugcauguguggcauaggggaugguuguguugaaugcaugugugcgugcauacacaugugguauauguggugugcugcaugugugagugugugcauucaugggugcaccuguguguugggggcaugugggugugugauguaaaugugcgguggugauggcaugggacaguuaggaacugaaccccucaggauccccgccgaccucugcugugguguucuuagcugcuugcccugauuccguugugcuggggucauucuccagcucacucccaaucccaggcucacccuccuugccuuucccaggggccggggagggugugucaaagcagggugcugcuguagugcuguuggugaugcagugaguguuuuucuucucucagcauggauggccagcauccuggcacagaaucuuggaacugggauuaaagagcagguuucuggcauacugaagcugcacaggacucuuggaaaguguauguuccauuccugcuuucagagaaauagccacaguguagacucugagucgucuugguaaaagucaccacuuccagaagcagaggcuacaauacugccaucuuucucuucucaauacaaaacccaagccucugauucuuaccugaacccacgugucauuguaguuuucugcagcuauggagaccaacucacacauauuaucucuucuaccugugaugcuuuugaaggcaagauuuaugccauuuugacccagcuccaugcaucuuguacuuggcccccuuucaugcauggacaaaggggcuuuucuagugugggagaucugaaaggaugagauccugcuccacaagcauggaugcccaccccugguuuucuaagaagcccaccucugcgugccaagagugaugcauucauuugggguccacuuggaguucaagcgcaggccugauguuuguggugcacuuugaaucuucucuagcuucuuucugcccauagcaugucucucagccccaucaauauacuuuuagaagauggauggauguucauuuauacacaggaguuuucaacuccauucuucccuugcuggacucugacacagacugcucugaaacagccagaagccaaggguugcuacugagaaaggggagagacgauauauuucaaagagugggcacuguacuuauuuugguagcuccugccagcuugccuuccuaaaaggcuuuucccgccagcugaugccggauagcuggugauaaggucugcuucucuauauccaugcccacgcaggacacucccagauguucaguuugugccaaucaaauaaugcuacuacauccgccacugagguggaauaucuuuucuuguuuauuguguucuaugaauugccuaguuaguauucauuuauccuuauuuauuuauuuuugcacucauacuuguuuucuuuauguccuaaacauugcaccaggauucagugauuuacaugaugacaugauucugugcauuguaucuucauggcaccuucugagauagguggcaugaugucucuguauugcagcuggggcacccgagagcugaagucacuugcccagaguccagugcucacaagcuguaggugguggagugaagauuugaacucaggcugggcgcagugguucaugccuguaaucucagcacuuugggaggccgaggcgggcagaucgccugagguuaggaguucaagaccagccuggccaacauggcgaaaccugucucuacuaaaaauacaaaaauuagccaggcacaguggcagacaccuguagucucagcuacuggggaggcucaggcaggagaaucgcuugaaccugggaggucaaggcugcagaaaucaugacacugcacuccagucuggacaacagagcgagagucugucuccaaaaaaaaaaagaaaaagaaaaaaaaaacggccaggugcaguggcucacgccuguaaucccagcacauugagaggcugaggcaggcagaucgcugaggucaggaguucaagaccagccuggccaauauggcgaaaccccaucuccacuaaaaaauauaaaaauuaaccaggcgugguggugggcaccuauaaucccagcugcuugggaggcugaggcagagagaauugcuugaacucaggagguagagguugcagugagccaagaucacgccacugcgcuccagccugggacacggagcaagacuccaucuuaaaaaaaaaaaaaaagauuugaacucaggcugucaggcuucagacccauggcuuuuacucuacauuaccaaaccacgguuugcuuuuucuguggauucauagaaacugccaucuuucauagguucuucuaaauaccaaauccaagucucugauucuuaccugaacccacgugucguuguaguuuugggucugaaucccuugccucugcuguauucauacauaguuucuuccauuucccucaacuuuguuuaugugucuugcagcauauaaauguuuuguuuuguuuuguuuuguuuuuuaaagauggggucucuuuauguugccuagacuggucuugaagucuugggcucaagcagccuuucugcuuuggcuucccaaauagcuggggagacuacaggcgugugccaucaugccuggcuuaaauguuuucuuacaguuuuuaacuguagguacacuuauucgucaucuuuuugguuuuaugccuugcuugagaaagcuuccccauucuaacuuuacaagaauauuuuacaguuuuuaauaaugccuuuaucauuuugguuuuucacauccagcuuccuagucuccccugcuguuccccuuaauccccucagcucgcaggaagucauucauuccuggccagagcauccuuccugaggcgauagucauggaguuaccugcacgcugcaugccuuugccacuccgccugcaacaagcacuugcagcagccuggcugccugcuagcuauguggccacgagcccuggucccaucuccacuggcucaauuccccugaaaccuugggcaauuucacuuuucugccuuacauuuuuuauuuggaaaacagaaauaauaguuaaagcugccuuguacaguuauugcuaaggauuaaaugguuuaaugcauauacuggcaguuagaccaauagcucuuuucuuuuuuuucagacggagucuagcucugucacccagguuagagaacaguggcgcgaucuuggcuuacugcaaccucugccucccguguuccagcaauuuuccugccucggccucccaccauaugugggagcccacccacccauaugucgucauguucacuuaauuacaucuugaaagagccuaucuucaaauacagucacauucugagguccuuaggguuaggacuucaacaugaaauuuugggacaacacaauucauccccuguaagaccucacccucaggaccuucaaaauucaugucuuucccacaugcacaauccauucaccucaucccaacagcccccaaauucucaaccuguuucagcaucaacuguaaguccaaaaucucaucuaaauaucaacaucucaaaucagguauggguuagacuugaaguaugauucauccugaggcaaaacccucuccagcuaugaacugugaaaccagauguuuuuugcuuccaaaauacaacugugagaaaagcauagcauagaccauucucauuccaaaauagagaaauccaagagaagaaaggguaaugggucccaagcaagucuuaaaucuagcaggucagggcuaggugugguguggcucgugccuauaaucccagcacuuugggaggccgaggcaggcggaucaccugaggucaguaguucgagacugcacuggcaaaaauggggaaacccucucucuacuaaaaauacaaaaauuagccagacgugguggcacacaccuguaaucccagcuacucaggaggcugaggcaggagaauugcuugaacccaggaggcagagguugcagugagccaagaucaugccauugcacuccagccugggcagcaagagcgaaaccccaucucaaaaaaaaaaaaaaaaaaucuagcaggucauuuccaugggauuuuaaggcucagcaauaaccucuggcucaguucucuguucuccaggcccagcaggcuacuggcccugcucuuuggaacucagaaggaaaugacuucaccuccugagccuguacucucuggucccaugaugacaguggcaguccuguaaccucugagccaccuuuggagucauucuucccuuuucuugaaggauaguacauauucauagccagauagaucuaucggccaguuuguagaaucccagaaguccuagccuucuuuuauuucaucccaucucuuuuccuuucaguuccagcuggcaguguuucugcugguauauaauacucagaaacccugcccuccaugcaguccacaggguugcaggccgucagacgaggguguccuccauagaccuuccuggauaaccucaucucuguuccuggcuucuguugagaugguugauuggauccgugaaucauacccagaaucucuuuaacaaaugaugagccagccacacucuuggugucucuccagugcacgcuuucuuauuuuuugccguauggauagacagaauuuuccaaaucuugaagucaugguuccuuuuugcuacaacaauuccuucuucaguuuaucucucucaucucacguuucacuauaagcggcaaaaaacuagucuuugccuuugacacuuugcuucgauaccuccucagcucaguauccgaguuccuuacuuacaauuucuguuuccacagaacaguugaauaugguuuggccaaauucuuugccacuuuauaauuggaggaucuccuuuucuccaauuuccuauaacguccguauuucuaccagccacuuccucaaggcuuuuuaaacaugcacuucagaacucuccuggccucuccccaugaccuaguucuaaaaucacuucgacaguuuuuggucuuuguuuuagcugcacccuacuuccuggugccaaagucuauguuagucuacuguggcuaccauaacaagguaccacaggcugggugacuuaaacaacagaaacuuacuuucuuacaauuccagaagcaacaaguccagaaucaaggcuucagcagagcuggugucuuccaaggccuuucucgucuuggagacggcucccaucuugcuguguccucacaggguccuucccucuguugaagucugccuccagucuccuccucuuagaagaccagugauuuuggauuggccccaccaucugacuucauuuugacuuaauuacuucuugaaagacccuaucuccaaguaaucacauucugaggcucuauggguuagggcuucaucauguaaauuuucagggggacacaauuucgcccauaacaugcacugucugcucucauaauuccaucuccucgcccaguuaacaaguaagagaucuuagcgguccaccuugucacuuuguuuucuucuuccacccaaguccauuaacagaagucaacugcugaucaaguaccuugucaucggcagccugguaaaaguuacaccuugcucuugucuccaccccaugagguccacaaaguacaucauacacaugaccucaccugccccaccagcagcuuagagcaacgggcugccacugucauucucaccuuguagacgagaugacccaagcucagagaagcugucuggcuggaacgagguuccugcagcucgaaaaccaagagucgagauaagcgucaaacauagccucucggcgggcgcaguggcucacaccuguaaucccagcacuuugggaggcugaggcagguggaucaccugagauggguggcucgcuugagcccaggaguuugagaccagccugggcaacauaaugugaccccaucuguacaaaaaauuaaaaacacaugcacacacacaaacacaaucucugucuucaucugaugauuucccuccuauacuacguggguucuuggcagacucaguacccacucccagacucauguucccccgacccccuugugacugagggacaaaugcccccuccgcuuccaccauugcccuuuaucucucugcucuccauagccucugugucuuccugcccugcuucuguuuguccaacuucuccuguccugagcugcucugacuagccagggcucuccuccccacagucaugaagcccagacuaaccauguuccuacucuuaucugggagggccugguucacuccccccaaguucuagauuugaguucuacauuucacagcagugaggaaacaggccaccuguauggugggcucugcuccauaagccgggaccucaggccgggcucugcacuguccacccagccccgccccgugguuccaccuucccaacaucacagacucaggaugcaggaaguccagagcagcuuuauccaucaccaccuguggccucagaaaugcggugcuacugggagccggggagcugugggggacccaggacucugggcagucugggacuguugagcagccuagcaaggcugaguagcauuucagcccuccuuccuggcacagaucaccuuaguuuauguguaaacauggcaaccaauaggucaucggguugcguccaggagcaaauaggaaugugcaugucaagucuagcacagucccuggagcaugcaagugcccagcacaugauauguguagguuguagagucuuccucucucaaguccuuucacuauccugauagagcuuucccccaugccuuguuaagugcaugaucuguaaauggucaaggcuuuacccagauaaauacagacuccuagagcuuggggggaugggguggucuccguggguagagaacaaaaggguuggggguggagauaagggaaaauggcugggaagagggagagcaaggugcccagcaugcucuggacacagcggggcccaugcugaagauuucuuccucacaggcuacaccaguggccccugcagggcuggccaggccgccccggucaccgaggaccauuguaaaaacacggguuuguaaacuccaagcugaguguuccuccgccgcggucauaggggcugggauguggccugugcagcgucgcugaccugcauguugccuuccuguagcuggcggcaacccgcgaucucuagagaacagccuggaugaagaagugaccaucgagaucguucucuccagcucuggggacgaggacucccagcauggcccguacugcacagaagagcuggggagccccacagagaagcagcgcagccuccccgccucccaccggagcagcaccgaggccggaggcgaggugcagaccuccaagaaguccuacguguguccgaacugugggaaaaucuuccgcuggagggucaacuucauccggcaucugcggagccgcagggagcaggagaagccgcacgagugcucggugugcggggagcuguucagcgacagcgaggaccuggaugggcaccuagagagccacgaggcccagaagccuuaccgguguggugccugcgggaagagcuuccgccugaacucccaccugcucucccaccggcggauacaccugcagccggacagacuccagccgguggagaagagagagcaggcggcauccgaggacgcggacaagggucccaaagagccgcuggaaaacggcaaggccaaacugagcuuccagugcugugagugugggaaggccuuccagcggcacgaccaccuggcucggcaccgcagccacuuucaccugaaggacaaagcccggcccuuccagugccgguacugcgucaagagcuucacgcagaacuaugaccuccuccgccacgagcgccugcacaugaagcgccguuccaagcaggcucugaacuccuacugagccucuccgccuggggcggccucacccuggcuggugcugcccccucaccuugguacugaucagcgcccccacccaggacauaccuuccccaggauagagagcacaccucccuccuguccuugcucucagguagugagcguucggguggugccaugggagcacucucccucccccagguaaugaaagaguggccaaguga

SEQ ID NO: 192243 - RNA, 31424 nt, Homo sapiens
ucacuuggccacucuuucauuaccugggggagggagagugcucccauggcaccacccgaacgcucacuaccugagagcaaggacaggagggaggugugcucucuauccuggggaagguauguccugggugggggcgcugaucaguaccaaggugagggggcagcaccagccagggugaggccgccccaggcggagaggcucaguaggaguucagagccugcuuggaacggcgcuucaugugcaggcgcucguggcggaggaggucauaguucugcgugaagcucuugacgcaguaccggcacuggaagggccgggcuuuguccuucaggugaaaguggcugcggugccgagccagguggucgugccgcuggaaggccuucccacacucacagcacuggaagcucaguuuggccuugccguuuuccagcggcucuuugggacccuuguccgcguccucggaugccgccugcucucucuucuccaccggcuggagucuguccggcugcagguguauccgccggugggagagcaggugggaguucaggcggaagcucuucccgcaggcaccacaccgguaaggcuucugggccucguggcucucuaggugcccauccagguccucgcugucgcugaacagcuccccgcacaccgagcacucgugcggcuucuccugcucccugcggcuccgcagaugccggaugaaguugacccuccagcggaagauuuucccacaguucggacacacguaggacuucuuggaggucugcaccucgccuccggccucggugcugcuccggugggaggcggggaggcugcgcugcuucucuguggggcuccccagcucuucugugcaguacgggccaugcugggaguccucguccccagagcuggagagaacgaucucgauggucacuucuucauccaggcuguucucuagagaucgcggguugccgccagcuacaggaaggcaacaugcaggucagcgacgcugcacaggccacaucccagccccuaugaccgcggcggaggaacacucagcuuggaguuuacaaacccguguuuuuacaaugguccucggugaccggggcggccuggccagcccugcaggggccacugguguagccugugaggaagaaaucuucagcaugggccccgcuguguccagagcaugcugggcaccuugcucucccucuucccagccauuuucccuuaucuccacccccaacccuuuuguucucuacccacggagaccaccccauccccccaagcucuaggagucuguauuuaucuggguaaagccuugaccauuuacagaucaugcacuuaacaaggcaugggggaaagcucuaucaggauagugaaaggacuugagagaggaagacucuacaaccuacacauaucaugugcugggcacuugcaugcuccagggacugugcuagacuugacaugcacauuccuauuugcuccuggacgcaacccgaugaccuauugguugccauguuuacacauaaacuaaggugaucugugccaggaaggagggcugaaaugcuacucagccuugcuaggcugcucaacagucccagacugcccagaguccugggucccccacagcuccccggcucccaguagcaccgcauuucugaggccacagguggugauggauaaagcugcucuggacuuccugcauccugagucugugauguugggaagguggaaccacggggcggggcuggguggacagugcagagcccggccugaggucccggcuuauggagcagagcccaccauacagguggccuguuuccucacugcugugaaauguagaacucaaaucuagaacuuggggggagugaaccaggcccucccagauaagaguaggaacaugguuagucugggcuucaugacuguggggaggagagcccuggcuagucagagcagcucaggacaggagaaguuggacaaacagaagcagggcaggaagacacagaggcuauggagagcagagagauaaagggcaaugguggaagcggagggggcauuugucccucagucacaagggggucgggggaacaugagucugggaguggguacugagucugccaagaacccacguaguauaggagggaaaucaucagaugaagacagagauuguguuugugugugugcauguguuuuuaauuuuuuguacagauggggucacauuauguugcccaggcuggucucaaacuccugggcucaagcgagccacccaucucaggugauccaccugccucagccucccaaagugcugggauuacaggugugagccacugcgcccgccgagaggcuauguuugacgcuuaucucgacucuugguuuucgagcugcaggaaccucguuccagccagacagcuucucugagcuugggucaucucgucuacaaggugagaaugacaguggcagcccguugcucuaagcugcugguggggcaggugaggucauguguaugauguacuuuguggaccucaugggguggagacaagagcaagguguaacuuuuaccaggcugccgaugacaagguacuugaucagcaguugacuucuguuaauggacuuggguggaagaagaaaacaaagugacaagguggaccgcuaagaucucuuacuuguuaacugggcgaggagauggaauuaugagagcagacagugcauguuaugggcgaaauugugucccccugaaaauuuacaugaugaagcccuaacccauagagccucagaaugugauuacuuggagauagggucuuucaagaaguaauuaagucaaaaugaagucagaugguggggccaauccaaaaucacuggucuucuaagaggaggagacuggaggcagacuucaacagagggaaggacccugugaggacacagcaagaugggagccgucuccaagacgagaaaggccuuggaagacaccagcucugcugaagccuugauucuggacuuguugcuucuggaauuguaagaaaguaaguuucuguuguuuaagucacccagccugugguaccuuguuaugguagccacaguagacuaacauagacuuuggcaccaggaaguagggugcagcuaaaacaaagaccaaaaacugucgaagugauuuuagaacuaggucauggggagaggccaggagaguucugaagugcauguuuaaaaagccuugaggaaguggcugguagaaauacggacguuauaggaaauuggagaaaaggagauccuccaauuauaaaguggcaaagaauuuggccaaaccauauucaacuguucuguggaaacagaaauuguaaguaaggaacucggauacugagcugaggagguaucgaagcaaagugucaaaggcaaagacuaguuuuuugccgcuuauagugaaacgugagaugagagagauaaacugaagaaggaauuguuguagcaaaaaggaaccaugacuucaagauuuggaaaauucugucuauccauacggcaaaaaauaagaaagcgugcacuggagagacaccaagaguguggcuggcucaucauuuguuaaagagauucuggguaugauucacggauccaaucaaccaucucaacagaagccaggaacagagaugagguuauccaggaaggucuauggaggacacccucgucugacggccugcaacccuguggacugcauggagggcaggguuucugaguauuauauaccagcagaaacacugccagcuggaacugaaaggaaaagagaugggaugaaauaaaagaaggcuaggacuucugggauucuacaaacuggccgauagaucuaucuggcuaugaauauguacuauccuucaagaaaagggaagaaugacuccaaagguggcucagagguuacaggacugccacugucaucaugggaccagagaguacaggcucaggaggugaagucauuuccuucugaguuccaaagagcagggccaguagccugcugggccuggagaacagagaacugagccagagguuauugcugagccuuaaaaucccauggaaaugaccugcuagauuuuuuuuuuuuuuuuuugagaugggguuucgcucuugcugcccaggcuggagugcaauggcaugaucuuggcucacugcaaccucugccuccuggguucaagcaauucuccugccucagccuccugaguagcugggauuacaggugugugccaccacgucuggcuaauuuuuguauuuuuaguagagagaggguuuccccauuuuugccagugcagucucgaacuacugaccucaggugauccgccugccucggccucccaaagugcugggauuauaggcacgagccacaccacaccuagcccugaccugcuagauuuaagacuugcuugggacccauuacccuuucuucucuuggauuucucuauuuuggaaugagaauggucuaugcuaugcuuuucucacaguuguauuuuggaagcaaaaaacaucugguuucacaguucauagcuggagaggguuuugccucaggaugaaucauacuucaagucuaacccauaccugauuugagauguugauauuuagaugagauuuuggacuuacaguugaugcugaaacagguugagaauuugggggcuguugggaugaggugaauggauugugcaugugggaaagacaugaauuuugaagguccugagggugaggucuuacaggggaugaauuguguugucccaaaauuucauguugaaguccuaacccuaaggaccucagaaugugacuguauuugaagauaggcucuuucaagauguaauuaagugaacaugacgacauaugggugggugggcucccacauauggugggaggccgaggcaggaaaauugcuggaacacgggaggcagagguugcaguaagccaagaucgcgccacuguucucuaaccugggugacagagcuagacuccgucugaaaaaaaagaaaagagcuauuggucuaacugccaguauaugcauuaaaccauuuaauccuuagcaauaacuguacaaggcagcuuuaacuauuauuucuguuuuccaaauaaaaaauguaaggcagaaaagugaaauugcccaagguuucaggggaauugagccaguggagaugggaccagggcucguggccacauagcuagcaggcagccaggcugcugcaagugcuuguugcaggcggaguggcaaaggcaugcagcgugcagguaacuccaugacuaucgccucaggaaggaugcucuggccaggaaugaaugacuuccugcgagcugaggggauuaaggggaacagcaggggagacuaggaagcuggaugugaaaaaccaaaaugauaaaggcauuauuaaaaacuguaaaauauucuuguaaaguuagaauggggaagcuuucucaagcaaggcauaaaaccaaaaagaugacgaauaaguguaccuacaguuaaaaacuguaagaaaacauuuaagccaggcaugauggcacacgccuguagucuccccagcuauuugggaagccaaagcagaaaggcugcuugagcccaagacuucaagaccagucuaggcaacauaaagagaccccaucuuuaaaaaacaaaacaaaacaaaacaaaacauuuauaugcugcaagacacauaaacaaaguugagggaaauggaagaaacuauguaugaauacagcagaggcaagggauucagacccaaaacuacaacgacacguggguucagguaagaaucagagacuuggauuugguauuuagaagaaccuaugaaagauggcaguuucuaugaauccacagaaaaagcaaaccgugguuugguaauguagaguaaaagccaugggucugaagccugacagccugaguucaaaucuuuuuuuuuuuuuuuaagauggagucuugcuccgugucccaggcuggagcgcaguggcgugaucuuggcucacugcaaccucuaccuccugaguucaagcaauucucucugccucagccucccaagcagcugggauuauaggugcccaccaccacgccugguuaauuuuuauauuuuuuaguggagaugggguuucgccauauuggccaggcuggucuugaacuccugaccucagcgaucugccugccucagccucucaaugugcugggauuacaggcgugagccacugcaccuggccguuuuuuuuuucuuuuucuuuuuuuuuuuggagacagacucucgcucuguuguccagacuggagugcagugucaugauuucugcagccuugaccucccagguucaagcgauucuccugccugagccuccccaguagcugagacuacaggugucugccacugugccuggcuaauuuuuguauuuuuaguagagacagguuucgccauguuggccaggcuggucuugaacuccuaaccucaggcgaucugcccgccucggccucccaaagugcugagauuacaggcaugaaccacugcgcccagccugaguucaaaucuucacuccaccaccuacagcuugugagcacuggacucugggcaagugacuucagcucucgggugccccagcugcaauacagagacaucaugccaccuaucucagaaggugccaugaagauacaaugcacagaaucaugucaucauguaaaucacugaauccuggugcaauguuuaggacauaaagaaaacaaguaugagugcaaaaauaaauaaauaaggauaaaugaauacuaacuaggcaauucauagaacacaauaaacaagaaaagauauuccaccucaguggcggauguaguagcauuauuugauuggcacaaacugaacaucugggaguguccugcgugggcauggauauagagaagcagaccuuaucaccagcuauccggcaucagcuggcgggaaaagccuuuuaggaaggcaagcuggcaggagcuaccaaaauaaguacagugcccacucuuugaaauauaucgucucuccccuuucucaguagcaacccuuggcuucuggcuguuucagagcagucugugucagaguccagcaagggaagaauggaguugaaaacuccuguguauaaaugaacauccauccaucuucuaaaaguauauugauggggcugagagacaugcuaugggcagaaagaagcuagagaagauucaaagugcaccacaaacaucaggccugcgcuugaacuccaaguggaccccaaaugaaugcaucacucuuggcacgcagaggugggcuucuuagaaaaccaggggugggcauccaugcuuguggagcaggaucucauccuuucagaucucccacacuagaaaagccccuuuguccaugcaugaaagggggccaaguacaagaugcauggagcugggucaaaauggcauaaaucuugccuucaaaagcaucacagguagaagagauaauaugugugaguuggucuccauagcugcagaaaacuacaaugacacguggguucagguaagaaucagaggcuuggguuuuguauugagaagagaaagauggcaguauuguagccucugcuucuggaaguggugacuuuuaccaagacgacucagagucuacacuguggcuauuucucugaaagcaggaauggaacauacacuuuccaagaguccugugcagcuucaguaugccagaaaccugcucuuuaaucccaguuccaagauucugugccaggaugcuggccauccaugcugagagaagaaaaacacucacugcaucaccaacagcacuacagcagcacccugcuuugacacacccuccccggccccugggaaaggcaaggagggugagccugggauugggagugagcuggagaaugaccccagcacaacggaaucagggcaagcagcuaagaacaccacagcagaggucggcggggauccugagggguucaguuccuaacugucccaugccaucaccaccgcacauuuacaucacacacccacaugcccccaacacacaggugcacccaugaaugcacacacucacacaugcagcacaccacauauaccacauguguaugcacgcacacaugcauucaacacaaccauccccuaugccacacaugcauacauacauucaugcgacacaccacagacacacagggacaaacccauaccucccugacccuucuuuaccuggguagguguuuugaggcaccaccgucugugggcaggccuggaacucuggcaccugcagcuccucacguuuccuucuuucuucuaccuggaauggcuggagacuuggagagucuuuccagaggaggaaauggaaaaauugauuuguuuugcaccuacagcacuaccugggagggugcuauccgaauagaugccaggcuacgaucugggggcggcccugggcuccguccuggggacuggcaggggguggccacucaauaagugucugcugagugaaugaaccugaaggcaaaaugggccaacuccacaaacaugagcucugacgcuagacagaaucgacguagauccggguucuacuccacccacucuauggccagagacaagcacuucccccagccccauauuuauucccacuuucugugguggguuuucuauagucaucaccacaggcuccugcacacuccgcacauccugcacaaacagcuugugcagagccuacaggguagagaugguacaggagcuacugcaccacaccaagucucugaacgcuuguuccagguggggauggugugucaaaaccuugucugcuucaugccagcucuaggucccaaaggggaagaagguguggagcugcugaugauucuguacaaagcuauuuccuccugaaggagcagaugcuucgaagcaccauggcauggagaucaugggugcaagugcuggcgacacagccugaaggagggcuggaaacugcugcugcugagccccagcaccuccccacaccccaguguccucacagcaccccuguaccaggcagaugggaagacuagacaggugaggcaccucaaagggcugcgcucggugcccaguuaggagacacucccucugcaacuaggcuugucaugaguaucugacuucacuccuggaggggcugcugcauugucagcacaaaccagauguuacuuacaggcagaggagaaagacauuccuauuauuucccaguccuuggccaagggaguacaauuccaaugccuggcaaaauuaagauccuccauucuuucuaugaaaagucagggacaaggcaagacaugcaagacccacauagagucuggggaaaugaagaaggcaauuaggggccgcagagagaagccagagagugggcucaccuccggcugccagcaacccuucccccuacucuguccacucaguucuggaaucauuacucacccaaguaggagaccuggggcacuucuuugcccuggagauccugcaacucuggaacgcguggcucauucuccucucccugggagagaucuggcugggcagcuaggucgucuguucaaagaaaaaggcaggguacauguuuauuaguaaucugauccugcagcaaccagggcugguccagaagagagaaggcggagggaugcccagcgggcauggcaccaucaggggcgagaagugaaaaggccagagcuggcagugcaggggcagugggggcagcacacgcagggagagcuaugggcuugggggucucucugaggcuuucggguguaaagcagacauaaagggacaaaacgguaagaacgauggaagagaaauggacauacagcacauguucuauuugguucugauaagccugauguggcgagacagcaggugauggucaaucggacacacugccuguagggccgcugugugcaaaugaccuccuguccagguugggggugaacagagagaucugaugcaggccccgcuucccugauccuaugggacgaaguugacucuuacuccaagugagaacuccccugcccaguucccuggucuugagguguggggggaaguuaagucuuacuuggaggcauugagaccccguaauccuccccaaugaugaacucuccauagaagccagucugggcaggaucuagaagggaccaauccucuucagagaagcauaaaaucauguccuugaauggagaaacccgacucugaaagcacaggagaacagggaugccucaguccgggacgagcuaggugucucagucuuaguccacugaggcugugacaacacaacgcuguaggacgggcaguuucuauacaacagaaaucuguuccucacaguucuggaggcuggacguccaagaucaaggugccagcaggcugggugccuggugagggcccacuucuuggucaaaagacaggugucuucuguguccuuacaugauggagagggcaagggaguucucuggggccucuuuuaggagggacuaaucccacucaugaggacuuugcccuuguuaccagaucaucuccccaaaagucuccacuuccuaauaccaucaucuuggggauuacaauuucaacacaaauuuuggggagauauaaacacugaaaccauagcauucugccccugguucccccaaauucauauccuuuucacaugccaaacaaauucauucuaucccaauaacccucaaagucuuaauucauuccagcaucaacucaaaaguccggaguccaacaucucauuuaaauaucaucuaaaucaguuacgguugaaacucaaggcacaauucuaccugacacaaaauucucuccagcugugaaccugugaaaugaaacaaguuaugugccuuccaaauaguggugaggccggcgcaguggcucacaccuguaaucccagcaccuugggaggccgaggcaggcagauuaccugaggucaggaguuugagaccagccuggccaauacgguuaaaccucaucucuaccaaaaauacaaaaagcagccaggcgugguggugagcaccuauaaucccagcuacuugggaggcugaggcaggagaaucauuugaacccggcaggcggagucugcagugagcugagaucaugccacugcacuccacccugggcaacagggugagacucagucuuaaaaaaaaaaaaacaaaacacacacacagagacacacacacacacacacacacacacacacacauauauaguggugagacgggcacaggauaaacauuccaguuccaaaaaagggaaacagaaaaaaagaaaaggaguaacagguccccagcaaguccugaaccuaugggucacagcacauuaugguuuacggcuugagaauaaucugcagaauaauccuuuuugucuugaugcugugcuccccaggcccacuguguugggaggugaccccgccuuccaaacccacagguggcagcuucacugggcaggaguugaguccccaaggcccuggguggucccgccccauggcagccccuggugagggccugcccuugaggugguucucugcaguggccccaccucuguggcagcucugucucuuucagaagcccaaggcucucuugggcuggaacuucgcugauggccccaccaucuagggcuucaggggugacugaagcggggcucucugcugugguccccugcuugcugcgggucuugcgcucugggccugugaugggcagaagagcccugaugauuucugaauugccuuuggggucauuuuuccauuuucuuggacuagcuccuagccucaguuucaauggcaaaaccuuuaucuucucuccuaaacaggcuggcucacucuuaccaacauaggcugacaaauauucccgaucuuuaaguucugcuucccuuuuaaguaacaaucccaucuuuaaaucacuucucucuuuucacauuucacaagcugcaccuucaaaaccuugcuuagauauuucugcagccaaauauccaauugcaguggcccguaaguucuaccuuccacaaaacacuaauacauaagcacaguucagccaagugauuugccacuauaagaaggauggccuuuccuccauugcccaccacacguuucucauuuccaucugggaccucauaagaauagcuuuacuguucacauuuuuaccaacauucugguugaggauuucaaaucuccucuuuucuuuuggagccucacuagaaaucacccguaauagucuguucaugggcugggcacgguggcucacacuuguaaucccagcacucugggaggcugaggcuggcagaucaccugaggucaggaguuccagaccagccuagcuagccaaaauagcaaaacccugucucuacuaaaaauacaaaaauuagccaggugugguggugcacaucuguaaucuccgcuacucaggaggcugagguugcagugagcagagaucgcaccacugcacuccugccugggugacagagcaggacuccaucucaaaaaaaaaaaaaaaagaaaaagaaaaagaaaaaauugucuguucauggcaacacaggcuuuuucuagccugcacuucaaaacucuucuagccucuacccauuacccgguucccaagcuucuuccacguuguauuuguuagaguagcacccaaaauguucggugccaauuuucugucuuaauccauuugggcugcucuaacaaaauaccgcagacuggggacucauaaacaacauaaauguaugucuuacaguucuggaggcuaggaaguccccagcugauaccagcauaguuggguucuggugagggcccaguuccuugcuccauagauggucaucauuucauuguguucucacaugguggaaggggcaaggcugcucucugaggccucuuuuagaagggcacuaauccauuuaugauggauuugcccuuauaaccugaucaucuccccagugccccaccucuuaaugccagcagcuugggggcuagcauuucaacaugucaaagcuguggggaggggaacacaaaaacauucagaccauagcacuaggggaggggggugguguggaagcuggggcugagggaagagcccaaagcaacacaugcagauagaagagacagaaaggagaccgacuaccccagguccaggcgccaguggacacacugcuuuguuauuucugcucuuggauccaccucaucccuaucuuguuuggcaaaauccacauggcagcuaccuggcuggguggccaaggauguggagaaacaggucuuccuccucagugcuggggaggcugcacauccaccacuccuauggugcgcugcugggcaauguccagaggucaccagcgugcucgccccucaaugcagagauuccuaaaguuuauguuguugcacguuaccaacaugcccacccuuccgugcagggauuucucaaguuuauguugcacaugugcaacguagucuacaaaagcugcuucacugaagcauugaucuaauaaauacugaaaaccuugacacacaucaagaagacagcggauuaaguaagcuacagaaaccucacaagggaugauccuacacgcacagaaagaaugacggccucucuguacugagaaggaauucucuucaaaguguguuguugcaggaaaacaccugugcaugauggaauccggauggccaccaagugcagggcgucuaggaguuccgaagguuagcugcuucucaagagguuccugggacucugggguuagguguaacagggagauuuuuuucauaaacuuugaaucauggaccaugggaaugugucaaaaaccugauuuuaauuucuauuuuuaucuuuauauuguuuuagacagggucucacucugucaccccggcuggagugcaguggcacaaccacagcucacugcagccucaaccuuuggggcucaagcaauccuccugcucagccucccaaguagcugggacuacaggagugagccaccacgccuggcuaauuuuuuauuuuuguaaagaugaggucuugcuauguuacucaagcuggucucaaaugcuugggcucaagcaguucucccaccucagccucccauagggcugggauuaccaguaugagccauggugccuggccuaauuuucauuacuuaauccacugucuuguugaugugugucaagguuuucaguauuuauuagaucaaugcuucauuuuaaaauuuucauuuuaaaauuucaauuuaaaaugaugguauauccauauaauacuaggaaaccaggaaaauaaagcaguccuuuauauaauuggaaaggaccacaaaauaaaauuuuuguggaaaaaagaaaaguaacucaaaggacuuuuauauuacuaguaucuaugugacaagcaaaaaaggaacagaauaauuuuuaaaacaugcuuugcaucugccuaccucucuggaaaacuaucaguuacugucagaugguuuccccggguguuggggccaggcacccaggacacggcugggaaggagugauuuucuuucuuucucuuuuuuuugagaucgguuuuugcucugucgcccaggcugaaguucaguggugcaaucuuggcucacggcaaccgcugcuucccagguucaaaugauuuuugggccucagcccccuaaguagcugggacucuaggcauucacuaccaugaccagcuacuuuuuuuuugguauuuuuaguagagauggaguuucaccauguugccaggccggucuugagcuccugagcucaagugauucaaccaccuuggccucccaaagugguaggauuaugggugugagccaccaagcccagccuugacuagucuuuuuuuuuuuuuuuuuuuuuuaaaaaaagcaaaaauauagagggcagagggcacuuaaaggaaucauguuggugaaaaguaaaagauguuaauauaaaaaaaaaacaccuauggaauaauuaugcgucaauuguacauauguaucccagugaucacagcugacgugacccaugcaggacaccccaccuucaaugccuccagaugugcugcauggggagugcacagcccagugugguucuccugcaaaaugcguggccugagugccacugugagucuaaccccaccugagggaaggaagcuguaucaccuaucacgauauuccacucuucaaaacuagccacagcaugacaaacauugagaacccaaggaggaaguguuaagagaugggacaacuaaauaagaagcaacgaugcuggaucauuauuguuuuaaugugaaauuuccucaaugugauaacuguauugugguuaagagauuguccuuguguuuaggaaauacgcuccuuuggcaugaauaagggggcacaaacgucugcaucuaacugaagauuuggggaaaaauagaaugagggggugggaguggguaaggaagagagagggagaacggggaaagugaaggaaaggguauuuggaagucucuguacuguucuugccaucuucccuaacuuuaaaauuaauuccaaagaaaaaguuuaaaauaaaaagaaagagaauaccucaaaaauucuaaauuugagucaggguuuuggaacaaggacucuugccuguacauaugaaucacaggcaucuuaguaaaaacucugacucaguaggucgggguggagccucagaggcuguaucugaaugagccccuaaguggaucugcugcucggaagaggucaguguggaaaagccugucuucccaggcuguuccacagaauccaaaacaggccucgggaagccacuggauuucauuacaaggaccugugggagucaacuugauguugguuucuuaaauggggaaaaaaugguaauugccccagugacaaaaaauacaaaagaauucaucacucugacacgacuuccugggagaggggugugugugugugugugugugugugugugugugugugcacgacuuccugggaggggugugugugugugcgcgcgcgugcgcgugugugugugugugugugugagcgcgcgcagugggggucccgagggaaaaacugagaguauauauuaacaacagauuuggaugcuuuuuccuuugagccuugguuagguguuugaggaucuacuugcuauacuuugaauguggcccucaaauuucaggugcuggaaacuugaucccccauguggcaguauugaaagguguggccuuuacgaggugaugaauagguugucaugggaguggaacugguggcuuuguaagcagaggaagagagaccggagcaagcgcgucaggacacucagccccucgccaugugacgcccugcacccaccucgggacaccacagagcccccaccagcacgaacgcucucaccagauggagccccucaacccgaaucuucucagccuccauaaauaugagaagucaauuauuuuuuuuauaaauuacaguuucagguauucuguuacaagugacagaaaacugacuagacagucaaggcaucacagaagcaaacccaaguccaagggccagguggguggacagacagugcuccagucaccuccagaaucugacacggccacuuagcaggauccccagggagcuuuuagaaccauauggaccaaugcuuacaugcuggggaggagcauaaaaacaggacauugaucuacagcgggauccuuuuauuugugaucgauuuauuugugaggcacacaaauaaauuggcagagaaaaguccagaaggaaguucacuagaccaugcagaaucuucucacaugacuggggaugagugguaucuuuucacuuccuacauuuuguuaauuuuucacgagaagggaugggcaagauagauaaacaugucuauuuaagauuaaaucuucagaggagauuuuucuaaugcuucccaacuaaguagaaugaaaacccuggacauugcauauaaaaugagcacaggagacucugaaagguggagagaggguggcagaauggccagggaccuuggaacaguaugugcuaaguucacugguuuuucuuucuaccacauauuccccugacuugaagccgaaggagccagcuaccaagaaauacccaugggcacagaccaaaaaaagcuccaacaaaagccacaggaccuggacaggggcagcccagccaaacagguaauaacugcucuacuccacuuaauaccacauaagaaaacuguggccccuucuuaccaacaccagcagagaaugacuggggagccuagacuuccacccucaccaggugcaaugaggugcccuaacaccccugcugggguggucucagagaaggccaaaugcggagcugggaccuccaucccugcuagcuaagaacaagccccccccccgccaccaguggagaccauguagggagcuggaacuccacucccacucggguguaugaggagcauccccacuuugaugcccgcggagauccaggaggaaaccugacguucucucaccagguaauaacaagugguggcccaccugcccuucucuugcuggagcuaugucaaaaacaacacugcacaaccaaacaaaaccagccacaccgaaguuaagguccagagucucaucauauaaaaauaugcaggcagaaaaucacucacuauaccaagaucugaaacugaaugaauaaagauaaccaccaacagaugccaacccucaggugacagauacguuagaacuaucugacaaagaagcugucauaaaaugcuucaaugaacaauuauaagcacacuccaaacaaacgaaaaaauagaaagugucuguaaagacacagaaagucucagcaaagaaacugaagauacagaaaauaacuaacuggaaaugugaacaguacaaaccacaauaugaaauaagaagcucagugaauaggcucagcugaggaggggacagaagaaagacucagucaacuugaagacggaaaaauaaaguuauuccaucugaacaacagagagaauacaggcugaaaaaaaaugaacagucucagguaccuuuauaaauuacacaguuucuaacaagagaucuaaaaccuguauccuuagcagucuggagaggagaaagagagagggacuaaaaaaguacuagaaaaaucuagcuuaagaauucccaagcuuggaaagagacauaaaccuagaaauguaagaagcugagcaaacucuaaacagguuaaucuaaagaaauccauaacaagacacagcauaauuuaacuucugaaaacugaaggcaaaggaagaaaaaaaucuuaaagguagccagaguaaaauaauaccuuccuuacagggaaaaaguuuuugaaugacagcagauuucucaucaaaagccauggaggccagaaggaaguaacauaauauuuuucaagugcugaaagaaaacugucaagugugaaucuuucaucuggugaaaacauccuucaggaaugauggggaaaugaagaccuacuaagaugaggaaaaaauauguaagucuaucaccagcagaucuaucuuaaaagaauggcuaaagaaacacucuaaacaaaaagcaggaaccuuggaacauaagaagaaagaaaacaguaagccacaauauggguaauaaauagguuuucuuuuuccuuuugaguuuucugaauaauguuugacaguugaagcacaaauuacaacacucuaugaugcgguucuaaauguauguagaggaaauauuuaaacaacugcauuauaauggggaagaaggaugaggguauguaaaaggagguauauuauauuucuuucuuuuucuuuucugauggggucucacucugucacccaggcuggagugcagugaugcaaucacagcuuacuaugcagccucaacccccugggcucaggcaauccuucugccucagcuucccaaguagcuggcacuauaggagcacaccaccauucccagcuaauuuuuuuagaauuauuauuuguagagacaagguuucgcuauguugcccaggcuggucucaaacuccugggcucaagcaauccucccaccuuggccucucaaagugcugggauuauaggcacaagccacggugcccgaacaaaggaaauaagcuucuacacuucacucaaacugauaaaaugauacucaguagauaaguuauguauauauaauguaauacuuagaauaaccacuaaaaaagcuauacaaaaauauacauacacucaacaccacacuagguaaaucgaaauggaauucuacauguucaaguaacacacagaaaaauaggaaaaaggaaacagagaaacagaaacagagccagaaaaacagaaagacaaacuuaagcccuaacaugucgguaaugacauuaaauacaaauggucuacauacaucaaucaaaacacaguaacuggcagaguagauuagaaaacauuauccaaauauauacuaucuaggccgggugcaguggcucacaccgguaaucccagcacuuuuggaggacgaagcagguggaucacgugaggucagaaguucaagaccagccuggccaacauggugaaacccugucucuacuaaaaauacaaaaaugagccgggccugguggugcgcgccuguagucucagcuacucgggaagcugaggcaagagaacugcuugaacccaggagaugggggcuccagugagcugagaucgcgccacugcacuccagccugggugacagagugagacuccgccucaaacaaaauaaaacaacacauauauacuaucuaaaaguaacuuacuucagauauaauaauauaagcagguugacuguaaaaggauggaauaaauauauuaugcaauuauuaaucaaaagaaagaagaaaagcuauauuaacaucagauaagaguacuuucuuacaaaacuuaccaacuuuuguacuuaccaacgauugcauaccugggcauuuaucccagagaaaugaagacugauguguauauaaaaaccugcacacaaauauuuacagcagcuuuauacaauaaugaccccaaaacaacccggauaguccucaaccagugaaugguuaaacgaacuguuggacuuccaugugauggaauacuacucagcaacgaaaagcaauggaauaguaacacgcaacaaccugaaugaagcuccauagaauuacgcugaaugaaaacagccaauccccaaagguuacauauuauaugaauccauuuauauaacauucuugaaaugaaaugacaucacagagcugaaaaacagaucagugguugccagaggcugaagagagggugaggguaggaaagaaaugaguguggacauuagguaacaggagguauccuucuggugaagcaccuguucucuaucuugcauguaucauugucaauacccugggugugacauuguacuauauuuauagaauauagauuuuuacucuauauuuuacuauugaggguuuaaaaaguucacaggaucucucuguguuauuucuuacaauggcaugugaaucuacaauuacguaaaaaugagaagauucauuuaaaaagaaaaacaaaacuucacguguaccauguucauagcagcauuauucacaaaagccaaaauguggaagcaauguaaauguccaucgacagaugaauggauaaacaaggugauauauacacacaugggaguauuauucaaccuuaaaaaggaagggaauucauggccaggcaugguggcucacgccuguaaucccagcacuuugggaggccgaggcagguggaucacgaggucaagaguucgaguucaagagccugacuaacauggugaaaccccgucucuacuaagaauacaaaaauuagccaagcgugguugcgggugccuguaaucccagcuacucgggaggcugaggcaggagaauugcuugaacccgggaugcggagguugcgaugagccgagaucgagccacuacacuucagccugggcgacagagcaagacuccaucucgggggaaaaaaaaacacggaagggaauuccgacacauacugcaacauagaugaaccuugaggacauuaugcugaaugaaauaagccagucacaaaaaggcaaauagugcauaauuccaauuauaugagguauuuauagucaaauuaauagggacuaaaaguagcauggagguugccaggggcuaagggaaaggguaaaugaggaguuauuauuuaacguauagagaauuucaguuugggaagaugaaaaaguucuacagauuggguguacaacaauguaaauauacuuaacaccacugaaccgcacacuuaaagacaguuaagauggaaaauuuuacgcuauguguauauuaccacaauuaaaaacagaaauuaaaaaacacuuauaaacaacaucuucaugauggugacuuuuagugcacugggaagaaacuaucacugggaagaaacuaucagaguaauacaacaguacugacuuaucaaaaucucuguacugugcucgcuauggcauuuacuagggacugcaggaauugaaagaugaagaccaaaccucauuagguacuggauuaacagcauccccuuauguguuauacugguuaaauguccaaauuuuaauaagaaauacugguuuuaccuccuuuguguuuggaaauggucacaguacacagcagaugcugacauguauguguugagcaucaggguaaacaggcgugugccacauuucugguggggcaaaagcaaguuauggagaugcccccuaacuggguaaccuggcuaacuccuucccaucccuagcccucccuucuccaaguuuaaagucauguuggcugggcacaguggcucaugccuguaaucccagcacuuugggaggcugagacaggaggaucacuugaggucaggaguuugagaccagccugggcaacauggcgagacccugucucuacaaggaaauacaaaacuuagcuggguguaguggcaugcaccuguagucccagcugcucaggagaccgaggugggaggauggcuugagcucaggaguuugaggcugcagugaacuacgacugugccacugcauugaagccugggugacaaggcaagacccugucucuaaaaauaaaaauaaaauaaagucaugucaaaugaacugugcagaaagcaaacugcucagcuuccgacauucugcugagacaugguaauaagagugucuacuguuuuucacaguuuucuguuggguaaggagcaacuaaacaaaagcaggagccacacauccuguucccaugggaggggaugaugcugucauaacuaaaucuugugccagccaguggaaaguguuaggagggaaagugaaggagauauggccagaaaacauggccaaagacagcaacugggcuagagagaggcgaguaagaucaccugcuggaccagcccccagcccugacucugacuccucagagcacccgaguaagcaagucuuacacaaaaacacgaacgagaacauucgaggaaauucuggaaugacucaccacguagaucugugacaggacugaaauuaucugugcuuucuucccuccacuuccuaacauuucuaaaauauaaccauugcugcgaugauuauuaaauugaaaaauucucuguaaaauaaaagagcagagagaucuccuuuuucacaagaggggaacuuagacaugcugagaggcccaucaauggggacucaugggccuuuguuuccugcuaucgucugcacaaagcuuccugaagguggccugaugacaguagacccagugggcggcugggaccacagggaaggaggagaaauggggcgucucuuaagcucacgcucugccuauuuuagcuuuucugggcugggacugaacauccuguguggcagucagaaagcuggcugggguccuaagaaagcugcccuguagccuacagaggcaaacaggggauuuucaaggacuccuguagaaaccacucaccggggguagcuggaggguggucaccugcugugugucccgcacauucucuuccugaagaaggaaagcaucuugcagaacugaaagagaucagaaaaugguguccuaaagugggccagggccaggccuggugcugauaccuucugagcuuccugcggcucuucauuuccauuuugguagcaaagaaaaucacaagagaggcaccaacagggaacuguuucauggugcuuuucauaaaaccccagucucuguucuuaacuguaaaaugaggauuacaaaaugacgcacaugaaaaguacucuguaaaccacaaagauugcugcgacuuuguuuccagauauaacaaggggggcuguaacagagugugccuggguucaugauagcacggucaauuaaaugaacucuuucaccucggguagguccccggaccucagcauuguuauccaaacuaugggaaaauaaagguuaaaacucuauggaguucagccguguguggugguacaugccuguaaucucagcuauucuuauuuuggggacugaggugggagaaucacuugagcccaggaguuccagaccagcagggacaacacagaguauuuguuucuuaaaaagaaaaagaaaaaaaaaaagaagaagaaaaagaaaaagccguagaguugaggaaucuauaaggacucuuagggucuggaugugguggcucaugccuguaauccuagcucuuugggaagccaaagugggaggauugcuuaagcucaggaguucaagaccagucugggcaacauagggagaccgcaucucuauuaaaaauaaaaaaacugggaagcugaaacagaaggauugcuugagccugagagauggaggcugcagugagccacagcugcaccacugcacuccagccugggugacagaacauggcucugucucaaaugaaaaaaaaaaaaaaaaaaaguaagggcuguuggcaaucagaauuacuguggaacuccauaaaaaaagaaggaaaauccugucauuuuugacgacaugaaugaaccugaaagacaugcuacgagcaauaagccagacacaaaaagaaauacugcauguucucacuuaaauguggacucuaaaaaaguugaacucauagaagcagagaucagaaugcugguuaccagaggcuagggaaugaggggacuggggagacauuggucaaaguguacaaaauuucagugacaugagaggaguaaacucaggaguccuauugcacaacauggugacuauaggcaguaacaacguacuguguacuugaaaauugcuaagaggguagaucugaaguauuuucaccacacacagaaaaaggauagguauaugagguaaugcauuauauuaauuagcuugacuuuuuuuuuuuuuaagagacuggucucacuagguugccuaggcuggaacagaacuccugagcucaagggauccucccaccucagccuccugaguagcugggacuacaggugugccaccaugcccagcuaaguagcuugguuuaaucauuucacaauguguauagauaucaaaacauuacacuguacacuguaaauacauacaauuuuuuuuugucaauuugaagacagaaauuaaacaaaaaagaaaaacuguuaccacuguagguacuccugaaagagcauuugacacaguguccuaaagacccucauacaaaauguaaaguguggcuuugggaccaucucaccagccuuauuuugggcuaccagggacucugccacucuucucuccuggaauuggaaacuacccuuuguucaggcuucugccaugagccacauccccugccaacagugcagccauguaaaaaugagcucuguuucaaaagguacuccuuucucagauuaagacuuggagagcugugcuauagucuacugguuaaccccaggucacauguuaagucauuaucaaagcaaaccccagaggccagugucccuggccuuucagaccuggaauacaaagccugcaggaaacagcagcugcaggaguggcuauguggaacaaaggacggggccaggagcccacacagauggcagugccauucuaggggucucaguggaaggcagccucuucacugugucugaaggggaagcucaggcuggaugggcguagauuugaggaggugguauuuuucuguguguauguuccauuuuaaguuucuaucuucaucuuuauuuaacuuacuuuuaccucccaguuuuauuaagcuauaauugacaaaaauuguauguauuuuguauacgaaaacuguacaaugugauaacuauacauugugaaaugauuaaauuaagcuaauuaacaaaucuauaccucauauauuuuugugacgagaacauuucuuauuuacuuucuuagcaauuuucaaguauaagaugcauuauuuuucaucaaccucaccaugcuguaccauagaucuccagaauuuauucaucuuaccuaacggaaacuuuguacucuuugaccgaugucucccagaggggguguuuuauuuuuuagagguggguucucgcuauguugcccaggcuggucucaaacuccuggccucaagcaauccuccugcuucagcccccugaguagcuggaacuauaggcaugagccaccaugccuggcuaggaggugguguuuuaguucugcuuccucacaccugccaccuucugggauauguagcuaucccagauauucauauauauaugaauggagaugcccccuaacuggguaaccuggcuaacuccuucccaucccuagcccucccuucuccaaguuuaaaaucauguuggccgggcacaguggcucacgccuguaaucccaacacuuugggaggcugagacauauguauauauauauauacacacgcauauauauauauacacacacacacacauauauacacacacacacacauauauacacacacauauauauacacacacauauauauacauacauauauauauauacacacauauauauauauauauaugaauauguagucccacccuacuuuuggccccgauaaaugaauacauggacccuuucaagaaucacuucggagaguugcagacccuacacaaaaucuagcuuuuggggaagaucuucaagaugaggaacuauacagcucugauagguagugcauuccaaugaugaacugucccaauaguuaagguuuuccugauugcuaacucucaucauaccuacuuugccuauugauuauugcucauggaaaugggagagcuggcccuguuuuccuaaagcccaucugugguugcuggcuuaucucagaacuuuaucaagaagcaacugcacaggcuacuguaguuccugaaacuucuuccucuccaccugcaugccuucccagaccccacuacaaggccucucacagccccccacuuccugcauaacccaagcuacuugcacgugcauuaugugggcgacuggcugcuucccuuauaccuguuguuacaggcuaaguuauggcccucucaaauuccuauguugaagcccuaacccuuagguaccucagaaugcgacugaguauuuggagauagggucuuuaaagaggucauuaagauaaaaucaggucauaugggugggcccuaauccaauaggacugguguacuuauaagaagaggagauuaagacacagacacacacaaaggaaagaccacauaaagagacccagagagagaaggugucuguuacaccugcucugcaaacuucucuuaguguaaacaucuuccucuuccuuucccugaaagaaaaccgcccgucaucaagaguccuggcacaaagcuuguugucagcuuucagggccggauauucauggguuuuuacgggucccaaagagagccaguggcauaagagacuuccccuccuagcuccuuuuuuuuuguuuuguuuugagauggaguuuuacuguuuuuacccaggcuggaaugcaauggcgugaucucagcucacugcaaucuccgccucccagguucaagugauucuccugccucagccucccgaaaagcuggaauuauaggcacccaccaccacacacaacuaauuuuguauuuuuaguagcgaugggguuucaccaucuuggccaggcuggucucgaacuccugaccucaggugauccgcccgccuuggccucccaaagugcugggauuacaggcgugagccaccgcgcccaaccccuagcuccuucuaaaugucuaucugcaaacuucucuuaguguuaacauuaggcaugucuacaagccaaggagagaggcuucagaagaacccaaggcugcugauacauugacuucagacuuccagccuccugaacugugagagaauacauuucuguuacauaaggcauccagucugugguacuuuguuauggcagccaacaacacaccaaacuugauuuauaagcaagaaaaggcugaagaguuuaugugauuuguacagaagucaauauaguuuuuccacacacagaaauuuaauaggcauuuugguuuuauuacugaaaagcuuaucauaaugccaaacacaacuucugcaagucauaagaaagucuccccuggccccccagacacucucuuuccauuguaccuauagagcacuauggcaaguccacccagagucauaagaaagccccccuggccccccagacacucucuuuccacuguacauauaaagcaccguggcaaguccacccagaggaacccacgggccagacuuccuucaacccaagggcgcugguuucccaugauauguacuuaaaguuuugggcaccucaggccuuguguucaaccuuuuguagguuguaucucauuuaauuguccaaaaaccccaaaaaagguaauuacuaucucugcuggacagaggaagaaacugaggcuuucagaguuuagaaacaugccucaggucauaaccagaagauucaaaucuaaguuuaucugaugaaaaaacuacuuuccuguagcuaccauguacuucauauacauacucaaacuauguguagcugauguucuggccccacacacuagacaccacccuguguccuccuaaguauuucuacaucucuucgcagcaucacaauacuccuguaaacaggaguuguuuagccaaggaaacagagguuccaagagacaagaaauggccaugcuccagucaugcagcaggccccagcuguacacuggcaguccccagcugucaucaaacugacaaauccugcagagaugcacccucgaagagaugagagggcaccaccucagugacacccaccuacagaagcguuagcucugagaggcucuagaaccaugaagaggacaaacauccugaugagguucucauuuaauugcucuaggaagggacucagacccugacaacagcucacagcaccucggggacacgagaacacugcugauguaaaagccaucagcuuaacaaaaaccacacccagugcacaguauggggugugcacuuccccagaucaccccugcuacacuccccugggcugcauaccuggguccccgcugagcuggcuugguggucugcuugggagccccaggcacugugccaggguuaugggcugggcauccugguucuuugcaaggucgcuguggggcucuaccggcagcugcuccugcuccugguccagagggcuguccccaucaucaaucaccacagggucuucacagugcuugagcugcaaucccagagacagcuuuucagggcuaggggaagaggucccaucucucccugggccuggugaccauccacuccacagcugaccaucaaaggcucaacuuaggccuuggacugggcuguaaaggggcacgacacuaucaugcccaaauuagagccuucagggaguaaaacuggcuuucuuaggaaacucuagucuggaccuaaccaaaguaaauggcucucgauggaacuccucauuccccagccagcacaugcauggcccagccaaagugucuaaguaccagaucucuacccgucccagccccaccucuucuacucacccacugccagggucucccgggcucccguuccagugccuccaccgcggccacagccugcucuccgcucucaggcuccugcgcccgcacccagcucuggaucucccggggcaggauggccaggaacugcuccagcaccagcagcuccagaaucugcuccuuggugugccucucaggccgcagccagcccccgcacaggucccagaggcgcugcagggccucccgggggcccgccgccuccugguagcggaaacggcggaagagacgccgagaggacucggggcugggaagcucccccugggggcuaggguucucuccaggugggcuccucauuuuccugggcuccucacuuuccuucggagccaagacucgggggcacagggcugugggcaugaugggauuugaugggggucagcagcagaagacgacccuauuuccaaacagaaaucacuggcuucaguguucuggucuccuguggucauuucugggggacagugacaaggaaacugucaaugcccucagagaccagcccuuuggagaagcccugggaaagguagggaguguugguguggcuggucuuuacacacaggaugaaacagacagaaagaugcccuccccccaucaguaccauuacguguggauucccguuaagugggugacuggaugaacaagacaggaaaucugggagaaagugguggcauuucaacgugacacugcuguuuugagcaucccaggaaaccaacagcgccacaugcagauguaaucaagacgcucugguaccuuggguggcuggguccuccuggagagauccgagaugggcaggccaagcaggccacuaucuugaagcuccggagccgaagucacuguucuuguuauuaagaccuuuacaaauggagcuggaaugacaaagacaugcaucggaugagccuucaagcacauccaggaauggaaaauccacccuucugguggcagagggcugauggugcugcgugcuggauggacaacccagccagaaucagcuuugcccagcagagucugcaaugggaggcaagggaaaacaucacaugagacagcuacaugcagucuaccagggacaaauaacacugcaucuagaaguaucagugguuuccuaugagccuucugccaauucugcccugaccuucaaccucgccuccacccuauucucuauccuugcccucuucaaaccacauugaaggcaacugcacacucgccaaagcccuuccucggccaggacagaaaaguggguccgucacugcacagcucagcccucaaagaaccccuggacacugcagcugccacacccccaaggugggacucaggggucccuacaccuccccgcuggugugcagacaacuagccgacacuuuugccacaacuaggguggcaagagaccagcaaccaguauaccugguguuuaugauucccacuuuagaacgcugggcccgugaaagggcacauggggacacucacaguccccuucucugccaucaggccucugugauccuuaggaccggcagugccugccacucccccaucugcacgagguuguccagcguggccgcgucuuaaccuccaacagcucacaaggugggaagggggacucgggccucacucccauuucacagaaagacaagugaugccagaaaagcuacggaacaacugagugguuccagaaacacccacugcucugaaucucuuugcuuuccaaaguaacaacauacacagaaacccauaugggggccguggcggcgucgggcuggacgcauuacagcgcuccccaccaccggaucgcuuccagggcggcuccggcaucuggagcccggggugggccccgcccgcccugcucggcggcccccugcggcgcccaucacacaccugcagcgcccaggacuacucaggcccgcccccccgagcaccggcgcccacccgggcugccacucggaucgucuccaaccagacggccgcguccgucuuugucacggcggcaccuggcgcgucggaggcucggaggagaugccugaugaaugaacuaacgugagugaggcggaggagggccccgcaggggcggagcgagcucccagccuuucgcggaggagggaccgagcuggaucggcagaaagggaaggagaaggucgcugugggccagggaagggggagcccgcccuccgcgcccucggucucccucacacgcgcgucucccgucucgccggcuccgggcuccucaccucacagccuggagcucccucccggcguccggccgaaaacccuccuguggcggcggaaguccagggcagccguccucauccucccagcccgcccggccgggcguacucgcugaggcggggucuccgcaggcgcccggcuccuuucccggcccguccagaccgcgucucccgaucauccggaaagccacggcucggcucgggggcaaauggaggcgccugaaaaacaaugguguugcuuucucccccgcccgcaccuuccugagcgcugggcucugggcugggaggcggcgccgcggaggccgggcgcgggcc

SEQ ID NO: 192244 - RNA, 149889 nt, Homo sapiens
gcggccgcgcugagccccuagcccgccgggagcgccaggccggccaggccugcgccgccgccgccgccgccgucgccgccgcgccgaccaugucggcagccaaggagaacccgugcaggaaauuccaggccaacaucuucaacaagagcaagugucagaacugcuucaagccccgcgagucgcaucugcucaacgacgaggaccugacgcaggugagcgacuggggccggcccggacaccuccguucugggagccgcgggucggcggccggggcgccgccaagggcugcagggaaaauaaaaauggagcagggaaaugcgcgaguccuggggcauggggacggggacgggaagugcauugacagagcugggacaaagggaaaauccucgaguaugccgaaaaauaacauccuuucccguucccauugcccggcugugugauucaugcuuuuugggugacucaaaagugccugguuucgcuuaguaggaacaaagcgcuuagggauugcaugccgcuugacgggaccccccugagauucuggcuugggacuggacuuggauuuguccagccagaguggcccaggggucggauuguuggggaggacugugggcuuccgucuagugggacgcagccugccccgauucugaaucaucgucacugucaagcacuggagagaggugaagggguguccaaaucuggcgaggagggucuuguucuugaacuuaguuuggcaggccguaguuuagcggggagcugggaccaguucccuggucacuggccgaggggugaggagaccuguggguccucgggaaaguugauuucugucucccagccuuaacugucaaacagggcuuugaacuaguuaugacucccaaacgugcauuagagucauagccauuaaacacagaguucuggggcccccgcccuggagugacuggggagauggggaauuuguauugaugaaaggcuccaagaggcuuggcugcagcccccauggcccuugggaaccccugcagugauugcuguuugaacuccuaguguuccaggauuccgagccuugugugcaccuccuugggaugugccucgguacccuccccacggccaucaucuccauccucuucagagcuuucucucagccuccugaaugaagccaggggaagucccuucacauuccaguccagugugaccuaguuguagccacuccugucgcagaagaaccccuuagacugaaaacgagugaacgggccugguuguuuuuaaugccacuucagugcacccaggguuugacuuguuuacauggccgacuggaguagggugguggggcagggguuacggccuggggcacggggccuuucucugaggucagguuuccaacugccaggaaaagauuccuuucaucuaaaccccaaaagcuuaacgaaacacucaaggcugcaaagucauagaugguuaagauaccaaggguuuuaaggacggucagcuugggacggauagaacucauuuaccucggaggguguuuuggaguguaaaggagaacuugauuccuucuucucaucuggaugcuuuuuuggaugaaacaguuuaugcgaugaggaguuguuaggagacuuugcuucaggucuuggcugucacuuccagcugugugaccuugaacaaaucccuuuacuucuguaucuuuuaauuuccuuaucuguaaauugggaauccuggucccuggcuuaccuccuucacugagcauuugugaaaagcaagaaaugauauuuuaugaaacuuuuuucucuuacaauuuaacaaaccaaaaaaaccugccacuuuaagaaguuucugggcaaggguuguucugagagagguuuguaaguuuccugguuauucuaagcaacugucaaaauugguaaauuuacaccucauaggggcuguuuucgaauucuuaagcuuagauaaacuaggauggaaucugcauguuugaguccaaucugcuaagauuuuuuuuaaucuguugauuauuaauuggauucacggggagaggcaaacuuaaaauacuguacucucacuguauucaaaguugaauuguggguuuugaaacaggccugagaccuucagggcacaacuggaaugguaguuucugaaauaaugagugggguuauuugugcugggagagguuagcccagcauucuaccuccugggaucuuucaggaagaaacugcucuugaaaagagaggagggagacucagggcuguugccaacagccuucucugcugcucucugcauccggcccucccucucacucucauccuuauggcuccauuagaaaaccucaaccaaucgguucccaucagucucccccaagccccugcuuccugcugccccucccagccuggagcuuauuuuagaccgucaaagcuggaagauacaucagccaccaucgaggccacucccuccuuaagaggagaggauacugggcccagggagguggugggcagccuuggccggcuuuugcucuggagaugucaucuucccaggagcagacauuucucugagccuuuugguuugagguuuauuuccucagcuguggguuuuguuuguuuguuuuuccccuagagaggcacagaaaccucuugcagggacuguauuauggcaucagaccuggaagggacuuggagaucagcuaauguaaccacuuccucuuaccggugagaagauugaaacccagagaagggaagugacuugcccaguucagggauggagccaggauucugaagccaauguuaguuccccuacuccuguucagggucuacaguggccacaccaugagcacaugaugaggacaauaaugucagggauaguuauguugcaggaggugccuugagaaugcuggcuuggagcaguggaguucuuugccuuuuccuccucacggaaauuuggaguaaucugggauaagugauaagugaccguccuuuauuacuuguuccaggccccuguucacagagugucauuuauccuccaguuuuccugugcauuucucagcgacauacggacccaaauauacaguuuuuuuuuuuuuuuugaggcggagucucgcucuguugcccaggcuggugugcaguggcgcgaucugagcucacugcaagcuacgccucccagguucaugccauucuucugccucagccucccgaguagcugggacuacaggcacccgccaccaugccuggcuaauuuuuuguauuuuuaguagagacgagguuucacuguguuagccaggauggucuugaucuccugaccucgugauccgccugccucggccucccaaagugccgggauuacaggcgugagucacugugcccagcucaaauauacaguuaaaccuuuuuauccugaacugugugcauguauuugcucugcgacauauuuuuuguuuucugcuuaucagcauaucuuuacguucuuuucaugguguugcauauaaagaugccagaaccauuuugcauauuaggccuuuaggaguguacuauaauuuaacccguuuccuuauugauagacaucaagguugcuuauggguuuugcuguuacauacagugaauguuucggcaaagagucuuauaaauacuucugggugugugugcgugcaugcaugaaugcaaguauuucucugggggcagauaccuauaaauagaauggcuggguugacaucaagcgcauaaauuuuuuuuuucagauaccacgaaauugccuuccaaaaaaggcugugugauaacauuuccaggacuggauauuaucaaaugauuuaauucucuaauaauuuuccuaauuacucaugaaguugagccuuuuuuauaguauuuacugaguauuuuuguuucuuuuguggauugccuguucguauugcuugcccauuuuucuguaagguuaguuuuucccccaguugauuuguaggagcuuucuauaagugcuuuaggucaggggucugcaaacuuuuuugguaaaaggccaaauaguaaauauaauuuagugucugugggcuauauggucucugucacaacugugcagacuuugccgucucaucacaaaggcagccguagacaacacauuaacgaaugaguucgaaugaguuacuguguuccaguaaaacuuuauuuaccggcagggcgcaguggcucaugccuguaaucccagcacuuagggaggcugagguggguggaugaucugaggucaggaguucaagaccagccuggccaacauggugaaacucugucucuacuaaaaauacaaaaacuagcugggugugguggcacaugccuguaaucccagcuacuccuugggaggcugaggcacgagaauugcuugaacccaggaggcagagguugcauugagccaagaucgugccacagcacugcagccugggcaacaaagugagacuccuucucaaaaaaguaauaauaauaauaaauuuaaaaaacuuuauuuacaaaaacaggcagcuggcaugauguguggccugugagccauaguuugcugacccugaacuagauauuaauccgaugcuugccacguauugcagguauuuuuucccagaaugccacuugucuuuuuugugugguuauuuuucuuuuucauaauauaaaugcaguuggucuuuuuuuuuaauaguuuguaguuuuaaugucauguuuaaggccuacuuuccaagauuuguaaaauaauuucucauauucuuuuauagcuauuuuuauacuuagcuuuuuaaucuaucagacuuguuuuuuaggaaaauaauucugguuaaaggcagaagaucuacuggaggcuauuaaacuggguaaauuacaaucaaggcauucucuccagaucagugcuggugaggauggaaggaaucagacucuagggacaggauguuguugguugaucagagguggguguugaggaaccugggguaguuagaaguaccuuuaacagagauugagaagaacagauuuggaguaaacuugggggauggggagggguaaaaaauaauaugguaaguuugacccuuauggacguagagggaggcuggguuggaauucuuaagucuuggauguggaggugguugcugaaaucaugggagugagugugagcacucaggaggcugcauagagugaaaggagaggaaccagccuaggaagcccccauguagugggcaggcaaaaggggagcaggugcagaggcugggaggugaaucagaggggugggcauuagugggagaagcaggucuggaacccagggugcucagcuucuacauccgcguguugaucugggggugaugucucuuucuccugcugacuguguaacuucaggcauugccucuguggaaggagccugcaagccuguuucuacuucuuugucuagcccuguuuuuuugugggaccuuggcugggucauuuucauugcucaggccuguuuucccaucuggaaaugagcucggucuugaucucucccaggguucuuagucuuccuggugugauucugcccuugcugugcccauaccccacugccaaggcuccaaagcugcgggggccucaggugggaauuucagacauagagggugugggccaggacgaggucucagggaagcauuucaucagguuucccuuuguuccuguagacauucguagaaguucuaaggcauaggacuuccugauuugacuuaauguguaucucagaaacaacggggagauuucgcaucccccccuuguagaagaucuguaacaggaguugguguguugcuuggcagggagcgugucaaaaaucucagacacacaaaaucccauuucagacggccaagcaccaugacaaaugcucagcguugucaucagcgaaacccaaauugaaaccacagugagauaucacuucauaccugucaggauggcuagaauuaaaaaaauaagaauauaacauguuggcgaggaugugaagaaguuauaacucuugcacguugcuggugggaaugaaaugguguagcugcuguggaaacaguuuggggguuucucaaaaaguucagcauaaaaccuaccacgugagccagcauucccacuucuagguauaugccaagaagaauugaggacagguguauucaaacagauacuuguauacaaauguucauaacagcacuacucacaauagccaaacggcagcaacaauccaaguguccauccacuaaugcguagauaagcaaaucauaguguauccauaccauggaauaucauucaguucuaagaaggagcgaaguacugagacaugccacaacauggacgaaccuagaaaacauugcgcuaagaggcagacaugaaaggucaugugucacauacugugugauuccauuuauguaaaauguccaaaacagguaaaucuguagaaacagaaagcagaucgguuguugccagagccugaggguugggugggcaauguggaaugacugcuaaugagacugggguucuauuuugggggugaugaaauguuuuggaacuagauaaaagugcugguugcacagccuugugaaauguacuaaaugccccugaauuguucacuuccaaaugcuucuugacuuaugaugggacuuaugguggggguacauccagguaaaacccaucagaccuaucacaaagucaaaauuauaagucagggacugucuguacaagaaucgcucucucacacacacacaccugccuucugcuccuugugucaccuggagugaauaucugauuguuucuagagucuagaccaaggcuuggcaauuuuuuuuauaaaggacucuucuuuuauccuggggaacuccuuccccaagccacucuuucccaccugaaugacacaguuggaccaggucggugguuuucaagcuuucaucaaaucccggagccuuuuacucaaaagaaaucuuguauauuuuagguuuugcaggccaacaggcaaaaucgaggagguuguguaggauauagccacuuaaaaauguaaaagccauucuugguuuuggggucuuagaaaagcagcuggugggccaauuuggcacaggggcacagugugccaccccucagaccagcccuguccucuagaacuguaauggaagccacauaggaaauuuuaaauuuuccagcggcuacguuaaaaaaguaaaaagaggggccgggugcaguggcucacgccuguaauuucagcacuuugggaggccgagacgggcggaucacgaggucaggagaucaagaccauccuggcuaacacagugaaacccgucucuacuaaaaauacaauaaauuagucggggccgggcacaguggcucacgccugcaaucccagcacuuugggaggccgaggcggguggaucacgaggucaggagaucgagaccacggugaaacccugucucuacuaaaaauacaaaaaauuaaucgggcgugguggugggcgccuguagucccagcuacucaggaggcugaggcaggagaauggugugaacccgggaggcggagcuugcagugagcugagauugcgccacugcacuccagccugggcaauagagugagacuccgucucaaaaaaaaaaaaaaaaaaaaagaggugaaauuaauuuuaauuauguuuuauuuaaccagauauauccaaaauacugucauuacaccaugcaaaaaaguuaugacgugcgcauuuuacguuacagcacauuucagcucagacgagccacuuucccacugcuuaguagccuggugguguggccgcugcccgcaguccugguggcagcccuggggugccacaggugguggugaguuuccuccgucccucccuugggccuuggguuggaagguuccuggagugcugcuucucugggacuuguuacuccuguuuguguccccacuccuccuuggcccuuggugucuauugccaacuuuugaaguuucuuucuuugacuaucacaucuuugauggcuucuuuugguguguuagaaguucucuucugggcucugauccccacucccugcccagaggcagaguuuaggggcagaagggaggaagguccuugccagggccucaggccuguccuguggggagccggugagggccguggugggcaggcuggcguaucccccucuaaacuggacgugcaauguuccaguauuauguaauugcacccuagcuuuuuucccuggguucuagccuguuaccugaucuuuuccucugauuucucuuucccuugccacacagaaggacuauaguccaaggccuauguucucuuccugacacaaaugugcagggugacccaggaaggugacuuaugucucccaccuguaaagcgggugccugccuucucuuugcagaguagugugcugauggaauggggaguuccugagccccccauguggugagggauguuccaggaagcacgcuggcugccgccucugggggaaguagccuuucuuugggcaaccucauguucuuuagcagaaauaaagaaauuuaacucagaauguuuaaauuguucccaagcugccacuuagucuugaaagagggagagaguguggcagcgaggcacaggggaagacauccuacuacuggacauggaggaucauugggugcuaauuuggaagcaucugaccuaagaaaacgggcucuucucuuauccugggaaacucauuccccaagccacucuuucucagcugaaugacaccguuggaccagguggaugguuuucaagcuuucaucaaaagcagugcagcucugggcaaggcagccaaagccuggagcuuggccucccauccuggggcgggguggcgggggagggccuugggucaucucuggggccauuuggggcagguucgaaaacucugcccuagauuuugugcuuuuuccaguuuuagcaauugaggcagucuuacagcugcucuggaauggagcccccaugcccuacccagagcucucaaggcauugucacuuccguugggggcaagagcaccuaggggguugauucacugacauuuugucucuggaagcuggaacugaaaucuuccaaaccacucacugguuuucucagucagggucauccuaguucacaugaaaccacagccugguuuuugccuggagccuguaacccuucuggcuccuuccccuugggcgcagcuuggcgguugcaugcugugccagagguggcccuggugucagagcugcuuugcagcgagacucugaguggaugggccugccggauccuuugaaccucuaccuacuauauugugucauagcccgugauuucacacagaccucagcaggcaaggguggccagcagggcugguggcagcaaggccucccucggaggaggggacccugaguuuucagagugguugagcggccugcccaaggucacugagcugcucagcaauggggccgugauacagauuucagcuccaugaggcucccgugccagaguccacccuggcuccagacuccacccuggcuccagacucauccucccuguccuugggaaggccacuuugcuuuguaaacuccuuaguguuuuuguuuggccccggggcagauggguaguagggagauugguauauugcagugcugcagaauaaaucacagcuguuuccuggacuucuaguuccuagcccugggaagagggaccugcuggggcugucugcaccugcccucccugccuuucccccacauuaugcaggugagggauugucuucaauuagcagauggagccgccgagaccuggagagguucagcagagguucagcgaccugccuaggucacaggaaguccagcacgauuuuuuccaaaguccuguuuggccaccuugucucuaauaaguguuaaccuuugcuaucaggaacagggccuugccccaacuuggacuccuuaguucuugagugugugguggggcgugugugugaacggugcaggcuguugugcagggcaucgcccagaucuucaccucuccucagccucggggugccccacauccccaacaugggcuacuggccuaggcagcagccacaccuuuggcacagcucugaacaggaagcacaauuuuuuccucugaaagaggaauucagaaucaggaaauagcuuuguccuugaucucuguagguucugaggcacuggauuuaacagacccacaagcaaccguggcgcacuuuccacacaagguuucugaccuccucgugguccuucccauagauaaaggggccaagggaagggggagcagcugcagggagccccagcugagccagagaaaggggccaugucuccugggucuccugaugccauacccagagccucacuaucaggacugggugagccacuugaggcucaggagccucagggccgcgggaggggugggucagggcauuugcauggcuucugcuuggggaccugcucugaccuagaaaucugacacagucccacuuuucauuucagugcgcccaggcaagggaauuggaaugguggcgagcccagauuugaguuuccauucuagcuccauuuuccaugcuaauggagcaaguuacuuagagcugaagcaucuaugccccucaucugaaaacugggggguuauaauaauaguacccauggcuuuggguccugaugaggaugcaggaagaugcuuccaaaguccucagcaaccgcaggaucuguggcaagggcagaguuuguaaauacuggguuauauggugggugcuuaguaaaugggguccguuuuaucagcaauaaaccauguaguauggagcugugugugggacacggaucuugcccuugggaagcucucacuuagcaugcuggcccaucugcucuugaauguccaccaugggccaggccaugggcgagauggggcaggggcagugcggggagcaccagguccccaucccucuuagguuacugcagagaaaacagcccagggaggggaccuuccacugugauuuugugggcaagcuggcccucaaaccuguuucugucugucccaugcccauuaaacagaagcucaggcccaugcccauuaaacagaugcucaggcugucuccucucccacugagcugcucugcaccacccuagcagcuuucuuaugucagccccuugaggacuggaaggaaguagucaguuugccuuguguguguuugauuuuucagaauguguaaguacaguaaguccucaccgucauugaugggcucuuggaaacugcuacuguaagcauaacaacacacaaccaaaccaauuuuaucauaagcuaauugauauaaacaggauuuaaguuucuacggcauauuucagguuauaaaaauuaaccaaacuucuaaauaaagauccaaaguauuucuaauauuaaacauggaaauacaugugagcuauuauauacauuucaggaagaugaauaaaaacaaguaagaucauuaucuauacaaguuuuggugagugaugacagugagugaugacagucauggugguagguuaaaucaaggaauaaaugucugcaaagugaaaauuguaaggcauaccuccuaccaccaggaaguucaaaaacaaggacaaaagcggugggcuggcugagugcuucuuacugcauaguuuauugucauguguuugugugauuaucguagacuugaugacuuuuuaguaggcaguuaccuguauucauucaugcguuuuccagcuugcuuauuccaguucaaugucaccgguagcuggagccucucccagggcacaaagccuggacaggacgccguuccaucacaggacacacuugcacccacaccugcucagacugggaccacuuagauguccaguucacugaaugugcacaucucugagaugugaaagaaagcagaguacagagaaaacccacggagucgugagagcacacaaacuccacacaggcagugggugcaggaauucuuuuuuuuuuuuccucaacauuguuauaacaaaucaauguugaaugaaauggcauuauuugaggaccugcuguguaaggacugaacugauuuuaagaauuuuuaggucaggugcugcggcucacaccuguuaucccggaacuuugggaggccaaggugggcagauugcuugagcccaggaguucgagaucagccugggcaagacagggaaacccugucucuacaaaaaaguaaaaaacauagccaagcuugguggcacaugccuguggucccagcuacuugggaggcugagguagaaggauugccugaggcaggagguggagguugcagugugcugagaucacgccacugcacuccaaccuggguaauagaacgagacccuguaucaaaaaaaaaaaaaaauuucuuuuuuuuuuagaggguaggaagugaaggggccaggcuucaucagcuuaggauuuaauguuagaggccacuucugugccccugucaagcccagagaagucaugcaggucccaugaagggcagagcagaucccaauuuuaggaauuucuuugauggguguaugaguugccaugggcagugugggagaagauuaagagaagccaugcuuaucccacucguauccauggagcaacugccuugcaguugucugggaaggaaaauccuugugccgggccugguugaaaugcccaaggaagguagagaggaucccagagcuggggagccgggucuagucccaaaucacugggugggugggagaucuggccaggacguuucguggcccccuggucaccaguguugaguggguccccucagcuggcaggcagguccuuccagccucucuguccacccuacccccagccuuuacaagucauucacccuugcagggaaaggcaccucugcugaggggacccuucuaugagaucuaaacaggaggagucucuucuuuugagccugagaacgagcucuucuaauaggcagaugucaccucggcagacagcccacuacuucucaauuccacaucucccuucccgccuggaaaccccgugagccugggagcuuaggaguccucuuccuagggggcccggccagcuagcaccuggccuucuaugguguggagguuuuccuauacggaaauugcugaaggguggccugcccuggcauuguuuuguggcgcuguuggugguauucauagcugacaggaauugccaugugccaggccacuauuagcucauuuauauuuccagcagucucagaaggcggaguuaagagaaggguagagagagguaguauaauaugccuagagcagcuccucugguggcaaagccgggaggaaacccagcugugggacuccaggccuucccugucuccacaugacucgagaggacugagcuuggccuugagaccaucaaugucuggcuguguguggcccccuuggccccuaguguccaggagcggggcugaccaccuuggcaugugcggggaaggguggggcugaccucauuuagcuuuccugcccuuuuuuugcuccuccuuccaccgugcuucuguccuaccuguuucugaaugggaaggacggcuuuuugaggaacagggugugacucuucccugcgaagacguugccccagaaauuuguccccacgcauucuccagcccucuucccuuugccaugaauggcgucauguuccaaaaauccuguggccacgggcuguuugucaagaccaaacagggaagaggcuuuuaaaaugucacuuucccccuccagcuugaauacaguggggagcaggggcaggggccggggcugggcuugcaggaccugugugugggcagagggaggccaggagcccagugggaguuggggguaguuuacagccagccagcagcugugggcccugcuguccccgugcuaugauggggugaacugugugugugguuccuugguuuugagggguuuuuuuuuugaggugaaauucacgcaacauaaaauuaaccauuuuagcauguacaauuccauugcauuuagccuacaguauuguacaacugccaccccucuucaguugaaaacauuuccauugcuccaaaagaaccccccaccuuaacuauuaagcagucacccccgccuuuaguccccagcaacuacaaaucugcuuugugccucaauggauuuaccuauucuggaaauuucaucaaaacagaaucauaccauaccauaugugaccuuuugucuguggugucuugcacuuggccuaaugcuuucaagguucauccaccuugcagcacaggucagaauucauuccuuguauggaugguagacagugggauugcuucacccuuuuggccguuguggauagugcugcugugaacacaggugugcgggcauuugucugaacaccuccuuucagcggaccccaggagaggacuugcuggccuguggccauucugucagugagcuguuuggcaucagcaccuggagccacaugucagcccugcagacugcugggugggagggcuaugggugggucccaaauaaggccugcccagagccuggggcucuucacagaggagucugggauggaaacuggguuccuggaccaucccucaagagucgcacacaugaaaugccgccaugaggcagugucacggggcggugcagggguggcucagcugcucggagguacacgccuucuuucuucccuuuuugucugaccugaagaucaucugacugccaagaaagaggcaaguuaauccuuaaacauuguuggaaggagggcuguggggcaugggagcugaaggcuggagaccccagggagacgcggugccuucccagugcuaggugcugggagcugcuggcagagggcccacagagccccacagugguccccagaggaccuuggggucagcuagagggaaaaggccuuugcuacgcuguucaucacuguuaccaguuuucaaccuuuauuucuuuggcagcaaaacacccacccccuugaaaugaaacguggagcucacauauaugaugcacgaauguucucauguugaaggacaggaagaggaauggcaucagcuaugagaccacccugacccccacccgcugccccauccuacacccgagguggccccugaagcaugaccuccagggaucuucacaguuugaagagccgcugauauacucuaauacuugcaguaauauuuuuuaauagaaugcaauauuggauguacacaaaaggauacaagcagcauacauuuacaauauaaaucuaaauaauaaaaaugaaugcucgugaaccugccacccaacuuaagaaagagaacacugacauccauucaaagcauccuucacgccccuccccagugguaucccuuucacagaggugaccugagaugauuuaggggugggagccgaggcccagauggguagcucaggcauugcccuucacaccagugcuggucgagcuguucuagggaacacggacagaagcacauuccaguggaguccccugcuuuucugacuccucuccacaggcucagggacguuaguccuguggcacaguaaaggugcuuauguuugugguccuucaagccccucuuugcaagcagggaccuggggagaggauucuaggggccagggggagcagggacccagggaggggaucuaagacuauggggaauggggacccagggaggagagcuccaggacuauuaggaguagggaccccgggaggggagcuccagggccguggggaauggggaccuggggaggagagcucuaggacuguuaggaguggggacccggggaguggagcuccagggccguggggaguggggacccggggaggagagccccaggggccauggagaguggggacccagggaggagagcuccagggacuguggggaguggggacccagggagggcuccagguccauugagaaacagguguugccucugucacagccccuccuccuggccuccucaccaaggcagagguccgcauuguugagagaaagguuuuccugucugccugugccuuggagucuguuucauuuccagauggaccauauguaacacagccaccaggagcaagucugggguuagaugucgccuuuuaaggcagugcuguuggauagaaaggacucuugaguagaaaccaggagauagacuuaaaggcaaguuuguguuugggcacauggcaacugagaagugggaucagcagggcugcuccccaagcaaaggugcagaagggguggggacgugcuaggggaguggguggcuaggucagcaguucucaaacuuuuuggguuccagaccccuuuaugcucuugauuauugaggcccucagaacgcuuuaguuuaccuggguuauguccauugguauuucuuguauuagaaguuaaaacugaaaaaguuuauucaugaauucacuuaaaaguaacaauaagccuauuauguagucacguaacauauauucugaaaaauaacuuuucuaagacaaaaauuugcugaaaagccucacauuuuuaacucuuugcagagcucuuuacggucugccauaaugaaagacagcuggguucucagagcuucuacagucuguggccauagcauguccuguguagccuuugggcagcucuacuguacacucaugaaagagugagagaggaggcaaaggauguuuuaguauuuuuauuaaaaugguuuugacucagggaccccaaaaagggccucagggacucccaccuuugcagaccacuggucgagcuuaaguugggccaugggcuugaggagcaugccggccucuauaggaggggcagugcaguucacuguuccaggcugcgccgcugccuuggggccugcucggcuguggcugugucagcuucccacagacgguguccccugacuuccauuucugaagucugucauuugcccccucccagggaagucucccacacuccuccccuuugcucccuggcauggugcugaguuccuuucccuuugcaccaccuuucgugucuucgucuccuuguugguauucccagaggcuuugcgaacuuugcaucaguggccuugcagaggcugguagacaucaggggcaucccugaccugccuccauagagagcagcagaauguggggauggggaguggcccaguugggaggugagccaauugcagucugcagggucccgggugggcauggcuguucugaguucugggaccagcaguccuggcauaauuagcagaaucccuuuuccuuccccaaguacucccaauuaagacaauaaauuacguugagcaccuuacugaugaggcucugaaguagguggcuuauuggcccagcuuuuccugggguggguggaggugguagccugcacccagccuugaugucuuugcacagguaggaaagaguccuucuggaggacagcccccaaucuccgccagcuuccugaccuccugcgcagauggccaggcugggugugugcugcaggaggguggucuguggcuggcucaucuggaaguaaaggcuguagggcucuuccuuccaugugugccucaugggcaaugugcuuuggggccccaccgggucccuaagcccccacuugcagccucccagggccguggccccagcugcauggauguggggcagaacugagugcugugcuggugaggaccagaccccuaccccugggagcacaucucacuugggaacaugcccuucaccugugucacccuuuaccuucuggaauggccugcuaaacuggggaggagugucccaugggccagggccaguguggaaccagguggccuuggugccuguuuugcuuccacugcuuccuggcucuauuuacuuggacagaccacugagucucugugugccucgguuuccugggguauaaaauggaggucaugagagcucauaugcccuaagcccuggggucagcuccacugccagcggggaggagugcagaccugcccucgugcucccauagcugggauguauguccucccugcagaaugcauuccuggcagcuggugagcagguguucucccucggaggcuuggcuuccucccgggacagggcucuggguccugaugauguugaaacacuugcgggggcuguagcuccaucuuuaguaucugcacaguggcuggcuguuuguggaagccuauauugaggaagguaguuuggguccacaacuguguggcuguagagcaauagaacaguauucuccaggacucaaggccccauggacaacuuuuaguaguucuagcacaguuuggucaacacaggacaagccuguggccucuugaggggucugcaguggugaccaguguucgucggcccuggcaggcuuguucugaaagagaagcccccauucugagcauggucagaggugugugcugagaacccacugugggugaggcaggugggcacagcuccgccaagaagcuucccuccccaagugcugagauucagagccacugauccucuugcaguccaucuggguggccacaggacacacaaggucuuggcaggggugaggcuugagacuggacuuugcugugugcucaccccugacuuuuacugacuuacaucagaaugucccagaaaagacggacaaccuugaagucucccaugauuuacaagcuuagaaagagggccagacggcugcuacccagguauccuuucucuuuggaauugaaaugcagagaacauuauuaaacagccuauuugcugugaguguggaaguguuuccacagacaccuuuuugggaaaaagaaaagggcaagaaucaaccugaaaacuacagaggauauauuagccacgguuugcacgcauucugcuuauggaucuuucagugacuccagugaggggccaucugucccauccagugccugagugcagcccccacccccaccuuugguccagagaagucuuugccccaagaaucugcccagaguuggggcaucagccccuacagguguggguccuucuucaggacuguguggaacuuuuccuuuugaagaacuuuccuggggaugaccacucugcuuggagucugggguggagccuggugugagggagccagcguaggguuugggugccugccccacccucagaagcaggagcccagcagcccuuggacugaccggugcuguucuggggcucccacuggcuccuuccacuguggagcacucccgugaacacugcuuugguuugaguaccaguacaaguguuggguguauguuccugaccuugaggcauucuugauugugcaguuaccuaggguaugcuugugucugacaugaucauuuuuuuuuuuuaauaaaaaauggcauggaaggaguauguguauuuuucuacuguagauuaugaaacugagaaucacagagauacugccuugcccugggccacacaucgaguaggugguggagccaagacuugaauuggccuucucguucccaggccaguguacauuaaauaccuggagcugugagguccuguugguggacaguagaguguagggguucccuaacuacaccuacuucuuguucugccaggaaugaccaagaucuccccuauugaagccacucugccaggguuauaucagaaguccugcgugcucggucaggcaggcaucuuccccucccuuaaauaauaacugguaagugccauguaguggcauuuacauuacaaaaaugguaaaaucaagcaaaagcccccaaaccugcugcugaucuuggcaguccgcauaauagcuguuuucucaucaacucucaaucuuuguccauccuuacauguguuauaaacagaacugaccacgagccccuugggagaugugugugcuucauguuuuuaucugcagggccuugaguggugccagcuucagggcagcugcuggagaaauucuguugcacacuuccagggggugccguucaccagcggacagagcagcggagccaugaaggccugcgcaggacaggccagcugcguugauagugugggcggugcccuggagggcaucuugaauccuuguccucgcugguaauuaauggccagguagcguguuagggaguagauguauagucacucucgaaacuguuucucuguuggguguugagcucuucccacaucaggaaugagacuguuugcuucucucuuugugaguucuucaggcccaggcucuggacaugggcucacuguaucaggaguguggaagcaucguggcucuugcauguggccgugugcugcugucugagugccagcuuuguccacacccugucucuuguccuugguggcauagugcacacaguggcacaacuggagacuuggacucgagaaaggagaaguacaaguuggauucagccaugugcgggggcaggcccuggcuugugucuacuugcgccucagugcugaucgucccucacuccugggugcugaccagcguuguccuagugaccugggagcucaggugugggaggcagaggugcagugcagccuggcuugcccaggucuuggcugggagggccuuccagcagcacucagagcuguuagggagcaguuaccuuuucagcugggugggggugacuaauaaguguaccuguagacuuguguuuauuuauuuggucauuggagcccaacuuuguacugggugcuucacuggaugaggcaggauucuuguccccagcgaggagaugugguguugugagagagaaggaauacauuuggccuggagccgguuaguguucuugaaggaggugugggauuuugaggggucuguguaugagacagugaaucuccuuauuccauggaauagaagauguuuguguaugggaggugagggggcaugggaccauagagggccuucuggguggcaggaugugauggggugagaagagugagacccaccugucugcaucgacuguuugaggccugcccucuuuggugccggauugcgcaauaugucugacuaccuuucuccccacccacugcagucuaaggacaggugaguccaaggggacaggaaaccuggguuaaccaccguuagagaucuugucaccgacuguucccuucucuuggagccacaaacaggccacacggagugagagccaagcauguugugugggcugguugugaugggguggcuguguccagagaccugugcacgucugagacgcaucagugguggcagcuugacaacacuggguauaguaggcugagauguuucucugucccuugccccuggccacccgcuuggggcaguugggcaacccagaguugagacagcuggguucauccuggcaugcaucccagauuugccuggggaggguggugaggggaagggacagaagaacccuugagagaagggauguggguggccuccagggaaguaguuggagaggccagcagagcauacgcggugcagcucagggccauggcaggcaggcgucacugaagaaggcccguggccauacccuguagaccccugaggacugacugcagaggccacaguggcugaguuuuguuuuucgguuuuuuuuguuuuguuuuuuuuuuuuugagauggagucuaucucuguugcccaggcuggggugcaguggcgcaaucucggcucacugcaaccuccgcuuccuggguugaagcgauucuccugccucggcgucccaaguagcugggacuacaggugcgugccacuguuuuuccuuuuuuauuaaacuacuuacguugagauaaucguguuuccccugugguuguaacaaauaacagagaucccauguaccccuuugcccagguccuccgauggugaccuucugcaacacugugguacggcaccacggcugggauacugacuacaaugcagaaagcacccagugucuccaucgccuucucccucccacaucaacccaaccccagccacccaggaauccugcuccauuuccauaaaucugacauuucaagaauguuaugugaagaaaaucauacaaccuggaaccuuugagauuggcuuuuuucaccuagaauucucuggcuauucauccagguuguugcuuggaucaguaguuugcuccuuuuuauugcugacucgcauuccaugguaagaggggacaccuaggcuguuuccaguuuuggucugcuacgaacaaagcugcuauaaccauucacauguaguuuuugugugaguguauguuuucauucccuggaauaaauauccaggagugcaguuccuagguuguagguaguugcauguuuaguuuuuuuaaaaacugccaaacugucucacaccagcaguguaugagugauagauauacuuacuuugugacguugccagcauuugguguugucaccauuuguuuuuuuuagccauuauaaaauaagauguucauaaauagcaugaacaccucuucaugcuauuuaucuucuguagaaagucuucucgugucuuuugcucauauucuaauuggauuguuuuguguuuucacuauugaguuugagggucuuuauauagucuaaauacuaguauauagucuagauauuaguccuuugcaaaaggacauuugcaaaauauuuuauccuacuucguggcuuaucuuuucaucuuccuuaggacuuugugcagagcaaaaguuuuuaauuuuaaugaaguccaguuuauccauuuaaauauguuucauuuugucuuguuuuuuguauaacacuacuuucuguaucagcuugagaugauuuuuuuuuuuuuuuuuuugccuguggacgaagggucacucuagcaccauuuguugaaagacuguauuuccuccauugaauucuuucugcaccuuugucaaaauugggcauauuuguguugguuuauuacuaacuacuguuccauugauccaugugucugacuuuccaccaauaccacacagucuucauuacuguggauauauaauaagucuugugauuggguaaauagauuauacccucuuuuuuuuuuaaauuaaaaauauucuaguucauuugccuuuccauguaaauuuuagaauaaucuuguccauaucuauaaaaagucuugcugggauuuugaugggaauuguguuaaacugaauaucaguugggugagaauagacaucuuagaaucuugcaguccacgaacacauuaugucucucuuauuuagaucuucuuugauuucucucaucaguguuguguaguguucagcauuuccuguacauauugugugguauauacaccuaaguauuucuuuuuuuugaagcaauuuuaagugguauuguauuuuaauuuugauguccacguguccguugcuagcauauagagauacaauugauuuuuguaugcugauccuguauccugaaacuuuguugaacucacuaguucuaggaguuuuuuguagauucugggauuuucuauacagacagcuaugucaucugugaauauuuuauuuugucaguuuugaucuauaugccuuuuauuuccuuuuccugccuuacugcacuagcuagaaauucgcgcacuauguugaauaagaauucugagauggccaucauugccuaguuccugauauuagagggaaagcaaucagcauuuccccauuauguguaaugcuagcuggagguuauuuagagaugcuuuuaugaaauugagcaaguuccccucuauuccuacuuucugagagguuuuuaaaaauaauuaugaauggauguuggauuuugucaaaugcuuuuucugcaucaguugauaggaccauguggcuuuucuucuguagagcauuaauuugguggauuacauugguugauuuuugaauauuaaaccggcaucccuggaauaaacccccuuggucaugguuuauaauucuauaaauauauugcugaauucuauuuacuaauauuuuguugauuuuugcaucuauagcagucccccuuuauuugcaagagauacauuccaacagccccaguggauuccucaaaccacggauaguacugaaccugauugcuuucaguuggaacucauuuuugauuggaaacaaccuagauauccccucaugucaaacccacagauacuuuuuucaucuuuuuuuuuuuuuuuuuuuuuuuuuuuuuuuuuuuuuuuuuuuuuugagacagugucuugcccugcccuguugcccaggccggaguguagugguaaaagcauagcucacugcaaccuugaauuccugggcucaagugauccucaugccucagccucccacguagcugggccucugccagcacuugccaccacaccuagcuauuaauaauuuuuuuuugguagaaacagggucuuguaguucccaggcuggucucaaacuccuggcuucaugccauccuccugcuucagccucccaaaugcuggaauuacaggugugagccaccacacccagccauaaauacuuuuucuaucuuaccugggcacuucaucacgcacaagggcuguaacauuugcaguucgaggugugauagaaaaauuagcaugaauuucuuuuucuuucucaauuucagcgauagaagauuuauucuuacuguacaucuuagcaaccucagcauaugauuuuuuuucuuaaauugaaaacuuuuaccauuucccuuaaaggaagcacuuuauggcuucucuuuggcauauucaaauugcugucaucacuacucuugugcuuuggggccauuauguauaauacuagcuggaugcacaagcacugcaacaccaccacaguccaucugauaacugacagcuacuaagugacuaaggggcagguagaguauacagcguggaugcgcuggacaaaggggaggcuccacauccugggaagauggagcaggacgaugcaagauuucaucacacuacucagaauggcaugcaguuuaaaaccuguaaauuauuucaggaauuuuccauuuaauauuuuaaggcugugguugaccguggguaagggaaaccguggaacuguggauggaggaggggggaacuacuguguauuaaugaggaauauuaguccauaguucuuuauuucauuuuuaaaaaauuuugggguuuugucauguaauuuguuugguuuuggugucaggguaacaccagcuucauaaaaugaauuggaaaguguuucuucuucuucuucuucuuccuuuuuuuuuuuuuuuuuuuuuuuuaacaauuauauagaauuagugucaguuccuuaaacacuuguuagaaaucuccaguaaaaccaucugggcuuggagauuucuuuuuugugaguuauggaauuacauauucaauuuccuuaauaguuauauaaucauuuaaauuauguguuuuuuagagaaguggguccauuuccuauauguugucaaauuaguguugguagaauuguauuaguauuccucauuaucccuuugaugucugcagaaucugugaugcuaucccuguuuuauuucugauaacaauuugugccauuaugucuuuuuuuuucuuuuuuggucuugucagcaguguuuuuuuguuuuguuuuuuguuuuuugagaugaaguuucgcucuuguugcccaggcuggaaugcaguggagcgaucucggcucacugcaaccucugccucccagguucaagcgauucugcugccucagccuccagaguagcugggauuacaggcaugcuccacuacgcccggcuaauuuuauauuuuuaguagagacgggguuucuucauguuggucaggcuggucucgaacuccugaccucaggugaucugcccaccucggccucccaaagugcuggaauuacaggcaugaaccaccgcgccuggcugaaguugaucaguuuuaucagucuguucaaagaaccagcucuuuguuucacugauuuuuucauugauuucuaccuuuaucuuuuuuuuuuuuucuuuuugagacgaagucucacucuguugcccaugcuggagugcaguguuacagucuuggcucacugcaaccuccgccucccgguuucaggcaauucuccugccucagccuccugaguagcugggacuacaggugugugccaccacacccagcuaauuuuuguauuuuuaguagagaugggguuucacuguguuggccaggcuggucucaaacuccugaccuugugaucugcuugccucggucuguaaucccauagugcugggauuacaggugugagccacugcgcccagcccgauuucuacuuuuaucuuuuauuauuuccuucuuuuucuugcuuuugauauauuuuguacuuauuuuucuagguucuugagauagaagcuuagauuauuuauuugagaccuuuccucuuuucuaaugugagcaucauaguuacguuaguucccuccuaggacugcuuuaauuguguuauugagagggauguugaagucuccaacaauauuuguggauuuauuuauuuuuccuuuuaguucuauuaguuuuaacuucacauaauuuugcagcucugauguuuaaaggugcaugaacauuuaggcucacuaugucucagugaauugacccuuuuaucauuauauaauauuccucuuugucucuggucauuuucuuugugcugaaauauaauuuaucugauaacauaacaacucugcucuccuuagauuaauauuuucaggauguaucacuuuuaguuuuuucuuuucaaccugccugucaucauuauauuugcagugaauuuuuuguagacaguguacaguugaauuauuuuaaaaaucuacucuaucaaucuuuuaauugguguauuuagaucauuuacauuuaaaauauuuacggauaacuuagggcauaguuaaugcgucucugguuauuauuucuguuuuguuuugcuuuuuuuuuuuuccugcuuccuuuggguuacuugaacauuuucuuuagaauuguauuuugauuuauauaucaaaauauaguuuuuuaaguguaucucuuuguauauauuuuuuacugguuauaauaagacgugacuuuauauagacauaacuugucacagucucuugguggugucauuuuaccaguucaagagaguaccugucuguucacuccuuuaccuuuuccuuguauaauugucuuaaguguuuacuucacauacguuuagaaccacauuagacaguuuuugcuuuagucacgaaacagaaaacucaagagaaggaaagccuaauuauuuacccccucccucccuuuauuuuacuguguucuuucuuccuuucagauguuccaggauuccuucuucuaugauuuccuuuuuguuuagaaaacuuccuuuggccauuuugcuagggguaagucagcaaaaaacuucucuuaguuuuccuucaucugagaaggucuggauuucccuuucauuccugaaggauauuuuuacugguuauaggauucuagguugacagguguuuucuuucagcaccagaaaaguagugugccacuuccuucuggucuccaugguuccugauaagaaaucuauugucauucugcuuaguuuucucaaaacuauaaggucuuauuuuucucuggcugcuuuugagauuuuuuuucucuggcuuucuuugucuuuuagguuuuucuuuaguuuaguuauuguaugucuuggucuggauuucuuuggguuuauccuuugauguucacuaaacuucuugaauguguagguugccacuuuugccaaauuugggagguuucuagccauucuuugagcccuuuuuccgcuucacccuuccuccuauccugcagagacucugaugacaugaauguuagacuucuuguuacaguuccacaguucccuuuuauuuauucauuuuuuccugucuguuuuuccucuguuauuagaugggaugauuucuguuguucuguguuccaguucacugauucuuucauugcccccaauccuucugcucuuaagcccacccgggagcuuuuauuucaguuaccguauuuuucaauuucaggauuuuuguuugguucuuacagcuucuauuucuuugcugucuuucccuuuaauucaagugugcucauaauuucuuguugaagcauuuuaucaugggugcuuuaaaaucuuuaaaugugggauaauucuagcauggcugucaucuugguguuggcauuucuugguugucuuuguucauucaguuugugaccuuccugguucuugguaugaugaugauuuuugguggaaaccaaguguuuuuguauucuguugggugacucugggucucauuugaaccuucucuuucaguggauuuuucugacagugcuuccgugggggaagggagucaccaugaccaccugguuacuuagauggagacagaaguccaucccucggccuccacugaugccugaacugggaggcuccucaucauggguucccuucccacugggcaaugguaaaaacccugacccuccucugggcgcccucugacacacccuagcauggagcaagaaggguccucguugcuguuggugggauguaaggcccuugugucuucugacaccacccuggccgggguguggggcaccucacaaggguggaaguccaaccuuugcucacuuggggguggggugcugccuuuccugugacuuuuggccagaguaaggcgguucuugucuaagaguuuucugucuuguugggcugcuccuuucugguucuucagcuauggaaaguagcuuuuuguuguuguuuuuuuugguugugugcccauuggcguuuucagguugccaguuucuccaguacccacucugggauagugagacaaaaagaaagccugggagagucaccacgguguccuuccuuggauccugggucccuggcccacuuaccuuuuuuucuccaccuuucagagucuucucauguuugucuuauacaugauggccccagguuuuugguuguacuuagcaggagaaaucuacaucugccccaucguccaggaagcagaaguuucaaggcacuguuuuugaaagagcuucagguugaaggcacacccagaccaccagcagccucuuccuagaggccagccagaaguggagccuccgacuugugugggucaugagugaaggccgaguuuaauuggagaggagguagcucgggggagucucucauguggucacuuuuauaugggauccggagccacaugcauccucugggaggaccugcauagaaaggggcccugugugcagggcugcuugaaacaggacucgggccccauccuuuggguccuuacagcccagcucagaucccccaugucaacaacagauaccugcuucuccugccucccuccaaaaugcccagcagcucaaccagaaaacagcaaagcuaagccuacccacgcagcauuuccagagcacacucccuccugccugcugccuuuugggcugucuguuuuagugucccaguuucagauuauuauaggaccgucuggaagagaauacuuuagggccuuuuagaggugcugccccaggaccaggugggcgugcgugggagccucugcccgugggcauugcugcacuuaaagacacuguggucugcugugcgggggaggaugcagcaguuuuagauagucugagacauagagaagcagcagcucuuccugggaggccuuucccacgccuuggggaugaggacagguugucugagucaggaccuagguuauguaaggagaagguaacucagagagggcaccacccacccacugcuggccuaggccggugggcacucaccuccacucccucugcacaccugccucaggaucaaggacacagccagggcuaggcagaccccaucccugccuuccuggagcgaagguucugggguggggguggggggcaagacaugucauagcaauguaauuacguacauaaugaaaugguagguagaaauuaguucugugaugugcagugacgguaauggcagaagugaguuguuagagacugagggggagggucaggacuguccccuugaggaagggacauuucggggaagcccugagggaugguagagagggccagguuuuggggagcugaggaggcugggggaggcugcgcagcccacguggcuggcugugagaggcaagagugguggugauauagcuggccaguuccugucccuggcucccuggacuugaggagugaguucucaguaauuacagauggcuccucauggccccauggcgccaucauuccugccucugcaccugugcaucagcugcgccccugcccagagaguccucuccaccccaggccucccccuguuaucuaugggguccuuaccuucagggcuuuuuuuuaauagcuuuauuaagauaaaauucacacgucauacguuuaacccauuuaaaugauacaauucuaugauuuuuaggauauuccaacugaugugcagccaucaucacagucacuuuuagaacauuacaucaucgccaaaagaaacccugcaccucuuggcugucaccaaccccuuccgccgucccagccccaggcagccacuccucugcucucuaucacucuggaauugcuuugaugaacgcuggguggggugucaccugcaucccagccugcuccuccacccagaggcccuacaucucgcucucugcucugugucugcgccgcccgcccaccugcaucaguccccucuguggugauccauaucaggaagucacagccaagcaaaguggcugcugcaggcucccugguauacagcacccagggccaugcacacgggguuccugagcagagguuugcugacgaugccuggguugagaccagggcucggguucugagggaacagaugcugaucccuuggcuccccacaguuccuccuggagaaaggucagguaaauguagcugauuaugugaugacaccccaagcccugccuccagaggccagggugguggcgcauagucaagauggagauagaggaauggcuuggcaggcuagccucuggccucacaggugggcacuuguggccggugagaggccgagcugggagucacagaguccagauacacacagggaguuguccagcuccggcuuucccaugcaaggccucuggguggggucugcuuaggaugugcacuccugggugggguguggagaggccgagcgugugugcccaccuugagguuugcugggcacagcuggaguucguagagagcacagaccucuccucgccuuugcuucugccuucccaggugggauuuccaccacauacuccuuggcccuccuggacuaugucugcagccaacacccacuccccuguugcagcaaagcaagccucuccuguccuugcagcuuucccccgaccccaggcacacagcuccacuugcaccauucauggggaaagccagugcuccuggggaccuugaggacccugcaggcggaagccaaguaaagggggguucuugguucagccuggaggcuguguggccucuggcacguggccugcccucucugagucacggucugcagcuaccaaaugagguagugugguggggccuccuaguuuggagagcacugaauaaaaagcacaucaggaggacccaugagggguccuguguguguaagcagcagucagagaacuuggguuuuaauuuguguuaccgcccuccgaaaggcacuggauaaaugggacugguuguaccuuuuccaaugcauucucgccagcuggguguggcugaggaaggagauugagccagagugucugucuagauuccccuuguugagcuccucccguggucuggggaguggggacucuguggcugguaaaauauagcagugccucacauuuguugagaccucacaggccagacacugugcucaguguucuuugugcagcuuuuuaaguugagcuauaauucacauaucuuaagauucacucucuuaaaguauacaguuuggugaguuuuagcauauuuacaauguugugcaaccaucuccacugucuaauucuagaauauuuuagucacccacgaaagaaaccccauaccuguuagcugucucuccuuauuuccuuuccuccagucccuggcgaccacuaaucugcuuucugugcuguggauuugccuauucuggaccauuugcauaaguggaauucuguaauaugugggcuuuugugccuggcuucuuugacuuagcaucauguuuucgggguuccucgguguugugguguauguuagugcuucauuccuuuuucuggcugaauaauguucccuuguguggacccaucacacuuuguucaucuauucaucuguccauggauauuugggcuguuaccaccuuuuggcaggugugaauaauacugcuaugaacauucaugugcagguauuuauuugagccccuguuuuccguuuucuuggguguguauacauaggggugaaauugcugggcccuaggguaacucugccuuuaacuuucugaggaacugccagacuuuuccaagguggcagcaccguuuuacaucccugugcuggguuuuacugauugcauuaucucaucaguccucacaucagagucaugagguuuagguagaauugucaucacucucacuuuucaaaugggagaguuugaacucaaagaguuucugcacgcagucacacagccagucaguugaugauucuuuggccagagcuggcuuugaucacgaaagcagucucuucuccaggcccuguuuuguaucuucaggaugaagcuuuuugacuguguuguucauguccuauuuccuggcgccuggcacacacugacacucacauauuuguugaauaacaugucauuuuuuccugaucuugguggcuugaucaguaacuugcaggagacagcaugucuuaggggauccuguacucuccagguucucacacuccugccagggccuguaugcucuccaccccggaugcugcagaauccccgccagccucugacucucaagcagcugcagacgcaccgcaguggaaauaggugucaugaccucugcagagcagaggcaacaucuguuuccagcgagugcuugcuguuaacuugaccuguucucucuucuggguugaaggcugcuggugaccugcccucuuuuuucuccucuaggcaaaacccauuuauggcgguuggcugcuccuggcuccagaugggaccgacuuugacaacccagugcaccggucucggguaagggcaucagagccaacucucagggaggaaccagagaagggacccaucuaagggugaacuggcagaguggaagagggagauggagaguugaacaguggauccugggauagcaggaccagcagggcucccccauuuggugcacuuguacguuguacagaaaaggucucaauuauacauaguuguguguagugcucccuucagaaugaggagcucucauguggguguugccuguuuugugggucagguugacucuaggaacaguaaaauggaagaggcaaaagagcaguuaaagguuugcauuauaccgagcagcucccaauuccuuccaugccaaggccugccccuguagcaccucccuucuuccugagccagggguucagcacacuagcacuagugaaggguugggggcccagaggccuuggcuuaccucuuacuaaaaugugcauugcccagggcagggccccgcuagagcugggaccaucauuggccugaccugugguuuguuucucugccaggaagccccucuggauuugacuccgguuacaaaacucuccuuccucacaaacuuucuuacagugcugccgcuugcacccuauaaauugcuuccacucagcccccuccauccccgggagcucccuuuccucuucuucuuaguuucugcugcucauccuuuccccacccugaauauuacacuuuggaguaggggccuugggcuguguauucuggucccacaggccuugcauugugucucuguucuuugggauugcuucuagaauggguuuugauuucagaggcugcacauaaggcccuuggaaauguuccugggaaacauguucagguggccuccucuacacacccagcauagaccagcccucuacaaggccucuuugcaaggcccuuugagucccuguucaugccacccagacaggagaacucaggcaucacugguccagcugggcugcaguuuccagggaguaguucccuuuccuauuuuauaucaagguuguacaaaauugccauuuccagccucugacaggagucuuuuuauaaaugauaacccuggcccaaagcagagagaugugcuuuuauagucaguucacguggccucacugccaguuaaacucugaguauuguugggcucuuugcuuuuuuuuuuuuuuuuuuuuuuugaaacagagucuugcucugucacccaggcuggagugcaguggcaugaucucgauucagugcagucuugaccucccagguucaugugauccucuuaccucagccuccugaguagcuggggcuacaggcgugcaucaccaugccuagcuaauuuuuguauuuuuuguagagacgggguuucaccaugcugcccaggcuggauugggcuuguugaaauguugaaaauaggucauggacccuugugaugauuuggggcugggagcugugccugucauucaugaccugggccagcagacucgcauuauggacaagucccuucuccccacacaaaggaagacauacaccgcauaguccauuucauuucagcuccugauggcaucugaccgccguggacacuucccaguggucuggcuuuuggagggagaguagagcgggggaugaucugugccaguuggucacuccuuggauauuggaguuauuuccacuggucuugcugcuccucuguuuugauuuucauuaacucauuucaccucagugaauucuggagccuggcuguuuuugugccuccucuuugccaguggaucaucagaacaaccccuuuuguagcaguuucccagguuuuuucagaaguggugaauccaugccuuggcauuccuggauuauuccaugucaugucagaucauucaucaaauaaauauugacacaugucaugugaugcauucuaugcugagcaccaucaggaauacaaaaagguaaccacacguuguuucugcuccugaggagcuuccaaguguuaaaaaaaaaaaaaaaaaaagacuucuuauuaagccucaaucacucaugugauuugggccugucucccagcccaguccuggcugaugaaucaacauucuugugccucgggucccucuuuuccugccaccugccccagaaguggaaucuguggagugaccuuccuuagauauggacuugucagacgugggaacuccagaagccaagcucuggggccaggacccagauccuccuaaccacccaccuugugcuccguugcagaaauggcagcgacgguucuucauccuuuacgagcacggccucuugcgcuacgcccuggaugagaugguaaguguuauccuugcccacucccuguccccagccuucaccaagucccuccauuacagugcccuugcguugucaugugagagcacagcagccaugugcuccugcuugugucuguuugggaguguggaauguuuugaagaacuuguggcaccugcuggagacagcuuuaaaaacccagaccuuugguuugaaacaucaucuucuguggucuugagugagaggaagaagugagggaggaagucauuucuguugaaggcuaauaguguggacuucacuggagcacuccugguuaggggaaagcaagggcaaaguccuggaucacgugugcaggcuguggaccugugggcguggggcaggggcuggcccuggggcuggcacaugugcucacgcaccuaguccugggguugccugucaauucugcgacuguaauugguuuugcuugucucauuugagcuuggcuuaguuuuccgagcugacuucagaggccuccuggucacaaggucaucguucuucuggucacuaaaccaggcagacaggcuucuuccuccuccccaccucccugguuuuccaguugcuuccugggcuggaugaguguuugcugcuguugccccagaggccaaaccugaaaaucaacuagguggaauuucuggcuuuucuuuuuccacccauuuuaucuccugacuuuuucucuaaaggagauuagucucuccuaauuaaucuaaaguaggacugcauuccaaacuuuguaaaggguugaagaugcgagauuugaucgccuuuuccaguuccacuuggugggugaauguuugugugcccauaugugcagcauuuuaaaauugggacuguccuggaaagccuagucucacuauguaaaauaggcagccccugccuauccuacccagaguuuguuucuuugcugcaggggcgagacagacucuggaaguaugaguggagauaacugucccuagagguaccuuccagacugcggcaggggguggcgggggugccugggauuuuuggguggucauuacagcucacaugugcaaaggucagaagugggcguguuuguacucgaguccuaaccuuugugaugugauauguuuucuacuuuuguuucuggggugaauuaagaggaugguaccauaauccuguaucaacugucaccucacugguuccuacuuaaaaagaauugucuuccuuuucauucuuuccggugagcauauuuguacaucaugauuagagcauaggggguuuuugcuaugggaacgucugugcuccaggguaguguacuggaggugagcaccgauuguggacuuggcuggaaguaggagcagggagacaaagcauuuggacacuccguuccuuugaggcaagaaagcagaccuggaggauuagacuucacacuucguguucuccuggcuuagcccuuacacagggaguagcccuggggucagagcugggcuccugcagcugugagguuuaucuugccucccuguggcugacugacuggcugaguccugcaauugacuuaacaguaucagaggagccucaagaggucacuggauuacauucaggcugggcugggucaugaaccaucccaaaaaaacaaaguucccugcacuguuuccuuggggacugauaauuucagucaggaaaucuuucuuuaggucuaacuaaaguccagcaaaauccauuauucccucuggcucaguugcacaagcacaaagaggguagcuucuggggacgccuuggugcuggcacaagugcagagcacaugcugccucccaggcacggcuucuggauaauugaggccgcuuagccaggagcaccgacacuucacagugcacuguggucucccagcaaccuggauaugaguugcguauuauuucauggagugcucaggcagaggugggacugugccagggauguggggaaagaaagaagucccagggaaaacuuggacugagagagggcaugggggcaggcccagagcugggaguuuugggccacgggcugcuuucuggcagaugaccugggagcuggagaaacugacccagugagcccaucaguaaauacugcuuugcccagccgaggcuguggagggguuucccuguuguaucaggaaggucacaggggaagguugcaaggaggcacuuaggguagaagccaggugggaggaggcagaggcuggagagauuucucuagcacccagugcucugcaucaggguuugcuccucagagccacuccccagagugagcagacagccuguagcccaggagcuccagcuuaacggucaaccgcccugagcugagagucccaccccaaacaggcuggcaggauccugagaccuggagcaggaaaacuccauuucagauaggcuuauguguggguaaacuccagccaagcuggaagcuuccuuugugagugccuggaaauagaccagugguccucagcgucaugccucccagggccacuggccaugucuggagucauccuugauugucacaccuggggcaggaaugcugcuggcaucuaguggguggaggccagggaugcuacugaaucuccuucacagaacagcccccagaacaaggaaggcuccagcccaaaaugucaacagugccaaggccaagaaacugagcaguuucgacagggguuuauuuaaauucuuauuuauuuuuaaaaaugaaaauguaaaugugauuugcuauuagcucugcucuuaaacagcacgggacucaccugucagauuuccuggagugagggggaugauggugcagugccagucguagaauggggugggccuguuucugaucuagagaggucuacgggguuccccugcacaccaggcaaccacagggccugcagaacugcuuguguguguguguaccagggagcacauagguggcacucccuacguggugcccucagaccgugauguugcaaagcaaucccuaccugggcauuugucuccaaaagcagcagcucuaagcagcccguggcuaccucugacccucccaggcucauauaauaaacuauagcauuuuauggcuggucugugcccuccacacucaaucagcaucuauuucgaauuguuacugacuuauaugauguuaccauuugauuucauuugcuugaguguuaucuugccaacuagacugacuucuuguuguuguugggcccgugauaauucuuggugugucuccccauugucuagcaugggguuugggcggcacaaaucuagccagguguucuguaaauauguguggaguugaacuaccaacuuuguaaaugccuugcugcguaauuucugcucccagcuugaaaaccuuaagacagggcggguaggaaaagagagaagauaggaaaagggguguuccucggagggagauuagcaauguagugaccuuuagggauuacucagcagaagggagaaaaccucccaagagcuccagauaacugggauggggaaaauucgguuaccucagccccacuggguugggaccuggagaggaagguggacaucaggaggucacagcgugcaggagagggaggaaggcagcagcagucccuggaucuggggacaguggcuucgggaagcccuuucugcucggggacuucugcuggggcuggggcugcuggacuucauccaguuccggaagcugaccauugccucuccaggcagcccugagauggggcuaacuuuggggaaucucuuuuccuuuuuugggaaauuucuuucucgauacacccacguacccuguaacugguggguguggaggagaggcaaauuucccgaaaaaggaaaagaaauuucucaaaugcaggcugaggugaggugggguccgggcagccucacagacaaguaaaagccugagagauuuggcugggccccugguuuuucaggaguggacaaagcaacaaucuagaaacccagauugcugccucuguccucugccuuuguuucuccaccuguaaagugcugcccaugauuuuaccuaauucugucaccaaguuuuuggggacugaugucgagcugagguguggaugucaccagacaucacuagaaggcucuugggaggagcuccaggucuagaaggagagugggagcgccaggaguuuaggguggagcaggccaggccaugaggcuuugggauucucaagggccugcucuccaaggcaaaaagcugaucaaaugcuuuuuccaauuuuuuuuuuuuuuuuuuuuuuuuuuugagacggaguuucgcucuuguugcccaggcuggagugcaauggcgcagucucggcucacagcaaccuccgacucccagguucaaaccauuauccugccucagccuccggaguagcugggauuacaggcaugggccaccaugcccagcuaauuuuguauuuuuaguagagaugggguuucuucaugcuggacaggcuggucuugaacuccagaccucaggugauccgcccgccucggccucccaaagugcugggauuacaggcaugagccaccgugcccggucuguucgaauguuuuuaacugugguaaguacacuggaaauucaccaucuuaaucguuuuuaagugugcaguucaguggcauuaaguacauucacauuguugcacaaccaccaccaccggucucucuccaggacccuuuucaacuugcuaacugaacugugcacccauugaacuauaacucccuuccccagccccuggaaacccccaugcuauucucugucucuaugaauuugacuccuccagcaccucacauaaaugggaucaugcaguguuuguccuuugugacugguguauuucacucagcauaagguccugaaagaucauccugguuggugucagaauuuccucccuccugauugugguaggucugaugaucuuggaccaugucugcugaccccaagccucucacacauggaagccauggagagacugaggccaccuucuguggcaggcauggugcugagggccggccuccaugguguggagcucugcuccauccuagccuggagaguccuugagcaucacgagagaugagagcugccugacuguguaggggcugugcuaaggacucauaaucucagcucacauccucggacauaguagagaaaacacuucuagcucuuggauaugugccuuuuucaggggcaaccugggaguuugucagucccguaagaugugaaguuccagccugagaaauuaauuuggggugccuguguacuuguguauaaaguaaacaggcuugguccaaaggaucuucagagcacuccaggugcagacagguuaggauucugguuuauuuugaguuugcuuccuauaggagaguguccaggagguugccuuguucuugggaccucugcucaccucacucuugacaaauuucugcaauuuuuggugguauuaaagccaugagcagcccaacguugccuaggccugugagagccuaggaggaggggcauuaccgcugagcccugcugucuuuaggaucuaucauuugagguuucucucccuuuucugcagcugaccgcccaguucccauugcucccuaagccauuuuuuugcagauguugcccugcaucagaaucugcagggcgaggcugggaaaccaguuuaaauaaccacuuuguguguuuuuuuguuguuguuuuuguuuuuguuuguuuguuuguuuuugagauggagucucacucugucgccaggcuggagugcaguggcgugaucuuggcucacugcaaccuccgucucccggguucaagugauucuccugcuucagccucccgaguagcuggaacuacaggcccgcgccaccaugcccggcuaauuuuuugcauuuuuaguagaaacgguuucaucguguuagccaggauggucucgaucuccugaccucgugauccgcccgccucggccucccagaguccaugugauuucuaaccacuccauuugagaacugcugcuucaagcucugacuuuguuuccucuagcucggagcuuucccaggcaggcgagaggaaccaucugcuccuccuuggugcugaggcaccucccgggcaucugauucuuugggaaccauaguggcugcuguguccguaacagagcgguugagaggacacuaggccauggaaggccucuucuguggugaagcucauaccuuucaggacccacaugaacauaugcagacuaaaucccuagcagaaccaugauguguaggcucuuaaaggcggugggugguuggggaggcagagaagucuucugggaggagacagguggcacuuggcugccuuuucgcucaucacagagauucgggaggagccaugugcccggccggggcuccuugcuggcacuuucugcccauucucuauccuacuucucacaaugguagauaccauguccauuucacaguugaaaagacugaggcccagagagauugcgagguggcucaacuaaugagugacagaccuugauguguaggcaaggcagacuccugcugagagagggauggugucuuuccuucaccaagugaucuuguccuucacauucagagaggccgcuccaccagcaccugcugccucgugcggguggaaaauagggcuugcuggaggccaggcagggcucucaguguccuuccugacccucugguuugucuguugcugcagacugacccaacuauaguagcugaccugugucuuuauuaaugccauugaaccaagcuagcugcaggccugcaacgcuguaggguccaccugccuucuuugcuacaugggcauaugaauauauauucagagagauuuacagaaaucagaacaauaagaacauagagccuguaacugucugagaggcagagaagcuuccuuaggccuggaggcccuucauguuuaaaggacaggaaggggcaagacagggaaccggggaagauguuuuaugggucagucuuauacuuucagguuuagcuuuaaaucugucauguuucagccuugcccuggccuuugugcugagguccuggucgcaagggaaaggaggcagguccuguuguguggugcguggagcccaaguaccuuagggagggcuuguuggaguggggucaguaacuguggggucacccaggcccucucucccuguguaggcaccucccgggcuauucggaccacaggaagcccuguguucuuuccuccucugcucagcugcucauuucuauuucugugcuguguguuuucagaaucagaucauuuaaaaaaacaacuuuggacucggguguguuuucaucuuuacaugagccccacgagcaagguaugaggggcuguuaaugggggagguagcccccgcaggcccuccccaugcaucgcauucccgcggggucccuaggugcuuucagacuuuugguugagagacuucggucuuuaaguggaauucugcacggagucuuaauacaaguuuuaaaauguauacagucaggugcugcuuuauuugaaguuuuggaauauuucugaccccucccucaucaacaaccccugccccuggcagcugcagaaaagaauacacacugacggcugggugugguggcucacgccuguaaucccagcacuuugggaggccgaggcgagcagaucacgaggucaggagaucgagaccaucuagcuaacacggugaaaccccaucucuacuaaaaauacaaaaaaauuagccaggcaugguggcgggugccuguacucccagcuacucuggaggcugaggcaggagaauggcaugaucccgggaggcagagcuugcagugagcugagaucacgccacugcacuccagccugggcagcagagugagacucugucucaaaacaaaaaggaauacacacugaccagaccggaccaaccuccuucucugcggaauuauccaggugcccagaggcccagaucacagaccuguucaggaaaggcaccucuucuugugcaaucauuugauaauuuuuccaaaugaauaaauuuauuuuuuaaagauuucccaaaguagucaaugucuucaagcucuuugccaguggugacuggugaaugagcagugcccauguuuauaggugaacucucaggcacacggaggcuuguguucacaaggagaagcggcuggguccggagcacaguccauuggcuuucagggcuggcauggccacgagauuccagaaauugaagacaagccaaggguguugagaagguucuuccaggguguugaggauuuuuuaccccugcccuccacccgacuugacuuuucaggacacagagccuuagaugaguccccaucccgucuugauuuggucaugacaauugagauguugccuauuuguaacaaugaauuccuuaaugaaggaagguagauucuuggcuggaagaugaggucugaaccagugcgguggagucugugcgaugcucuuuucagcagcagggaguuggugggauaauaaguggggcagggagggcccugcucgacugagcuuccuguaggccacuuugccuuagagcaucuguggccagauuuaaguuauuuugaaacacuaaaggugagugagccaggucugggugcaggugaacccagguaggauggaaacgcuuccuaagugcugugaaaguagaggguaggggucauaagggaagcucagagcuguuugcugacaagugacacccacuuuuuuucccugaaguguaauuuacggugacucaugaaaguucacccauuugaguggagcacguagaggucggagcauucucuguaccuccgugggagcuucaagauggauguucucuggaaacuggaggcugagcuuuaagcccccucccuuccuuuugucauaguugggagguugggggagaagagcuaaugacagguccgggaagggcuugggacccagucuuauaagucucuuggacccggaacuguuaggcaggggcagguucugccuuugggagcuuucuuguuguuugcaccucugcccagaggcccaagugacauuucccacacugaaagaaucagggaauggaagccagcaaagguuaaucaugggacuguguggaccaaaaacagccaacuccugagggugacaguuggggguucccacugugaccugauccagaccuuccauuuuguagugaggaagcuuagcuagggggagggggagggagugacugaaccacagauguggacaagcagccgggucccuggaucuccugucccgacuuagagccugggaguugcccuucagggaaggaaagagggagagggaaguguguggggcaguuugaauguucugugccuccaguauuagauguucuguaccuccaguguuggagucauacguggauggcugagcccuguagagggaagaaguuggagcagaacgugccagagugagcaggcaaagaggaucagaggaagggaccucugcagguacugagagggcucugcaggucacccugggucauucuggagagccaagagaagacacagguuggcccuggccagacgcgaguccucccuguguuccuaacccgaggacaccugucagagcaugcggagcaccuugcccuuaacuuccacgaggaucucccucuacaggacggugagcgccucuaggcagcacuggugucugccugcguagacagggcacauguugguuggcuggcgaaucaggcagcuguccuccccagcucuuucuugcuugaguuucugauguaaagauuucagguaggccacucccaaaagucccccuucuuugaaucucaggccgcacugagaggauuuggugaccucaggugcccagugagugccuuucugucucaucaggacugucccgugcgcuuaccuuccuguuacauaaguggugagucaaggacacaaaaugggaauuagcugccagccuguguucagggcuauaaugagauacccacauucucucucugccuucccuguguugccugaguggagugacugcuggccacccacaauugauuaucaaggggcugaagagggguuccaccugguuauccacuuaggugcucucuguucagacuuuugccaugugcacagcucuuucagugauggaaggugaugggagcggcgagagcugucgugaggguaaagggguuucuguggcccacaccccgcacuggggaggcagccaggaagaugggcugugauuggcacccuugcuggucuaucuucagagcuguggguggacuucucugcagcagcugugacgguacccugcagcgugaaggcucgugauaacguacugggcgucucccucccacacagagagaaaugacuuuagauauuaagaaagugaaaagcuuggaauaguugguuaggaaacuaauuaaguaagagcggggaaagaagugucaaaaaaagucauuucaugggaggugcaacagaaaauauuuaggguugaaaaagcaaagccacauggcuggugcuagugucuucacguguuugugcagugcucacacacuugcacaaacagggcuggcagcauggagccagacugcaaagucccccaggggcacaucccuuccacucucaccuuuuaggcuucccuugcucugcccccugcugagauccccaccugccuggccaugucuuuugccuggggcauuccuggaaaauauaucauguccaaaaacagucugaugagcugauccacguagggcaccacuucuggcaggcaauguaguauguuagugucuuagccucuccuggccucugcaagacuguuuuucagaaaaaucuuuucuuuggccgggaaggaaauguucuuuaugguggggaaaacucucugaacccggggagcaguugcacuggugggaucucagagaugcaggucagcagcacagggaccuuaggaaggagguguccuucaccuuaugccauguacuggccugagggcugguccagcccacacacaggcacggaccagucacuugcaaacaccugcccucagugugucagaaucgaacuccaggguggcuuccuuugugggaggugccagucacagcacacaacauggcagguguguuuguuuccuguggccacuguaacaaguugccacaaacuuaguggcuuaaaacaacacaucuuuguucucugauggcucuggagguugagaguccaaaaugaguaccacuuagcuaagguccagaugugagcagggcagcuuccuucugaggucccgggggagaauccccucuccacuguuugcaggcuccaguggccaccugccuuccuuggcucguggccucuuccugucaccacuacagucucuugcuccugucaucacauuuccuuauccucuuugucacauuuuccucugccucccucuuagaucagaaucuggaugacuuuuucuuucauuuuuuauuuuuuagagauuggguuuuuuuuugucaccuauccuggagugcaguggcgcagucauagcucacugcagccuugagcuccugggcccaagugaucuuccuaccugagccuuucgaguaucugggauuacagaugcuccgguguugagcucuggggaguucagcagggcuaaguaggacuugugggggugcugcuaggugugagguguaggcgugagaaacggggaaaggaagauggggccaccagagacugcccugauggaugacauagucaccaccuagguaucagcaucaccccacuuccagagcauuuguguuuucagugugaagcaggaucagggaaugucauugcuggaaaggaccuggaagagccagccccguccucaguugggggcgauggagaaguggcuuuugcuccgguuggggcaguguggagccuggcacugcagagcuuugaagguuucccugacucaagucagcguggaagcugagccccucaauguguagagcgcagcagacacgacgccuggccuccuguucacugauucaaccccagggggagguggggagacggaaaagacuccuuguccuugagcagggucgucuuguuggugagacugguuuuguguuucucacgugugaggugcagacaggcaugguguugcagaccaagaccuuggggcacgaaggugaaggaacagggacagagcagguggaggaggagagagacucccuggagccacaaggcucugaaggacugugcagucccagcugugaccuaccuccaaccagccgcacuaaggcaggcuugucccgcaggggcagaagggucuuacggccccaacccguccccuguccucauguagcuaaugcuugcuuuugggcuucugucuguuccucugccucgauggaagggugguagaugggcugcuccacaaagucuaauaagcagugagucauugucuuccucugagcccaccaggguugcaccugguggcuggggaaugcuuugugaugcccagggcccagcugagaagcagugguguugggguucaucagugguguuggccgucugucugcagggugcaguggcugucuuggggcaaaaguccaaggcucacuuccucuggacacugaguacaguuuuuggaaccagcaagcgucugugaucaguguagagguaaaaagaaaucacacacaaaccacagugcuagcguccucacuguguuugcauuuaauccugaaaauggucgcaugaggagagcaguaacuugcccaaaaucaggguuuuucugggcgaucuggggguuuugcguugagccacagguuggagaccugguggguggagcuacucuggcuccauucccauucugugagcuggggcccagacacgcccuagccugaagguuuuggagccuuaccugguuaauguuugaagaucucggcuaugccaggauaaacuggagcagguauuuacaccucugccaagugaugggcccuaacgcugucagguggccaauaccuguggagcgugccggccacaggggaacacagggccaggaguccucuuggcuucaucccccaagacagcugagguuugaagaucucgggggcgguuggggagggggugggguuugacuugcaccuggauauggaggacaugcuugccuggcccugacuuccaguggguuuucagcaagagacccaccgaggacgaccauauauucuggucccagcagcggacccagaggccguucuagcuguaucugaaggggccaugagaacgguaggugugggguggucugggaaggagggucuuuggggacaucaucuaguccagcccucaccuuugacagaugaggaaacugagacccagggggcaggcaggguccccacuaucacucccaguaggcuucagagacagaugccgcuugcuccgugcagcaucccucccugcccggauuggugugaacagggcaguugucagcgagcagugagcgaccaagagagacacuccucaaggcucagcccagcagaugcucucgugcguauuaggugcugggugacugggggcugaauggaauguguuguccagggucaugcggcugguugucccagaaccauggcuggacagccgacccuuuuccagugcccuuuucacuacaucacaucccuugcgguccucccggcccugcuuaaagaggcaggguuggugcggcucucccucaggaaaaaccgagggugcaaagaauggggagggugagaggcugugaugagagacauggacuugcagugggagaggugggauguguguugcaagaacgccuuggguuucuuguuucuuggggccuccauuccgagauggagaagagaauacuauuugugcuccacgagaaaagauuaggaaaacagccccacuccaguggaccuggcagcauucuauauaaacaucgacaucugggagagagguccaguugaauauuguugcaaauggacuugugcucuuuuugggugaugcuauggcgacccacacuagaggagggugcuggagcccagcgucaggccagggcccucugugggaacaaccccuuaacucccugggcccugccuggcuugcuuuguuugacugccuguaccaucuugucgcuucuuccaccauauuccccauggcauccucuccccacuccaaagaugggugguguaagcccuacaaaguggggcagauggcuagagccacaggugucagccucauucacaucauccauguggccagacuucagcuuccucuuucucauggucugaggcguguuauagucguguuaaauguccagcgcuagaauuuuagggaaggggaguggcugugaauauaugucaggugcacacuguuuggucaucugcuugacuugugcuaggcacugugaugugcagaauaugucauugugacagcugcguccucgagggucagguuagguagguggacacuucuaaucuuuagccccucccuucuuaguagagugggagugggggacggagaggccagagcccaguuggugggaauucccgaaggcuucccucauccuuuucuuucuccuugcuugcuucuauucacguuuucugucuccugcagcccaugggaucagacccugcgcugagcuccuucacugugugucuguugcugaaguaaaugcaagcccuguccuuuccagagcaggaaaggggaguaaaguuuuccuccuggggucauuucacccuuguucucuaucucucucucucucugucuccuacagagacucugcagggaaacacagguguagguaaugucaaaggacauccaacuuguguucuaggaccacagccucgcccuucugucguggcccccacugggugaggagagcgccccggccacaccaggggucaguugucgauggaaaggaauagacgugcaagugugcauuuacuguuuguucugucacuuaccagccauuugagaaguccugggugcugugagguggacugugcaguaauuugaaggguggggagggguaagagggcuguugcauagaagucuagccuuagaguaacacauuugaauuuuggauaaacggguggcaacggccaugcugguuuccuucauauauuguuagccuuuuccuggcugggaaaaaagcauuugccuaauuuuagaacacaucagucauuugguugaaacauccuauuucccccaaagucaaguguuugaauuguaacaacuuuggaggcuuggaaaggaucuucgcauagucccugcaugaacucuccugcauuggaugcccugucugaggaguuugaccuaggaguuagggaaacaaucuuuauuuccaaugaagaauuuuauguauaaacacaccuaaagagaaguguaaaaugcuugaccugaggaccuugggagcagucucucagacccuuaaaacuuauucuguauucucauuggugugauaguggggcaguaguuuguuguuguuauuuuuuccggggcagggggauuacauaagauuuacccauuucucucccuaucaugcaauaguuacccuuggaucuuacugugcucccugauauaugugaagguugaaaaugggccagaugggaauuuuaaaggcaaugaggggcuuuaauuguuuuuucaaaauaguguauguacaguaguucaaaaagucagauauguaaccacaaagcuuauacuaaaagaguuuucugcuccauuucuucuuacuccugaguccuguucccagaggaagccauuucagcucuucuagccagaauacuccggugccuaccucuguguuuguaaauaacugguuuuuacugcuacuucuugaguuuuagaagauauuaucuauugguuuuauacaccacagauaggauuuagcucuuucaucggccuggcuccuugcuccuacccagcuacccuuguuuuuccugguaauguuacucacagagcuggccguccucacguuccagacugacucuggcuguccucuggaccugcugcauagcucuccaucugggcuugaccuuccccaucauccugggaagccucucucucuuucucucucucucuuccaccuucucccccaccuguuuuuuuguuuguucguuuuuguuuuugugggguuuuuuuugguuuguuuuuugguuuuugguuuacuucacuuggugaaaccucuugagaaaugcacagggaggaaagguuuuguggccuugccugucucaggaugccuguccugugcacacucuugaccaggagcuggacuggcuguagaauguuagaugggaccuaauuuuccuuggaauuuugaaggugguguucauuuuuuaacuuuaucauugguauugagaaguucauaugcaagggucugauuccugauccuuugcaaauaaacugaauuuuccuuccgaaaacuuucaggagcuucucuuuaucccuugaguucuaaaauuucaugaagauaugccuugguguggauuuguuuuguuuuauuaagcuagaggcuuguguauauuucagugugggaaguucugaccuucuaguccagagugugucuuauauuuucuuccucugguaauuucuuucuuuuuuaacucaucccucuccucucuucacugucuuuuuuuuuuuuuuuaauggagucucgcucugucacccagguacaguagcacaauguuggcucacugcaaccuccgccucccagguucaaaugauucuccugcuucagccucccagguagcugggacuacagguaugugccaccaugccuggcuaauuuugguauuuuugguagagauggggguaucgccauguuucccaggccagccucaagcuccuggacucaagcaaucugcccaccuuggccucccaaagugcugugauuacaggagugagccacugugcccauccugguaauuuuuuuuuaaaauuuuuccuggucuuuacuucugaaacuccuguuauuuggcuauuacuccuucugacucgauucucuaaguuuauugucuuuuucuguggcuucguuuugccugagaucacauuaaccuugccuucuaacccuucuguuggggucugauuccaccuauugaauuguuaauuucuuagagcuuguuuuuuguuuuccguguguccucuuuuguagcauccuguuuguguuucaugggugcaguacuuucucuaaucauuucaguuauuuugaaguuguauucugucucuggucugacuuucauucuccuaguucccuuucuguuuguuauggucuugggcuuucucgaaugaguggcgacccuucagaaggaggcuguguguguauauggggugcguguaggaauaucgacuggcaggcuuugccuuagaaggacaggcaggcagggcaccaguuuguuuugggagagacccuagaauguccgcacguacgagcccucucgucuccauuacauggagaaugacaguuuuaggaggucuuucucuugggcuuguugguuuccccugauaggaauucucucaucuccaaucuaggaagaccugugggcagcagaagggcuugggaugagggacucaacuuuuaggaugcagacuuucuuggacuuuuccugcuguuaguccuucaccccuacuuccccugcccccucagcugugccugcugccccugacucuaggggcccuccuagggcaacccuccgugcuggucaguauauaggauucucuggccagagccaagcccugggaucugccugcccuuguacgggugcugaucaguucuccugcucucagcccugccccugcuguuggaguccccucugcccccaggcccugagcuuucuggugucugcagcagugccagccugccuccuccuagcuguccucaggaagcuucuuccaugccaccaggccacuuuccauguauccagccacuucccacucaaaguuuacuugauaucuuauaucugcucuugucuccucuccagcuuuucauccuugagaguuuauaccucccccccacacacacuuuauggucauauuaauuaggguuuuagcaggcaauugaacauucugguguguuaagucaccuguguuuaacuggaggccccucugugugucaggaacuggcccgcagccugucgacacguguugguguccaucaugggcauaucgugccugccuuguacccaccuguuuccaugccacuguucccuguccuuucccacacuguccccugugugggucauauuguuggucugggccuguguagcucuuugugcuuggcagggugugugugugugcagggugugugugugugugugugugugugugugugugugugugugugugugugugugucucagagucaaugcacaugccugccaggggaccuguguguguuggcauccugcauuaaauguaccaucuauaauuugcuccaguaccuuggagaaaauuuuaugaggaaaagauacuuucauaaauaguugaaauuccagauucuucugguuggaaacccaaggguuaaugaugacuguuguuccagaaagguuggagggagaggagacaguuuaucucauuucccucuggugaauaaggccauuuacugauggggcccaaucaccuaccugggacuaacaauaagacccuuguuguugacugggcagguuccacagcugauacuccggcugccuugagcaauaccaucaggcagaucuggggcucagcccuguccuuacccagggccucagagcacuaauauauuuuccuuuuccucacuccagaugucuucccagugacucuccuuggggccuggggaaaccacaagggagcuuggauucauucacccauugcugccuugcugugugccucagaggggcucagagguggaaaauaaauaugaaaaagcauccuugucuucuagaaucucgucggcugcugggaagaccaaggggccagccaucgcagggagcauaagcacugagacaggcacacgugccugcccggcuaucguagccaggcuggcagccuugcaacucccuggggaagaacaaucuaggaacauucugggguguggagcaggaagggagugucacaugcaaaaggcaggaucagccaaagcagaggggcugaagaagcagugauucccccaccuaaugucagaaguaaaaucaguucauggugaaaauuuggggaaacaaaaucaugcagcaaaauugccuauuaaaccccacacggagguaaaaaucgguucauauugugguuauguaucuauucucuuaugauguguauuuaugugcuuauguaagaccuaaaaacaauaauuuuuaaauaaaccaguuauuuuuaauaagaauauucuggccaggcauggugguucaugccuguaaucccaacacugugguaggccaaggugggcggaucgcuugaagccagggguuccaggcugcggugagcuaggauugcacuacugcacuccagccugagugacagagggagacccugucucuuaaaaaaacaaaacaaauucuaucucacaauuccuuuccuauccuucuaugcauggucuuuaauagcuacaccccauuccauuggguggcuguauuugauuccuuuauucuguacuuucggacauccaaguuguuuucagauuuuuacuuuuuuaauaugaugcuucagagaacauuccuggaaguaauguugccagugcagaggugcaagcauguuugagacagcugauaguuaccucuguccagaacuggcucacucccaacagcagcaggaggcacccagggucucucacuuuccuuucaauuuuccuuucuccacauccuacccccagauuugucugacuuuuccagaggcuauugagagaagcuuuuugagugaggcaccacacagauguuuaagacuaaguuuguggucuuugagaaccgagguagccugacccauuggaagccugcagauaauugaaaaaaucuuauuuuagauccugugucauucuucugcuaucaaaccagagccagcagcaaaggaagcugggggugaugggccuucauccaccugccauguugccucccugcgcugcuucugccaagagugggcugcuggggguguccugcuggggccaggcaccaggguuccaaugccaaguaguggcauucacgcaccuuuugauaagcgaggaaaccgcuggcagcaggaagaaagguaaagcagcuccagggagcucagcgcucagccucaaccucuuuccccagaaccugcgccugcccacuccaccuccaaggccccucacucuccaccacccauuuggccuuuuggaauugggacuggaauuguuuccagcuccagaaggccccugccugccuaauucccaugucucuaaaaauaucugcaagccucuucccacccaggccuguccccacagagcccacuucucucccccgacccucggcuaggggaggaaaugagaucucccucucuugacaggauuagaacggaauaaauacgaaaggcugaguuuccagaguugaaaggguagggcugccuuugucggguccggagggcuggcguggcaucggugcaggcccacacucggaggagggaauccaggagaaagaaggaaggggaaaagagcaagaaccccuuucuccccucugcauaugggauggccaagagaagccaggcccugcuguggguccccggugggaaagaagcuggcucccagggcucccaagccccagccacgccuggucagcacaggcaaaaggagucugugggaagccuccaaccuccaggcugccugaggccccuggagcuuucucaggcauuccuagauugggacagagccucagaccccucccugccccaccccccagcauuggaugccugccuaauagaggcuuuauuuaucuccacauuuucccagcucuguauaaagagacaagcacgugggugaggccuacagauauuccaaaagcaggggguaguggggugggggaugaagaauacgcaaggaucugcuuccaccauccccuagaggggcuuuggagggaggagggugggcuagggcaaagggucgaugugcaaaaggcuucuuuucuuucauuuuccccuacucagaaacccaaaaauagccaugucaaaggcacauacauugcaaauagcagccgagaagagccagcugaaagccauuugcuucucccucccuccucccuggacacacuccccguccucugcaguccccuucuuuccaggcucuugcugggccaaccaguccugcagccuuguaggguccagcaccucccuauaggguuacugaguugcaucuaaauucacuuaauaggcggucacagcuuuuugugaaaacccaugaggaaaugugaaaaguccuccuuugguucacuuuucuugcaacuuugaauuuuccuacuaagaguccuuaaagugaagcaaaccuguagcuaaaauguagacaagagccaggcacagugacucaggaggccaaagugggagagucaguugaggccaggaguucaagaccagccugggcaacauagcaagaccgcugucucuacaaaaauuuugaaaauuagcuggaugugguggugcauaccuauaguccuagcuacuugggaggcugaggccagaggaucgcuugagccugggaguuggaggcugcagugagccuugauugcaccacugcagucuagccugggagacagacagggagaccccaucucuuuuuuaaaaaaaauguagacaauaaaaaauauauaaagauuggauuugaucucaagucaagaggaguggucauaugcaagagaguagaugccaugaaaauggucugcugucccaaguguuuuucccaauuauaaaacuaacauaugucuuguacaaauuuuguaaaaauuauacauuuugugaaaauagguaagcacaaagaucaaaagauguuuuccaggaagaaucagaugggacaucuccaccugaugucacucguggcaggcaaggggacacuuauccuugugugguggucuccuccugggauggcgcuggguggggaggcccaccuuuuggagguccuuugguggcucugaccaggcuccacccugcacuauagcuguccuggacggcggguugaauagaaggguacagauuuagaauugacuuggaaacacguuaauuuggaagccuaccuuccccauuccaaagagauucugacuugagauccaagguuuccagagcgccucaaugcccuuccugaaucaccaaguucagucuggcuuggagagcauggcacggcugacccagugaguccaggguacagaggccagacucacagcucauuucaagcugggcuuuuucccccuugucgaaccagucaaaacaaacgaaauuggauuagucugucuucaagcacuuugucagaaaauacaugaauugguguguguguguguguauuucaguucugccaucuguuggcucagggguccccagugcccaggcagguccauggcuuauuaggaacugggcugcacagcaggaggugaguggcaggcgagcuagcauuacugccugagcuccaccucuuucagcauuagauuuucauaggagcgugaagccaguucugaacugcacaugcaaggggucuagguugugugcuccuuaugagagucuaaugccugaugaucuguuacugucucccaucacccucagauggcaccaucuaguugcaggaaaacaagcucagggcucccacugauugauucuacauuauggugaguauguaauaauaauagaaauaaagugcacaguaaauguaaugcgcuuaaauaauccugaaaccauccauccauucccuguggcccuggaaaaacugccuuccacaaaagugguccuugguaccaaaaaguuuggggaccacugcauuagcuaaccuugaacaguuuugcaaucucacuaaaccuaaauuuccucaucuguagaauggggagaauaagaacaguuuuuuaggaugacuguggauuuaaaccagaacucaguggagcgcuauauccugucuucucugccacccuucugcuucacucagggaauuuaucuuaagaguuggggagaaggcaggggaaccuucugccauguccugcuaugcuuguguggcccucugagcaagggagagccuugcuucacccucaauaaaguaucuuccuggucucaggcccagugacaccugccaacugguuaagaagcagaguuuaacauuucaguaauguuauauccggauauuaagaaagaaaaggccgggccugguggcccacaccuguaaucccagcacuuugggaugccaaggcagguggaucaccugaggucaggaguucgagaccagccuggccaacaggaugaaaccccaucucuacuaaaaaauacaaaaauuagccagacaugguggcaggcgccuguaaucccagccacucaggcugaggcugaggcaggagaaucgcuugaacucgggaggcagagguugcagugagcugagauugcaccacugcacuccagccugggcaacaagagugaaacuccaucucaaaaaaaauuuuuuuuaaacaacaacaacaaaaaaaauauauauauaguuacuucaaagaaaaaccuucagcaacauuaaacaguaguguagacagcagugaggacuucaguuguguauauauuuuccugccuggggaauuguuuccugaggguagaguucuagaaauagaauggaaaaggcccguaggguagguacugcuauggcuccuguggcagguuugcagacugcucaggcagcugcaguucaagugcccuuuccaggccaugggcugccuucaagccaugcccagaaagccugccugccuuggcucuacauccugauguccaggaggucaggcuuggccuaaaagagggcuggcuuacccuuggcucaaaugucacccgcagggagcugggggcugaggaagaggaaacguccagguggguguaguccucuggcuucuaggcuuuccuuuccuaucuucauuuuuuuuuuuaauuuuuuuuauuuuuuaaaaauagagacaggaucucccuauguugcccaggcuggucccaaacuccuggacucaagcaauccuccugccucggccucccaaaacgcuggaauuacaggcaugagccaccgcacccagccucccuuccugucuuuaugggccacuccugucugcguuacccauagucaaggccaggccuugggccaggaagggggcuauaccaucagcuccccaaguguacaaggcccuugccucuccuuuggccuacaugagcaccugccuuguacucuauguugugccaggcauugugggagaugccaagaaagccaaucccucugcugccccuucagugcugagacaccugggccuccaaagggcuggugcagugcggagcugucaggcuuucuucucugccaggucauugugauggggcaggugaucgucagggcacguguggagugugcgagcagguccacccaugacuaguggagcagccuuggcuaagccacuuucucaccugugcaguggugacagcccccuccucagggucauuaaggagguagugagauggccaugucucaugucccaugcgcuugguauacacacccccaagagaggccaggccugggcugacacagguaccccucacucuguggcccagguggcaucugcuggcagcacacccacccucccugucuucugcaguuccagcccagcuaguggacaccuguccacagaggacucugaaggaaacaucugaaagguuagggcccugcugggcaacguugaggucgacacuguggacaggcagcuccauguaauucuucuuccugcccuuacccagccaaaccugcacccuucuggggguggaccucuguuugucccguuuguaaccacuucugucuggcaugggcuccaagaguugaugcugcaugcaggccucauguacuuugacacaagugugagagugcuggggguuggaagacucaugugugccagccuccagguacagcuagccuguuuccuccaugccaaggccuugucucccuugaggcagaguggugugguggagcgaguacuggacuaagucagaaggcccaggcaguucaggcagccacagauuaagucacuuccacucuggccauggggucuuuguaagaugaggagguuaugucagaugcgcucuggugaaaguauggaaaaaagcauuggugacguguggagcuaaggaggucaggcuugucaccaggagcuggcccuguccccagccauguguccccaucagcacugcugggaaagcagcucagaccccagggccggcagccgugaggguaucuugcaguggcucuuugggagcagcggcugcuauuuuuaguaagcugccuaauuggagguccugguggagcuuaaccagcucaccuugugcuuugauccuucuguuuggccuucucuuuuuacguggaaagagcugaaguucaugcccugaccaaagcagauuuguuuuugcaggagacggaggcuuuugcuguuaaaaaaaacugccccuucccaggccccugcucugucucuuaaguaauuuccaguggguugucagcauugauguugguuccuuccuaauaagaucucccccuuuuaucugcuauaucaggacaucaggggugggggcugaaaagaguauugaaaaagauggaagcauuacucucugcaggaaaacagauugguuuuaaaaaugcuguccuacauccugccucagaugauggcccuucgcacaugauuucucucacuuuugaugcccucacuuuauuuuaagccgaagaaccaaaccuucgaguaaagccucuuuguuccuuuuuagcagugagauaucuccuaggaugggagaccagguguuuucucgggaacagucaucauuuagcuuuuucccaaaggaaaggaacucugugugucccugguggcucugggaauggcgugugagcccauuuccucaggauaaaacuaagaugguaaugaauaaugucuguuugauuugugucagauauucaugugacacagacacuaagugcucguaaacacucucaguuaauucuugugacagccuuuagggaauaggccucaugcuuaccuccauuauacagaugaggaaaacugaggccuagagagucugagucgucccacugcuaugugaccaugugccugcaccaucuaacauggugccagcgcuccugauguguggacgugagugucuguuuucuggaugugcauacagcaguguaccaggcugcaugaccguggggugcugcugcauagaaccuuuggccaugagcgaguuuuuggugaacuaacagaauucauuguccccuuccugguagagaauugcuucuguguccugaggagauguggcaugaagggugggcaaggauuguuccugccagcuggguggccgugucuuucauccuuccuuccucccgaccaguccacggcuguguucaagccugguggggagccgugaaggcagaaccguuucuccguccuuccuuuugucccugucaccuuccccuggcugcuagcagaguaccuguccugugucacagagagacagagccccaauuguuuucuuuccgcugcgucugcuccuugccucccccucagccacccacgaggucucagugcugugccagcuagcuugcugcagggagccgcugccucccuucggagcacccacgcuuccagucucccuuccaucuuucauaaaagcaugggccuguggcucagugguaugggccaccagcuuuguccuuaagaccccucuucauuauuucccugagcccacucuggggcccagugugggcacuuguucagguuucucuguugggauucuucuugguuuagggagggugguuggcaugugguggaguugagaggggccuuguugcuuccaggugcuuugguagaguggucccagguauccacugggcguguuugcugcuuucuccugucuucccugucacaguccacuuuaggguuauauaaaccacacacagaagccuacaaauagacuuuuguuguucauccucaaguaggcacuaauuccauucgauggaaccugggaugggcaucgcuuucucccagggcagggagcacugccugcugucccacagcaugucucacccacccucgugguggggcaggucgagggcccaacagggaugcucuugggcuuuuucacugcaggccucagccagcacccccaggcagccccuguugcugcucucuggccaacagucuccuaagaguccaggguugcccauugcuauuguggggucacauaucuuucuacauccauacuccuagggaggcggagucggucuugaaacuggguggggaccccuccauucccccgugcuccucuugacuggggcaguacuguucucgcccccuaagaaggagguagaggugaggucccuguucaccuugucuuggagaccagucaagacaggaaagcucucaccucagagauggaugggucccuuggccacugagucaggccacugaggcagaggagggcaggcagucacucacuggugguggugugagagacgcugucucugauuauccgacguccuguaaugagauacuuuucagugagggcuguucccuggaaacagugugacuccaggacuaugggaagggggucugauuugggcccuaauuccagcucagccauuaccagccugguggccuaggcagggccuuccuuucaaggauuugaucuuuauaauaguuuugaucuuuauuuaggguuaggauuagguuaagguuuugaucuuuaaaauaguuuuuccuaccccauauaggacaucugccacucaaagggaggcauguuaaagaaaccuuuuauuguggcaagccguaagacaaaaaaacaugugcaucccagguucagcuugaugaaguuucacagauuaagcacaccuguguagccaguaccaugaucaggaucuuccugagucccucaguggcuuugagggaucucagagcacggcaucuccaggugggugugggagcuuguccagggcgaagugucugcaguguugcagugaggcacgggguggccucaccaccaugucuuucucagcccugccggcguccaacacagcagaggugcucaguaccccguuuucuacugagugacugaaugggugaaaggcaacuggauuccuacacucuuggucuuuuccagggagucugugucuugguguuucugcugcuucacucuuuguggucgacuuguagaagccccucugcccagaggacuugauccugggcaggcagcagcaggaacacaccaugccuggcgugggcagaaccugugaucuugaaagaguugagccuccaccacuucagagagagggcagcaagagcgcucuggagccugcccuccacagagcuuggugcuuugagaccuggacagugcccaccagacagaauccacauaguguuuccucuccuccuuccagaaccggaucuuccugagucccucaguggcuuugacuggugaaggcuggccaggccugcuggagagauccgggaugcagagcuguuuagucugggaggcaggucagucucagaggaugggugggucagggcugaacacaaggaaaaaagacgccacacauggaaggaaaucaccacuaugccaucauaacugaccaacuacauuuucccaaccuuggaaggacaagguaggaguggcaggcuagaaggauaggucuucaaacaucacuguugaugcaaagcucccauaacaaguuggauuucugagaagcagauugggaauucccagugggagagaggcagaugagagcauccaagauaacgacuucuuucccagaugcuggccuuccuggaaugcuggcagaggaucucaguucuuaauaauuauuuuauuggguggggaagucuuuggaagcagaaaauaagccaaagaggaacuuaaugucauaccccuuucucaaggaaaguuuuaucuacaacacauuuggucuauucuuagcuucugcuccuguccuuuggaaacguagccuggagggugucgggauuuaaugggcucuagcccccugccccucccuuuagagugaggggguggauugguguuuguggguuuucucugugaaucaguucugagaacaccagagagcuucuuucaggguucuggacuuacugccaggaggcccaauuccucccagugacaaagucacugaagacaagagucuucaggaaggagccucagagccugggcagggcggggacuucaaggcugcugccagguuuggguagauguggggagcaggagccagacagaggcugggugcuauucagguugcuccggcaucuggcauuugggcacaagaccuguccuuagaaggcuuggggcuggcaggugccuugugagccugacacuguuggugcagggagacaccugcaucaucucacgcagcagcuuccucuggaguucaguguccuggggcgcaacagggagggcuguggccuggccuguauucagguggauuuggcacacaggcccaggcugguccugcacauccccugcuagagagcaaucccuacccuccuuuguccccuucgugucugagacucugauggcgggggaaacccagagauuccuguugugcauugagcucguucuugaguucccaucucucuagcugguuuggaaucuuaaguuucuccccagcaggugauuugaaguccuuugggcuuccagcuugcauggguuccucugugccugccugcugcccucugugucuguaagugguuggcaggaaggugcaugugugagaaccuaugguaugcccgcuuagggccagggcugcagagguugcucgcugcucaggggccugcccggagcccuggccacaugucccgccucacauaccugcaagggccauuucccuguagauagagcaguugccugacacagccaccaccucucccuuuuucccaggccugcuggagaaggauggcccucccuccugccuugucccucaggcugccugaggguuucguuuucuuguggcuggcauggccuuucaggguacuguccccaagcacuuuaugaaucauaaucgcagcuccagcauguccauucacccccacugccagcaggcucuuuacagcugcauuuugucuccacacucuucugucuuucuuugcuuucaucaggcccucuuuggcccagcaaaaagcuguaagugacuuaauacagcuggguggccagccugggacagacagccaucggagccaagccucuggcaucaaauauagaucaaggucucccuuugaggcagugguucccagccuuggcugaacauuagaaucacuagagaagcuuuuaagaauuccuaugccucagcccuacaucugagaauuuaaaucugagucucucucugggcauagaaccucuauuuugaaaucuucccaggugauuacauuauucagcaaaaguuuggaaccauugcuuuaagcucuaaaaccuuccauuuuaagccagcuggccuuugucucuagccucuagagaggucugggcccccugaagcugcuucucccugcuguagaucccucaggggugaccgggagggugcuggggguggggccgggugaauguuaugggccucacagcugcauugcuuucagucucacugcagcaaacagcagcuuguuuucucuagaucugccuggcaggccuuugggcagaaaaggcaguuacaccauguggcauggcagcgcccucucccucucaggcucaggcagacuuggagaccaggcaagcugggacacaggaagcuccaucugaagccaccaguggcagcacuccgcccaccuguaugcuagcacugccucuucuccagugcaacuucucccgccggcuguggugcgcagauuucugaaagcgcucaaacaggcugaagggcccuuagcccccuucucucccuuuccuucuguguccucuccuuacccucgccacuuuguuccccucccuucuuauccaaacaugccuuggaaaggucucaaaaacucaugcugaagguauaaaauauucaaucaguauccguucugcccacugcugagcucguggguauauggggcaccguugcagguucuucucugagaauucaccagagggacuuccagacagugguguaaaagggagugugcacuuuugcaguagaguggagucugcaagccaagaggccagaggagccauacauaggcucugugugcaagggaaagcaguucucucacacgaguacugacacuuuugagaccacaaugccuguguacugggauucaacaguuaaguaaauggacggcagguggcaggagccacuguugcacacagugacaaggaacaggcaggcaagggaaggaggcuagacugauccacggaggugcuaguguguuuaguugauagagacuuuaauaaagauacauaaggauacagagagaaguguuuauagauaugugguaugcccagguuauauacaccucuauuuccuuguuccauuagcggagagggccuagaagcugugagacccgcgaaacaaugagcacaccugccauccagaucuugauuuuuaauggcacuuuccaauaaaaguaaaccagggcuucuggaggaaaugaucaauucuagggcuggggcgggaaauauacccuaaagguacaugaagcaccuugcaaugccaggaagugcuuugaggcugcacaggugcacaugcggaugggggugugucagggggacaugggagccggcugaaaagcucccaguguccaaagcuggaacacuuugagcaacaaaauaaauacuguaauguuggauuaugguguaguguggauguuuguccccuccaaaccucacguugaaauguguuccccaguguuggagguggggccuaguugggaggcguuugggucaugagggcagaucccucaugaguagaucagugcccugcccugggcggggcagcaaguggguucuugcucuguuaguuuccuggagaccuuguuguuaaaaagugccuggcagcuuccuucucacucccgcccuccucucugaccaugugaucucugcacacaccagcgcccauuugccuuccacccugaguagagcagcacaaggcccuccccagaugagauccccaaucuugaacuuuccagccauccagaauugugagccaaauaacccucuuuuucuuuauagaugacccagcuucagguauucccuuauagcggcacaaaacagacuaagacaagauauaaaauccacaaguccguauuggcauaaggaaaucauuuaguaaagaaauaaauaaaugggagagaagaaacaaaauguccugugcagaauuccagguuauuuaugcagcuacuccuuacuuaaggagauggccauagcuccccacuccguguugaguggugacuuccuuccagagagcacagggguggggagcagcucugcagcagagaaacugacaggcacgaccccagccaggcacuuaaggucaucaucaacagugaucagucgugaagccuuggaaggaugggaagagaagggguaucaccucuaugguuguccucccuuaaacacauaaccacagucuagucgugagaacaacgucagacaaacccaaauugaggugcagucuacaacacaccugaucagcacuccucaaaaccaucaaggucacccaaaacacagaaggucugagaaacuguugcagccaaaaggagccucaggggacaggacacuuaaugugaugugggguccugagugggaucuuggagcaggagaacaguagaugcaagcugaggccaccugaaucaaguugugcugaaugaggugugagcuuuaguuaauaacaggucaguauugguuuauucauuguagcaaaugcacugcacugauguauuaauaacaggguaaacugggugagagguguaggagaacucuucacacacucuugucuucuuuucuguaaaugugaaucuauucugaaauuaaaagguuauuuuaaaaguuuaaaaaaaaaaaccaaaaaaaaaagaaaaaaccucuaggcacagugucgugggagagcccuguuucacaagggguagucccaaaaaaaaaaaaaaaaaaaaaaaaaaguaccauagagacucgaagagagaggaagccacuguaggccaggcugcuaagaaggaccuggaaagcaggugccaguggccuugcccuugaaggacagggaagaccagcacccuggccaugaaggccccagcagguguccugaggcaggaccagggccccaggucaugagaggaaagcuaggaagugggggcucagcagggagccucaccaggggcuuuuucccaucuccccugcagccugggcaccugccugcuggccuguguguccaggggggucucuguuuucugcuucugcugaggagggagaccuggcaacggguggccccugagagaccaugcuggggaacagcuguggagagugaagccagcgucccucuugggaccgcauguucuguuguaggacuuguucagacucuucugccuguuaaaccgaggcagcaggaccaagugggaacugcggacugacucagcuguuacgggcgguaccaacagcaggcagucuccuaccuuccugagugugaugucuggucagaccugugcccagucucccucaagcgggccgccuuccccagcacugcccacucacucucuguucccaggaggccuuucccaccauaucugcuggcuucucaccgaggcccuuccccacaugcuacccacccuggcauuuguuuagcuugcccgacugcuuggaagggcaaccguccaggccagguuucaucaguucuguucauugucgcaugacagucgucggcaccccacagagcagguguuggguaaauauuaauauuuacgaggugugcgggugcugugggcagcgugguccaccuugggcaugcugcugcgcuuuuccaacuggugucccuguguaugcgauggcagugauacaccucauacuugcgggacagaacaugccugugugaaaggccuggguaacggcgcuuucuuaucuccagcugagcucugucucugcccucccacuccuugggccuagcucucucugucgggaucucccaggacaagucucgagccuugugccuggggccaccuuuaagacaucugaauccuccaaacccggccuccuugccccugcaucccacaagugcccaucucacagcagcuauguaugcccucucuuccccccguaucaugaagucuguggcaggcaccaugucuuccucaucacugugaccccaagccugauguccaguagaugccauggaguuaaaggauuugggggaugguggcccugccccgcagccccagccccuccccagcugccccuguccucuguacguggaacaguccuggcuccugccgucugcuccugcagggcucacucaggaccgucaucugcaugguucaucgcucccaugaacugaguuccacuuacucccagccuccuccccucugccccuuuaaggggagcccagcucugcgggaggaggacagccuccugaggacagggcugcaacugggcuguggguuggugccacuggacaaagguguuucagcgcagccgguggcguugagggggagggagggaggaugaggcggcccucaggcugugccuguacugcguuccauccccacugaguagcacgcgggccuugggagaggcuaggcauuucugcuggugacacagccaacucacucuguccuuucucccuggccacaggaggccagugaggcauccucagcccugggcuguuucccagcgguccuccgagcucagacagcugggauggaacuuggggucucacuagcucccaugagcuuugggagcuguccacuuggggacuccccaggguuggggcuggaacuguuucaugcccugggggguggcaacuugaggcugcccuugcagacggcuccuggcccugcccugcagucucuucuuccacugauugguaucccugccugcccuccccagcugaguccaucacuagugguauagcucucaagggucuguuuucuaugaagacagggacagaaaugccagagaaagguagcugggguauaggucagguacagaauuuuugaaaagaaauuugccaguagcuguucucacccuggcaaccaccauucuacucucuaugaauuugaguacuuugggugcuucacauaaguggaaucauacaguaucuauccuuuugugacuggcuuauugcacuuagcauaguguuuucaagauucauccauaguauagcacauaccagaauuucuuuccuuuuuauggcugaauuauauggcaguguauauacauacuacauuuuguuuauucaucuaucuauugguggacacuggagcugcuuccaucuguuggcuauugugaauaaugcugccaugguacguggguguacaaauaucuguucgagucccuguguucaguuccucuggguauauaccuacaaguggaauugcuggaugaaacagcaaaucuauaaaguccaguuuaauuuuuugaagaagcuccauacugcuuuccagaguggcugcaccacgguuccaguuacuccaugaccucaccaacacugacaguuuucuguuuuuuaacuuaccucuacccuagugaaugugaacuagcaucucauuguggcugaugugauuugcauuuucuuuucuuuucuuuucuuuuuuuuuuuuuuuuuuuacuuaagagacagggucucacucuguugcccagacuggagugcaguggugccaucacagcucacugcaaccucgaacuccugggcucaagggauccucccugcucccaaguaacugggacuauaagaguacaccaccacaucuggcuauuuauuuuuuaauuuuuauuuuuagagaugaggucucacuaucuugcccagguuggucucaaacuucuggccccaagcaauccuccugcuuuggccuucugaagugcuaggugacuuucauuuucuaaugacuaaugacgucaggcaccuuuuuaugugugucuuggccauuuguauaucuucuuuguauauucacauccuuugucuauuuuuaauuguuuuuuguuguugaguuuuaggagcuguuuauucuagauacuaauacuuugucagauauaugauuugcaaguauucccuucccuucccuagguugccuuuucgcucucuugguccuuagauguacaaagguuuuuaauuuugaugaagucuaguuuaucuuuuuuuuuucuuuuguugcuugugcuuuuggcgucauauccaagaaaugguugcuaaauccaguguuacagggcuuuuuuccuuggucuucugugcauuuuauagccuuuguucuugcauugagguaucugcuccauuucaaguucauuguugcauaugguguagugucacccuugguugguggauccugcuagcugaccauuguggugggugagggggaugaaaagcuguucuuccccaguucccaugccucuccuaccuucuucccaucuaccccccgcccacccaccaccaguuuuaggaggaaggugggccuuaacugggugagggcucccaagggaagcuccucuggcagagggcccuuggccauuuggcgggggcccugguaucucgcugcccaggcagcggccgaagccagcaggccagccuggcguagcaggugugaggaggaacuuccuggucuuggcagcaagugaaaaagguccuuguuuucuuauuuucuccguuaaaaaaaaaguaguuuagugguucuaacuaugccccugggaaagcccugaacgggucauuuccucagcaucccacaaagucacuuguagcagaaggcccagcccacgcacugcagcaccaaggcuggggcgaggcccacacugcauuguugcugcuggcauuagcagaugcugcacaucuuggaggcccccuccugcuaauccacgaaugccucagaaagcaugcacugucucuggggccagagcugaaucuuagaagagggccuacuugggaugggagcgguagcucugcgucuguggugacacccacugucacauuccaguagagggaaggaaagguagggccucgggauuuuggcccugacugcaugguuccugcuucuucugugauggaggcggcaugcuguggugggcuaggaguuaggaagccugggccugaguuuccacguccagacguuagggagaggugggguguagagggccuuccaggccuggguuggcagggaggcgagcucuuucucgugauggagccaugaaggccuguuggaaggccuggccugcuugcugcugagccugugguuucucccuguuaucugugcaguguucuguuuuguuuuguuugaaguguacaggucauugucuuugaggauauucacgugguuauacaaccaccaacacaaucuaauuucagagcauuuuucaucaacccccaaacaaacccugcaucccuuagcugccaccgccacuccuccccuccugcuucccaucuuuaucgauuggccuguccuggacgcuugauguaaauggagucaugcagcaucaucucacaacuuuaccaucugcugguugcagcagagucauuggcccaaggcuggggugguggcuucagaccaacaccauggacuugguggccuaggugcugaucaugcaaaggccauuccucaggggccugcaucucuuuccagacagcuucucuaccucaugcccugcagagccugccacugucuggucuuugcacacgugucauccuguuaacccuuaaugaauaugggauuuugguuaaaaugaugguuucuauuuuauaaauaaaacguaucuauuacauauauaaguaaaucaaauauuuauauuauaauuaaaucuauaauauaaaucuagcaggguuggcuuguuccaucauucagaaauguuuacugaagcacauauuggaaggugcugaccuagguguauagaguaaauacaaggaguuuuaucaggcaccuuguggcuuaguaugcagagcaguugggcagaccuguggaugggccauggccucugcacaggggcucccuucagggagcacaggacaaugauccaggaggggagaugugccaggcaggccucuccggcaggacagugauaaaggaggcugcucugugcagcggguaaccgugggucucccaggccagcaaguagguccaggaggcaagguggggcaauuggugcagggagcagagcuugggcugggagcuguuggagcaguugaguuguggguuggcuuggccggaucuauguucaugaagaaugguucuggggcuguuccuguugaaucauucugaggcucccagcacugcugugccuaggaggguagaacccaugggccucuucacuguguaccagguguucccagcuggccucaucuagccaagccucccacggaacucccagaaucacaggucugaggccuccguccugccaguccccagucuguauuggugggcagugggaaagggccugccccgcaugcaucugcagcuggggagaggggucagaaauguuuugcagguagugucuggggccaggugcugucagccuggggcucagcagaggggcagacccugcucuccccuggaauguggccugggaaaccagccucuggugcuccccagggccccaaggcaagggccagagaggcacagggagaaucugcacgguacucagcugccuuuggauugacccuucggcuugguccauuguuuucaagagcccuuaucagccaucuuagcacaaguagauggccauggucucugaguagaggaugugcccccuccccuugcagaagacgguggcccaugaugcccagagcuccucaguccacugagcccugccucucugccacaggguagaagacggaacaugcccgacacuguccucccuccuucccaaacauucgaggaaaguuguugaacccaucgucuucugaccaccacccuugcuugguaggagaguggugaugugcacugagaagcagcaggcggcacgggugugccaucccgagccugagcucgagucccgcuucagcugugcaguaucguuuguagucuugugacagaaggggguagauuaucaccccaaagggaaaucucuaggccaaaacauuaggccacuucucauuccccuccccuagccccuggcaaccacuccucugcuuuuucucuauggguuggccuuuucugaacauuucaccaagauggagucacacaguguguguccuuuugugacuggcuucauucacuuagcgugauguuuccaagguuugcucauguuggagcaugugucaggauuucauucuuuuuauggcugaauaaaauaauauuccauuguaugaauauugcauuuugucuauccauuuguccacugauggacauuugggcuguuuccaccuuuuggcuaucgcgaauuaugcugcuacgauaugauuuguguauauguucgaguaccugucuucuguucuuuuggguauauauccaguaaucaacuuguugggucauauggaaacugucuguaauuuuuugaggaacugcuaaaguuuuccacaauagcuacaccacuuuacaaucaaaacgaggccuauauuuacuaccauuuuacauuagggaaacugaggcucacaauuugcgacuugcccagaaucacagagcuagugagugcagagcuaggacuugacuccaaggguaggcucuucuuggcuagagagcucugaaaacagauugcuuagagucuaccuuagaucucagaacuucugcagagggaaacagcugggagagcagugguuuguggcuccagcucuuccuccuguccugggcugauggaagccccaugagcuggucucccuggccugugcuguagguccagccuagguagcccuggcuggccaaagcugccuaagguccugggagucucacgggggcuguguggcuagcccaggucaugggguggucucccggcccuucuuucugcagccaaacuacuucuaggagccugaucuaacaaaucacaagccucucuuuugaggaugugcuggggaccaccccaaaagccaucggguguagaaugggcauccaacucuuggcccaaagucccucugggguugcaggacccucucuggggucugccagguuguagcaugcagguuucaugugggacaccugaaggguggggaagagugcagaaucauggcucccuucccaaggaggugauaggaccuggaaucagaccugacaccugaggacaggcauugggaugagggcucagcccagccuaggggcuguuccaugcagcuucaggaggcuacaguguggaggaugauuguggaacugcccuuugaaccaugaggacuguggaguacaccaggacuggcggugacgacugggaagggggaagggaguucugccugguggguaccugcuaggcccauugucagucccuaggcgugguuggccuaacacuucucugaguuguggcacagaggccaggcagaggcuuugcuuacucugggccugcaugggaucaugaccccuuuucugcggcucuuuccaguuuccucagaggacuugggcuuuggggauaucugucuguggagagugcugcucccuggggaggucugcagccccagagggacuuugggccaagaguuaagugcccuuucuacacuugauggccuuugggguagucaccagcaccuccucaaaagagaggggcuugugauuuguuagaucgggcuccuagaagcaguuuggcugcagcaagaagagccgggagaccaccuuugaccugagccagccacacagcccccaugagcccugcuccuguguugugccucccaggauguggguuccaggggcgccuaggaacucagcuggugcuccccaagggcuguguuccuuccugagaaaacucuggagccaauguccugaauuccaaagaaaggaaggaccucuccuuagaccuggcucgagcagccagaccaugucugcagcacagcccaccagcccaagggaggagggaggugguguuccugccugggcgcugccuaaucaggccauagcucagugaagugccaggcugaaggcaggggccgugcugggcaagucuccacgugguccaggcuggguagcccugccuacaguuucucugauaaacuuaggcaugaccuugugcaaacaauuguuaaguccagggaggaaagaugccaaggagagaggggcaagggugccagucagagaggaccacacuuguucuggguggcccacagagugccacgucccauaaucacuuggagccccagcuuguacauuugaaagucagaacaaugaugugccugccuccugaagcugucaucaguaccuguagcuacucagggccuggccacagugagcacccaggaaguggugaauacacuuccugcuucuacugcaaggcaauucccuguguccucccuagaacgugccgagcugccugucccugccagagugcagaugagcaaggcgaccgcucagccccaaaguuugcagacaaagcuuuucauacuccuuaagugggucacagugcauaugaaaaaauaauaaauacagugcacaugguagaaauacugacucaccguuuuccauuucaugugcaugugugcacuugugugugugcucaucauggugugaaugugguguuccaugugggccuugguuggaugaguuugugaaacaugcugucucaggaccucagguguggggggaagucagguuucaccuugaaauccccuuucugaccuugagauuuugggaguaauucuuugcccuaggggaaagccuuuguuucuugggucucuguuuucuggucugaaugagggauugggggauaaagggaagacucccacccaggucucacgugcgacugguucuguaacagcagcugccuggaaggaagguccuccugaugauaacgccaaacagccucucaccauauuucugcuuacuuuccucuuguuucccucuggcucuuagaagcuugccuucccacacucauggggucaacaagaaacaaaggccuguuuucccaaaagugcuucugcuugggccaggggugugguggagaguccccgguuggagaggcugcuauagcaguauuauccuaacccaggaaggucacucuggccucugacaagaugcccuggcugcagugcacagagcuuccagccucccaugggccuguggacagaggaccggcaggaggagcagggugugcucaucucuuuggagagaagccugaguccuguguccuccugccuaaacaaucugcagccuguagcaacucugccccuuagcugggguaggguggagcccagaagaggaccagaggcuccagauagcuggagggcuaugugggggcugaacccauaacuuggugacauagcagagucgauggccuacagagggccgucucuuuuuuuggaaaaugaaucaaacaaaacuaggugaagcucagccuccuaggaaaccuggauuccugaccucuggagguauagaauuagggcaggaagcucaucagaguugcuuugcugacagcguuagagcugaggcguuccuucuggcuggauuuggguuacagccuagauauuugcccuuacucucgcagcacaagauucaggccuacccagacacagaugguuguauccugcccccuaggcagaggcaggggaggggagaggugcuggcugaggggcucccuggagccauugguugagucuguucagucuggaaaugcugcugagugcagagcagcagggggaccagcucuggaaccagagugccuggguuugaauccugacauggcuacuuccuagcauugugaccuuaaaucaaaauuacaguucugcguuguuuaaugacaggcacacauccugagaaauguguuuucucaggcaguuugguccuuguguaaauauucuagagugcacuuacacaaaguuagacaguacagcuuauugcacaccuaggcuuugugguagagccuauugcugcgaagccauaaaccuguacagcauauacugcaauaucacaagcaguuauaacacaguggcaaguauugauguauccaaaccuagcaaaacauagagggagcuguugacuaacaucguugugcggugcaugacugcaccuagcuucuuagcagucugcuuccuugucugcgggaugagagugacaguagugccugccucauaguguguucggaauguucagugagaggacacgggaagaguuugcagcagugcgugguauucaagggcaugggcgcaaacaugagcaccauugugcccugcgccugugcuggugcuguuguugcugcuuccccaucggcagcaggggaagggggaacacugcacuacugagacuuggagggagcuauuuucuuuuucuuuuucuuuuuuuaaguucaggggugcaagugcagguuugucacauagguaaaguugugucauggaaguuuguuguacagguuauuucaucacccagauauuaagccuaaugcccauuaguuacuuuuccugaucuucucccucuucccacccuccccacucugaaaggccccaguguguguuguuucucuccaugugucuauauguucucaucauuuagcucccacuuacaagugagagcaugugcugugugguuuucuguuccuguguucguuugcuaaagauaguggccuccagcuccauccaugucccugcaaaggguauuaucucauucuuuuuuaugacuacauaauauuccaugguguauauauaucacauuuucuuucucuggucuguaucauugaugggcauuccgugucuuugcuauugugaauagugcuacagugaacauacauaugcaugugucuuuauaauagaaugacuuauauuccuuuggguauauacccaguaaugagauugcugcaucaaaugguauuucuaucuuuaggucuuugaggaauugccacacugucuuccacaauggcugaacuaauuuacacucccaccaacaguguauaaguguuccuuucucuccacaaucgaagggagcuguuuuuuguuuucauuuuguuguuuuuuuguuuauuuguuuuguuuuguuuuguuuuugagauggaaucucgcuccaucacccaggcuggagugcaguggcgcaaucucggcucacugcaagcuccgccucccggguucacgccauucuccugccucagccucccgaguagcugggacuauagacgacugccaccacgcccagcuaauuuuuuguauuuuuaguagagacaggguuucaccguguuagccaggaugaucucgaucuccugaccucgugauccgcccgucuuggccucccaaagugcugggauuacaggcaugagccacugcgccuggccaaagggagcuauuuuauagcagguccucaguacguaccuggaccugucuuccaagagugcugguuagaagcaguacauaaauacaauuuaaaaaguuagucccaaacccucacgcagugcuagugggaaugugagauggcacagccacuuugggaaauagucuggcagcuccucagaguuaaacauauaguuuccauaugacccagcacuucugcuccuagguacacacccaagagaaaugagagcacaggagcacuguacaggaaugugcacagcagcacuauacacaguagccaaaaaauggaaacaguccaaauguccaucaacagaugaauggauaaacaaaaugcgguauagccgcacaauggaacguuauucagcuguaaaaaguauugaaagacugacacaugcugcaaugcggaggaaccuugaaaauaugcuaaauccuugaaaauaugcuaaauggaagccagauuuuuccauuuaugcaagguauccagaagagaugcauccacagaggcaggaagcagguuagcaguuguugagguggggacaggugucaaagggaagugacugcgaauggcuuuucagggggagauggaaauguucugcacuugauugcagaacagcucugugaacaugaugcuaaaagccauugaacuguacacuuuagguaaauuguauguaaauuauaucucaauaaagcuguuguuaaaaagaaaaguuaggccaggggcgguggcuucgcgccuguaaugccagcacugugggaggcugaagcaggcggaucaguugaugucaggaguucgagaccagccuggccaacauggugaaaccccgucucuacuaaaaauacaaaaauuacuauaaaauacaaaaauauaauacuaaaaauacaaaaauuagcugggugugguagcaugcaucuguagucccagcuaguugggaggcugagacaggagaaucccuugaacccaggggauggagguugcagugagcugagaucacaccacugcacuccagccugggcaacagagcgagacuucgucucaaaaaaaaaaaaaaaaaaaaagaaagaaaaaacgaaaaguuaauaccaggauuaaauaaaaaugagaucaucugauuaagagcaggaaguuuuuuuucccuccuccauggaaauagauugggcucuggaguuaaaauauucccuucuuugauaacguauuuacccccauuugcucuccuuucucugugugugauaggguuaggugaugcccgccucacaguaaguaauauugaagagggcauaaaagggaguguaacugugaaaucuugacacacagguaguuaauacaugcuaauuuccuucaguccuggcucagcuugguauguuuuugccuuuuauuaaugcuucugaaauccuuuuuggaaggagauagaacccucacuuugcacaugaggaaacugaggcccagagagguggagagguggaaggcauugcuucauacucauuuggugaggcugagacacaaccacguucagcagcagagcaggggcuuuguucagcugggggccaagugcccaaacaauuacugcguaagagggaagagugggcuucagggacagugagcaauuuggugacacugaacccuggaacaguggccucaaaguggggucugugccuccagggggccgguggaugaucccuugagaagaaaacuuuggaauuucuguugauauauuccaucuaacauaugucucugugugugugugugcacacgcaugcacacucauaauagacuggcaccaugguauggauacacagcucauccagggccuguacugucagcaguuugagaccacggucccaaggaccagggugggagucaaagaccagagaggaagggccaccuuaggaaagccccucugccuccacagugguuccuucaggauggcuucugacacucuaguaacgagugcacuggccacuuuaccauuucaugucauccaguccucacugugguccauggaguuuccucagcaaacaagagaguccaccucagagagacaagaugccuugucuagggagguggagguggggugcgcuuuugcauggggguguugggcucaagagggaagucagagcaacccuucauuugcccagaggguucagacaggcaccugcacuaugccaggaugcccaggaugagaauuucugucaaauagaguaaaggggcuggagcuggagagaggagauuaggaaagccaggacccccaccuugggcaggaaggcccaccuguccuguggcuguggccauagcacucagugugggucuccccaaccagaagguggcaggggcuuggauccaggcuuccuggacuaacauaaagauggggucugaggcugccuccuguacccucuccuucucaagaaacacccacugcuugguugcagagcaacccuacccaucucccuuuccuggcuccuucucaaggacccuccaagagugucuggaagagacaccugcgggccacuccacugauggagagcacugagcugggcuugaauguggcuccuccucguguccccccagggucaguguugaggcaggaugccaaugguguaugcugaaagggugaagccacugaaggaggcuucccugugagcccagccuccaucccaccugcugugccaccucccuucugagcuggacccacgggggauggcugaguccagagaccccacaaggaaaggcuucuuggaccuggacauuuaaccauggagaaaagagccagcagccauguaggcaagggcucugcaaagccagcagcccuccggucugacuccugcaggcaggcaucaagggguguagaaagagguggcaaguaggucagaggaaguaacaggaagaucacaggagcuugagguggagggacaaggagguugcaccuaaccuguuucugaaaggaagaaggucgggguguggagagugguuggucugagcucagcaugggcaccagacccagcauccugcucuugagaccaagcccccauugacugucagcaaggagcuugaggcuggauggccucuggguggaaggcagcccaacugcaggccaccccucagauggaucagaagcaucuucugcuucuucaagaaugagaacaaggaaauggugggcuguugggggugcucaguggagaagccagcagcuguccauuagugggguggagucaguguggaguguguuaaggacaggggcaccccugguguggugguaaccauggcaacccaucugcucucccaaagcauccuuacguugggagaguaagaaagaggccagaggguacagggcuaaacaagucaucuccauaaagguccucuugccuagcccuuugccucaguagggauuucuuaaaggcauccuuuccugcuuuugguuuucugucccuaauuucaguguguaacaguuuuugcuguaagaaaaaaaguuacuguuugccaugccagagcugguguggcagccuuugcugggcucugcuauggcccugggaaggugccgugggccaggcugccgggcgugcuccuuggccgccucuaaagaaggcacagugcacccaccccacagccugcucucaaggauguggcuucucucuggcccccuccuugccucuaaaaauaacccugcuauuuugaaacugccuccucuggagcuuuuucuugcuucucugugggaucagcagcccuucugagaccaggaucucagcugccccugucaccgcagcuguccccauccuguccuccccugcauauccccuccagugcaagugggaugucgcucuccacguaggagggauguuuagcuggguguccucuggagaaggccaggccugucccuguccucccugggaugggcacaaaggaagaggagcuggggcuggagugagggagagcacuccuagaggccccacaggcugggagggucaggaauggccuggggcuguacgacaucuguggccccauuggcuggccucugggugacucucugccgccuucuuccagcccacgacccuuccucagggcaccaucaacaugaaccagugcacagaugugguggauggggagggccgcacgggccagaaguucucccuguguauucugacgccugagaaggagcauuucauccgggcggagaccaaggagaucgucagugggugaguaugcuggcacuguggaacaaggcaccaccaccugccacagggccaacaccagaugggccgccugccccuguggcagugucgauguugucuacuuccccgugugccucuauucuugggcucugucucuguucucaacaccgcugugugcugagcacagcagaaaucaggacauucaccauuccaccugcagccucuggggccccucuuugcucuggccaccuuacccuccucgggccuccccaccauugcacucaccacacccccaacucaccugccccuccaccuggaaggggaucagucccugaaucauaugaccugggcacgcccucccccagucugggauggcugcuccuccuuccagggcuggugcugggcuccaccaccuaugaaagcgccagguuaucugcuguguccacgugugucucugucagugguggugggggugggaggugucucagucacauccccagcaccucacacccgagccacucugcugccacugcacagauugguuucugugaguggagagaauggguaagugucucacucacccagguccccugagaguggcgaacuggcucagguugagagagcccacaguccaggggccugagcgcagugcugagcccagggcagcaucugccuucccagagcucccagucuagcagggaauucuuugcuacccacauggccugggccauggugaaaagccguacauaguccgugcaggugaacaggcucauugggccugacaggagcucacaaacuggaucuccgagaaucccugucuugcuuaaggcugagaaggaggcacaugagucuaagaagcucugggagaaaguaaaccuggggcuugcugggccaggcugacuguagcaguacagaguagagggaaucaggaauacgaagcccuugaguuugaacacacagaugacucggagcaccagccuuucuuuagccucucagcugcagccuggccaagccuggugagugagcacagcuggaaguccagggccacauggcaaggcguccaggagccagugcugggucccgggggcgcucucugcgggggugugcucuccccuagaguccuccccuggagagaggcagguuugcauuucugagcaccuggagccgagcuggaggagcacuucugucucccacaaucuuaauccagaaccauaugaucaagaaugucaagggccucugaagaacccucgugguacagucgaggagacccagggccuagagacaggagccuggccaggggcaccuucugcacuuucuggcucacaccuguuucugcuguuggccgggcagcacacagccgaggcuuccucugcccagguggcuucccuaggaaacccucacccuuuccacaggagcugggucccagggaggguguggguaacaggugggauggaugggaguccugggucuccagggcaagcuggggagugucuggagcaggguugguucuaggaccagcacauagagguauguguuguaccaugugguauuaggagagggugauguuuagcauuuggacugccuccagcaggcagcuuaaguccugccagaaguccucacuccaucccaagccccucuccugggucacuucucugcucucuucuguugcauauucaggcuugccauacccaugcagcuuggguagacaagaucguuaauggaccaagguaccgggugcacaugccaucugggcccuacgugugugguggcucaguggcguauccaaagccagaauaagcugccugacgcucuuccccuuccccucgcccugguugugggccacguuaguucguguccaacaggcagguucucacguggcauaaccucgugauccgcccucaccuucccacaagcugggaugcucagcugcgugagggagucagguguggccuaugcacccuggggacaagugcuuuugccuccuucucccauuccucugucuccugcccucgcugacagcccccuuccucugcucccucucuugccucccucuguuucccauuauaacuccucuucccaguaaccucaucccuaggcucuggagcgccauucugggucugagcucucuggucacaucaaagcuggucccuaagaaggugcagacacuuccaccaggcagcugggagcuggguggguuggggacagucccacccagucuucuucccaggucuucucugcauagcccugacagcugcgugggcugccgggucucuccugggccuggguagaggaaguuggcagcucuuuccaguucccacuuccaggauucugggccacacuuuacauagcucuuuuagacgagguggguuuggguaggaguuggcaagggagcucuucugugcucucagcugggugaagucuggacuucccuucucccugcccugccuuuuaaccuuacccacuccccuguucucacucauccgggcucugccgucccuauccggggagccccagcaccuaccagucccauauucacaccccucuccucucuucuugggguuuguuuuguuaacauuuauaacacaucuggaugauguuagacgcuuccuauugggcuuccuugagaaauccaagugcagaggacacauuccaucaucuauuccuggacccugcaucucugcgacuccagccacagacugcagucugaacagagauuaaguugcauaaugggacugaggccacaugagacaccugcuguccugacuccucccgaguccuaggcuugcuggagccagcccaggagagcucagcagcuccacguagucagcagagcaccugcggugcagccuucuccccuccccuccagguuccauccugcaaggccauuagucauugcugacugauggaaccugggccagucugcaggggccugggguaccuggcaggguucugcaccuccagcaugcuccacaccuuggugaaguuuuaagugcagccuucugcaggcacagucccucagaguggucagaagaaguggcagcugccauggcagacuggaaaggcaaaccucuuuaaucccauagggcuugugaacaucccagguuguaugagcgaggcccucuccugggaccucugcucccagccagccuugaugagaagugugaccagggaggagaggggcucaggacccucagaaggccugccugucugcuggcuuugcagauagucacagccuccuuucuuguuuuggggccguggaggaaugacccacaggaccuguggcuuggaucucuggcauugcagguguuuauucauucucucagcaaaucgagcaucacuggcugugggcugagcugggcugaggguggccccucagcucuguugcugugguuccgugcauuaagccuggccucugccgccaccaccugucaacagcacacccauccugaggcugucucagaagccagugauugugacugacccuuccuuugucuguuugucccuccuucccuccuuucuucauuuucuccuucccucucuuccuguccuccuccccucccucccuccuccccaugcucuuccucucuucgcuccucuaucccuuuucccccuccccuccucuccucuccaccucaaauuaaagaaauaccucugggcacagaagacucgagcccuucuccugccccaggcucagugugcugcugggugcugcacccgugugaucucuagcaggauacagcaguacagacccccccauccccaacccugggcccaggcugccagcaggcccagcguggacccuggugcugaaagaagaccuggagcggugucuucugaggcuccuuccacucuggagaggacacuagggcugcccuugcacaaccaggcccagggcuggagcuggggcuucagaggcaggaccuacacugcccuccgcuccucccacccccgucgucuagcccccacaggacugacaggcagcucuggcaaggcaacugcuguugguuccuuugucuguuguaaaauucuauaugguggaaguaguugugccaugaucugaucuagcuccugauuucagaaaugagaagauugaagcuccuaaggggccaggagccacccaagauugugcugggauaguggcagaaccagauccagagucguccugcuggcagcgccugcuuuugcuguguucccuugcugcaccccuggugucuauccagagugaacuugccacacacaaucccugaugggucccugggcagcucugcccagccuuccucaaagccagggugcccagcacccucccucugcagggacugugggaguucagcaaccccccacacccuagucccucaagaguacccauugugggaacuugaccagcacagcuccuagauucuggccucagggccagcaccugccucuguugcccuaaaugggcacagcucgucuguacucucaccaagcccacucugggagagcaguguuagggcaauuccaggcccuggagacagggucaguaauggaaguuacacauccuaugcucugaggccauggccaggccaggccucucugccagcacggagucugugucguguccugagccugcuguggguguggcagggucauuguccaggcuugcucuguggcacuucuggccccagcguagcagucugucacuggggacaaugcccugcucuacuccuggaccacccggcaagggccagggcuccuaguccccgagugccagggucuuaccugguacuugucuccuuuucucuucccagguggcuggagaugcucauggucuauccccggaccaacaagcagaaucagaagaagaaacggaaaguggagccccccacaccacagguaggcaguggguuugccagauggcauccccucaguggagccagggcuugggaagaagugagggcucccugagguuagagggugaggacacagucaggccagggcugaggcagucaccaacucugcacauccuugcuuugggcugcaaucugcaagauccucacugagccacaggggaaccacaacagggacaggguggccugcuagugugcucuggggcugcccaagggaaguuuccagccagcuagcaguacacagcugugaccccuccccucgcuauccugcuggcagcuggggaggggcagcacgggcagccugcagccacagucaaaaggacucugcacccacagauggcccugcaggcagccggaugcaguaggauggggaggagaauucuggagugguauggcccauaaggagcucacaggggcccuugcugcaacucccaugugaccugagcagggcguggcugacugggguggucccucaaggcccaguccuuccccacaggccaugauccuccuucccucccuggccagugugcaaggcuuagggcauagaaggguccuacaccgccuuaccacacuccccacguuccuggggccaugggggaaugagguaaccuuuuuugagccucaguuaaucaacuugcaaagcaggccuguugcugccuaaucgccaagauuguugugagcaugaaaggaaguuuuggaccuauuauagguucucaguaaauguaauuccuuucccucuguaccauacgcuacucuucccaaguccugagccucauagucacccgagagggagcaggguggggaugggggucccuugggcaucacaaggccagaggcccacagaagugaagagagccagcccacgggcuacagaggucagggagcaugcacuggucugggucccuuucucuccucagccccuugggcugcccuuggauauaccugcccugggcugcuguauuggcccuccugcugauggagucagccugggccacucucagcccauggucauccacccuccauccuggggucagggaggcaggugggggacacccaagccaacauccgcuggaaaggagaugucgcuagcaagaagucagcgaaaaauacagagugguuccugggacugaaaauggagcuuccugcuggggaacagcaguuaauacguaaaucccccaaagcuucccaguuggagagaaacaaaaaaaucacaggcagaauaacagcguuuaggguuacacugcguuuccauggugaugccuuggaaacagugcagaagcggagcuccugccucuaauaagguaacuccaagugcagaagccgcucucagcccaguccagggaacuugcuugcucucccucccucaugacacccagcuccccaaaacagcuacccaugaccaaguuucaacuuuuuuguugguagaaggagccacaugaucccaggguggguagguuacccacuucacugagggucucuuagagucuggagcacaggguuccuagccuucugcacucaggccccuccuaagacaaccuugcggggucucuccuuucuacccuuuggucccgagagcaucccauuugaggcugcuuguuuccagaagcuuugaauuguaaucagaggccaucucuuugucaagucagucuuguggggugacgugggggcacugcagaggagcagcaggguccaugguugagaugggaucuuuggucaggccuccccucugcaugcagccugaugcuaaaggcauucucauggccuaggguggggcuggggguaaaccucacaccuucagagcaccuggagaggcgagaacccaagacccuauauuucuuucuccauggcccaguguuggcccgggagaguuucagauugaaccaguggagagcuugaagcguuggcugccuguugugcccaguaagaaucagcuucuccccuuaaggaacucaggugggaccuucuggaagguucugcuuccagaaguuggggccaaggaucgcacugcgggagcagcagacagccuuucagcugagggcgggagucucaauagagucuaggccugggagaagagaagggcuuggcccugacaagaguuuccaaagccuguggccugagaggcgugggcuccaggcaauaaaggaaaaagccuggagcagaaggaaacgaugacccauguaggugugaagggcggaaggauggagaugguugggaagcccagagcuguguuuccagccaggugugcaggccccgggucuccacuccucugguggagcugaaggaggcccgcuccuccaucucccagccccccagguucuucugcuuuucucuggcuuucuucugaguucagugugagcccagccagcaccaccaggcccacaugugugucuccuuccuuaagaauccuguuuuuuacugggaugucuacugucacccccacuccaaguuagaauucuuccuucccguugguugccaugcuccguguuccugcuagggaaguggggagccuucugaaacugcugcagagagaggcccugcuuggcaagcaaggcucuagagcaacuugugcuuuggggaagcgcugcugccggggugggcaguuagggugguucugcccugggucuucuucccagggcagcacagcugcugguuucccauggguaagcagcccaggaugcugugcuuggugcagggacaggucguccuggggcggcauccccuugggucauuggagcccuugggaaacuugucaggagaaaccuucacuguuugcuuccgagaagcuggcuucuucugaggggagccuucagccugggagucugucugcuggcagcccuaagcugaguagguggucaggugugcguccugggucugugggaagagccucccugcuuuuauccuguccgugaggccuggaauccuugcaaaagugccaacagcuuuggacccagagccccacccaaggcagugccccaccaccccauggccuuccugcuucuggagcacgugguggaaacacucagacccccaugcugccccucacuggcugugugcgugugggccugcugccucuucugucagcgccugcggccucccuugggaggugggugggugagacuggauguauggaucccagccaggcuauugauaaauagucugguggugaugcugcaucugcaagugugcgcacauacaugcauauaaagaaccugugucaucugcaagccucuccaagggcccaagccagagagagacuaaggugguuuucuaaaaaugaggcuuggccaucaggaugggagugggaagugggcacuuguauaucaugcucuugucuuuugcgagagagcugagaugugcuucacuuuuggagaggggccaaagccauccuguuggcagcccucugggcaggguuguuggggcccaggaugugaccuggcacugcggagcagcugaggaucacagcccugcuguugccuggauucuguguuugcagagucaaguuaggguucucugcccagggacugccucugcaucugccuaaaugccugccccacaaacacuucucccucggagcuaccacuuccagaaccauggagagauuggggauugacaccuuuuccaucugggcuacuggcuuguaucuagcuuugugugugagcuugugagugugagagagcaagcaugugcacaugaauguguauaugcauuugugagugugugccugugugcagauucaagugggguauuuggugucuuuguguguucugucugcuauaauaaaauaccacaggcuagucagcuuauaaauaauagaaauuuuucucacagcaggcugguuaguccaagauuaaagugcuaguauuuugggugucuggugagggcccccuugcugguccucacauguuagaaggggcaaggcagcucucugaggccucuucuaugaaggcacuaauccuguacaugagggcuccacucucaugaccuaaucaccuccuaaaggccccaccuccugauaccaucaccuuggggguuaggauuucaacacaugaguuguggggagacacagacauugaaaccauagcauuuaauuugcaucugacgacucuuuccuucacauagcgucugggcacuccauuuuagcuucuuaggggcaaaaagcagaggguggguaaggccacagggcuggcccagacuugggcgcugugaacuuguucuugcauucacuguaaggagcuacagaugaugcuggaccugucucgaggguguguucucuuuccuuacucuguucugucucaccuuauuugagucuuggaugucuaggaaugacagacuccaaagcaacuacuguggucucacuguuuuggggcaguaucugaagauuccaggccccugacauuguguagcuggcccgggugcccccuauagcuaggcagccaggaccugugacccaaccugagcugugugcuccugcaccuucacagacaccacuuucuccuccuccaggagccugggccugccaagguggcuguuaccagcagcagcagcagcagcagcagcagcagcagcauccccagugcugagaaaguccccaccaccaaguccacacucuggcaggaagaaaugaggaccaaggaccagccagauggcagcagccugaguccagcucagagucccagccagagccagccuccugcugccagcucccugcgggaaccugggcuagagagcaaagaaggugagcggaggccaggcuggcuuguaugcacgggaauggcccucccucccaucagagcuggcccuggggauucagccaaggccuguagagcccagucgcaagccuggaccucgauucccuuuguccaucagcccuggggguagcaccuggccugguauguucugagauucccgggcuccagucuuggccuugccccuucuagcucuuaaaucccaucuuuaaaggaggaagacagcuccuguucugucagccccaguugcuugucaggagaaucaaaaacguuuugcagcagggucuguggaugggaaggccucugucacugcaccaucguguuucuuucugugugcauccugccccaagaagcugcagucagucucaucccucucaccauccgcauucugccugggccccuggcagaaggaggggaaggggugcuggggaggcagcaguuggcauccucgugcccugucuuuuagcacuuuggaauuaccugagcaggagcaggucuuccaucuuugucugucuuguucccaggcucuagagggcucuguaagacacaggcuggguuuucccaucuguauuuugucuagauuguuaaaaauaagugagcagcaggggccagcccagcucgcucugucugcaucuucuacaugcacucuggguggaaggugucugaaucuuccucucaggccuauccauucaaaaaucuauucacucugucucacuucuguagaaguccccugccccuucccaccaccagaaugcauuaaaagacugaaggggccgggcaugguggcucacgccuauaaucccagcacuuugggaggcugaggcagguggaacaccugaggucaggaguuugagaccagccuggccaacauagugaaaucccaucucugcuaaaaauacaaaaauuagccagaugugggggugcacaccuguaguccuagcuacuugggaggcugaggcaggagaaucacuugagcccaggaggcagagguugcagugagcugagaucacaccacugcacucuagccuggcgacagagcgagauugcaucucaaaaaaaaaaaaaaaaauacugaagggcuuguuggcugucagcuucccccuugauguuggugagaagcgguugguggugggggucuugcguccugagguacagaucugaucuuccagccaagcccccagacuagaacugcagggccugccugccagucuggcugagaggcagccagcugcaggggagagauggaugagagaaaaaagcaugcacgaaauauuucauucccauccaugguucuuuccgucucacucugcccuugaguggggugugcuggauguuagagacgggagguggagaaggccccugcuuggauccuacaugggcuuuaaaaaaaaaaguccucaaagcaaagcugccagcaggcugagugcgucuccucccucccacugucucuuccagaggagagcgccaugaguagcgaccgcauggacuguggccgcaaaguccggguggagagcggcuacuucucucuggagaagaccaaacaggacuugaaggcugaagaacagcagcugcccccgccgcucuccccucccagccccagcacccccaaccacagguacaguugccccgagucgcccucccaggagcucggugguccucuuccuuccccagguccucgacucccccaccaaauggucugcagcaucucccucagcucccuggauguggccagccagccaccugccuacguggacucuggcagcacuagggggcgggggacagagagacuggggagcgccuuugccuuuaaagccagcaggcaauaugccacccuggccgacgucccuaaggccaucaggaucagccaccgagaagccuuccagguggagagaaggcggcuggagcguagaacucgggcccggagcccuggcagggaggagguggcccgucuguuuggcaacgagcggagguaaggagcagguuagaggguugaacacccaggcccacacacaugcacuuccacccacgcacauacacucauacucucuguuucucucacauacaguccccaagccucccuuggcggagcaugcuuucuguucagagcauagggguauuuucccucugggcccagaacucagcucuaguagccagaaugcagaauuucugagcaucagaggucgacgccaagaauagcaguuuucacaucagugccuccuaggacugggaccuuaagguucccugauggguucucagcugccugguccuuguggggcuggaucuuuuccuccugggccauuucuauucucugaaguggcauggaggcagggagucccuagagcuacauguggugacagaggcgcuccucacccuggcagucccagggugggcaaagggcacugagagguucagaggcagacaggcaugcccaggaaggugggggcagcacagguuccucucucaaggacaugcucccuggggagccacagccccaggaaaccugaggcaaccugugaagcagcugagcaccaaauagcauugcuuuugcccuccaggggagcauugcuuuuugcccucuaagacuuugacuggcuggagagagagaaaguuuggacauccgggccuagggcagggaccaggggcacaggugcagaacuugacugcugccgaagaagaugagggcccaugcccugcccugcccuuguucuccagaguuuccuggagaacuagagaaagaguuggauguccucugaggccuccaagcccaaauccagacgcaagugcccaagcacgccuucaaucaggcuugcaccccugcaucuguauacugaggcuuugccuugacagcaggguuccucagccagguuuauggauagacuuacagacuucuggagguccaugaugaccugcccccucaauaaaacaauuucacaguauucuucccagaagagaguuaggguuaggcacucuucugggaagaagacccauaguuuucauuagguucccaagguucacuguccagaaaagagguucaaaccauaguucuggaagucuucucagaguguccucccuuccccagccacaaccuggagcucagaguuagagacgcuaccaggagggacaggugaaggcagccaugggcucccgugccucgaagggcagguggagggaagugucuuuacauccugcccccuuuucuucugagcacccaccauuggcugacagcccacccacucuuccaaacgucccagaugaaaaggccugugagccugcagguuagucuccaggauaaggaagcaucucccagagauacugcuggugagaggaaaaugacacguugacuuccuagggaaaggaagggcagccaagugguucccagccccugccuagugccccagggugcucugcuaagcacuuggcugccuuaauguuucauaguagccugaugaggaucuguuacuaccgcccccaguuauagaugugaaaacugaggcucaggaguaggugacuucucaacaauggauagcuggugcagaucccaguggggccuuagccaggaagucccugcucccauccugugauccaggacugaugccaaggaugcucuuuuaagcaauuaagaaaauauauaaguaaaggguuuugcuagagagaggaggaggccagugggugggcaggggaggcuucaugcuggcuggcaagcaggcugugugucgugguggcuccagagcaggaucagcuauguccugguuuagcgccagaccacagaauuagcauucagcacaccugcuuggcuuggcuucuucucggagagacuccuuuugaacucguucuugucuccugucgccugggacaggugcagucucuggggcuuuguacucugcaugcacugccacacggggauggguuuucaccuggugcuggccccaccccccaccaguucugcauacuaauacugcagcaucccuuucuccugacccuggugacaucugauuggcugcugucgcuuucugaggccugcucacuggaucccuaguagcccacccugugcuugguuggauuccuguccccugguugauuagagcagaaucuccaaauuggcaagagauucuuggccacaccuaccugaaauggcagccacaauaggugugcccaggagccagacugcugggaccacaggguugguuuuuugacaagccacagucaucuaggcaagccuaucugaaccugaccgguucugggcuucgauguguccguuccucagacuuccagaguguuucuuggauagugagucaccucuggcugcugagugggggaaguuguuuuccugguuggccugcuggugacuggcagcaaggacagcuccccauguagcccuaaccccccugcccucagcacagcgguuagugcccugggaacccuggagcugcagggugcaggccccguuuucugugcugaccaguaaggugcuugcugucccaccugcagcuuccagggcaccaaguaauaacuuuccaccucgcccaguagaucagggcagccagugugcgagccuguggucuuacaggaucuccccaggcccccaugcagagugacuguagcaagugccuuuccucuucuccaccacgacuccucugucuggauccccacaguaccacggcaugcgauuugcaugagguuaaagcccagcaguuccucacugcuuuccuggggcuuucuaggccccaguguugggcagaggagcccucauccuggaaguggccuguuggugagccuugaaucucaccaagaucccaccacaaucgcucaagugugguggacgccuggcuugcacuuaccaagcuuucccuggguguccuggaacuccagcagcuuccuuagcuuccugcucucacaaugccgcggccucugcugcuccccuaccccagcgccugccuccgcugcugguucuagcaggcuggcccggcacaagcuucuuuccugaggaagacacuuugugucuaagcacagggaggaagcugagcugaggaagacacuuugugucuaagcgcagggaggaagcagagcccggggcccucgcccuccucucuccgggggugaagacgccuuaggcagccaguuuucccucgcacucccugagaagcagcuggccucuugggggagguggggucucaggaauugaucuuguuuccucucuuccuuguggagauaauuaggcuuccaggcuugggagcccuucacccacuuccucuggguucuuauccucuuguccagagcagcagugacacccuccccgccagguaacuuaggugccccugggagaacaggcccggcccugugagcugagccucagcuggugcgucccccaccucugaccccaccagggugacuucuugcagcuggaggacaaucauggucucucucccucuucagugauuaccuuggguuuuugcuucuuuaauucuuuggauaauuuugguucaccauuauuugauuugaaaaagcagcgcucuuccauguauucauuucccagccuuguuuucuuucaggucuugccucugcgcucuccugcugugccgcuggguggcgcugcgccuccuccacccgcuucgcccccaucuaagcuccgucuccggccguagacagccugaggaggccgccagcccuuucacaugaaaucagccugcuuuguuuuuguuuuaauuuggucuuugauuccuuuuacuguuggcagaaacaauguuaauuccugggccucuuccuugcuaaauuuugggguggggggugcacugugauccaugagggaugcaaugagaauggaggcugccuuccgugguggugguugccuuuugaucaugucuguggcucaggagaggcugccgggugccaagcugugugaaugccgagugggucagcaccacagagccugcagggccucuagcgcgggggcagaggguaggggcaagcgcaggccugaugggagggagggccguggaggggugcaggcagagcucgggucagcugagcacgugucuagacaaccucggugcugugcaagccugaggggaaucaggcccgggccaggccgggcaugggaggagucggcucacugccaccucacagcucaccucacugccaccucagggccucguguccucucuugcaggaggucccaggugauugaaaaguuugaggccuuggacauugagaaggcagagcacauggagaccaaugcaguggggcccucaccauccagcgacacacgccagggccgcagcgagaagagggcguucccuaggaagcgggugagcuccuggggcugggcagcaccucagggguggcucgggggcgggucagcaugcaccccaugcgccaaguccccuccacacaggccugggaugugcuccugccaggcuucucuccaaccaccuccucugcauagugacuucuugagagcaggccugucuccugcagcuucauaucagagccuucuccgucucugcugaaggauauucucaugcauuuuagaucccagauuuaauuaggaucacucucuuccuaucugagacagcccagcaacaaggcugaaugucacaccuuccuaacucuuucuuucaguacaacuacaccccucguuucuccacucagcccaagguagacucggcuucugaaauccuccugggcacccgccugcugcuuuuguagccggccaagucuaagcucaucuucuccuggcuucucucuuguucacaaggugccuagugccuacugucuggcccacagcuugccaccugccaccacagagcccagggcucuuccuucugugacccagagaagcuggaggaugggguggggccaggaaagugacagugacugggaauccaaaagaaaaggcugcucuaucaaccagggcaucucaggacccggguccuguccuggcccugcugcagacuugcuaugguggcuaggcagaucacugccccucgccaggagcaaggcccuggcggcucuuggagggguggacagcaccagcucgucccucacaugcccacauugcccugggcugcacugaccagcggcugcucucugccacaggacuucaccaaugaagcccccccagcuccucucccagacgccucggcuuccccccugucuccacaccgaagagccaagucacuggacaggagguccacggagcccuccgugacggugagcccaggcgccgcguccuccggaggccgugcuccucugcuucuggucacucugaggcgcugucuguuucugucuaugcguccaugccagcugucccucugugcacaggcccucguguccgugagcacccccacccaccgacccacaggccgucgaacacagauucuguuucuucccuuuucuggucccagcagaaccaagggcuccauggcauccugagcucugggaggaggcccugcggaggaggccaccucgggcuaggcagacucccgacucuaggcggcagggcugcagcagggacccuccgcuccucuggcuuugggcauugcuuuuuguggcacuucggaggcagaggccacgucuugcuggagcuugucucguucuccgugucaugccucaaguggaagagcaggccuugcaccagguucuccaugggccucagagcuaugacaacagaggugcggaaggaguggucaggguacaggagcaaggccaacucagcaugcugacccagcuccuacccgcucugucuucagccuccaggggagccuggggccugcucacugccucuugucuccuccuugcugccugcacagcagcucaccaugggccuccggccugccccagggcuugggggcugccaaccacagauugauguguaacauggagugugaggaggaguaagguuuggguuuuuccuucagucuggguuuugcuucaggugucuugaacaaaacuccuuguuucucuguuaacuuagcugggagcgccuuccccaacagagaacaccagcagggaacccaccugcauaggccuugccauuggggucagauugcaggcuuggcuucaauggcacaaccaugauauggaaauuacgaguuuuuguuaaagaucugcaagcuaggccgggcacgguggcucacgucuguaauccaagcacuuugggaggccgaggugggcagaucacgaggucaagagaucgagaccauccugaccaacauggugaaacacugacucuacuaaaaauacaaaaauuagcuggguguggugucgcgcuccuguagucccagcuauuugagaggcugaggcaggagaaucgcuugaacccgggaggcggagguugcagugagcugagaucgcgccacugcacuccggccuggcgacagagcgagacuccgucucaaaaaaaagaaagaucugcaagcuaagcaggcugucagagagggggcagguggcagucccacgucucagguccugugccgcaauggcaacuacaagcuugcaggagaggaccucccuauuuaagggcuacuugggguaggguguccuaauuucacaguguugcuuuugauugggugcuucaaauaacucuggcggcaaggacaguugcacagcuuggcaggacguugggguugaaacagggcucuguagagggacuucuuaucuaucugggucagucuuggccagaccuaggcagcagcggacugugguuccuuccucacuccucagagacaggguucugagcagaggcucccagagcgcuuuguucugguaguuauccugacaauucuugccuguucucacucucacuccuuggaauaauacaaacagacaucaaagcuagcuucugcucagauggcuguagaaaagagagcaccucggaccagagauaaggugacccaugucucuguggggccagccaggugggcuguagauggcagugcugucucaggcuguuccucagggcccaggugugucugggcggcacagguggaggaaggacaagagcgcugugccugggcgcugccccccugucugccauccugcuucuugugggggaauacaggucaagccuauuccugguggagaaauggccugagggucucagcggggcugcagcugcugcuuccucaacaccgcacgucucuguuucccaggcuuccuguggcuucugcaagaacuuuugaaucaauucuccuuucagccuucccugcagauguuucccuucaaauaaaauguucugugacucuucaucugggcuuguuuucugccucccagauaggcccugugcagugggcccuguacaggccggagcccacacugcucacagggcaaugagaccauaccuucucuccugccagccugccaagcccagcaucuccuuccucaaggucgcgugugccuacagaaggcugguugcaggcagcacccaccagggugagggggcugcacaggcuugucuggcagguggagaaaccccuuuccugguacccgccucaucuggacagaaauacuggccccaucagacacucaugacacuagaagaguuuccucugagcuguucuuuuuucucccuuucucagcccgaccugcugaauuucaagaaaggcuggcugacuaagcaguaugaggacggccaggugagugugcaggguugccguggccccugagggaucuggggacagggugagggugagcuguccuuguccccagccagucugcaagugcuggcuccaugccuuccuccuccaugccccuugucuucaugaccagggcuguggcugagacucccaucugcuccuagaagugcaggcacacagccuucauuucugcaguggggggugcucuggaggggcacucgguaggccugucugcugauggcaagcggguguuggcccggccuuagggaugccuuguaacacuagcccccaccuggugaucuuuccuaaaaguuguuuaggggccuggcuuccccagggacaaagaaacucucuggcugugggauuggcuuguguuuccaugcaagccagccaaguagacaguagccuagcacugcaagacucucaugccagagaccccucagcugcaguggcaguguuagcccuggaaggagcaaacaugguacauucuugccaucagacucaagcaggaagagccaucugaggcuggaccugccagcccaccuugacccugugccaugggcuggaaggccaggccucccaaggaggcaugaagaaaagccugcuggguccuuaccuaagaggcccugaugccuagcccauccucacucccuuccugcuuccugagcugcuaucccaagacauccucuuuauuucuccuccauaucaaaugcccuuggccuggcaugaagacucaaguucccuuccuuacugcucacagugaagacuuggucucuagcugguuaguuaccccugcugguuaggaggccacauggccauggcuugcgggcugccaccugcagguggagaugccauuucacagccaccuuuccguucugaugggcccagccuguugucugcagccucuguaguuacugaggaccgcacggccuggccaccagccacaccauuggucauagagcccacagccaaggccugcucagcugucugugcugccucuucacuggagggucacagcuuagugagcguccugagggugugagcgcauggcugccugcaguccgagcagaguccucuguaugcugucaagggaggggccagccuguccccugcuuucccugugcucugggagggccccacaggcucuggcugcgcaccgccguggcguggcaggcaugcuguauaggaguugguagucgagucauuuuucuuuucuuccccuuuaguggaagaaacacugguuuguccucgccgaucaaagccugagauacuacagggauucaguggcugaggaggugagugucugggcuuugccucugcuguggagacagcuggagggguccaggcggcaucuggggcuaguagaucugcuucccccugggcuaauguccccacuucugaggacagcgcccuucggugguguuaccuugccgaagguauguccauguugcccucuuggguuucccagucccgaccuggugggaaggugagcacaagaccagccuuuguccuugugaucauuuuccuggcugugaugcugggcuucgucaaggccuugaauuaagugcccagugcaguggguuugggcagcuuuucuuuucucuguucuuugaaaaacacugaaauuugaaaacucaggaugaacaauuuuguuuuuuccacaaagagauuucaugguaaauggaguuggaagaauugaacuacaucuugugcccugccuucuggacaaggacaggauaggauagaugagcuuuuuugggccccuggacaguccugauucuguggucaaggaccaaauagaagggguucuuuuuuucuucaccuacaaauaaaauaaccucuucuaaacaguuuggcaagucuccuuugccuuuuccccaguaguuucacuccaggaaucccucagauaacucccacauguggaaaaacgucuguuucagguuagucauucccacacguuuguaacagccagaugauuggaaagagccuaaauacccaucauuaagggccgggauauguauuaaauacucugagccagucuuuacagacugaaggagaaaaggugguagugauaagaaguagggguaggagagugugggcggugggccucuggugguguccagcguuggggaaguaaggagccuauguaaguguuugguugcaugugcauagaagagcacuuccgaguguggucuguagaccucugggggucccugaggcccuuucaggagagcaguggugguuaaaauaauuuguaauauuaagaugucauugacuuuuuuuugcgugugaccaucugcacugauggugcaaaagcaaugggagguaaagccacuagcacuuggcacagccccaucuguagcaacaggcuggaccaguggucacuggauucuucacugccauacauuuuaaauaauuaaucguuuuaaaauaaauaagguccuugaaagagcagcagaaguuacuaauuuuaugaagccucaaucuuuaaaugcccaucuuuuuaauauucugugauuugaaaugggaaguaagcaucgccuggcugcauacuagagugugcaggcuuucucauggaaaggacuugugugauugaguugccagcugaacuagcagcuucuuuuggagcaccacguuuacuugaaaaacaacugauaggcaaaacuguggucauuaauuuuggguguuuggcauauauuuucaugaaaaugaaccaaguuggcucauuccucuaaggaaaacaacugacagaauuuguugccagugauauaauuugagcuuccaagcaaaaauuagaacuugggaaaauuuguauucaccaucaugaacuucccuuuacuuacacucuccugaugaaauagguggugguauuagcaaaggcgauauuuuaauauuacauaaugaaauguguagacaauuggaagcugugcauaacaauauuuuccaugugaccaguaccuaauguuacaaaagcaugccuggguuuuaauguaacacaguacagagaguucaugggcaugauuucagauaccacauugcaguuaaccuuuaagagccuacugcuugucaaagaacagccacaacuaccugaaaaagcuauuaaaaauacuuccuuuguuguccgggggcgguggcucaugccuguaaucccagcacuuuggaggccaaggcaggcggaucaccugaggucaggaguuugagaccagccuagccaacauggugaaacccugucucuacuaaaaauacaaaaauuagcugggcuuggugguggucaucuguagucccagcuacucgggagacugaggcaagagaaucacuugaacccgggaggcagagguugcagugagcugaaaucgugucacugcacuucagccugagugacagagcaagaccccaucucaaaaaaaaaaaaaacuuccguauugaacagauggaaugcagaaacaagaauccagcuguccuuucugaagacagauguuagagagauuugcaaaaauucaaagcaaugugacucuuaucacugauuguuaaaucagauuuuuauuuuaaaaugaauuuauuuuauucucaaaugaacaaauauauuuaaauuuuacauuuauauuaauauauauuuucauauauauuuaaauguauaaaauauauuuuauaauauauuuuaaaauauauuuaaauauuuuuaaauuaaaauuuuuaaaauauuuacauuuuaauuucuaacauaguaaauaccaucaauagaugaaauccaccuaacagaagcucuucuagggccaccaguuuuuaagagugugaagggauuucaacagcagcauguuugaggaccacuggcguggacuaucuuuggcuggauacagggacagaugguggugugauugcacccagugaggggccugggucaugcaguaguaggauagacgguguccucacuugucaguguguauacuauuaaaaguaaagucagugcagaaaaucacuuacggaaauuugcucaucuaggcauugguucuacuuccuaaaaaucucaagacauucucacuucccucggcaggcagccgacuuggauggagaaauugacuuguccgcauguuacgaugucacagaguauccaguucagagaaacuauggcuuccagauacaugugaguccagggauggaaguggggccacaggcuugacaggcagggaugcaugucagagugccuaaugucugggcugggggcacuucuggacaggccugaugcagcguguauggucagcacuuagucuuucccacuacccuugacaccucuguccuguggcaccugacccuauuccccaauuugugaugugaacaguacauuagacguuaguaucuuuuuucugaagacugcuuaaagcuuuuuuguuucugaagguuccuuuuuucuuuuguuuuuuguaaugcuggaguuggggcaauuggaaggaugugggguauggggaauaagaaugaaaguguuagucaauuauuuacauccgcuuuuuacucacuuauucauguguuuguucauucauuuacuuacaaggcuauuuuuucccaaaaucuugugagguacucagaugagcaaggcauugcacuguucucaaaaaaaaaaaaaaaaaaaaaaucuuauugguaggacaaaaugguucuuauuggcuguuucuucaaaacuguguggaucaaggacugccugcagucagccagacuccagguuaagagcacaguccuccugacugccacaucugccuccauuucuuuuuuuuucccccaagacagggucucacucucuguccaggcuugaguguaguggcacaaucauggcucacugcaggcucgaaauccuagacucuaacgauccuucuaccucagccuccagaguaacugggacuacaggugcaugccaccaugcccagcuuauuauuauuauuauuauuauuauuauuauuaucauuauuuagagagacaggguuucaccauguugcccaggaggguuuugaaccccugggcuccagcgauccacuugccuuggcuucccaaagugcugggauuauaggcaugaaucacugugcccaguccugcccccacuucugacaccaguugugaguccggagguuuccaaaaccaccuucaguuucaaaaauucacuagaaugacucacaggauucaggaaaguacugucuuuacaaugaguuuuauuauagagaaaguauguaagucagaaccagccaagggagagccauguggaguagaaucugggacugggggagucacagaugccaaaaguuucugcauccuuggggacacgguguccucuuagcccugauguggggcagugcgcagagcauugcccggaagcccaccugagccccgguguugaguuuuaggaggcucuguagcugcugugguugauggaguuguuguccucauaguugaacuccaccuaaagcccuucccgccaugguuggcuacuuucacauggcccaaaccccaacccucugauuuaauggguuuccucuaauuuccugcuucuggccaggccagccucuacccugaguugucuugucagcaugaaguguuagguggggucccaggguaccaccaugaguaacaaagacucuagucauucaggaaauuccaagguuuggaaguuaccucccaggagcuaggacagaggccaggccucucuuuggguaaaguuaguucgucacucgcaagggcuuuaagauggguggagagugugaugaguagagagcugcccccauggggcugggcccuggcccugggacuugguucucacacaaggcuagacucuggugggcucaccuguagcagggucauaccuucaaauuuuggggcccagaaacucaauuuuauugcuguguugagaguugauccaguauuuggggcucacucaguuuggcccaacuuagaggagacugaaguauagacccaaaggccaguguguucauuuacuaagaaaauccuggccgccagcccacugggcugcuggcuguggcuuccugcgugcaggcaucugcgagaggagcugagucacaguuggaggcuacacugacagccuggcaccagggccgggugugaguugucugcucuuaguggccugcacugcccaaguuucaaggcuccucuguccucauccgcugugggagggguaggcgggcauagugcccggugagccuccucuccugccguccaccucccaucuucaugagcagcuuucuccaggcagggcacaccugaagucugagaacucaccccgcucuccuagugacaaaugagggcaucagccacucucacccacugaucaaccccuccucacuucacccugguagggcuuauccugaugacuuucggugauccccaacuacugagaguucuaaggaaugaggagaugcuuccaguguggagaaggcuuccugggggaggcuuccuggagaaggaucccucaaggcucagcaggagggaugagugugaaagcaugucccagacuggacuccagaccugguggcacagagagcacagagccagucuggggcuagagugcuggguggagagucagguuggcgcugguccagccuuuguggagagcacugaaggguguuagaagaugccagucaguugugcguucaugauacaugucuggcgggacaugcagguccauuagaaaggaaccaggcuggcacgguaaagcugggcaagaaaggaaggagcagcaccugggaggaagaggugagggcagggccaggaccuggcaagaaggccccgcccacugagaagccagcagaagagcugacuucacagaagcagggggauccccuggaauuccggcugugauccauuugaggcaugaugggcucucagagaacauuaggcagccgcugggaaagaaaauucagcuggagaaaacagcuguauguggagugcugaggccaaacuccagcaacgcccacaccuggggguggagaaggauggacccaggagaaggugguacccccccaacucagcucacauggauaugagaacugaugaaggaggaccgagcugggcagugguggugucuugaucgggcauguggaggggcaggucaggucccucccagcugugcuuuguggcacgucaggccggugcgugaucuccuguuuuggcuucuggccaggccacuagcacccauccgaaaaccauccucaugauugcauccugccgucagcuucccuacugaccuggcugcugagucugcuugugagcagcucucgguucaaggcugcagcccucgcuucuguugggcaggugccuguaggugcagaagcaggccuccagcuccaugcaggccacuggcccuccccugccugguacccaggcaggucugcucaggggcgcaguggucaugucccagagccaugugcucuuugcugcuuuguccuaccugcugccccguuccucgcccaaaacaggcuccuccccugcuaccuugcacaagcaccgaggacaagcccuagacuccaccucauccaagcaggagucuagggcuugucuaggugcuccccaacccaaccagccagacgcuguucauaccccuuuuguuacuucugagcugcccuguccccugccaucaccuuaauucucaucacuuggacagcugcaguaaccacccagcaggucucccugccuuuucucagugccaccaacaagacccugauaccccuuguucuuaaccacucccugggcccaucaugccaugugccugugugagugcagacugcaggugccacuccccacgcccaacacacacgcccuuccggauuccccaccuccaccacugcucagcacaugcugauucugcccuucccccgaggcugggaacuccuuaaagaggggugcagcauccuccucugucugaguggacaggcugcuggugcguagugggugcucaguaacugugagcuuguuacugagagaagauaccggauuuaccauugccacaaauacacgucccucccacagcuuugacgucuccugcucuccagcucccucaugucccaguagugggcacauguggcacuccuagaagggucacccagucacagccuuucucccugugggacuuuacccagugcagggagcuucuuuggagauggagggcagcaggcacccuaggggacagucacugauggugccucaucuuuucucuguagacaaaggagggcgaguuuacccugucggccaugacaucugggauucggcggaacuggauccagaccaucaugaagcacgugcacccgaccacugccccggaugugaccagguaggauggugaagacaccagggagcccuuugugccucuugugggugccacucccgccagggcagugucagacucaggucugaagucugagaccugagcucagugcaucccagucugcugcuccuuccuuccuguguccuucuguugcucagguuccugucccaaguaaucagaacaaacauuucugguucuuuucucuuguaagcccaagcguuucaucuugcagguagcaugugugcuggucauuagaacugggcuuugguggagaaucuuccaucugugucagcaggcacuuggccagaccagccugagccccgcagucggugcucucaggccuugggcucugcugcucuaaggguggccccaugugcggcauccauaggccacccagugcuucuuugucuuggccuucuuuucaccucacuccuacgucuguuugauuucugugcagccaauuugaaaaacccucuccuguuuuugcauucugugguucaugugucucagauuuugcuuugggcuuuuuuccuccugcccugaagguuaaagaccuaguucucauuuuaaaagauggagaaucagaagacucagacauaucuaaaacaaaacaaaacaaaaaaagcagagaagauuccagugugggggcugguccuuugauggccagaacucugcuguccccaccuucagagccuccacgcaucugagcaccucuggugccauuucucaggucaugugauguagauuacaucucgaauguguuucuugugcuguggguuaggcugcuuggguguggcaaugucacagcgggggcuguccauggaagcuuugaccuaaaagcguguucuuuuuuuuuuuuuugagauggagucuuguucuguugccuaggcuagagugcaauaacgugaucucggcucgcugcaaccuccaccucguggguucaagcaguucuccugccucagccucccaaguagcugggauuacccaccacacccggcuaauuuuuguauuuuuaguagagacgggauuucaccuuguuggccaggcuggucuugaacucgugaccucaggugauccacucgccuuggccucccaaagugcugaaauugcaggcaugagccaccacagccggccuaaaggcacauucuguauccaaaccuuugccuucuuccugcggacuccacaccucuuuacauaagaaggaaagaacuccuaaauugauuucuuuauaguccucuuuucugugucugucauuuguucaugacuucauuuauuaaacaaacacugucuaguaaggccaagaggccgugaccgggacagguugcccucugucucucaggauccuaugcagagagcuggcuuguugucuagugacaaguccucuuugugcacagccagcaggaggcacccagagcugcagcaagcucucccacccuccaggggccacauccugugguggccucagcuacugcuuccauggcucucccaucaggagcagacacccaagcuugacaagcuaagugcucuuuuccaagcaccuuuaggaagccaccagagcaaagugagaaaggccucagcuucuuugcccaagcuauuggcagcagacagagcuuaucacggggguccaggauggggaguggugggcagugcauauggguagcuggccugagguccucuccugccccucuucccagccaggccugggcucggugcuguagauuggcaauccugucuggaagaagucagcuuugggaugucccagggcagaugucaggaaugcaccugugcacaugccugugccugcacacagcucaggagaggcgccuccacgcuugagugccugcuucccugcgugcaggggcuaugggcccaggggaaugaaugaggagacaaggguuuggcucucacaugaaaguugaccuggcaguuggccuccugacuaagaauuacuucauaaccuagcauaucugcauagucugguagagugcucacccuccaccaguuuguuuucagcauuuauucuuccucuguguaggcuuuuauuauuugaggaaaaaugugaguuuuuuagugcugccaggcaaaaucucaaggaggcaugaaaacaaacugcagucucagaagcugcuguccucguccugcucucaucgccaucuugaaguccugggguggggaaguugcagggugcuucccgccuuuggcacuagaggagccuuguggggagguuucuccuagggagugcggccgguucugguguggcugugacuuuggcggcugucagggccaggcugggggccuccaugcaugcccugcccuaugugucauccugacacucuccauggccaggagcucuuaguucagugacgucacaagaucugcccugugucguuuucauccagauguuagcgugcucuuacaguggacaccugcagauccuguugcugugaagcacuuugccucucacucgauugcugccuggacaggugacccuugcuccagguggugacggcaaccauuuccucuuuuccuugguucucucucuaaagacuccuuuccuuuuggcccuaauugaaacacaugugcucccuggagcuccuccuugggcccucacuguccucaggugggcuugcaacugccuucugagggccugggugagauuaggggccccucagucagccucggaccagcuggcagucuguggggccuaucucuagagucuacaaaccuuugccucaaacacucccagccuccuugacaaauugccaucagcaaugucccugucccugcccuacugcagacgaggccuccccaggaaucucugcuucuagcagauggggacuagacauggauuccucaggcagaccuggcuucacuccacuuacugcagggcagguagcagcaccaugagcacgaccugcgcagcucaugucccguugcuggcugccgcuugccugcucaagguggcagguaacccaguguccuucuccccuucugccuuccucuccaagccucuggcuacugcauggugugaacucguggccaccugggccuccuguuucccucacccuuaggaggucccagucuuucauacugauccaucugucaugccagcagcuggauugggcuuuuaaaacauagauucaggcugggcacaguagcucacgccuguaaucccagcacuuugggaggcaggcggaucaccugaggucaggaguuugagaccagccuggccaacauggagaaaccccguuucuacuaaaaauacaaaauuagccaggcaugguagcgcaugccgguaaucccagcuacuugggaggcugaggcaggagaaucgcuugaacccagcaggcagagguuguggugagccgagaucgcgccauugcacuccagccuggguaacaagagugaaacuccaucucaaaaaaaaaaaaaacaaaacauagaucugaucacguuaccugcuuauuaaaagguaagcccuucuagaaagugcuaguuuucccucauucugucaccacuguccaguccaggggugcacagggcccaggccucaccuggcagguacgguggcugugcccaggugcagccuaauguaguucuuggcccugagcaaggcagggcuggcccguccugccucugaggcugugggaguccugggacuccccuggcuccauacccuggcaacgggaccaccacagugagccccucacagccucuucagucaagggacccccccagugucauuaugugggaaaccucagcuuucugaggcucuuuucccuuccuuuccccuuccccuccccgucccccucccccucccccacucagaaccaguuugggaagggaugugggguaaaggcagaguauuccuguccucccugcacuuaggaagcugggauuaggauagaaaaaggauguggugcucacaggggcuggguuguggcucagcauugccagcuucugccuggcaggccacaccagagccgccccugacaggcuauguccauccuccugccccacagcucguugccagaggaaaaaaacaagagcagcugcucuuuugagaccugcccgaggccuacugagaagcaagaggcagagcugggggagccggacccugagcagaagaggagccgcgcacgggagcggaggcgagagggccgcuccaagaccuuugacugggcugaguuccgucccauccagcaggcccuggcucaggagcgggugggcggcguggggccugcugacacccacgagccccugcgcccugaggcggagccuggggagcuggagcgggagcgugcacggaggcgggaggagcgccgcaagcgcuucgggaugcucgacgccacagacgggccaggcacugaggaugcagcccugcgcauggagguggaccggagcccagggcugccuaugagcgaccucaaaacgcauaacguccacguggagauugagcagcgguggcaucagguggagaccacaccucuccgggaagagaagcaggugcccaucgcccccguccaccugucuucugaagaugggggugaccggcucuccacacacgagcugaccucucugcucgagaaggagguaauagccugggaccagauccccacccugcucccagcagccuuuccagagcaucagcugugcccagcuguggccugagggguucaucuagacaguccuacccgcgagggacuugcagaccccuaggggagacagacgcauagaugaguccucauaguugaggcagaccugagagcugugggagcgugccagugcaugcagggcagggaaaggggccuuccaggcacagaggaauucuuccgauggugggggccccugccauugagaggcaagcggcguugcagggccuagaugguuuccucguucugacucccgauggcaggaggggcgcgagcagggcaaggcuuuugcauuacgcagcccuggcuuggacaggucaaagcuguaggcagagaccagccccaggugcucuuacaguggcuuggggacggccgaucagaucugaagccaggggcauccagcaggagaugacagcuggguccuaggucaugaggauaugaagcagaagacaguggugaggcaggguaggcuguggaugaaggcugcccugugacugucacuccuccacgaggccuucagugcaccuagguacauagaugaacaagcuggcccccgaacuauaaaauaagauguucuuucauggaaauguaugcagaaauccagucugcagaacuucagugguagauugacaugucugggcagggagucucguagcuggggagguguagcguuacaguuuuuguagaacucccuguuucacucuccauuuagggacaguuuucaacacuguguuucaaauguguucucuuacguaaguagcuuguuaaagauuugccacuuggguaugccucaagcuucucaucuuuuuuguauuuuauuaacuguaugaggcugaguuaccaccagcacuaauacuuguacuuuuucauuuuccucauccauuaacaaguaacaaaggcaagaugaaauaaaauaacaguugaaacucacauuacuucaggcuaccaaaaugggccagccagcaggcgacacacuggcucaacaaucuggggggucagucuucacuguuuaaaagucaggggucggcugggcaugguggcucacgccuguaaucccgguacuuugggaggccgaggcgggcggaucacaaggucaagagaucaagaccauccggccaacauggugaaaccccgucucuacuaaaaauacaaaaauuagcugggcaugguggugcauuccuguagucccagcuacuuggaaggcugaggcaggagaaucacuugaacccaggaggcagagguugcagugaccugagaucgcaccaucguacuccagccuggcgacagagcgagaguccaucucaaaaaaaauaaauaaaagucaggggucuccccgccucucacagcacagucugucagcacccugggcggcacuggccugacuguccaccacacacacagcuccauucagcacgagcucugggagcagguuggguagcccugcacauggccaggcaucaggaggcaccugggagguguguagggaagagguggauggaugaaugaguagcugaagcuguugaaagcaagaagaguguaaaauagcuuacucauggguauccacaccuuguuugagggaacugcgggaacucuuuuugcaaacagaacuuuguggaauccaucauguaaagcuggucaaauggagugguuucaguugagaccauagugggcccuggagugaggccugcuuggggccaccacucacaguggucccuguagagccuagccuggccugugugaccagcugaggacacccaaaggaccccauggggugcuuccuccagaugcagaugcaaaacccuuguuccccaguggacacauuccccuucucagaaaugaacaccccguaugggccuuggcaccuauauagggcgugcauguuggaaccuugagcaggugugggaaguaugugggcauccaggggugccuggaguagggaaggacaagguagucccuuggugcccauaagguaccaagucugccauuguuacugauggcuugcauuggaaccuucacuuccaaaugcugcugguaaaggccauaucagcacaucugcugaaauguggagacuccaaaacucuugggccacauggaagaccagugaaagagucugugcugugcagcugcuuuguuuaucauugucauuuugcauaaaagugugugucuuuuugccaacagcuggagcagagccagaaggaggccucagaccuucuggagcagaaccggcuccugcaggaccagcugaggguggcccugggccgggagcagagcgcccgugagggcuacgugcugcagguaggguggaggggcugcuguggcccauggugcgcucaggagcuucagugugaaggguucaugcucaggcaggcuaggagugugcaaaacuuggcugagcaggggugucucccaggagcucaugccccugggcuuuucugccacaggacuggacacucaaugugcuugggggggucuguuuguuuuucccuccugauaugacauuuuggggaaucucccugaaaccucuauaucuaaggacuuuuuuugguaauaaaaugauuuuggugaccuuucccuuugacucugaaaguagccaauauacauuuauuguaaauaccauacauuugcaugugauuucucauaguuuucacuauaguaauauuggaccuauuguacagauugaagacauugaaucacacagcaaguccagugccugcuuacaaccaacagcaagucaguggcaaagcuaguacuggaccccauucccaucuguuucuauaccacaccuggcaggcagagcuggggcucuuaccacuacuagcccaaccccgggauaccuccacugagauccuguaccacagagcccugauauaggggugucacaaggcuggagcuagccuggcccaagggcgugccuaugucugcugacuuuccugcagcgugccaggccuugugccagguauugggcauaaaacagauauacucuuguccccauugagugguagaggagauugugauaggaagauugauauauaaauacugcaggagaagugaagugggguaccagaacagggagccuaaguucucggcaaaggcugaggguauaacauuagaaucaagguccuagguucaagacuuggcccugcuacugacccccaaagcaagugcauguguccccuccucuacagcggcagucugcugccuguguagacuuagacccagugaucccugagggcccuuccggcucuuagaccccgagucucugucacguauugucuacauuugcagaccgcagugcgcugaccuuggucugaguugucccaggcagcagauggaacaggggcacucagcuggccucugaccauagucugccucuuugcagacucucugcuguuucuucuccugugugcucccugggccuucucuuucuuucugccccacaugcccuagacucuccucuccagccucuucugccauagucauugccaugcccuguucagaccuggugaacagggccucccugugggccucccugccaaggucauuugcgcuugcccuccagguuugaggagcaucuuuuuaauucuugauugggccucauccuauaagaacuggcuucaaaucagguaguaaagauaaaaguucagcaucccaaauucgaaaaucugaaaugcuccaaaauccaaaacugaacgcugacauuaugcugaaaggaaaugcucacuggagcauuucagauuuuggauuuuuggauuggggaugcucacccaguaaguagaaugcaaauauuuuaaaauccgaaacaguucuugucccaaguauuuuggauaagggauacucaacuuguacuaagcagcggacuuugcacauugcuaaccuaggaaccuaccucugucuaacuugcauaauugcaugagccuacacugaagccccuguuggucagcacugggcaaagcuggucuuuaauaccuuuucccuaagucuaauaaccugugacuucucaccacccuuuaugcuuuggaaaugcuuuuaaucacgacucagaaugagcagggggucugugggguuaagggucaggagccagcuacuggggugggugcuauacuaacugcugggaggagcuugcaugauuuggacauugagugugaaguguaacuugaacuuaacauaacugagugucacaucuguggcuuccccggccagcagaccgagagggagccauaggcaggccagauucuuaggcugggcucggcucacucuuguuuguguuguuuuucccuauauuaaugaguucugucucugcaugccuuucaguguggggaguuuuguuucauuuacguuguguuuuguuuuugcaugcuucacuuuuucuuauuuugaacuccacaaagguuuguuuguuuuguugauuauuguaucuuacuccaugguucccguuccccccucguuuugacuucuuacagguagagauuaguucuuccuguuacucuagaggacugacuacacuuuccacaggaaaauguuuggaugucaccuugcugacaucucccgaguguuaccuuccuuccuucuccuccugucuuagaaggaaguggcaucauuuaccuacaccuuguguccugcgcuuguuuaggauuuguugucaagacugcguacuuuuuguuuugugaaacaaacagcugcaggugcugugcuccucccgccugucccucuuccuggcgcucucuuguccuuuagucuuuguuuugcuucuuaguguguuccauuauucaguuuuguuugguuuauuucuccuagaagcuguuugguuaaagcuguuuucugauguuauuguccauguuuucuguuuaccuggaagcagcuacuuacuaaaaaaaaaaaaaaagaaaauuuguuggauuuuuuuaaugggaaaaaaaaauaaaguuguacaaaggauaaaagccaaagccaucaaggagcuuucugugguuguuccuggccagaggugugacacucagaacugggaggcccgaguguuacuaaccaguauuuaaucgguuuuuuuaagacugaaguggccgccuccccaucgggugccuggcagaggcuccauagagucaaccaagaccuucaaagugagcuugaagcccagugccagcgccaggagcugauuacacaccagauucagacccugaagcguagcuauggggaggccaaggacacgauccggcaccacgaggcugagauccggagccuucaggcacggcucagcaaugcggccgcugagcuagccaucaaggagcaggcgcuggccaagcucaagggcgaccugaagcgggagcagggccggguccgcgagcagcuggaggagcggcaacacagcgaggcggcgcugagcagccagcugagggcuagcgagcagaagcucaagagugcugaggcccugcugcuggagaagacgcaggagcuacggggccuggagacacagcaggcgcugcagcgggaccggcagaaggagguccagaggcugcaggagcgcauugccgaccucagccagcaacugggcgccagugagcaggcgcagcggcugauggaggagaagcugcagagaaacuaugagcugcugcuggagagcugugagaaggagaagcaggcauugcugcagaaccuaaaggaaguggaagacaaggccagcgccuaugaggaccagcugcagggucaggcacagcagguggagacccugcagaaggagaagcugagcgccacuuucgagggcagugagcaggugcaccagcuggaggagcagcuggaggcacgagaggccagcgugcgcaggcucgcagagcacgugcagagccucugugacgagcgggaccuccucagacagcgguuccaggagcugacagagcgcguggccacguccgacgaggauguggcugagcuccgggaaaagcugaggagaagagaggcugacaaccagagccuggagcacuccuaccagagggucuccagccagcugcagagcaugcacacucugcugagagagaaggaggaagagcuggagcgcauuaaggaagcacaugagaagguucuggagaagaaggagcaggaccucaaugaggcuuugguuaaaaugguugccuuggggagcagcuuagaggaaacagaaauuaagcuccaggcaaaagaagagauuuuaaggaaauuugcaagugaaucuccaaaggacauggaagagccacggaguaccccugaagagacagaaagggauggcacuuugcucccaggccaaccaguccaagccacuagggcaccucuaggccucccacacacaaggcucgaggaugaggacgaggaccugggggcuccuccgggggaagaguacggugauggcagccccaguagggaagacagcauggugcccccaaagucaguggaagugcuugacagggagggccaucagcagggcacagccaaacucgaccaaggggcaccugguguuaaaaggcaaagaauccgguucuccacaauccagugccaaagauacauucaccccgaagggucugagaagaccuggaccagcagcacaucuuccgacaccagccaggaccggucacccucggaagaaagcauguccucagagccugcacccaguguacugccugcaacuggcgacucugacacguaccucuccaucauccacucccuggagaccaagcucuacgucacagaggaaaagcucaaagacgugaccgugaggcuggagagccagcagggucagagccgugaggcacugcucgcacugcaccaccagugggcgggcaccgaggcccagcugcgugagcagcuccgcgccagccugcuccagguuggcgcacuggccucccagcuggagcaggagaggcaggagagggccaggaggguugaagggcauguuggagagcuuggggacuuccaggucaagaauagucaggcccugaugugccuggaaaauugccgagaacaacugagaucucugccuagggccagccaggaggaugagcaggacgcacgcgcagccucccuggccaguguggagagugcacucgucagcgccauccaagcccugcagcacuggccggccccagcccauggcggggcccgugcacagcuggagacagguggcaccgaggagaaugggaagccugccucccugcagcagugcucccagucugaguugacagagcaggagcaggugaggcuucuuucugaccagauugcucuggaggccucgcugaucagccagauagcagauucccugaagaacacaacaucagaugucucccgaaugcuccaugagauuucuuggucaggacagccaccgauggaaucugcuggggcccccguagacaccugggccaggaagguccuaguggauggugaguucuggagccagguugagucucugaggaagcacuuggggacacugggaggagaggcagucggugccucaggagacgggcagcaaagcaucccacagggccuggcccccauccuggccaaugccacaugggucagggcagagcucagcuuugccacacagucagugagggagucguuccaccgcaggcuacagagcauccaggagacccugcggggcacccagacggcccugcggcagcacaaaugccugcugagggaaauccugggagccuaccaaaccccagacuuugaaagagugaugcagcaggucuuggaagcccucaggcuuccagcgggccaugaagaugguguucagcuguccugggaccugagccccuuaggagaaguccugggccgagacucagacagcucucaggagcccuucgaugugucugaccagagcccuggggccuuuguugcuauucaggaggagcuugcccagcagcugaaggagaaggccagccucuuagaggagauagcggcugccuuaccaucucugccaccuguggaaucgcugagagauugccagaagcuucuccaggugucccagagucucucguauaacacuuguuugggaggccucggucaguauucuucauuguugguucaggaugccauuauucaggcccagguuugcuaugcguccugcagaauccggcuagaauaugagaaggagcuccagcucugcaaggaguccuggcaaacccgggagcccuccugcucagagcaggcacaggcagcccgggcccugagggaggaguaugaggagcuucuccgcaagcagaagagcgaguaccuggaugugaucgccauuguugaaagggagaaugcagagcucaaggccaaggccgcccagcuagaccaucagcagcagugucuggaggaugcagagagcaagcacagcaugagcauguucacccugcggggcagguaugaggaggagauucggugugugguggagcagcugaccaggaccgagagcacacugcaggcugagcgcagccggguccugagccagcuggaugccucggucagagacaggcaggacauggagaggcaucauggugagcagauacagacccuggaggacagguuccagcucaagguccgggagcugcagacgauccacgaggaggagcugaggacccugcaggagcacuacucgcagagccugaggugccuucaggacacccucugccuccaccaggggccacaccccaaggcccugccagccccugcccccaacuggcaggccacccagggagaggcugacuccaugacggggcugagggagcgcauccaggagcuggaggcccagauggaugucaugcgggaggagcugggacacaaggaccuggagggcgacgcggccacacugcgugagaaguaccagagggacuuggagagccuuaaggucuuaacgccccauucaauuugcagagcagaucuuccuugauaaugggguggguguggggacgucuggcucagcuaccgugcaggcagaauugaggggauaugcugcugucccucuacuugcuagccaugguguggucucagcagggccugggccgcaggcuuagccucuuguucggcaucccccaguguccuccaccaggaggagaacuagcaggagggccgccagggucccuggugggagaggagcacguagucuucccagcacuucccugccugccuaaugcggccucuccguguuccugagagcagcccccaauccccuugccagccuugccuccuuccugccccugccccgggaaccccgucuggcccagucccagcccaaaucugaggcagcugccugaggacagccuuguacucacagcaacaccccggagagccagggcccaguuggagggcagucuccuccugauugcccuaggagagcacagucgggcggagggucccucucuggaacuggcauuugaugugugcucuggugagaagaacuuucccacggagcacagccuccagccacuccuguccccuuccccaggaccuuuacaaguagauuuuccccagaacuguccugcauccccgccccugagguccuggagcacaaaggcgaaaugccaggcccuggaggugguggugggcugaguggaggcccagcugucuggccccacccuuuguagcugcaggccacacccaccauguguggcugucaagcaucaucccuuagacucaaaaguuuaccaugauaccugugcccuuauguuccuuccacucaggaagcugccccaguaaaugacuaggaugacuaggccccucaaaagccauguucagguggugccuuccacgcucauguggcagagccaggcgcgcacacagccagcaccauugugcugcaagcuccugacucccagguggcugccacugcuccugccuacacauccucacagccacugucuagcaggacaccuguuuuucccagcccguuacuccuguagcucugaauggaaacagcagcucacaugucaccucugugugacggacucggccccacccagacacacaggugugguugucagcgagcaccucaggagaacugagaagcucuuuuucaccauucuuuccccaaaucagucaaaaccuuuuaaaaaccauuaugaguugugagaagguuucaacagcuauguuuucaaaguguguguauaugauggcacuguggucaguucaccaagagcagcacugagauggguggauccaggugcaccuugaaaaguuaauugcacaaaccuuugcuuugaccccaaauacgcuugcuagugcccuucccugcagcuucccagacaaucagcaggguccaugggggcagggccugggcacagcaaugcccugcuuccugucugcauccauaagaggccccuccacaccgaggcugcuuuagguuagccaaccaggugcaggggaggccccaugcaggugccauuauaccaacagugagcaagaaaucagaaaaaagaggacugccuuauguugagaacugaccagagauugugcugggccagugucacuaggagggagaaacagaugaugcaggucgggaugaggccccucccaggggcuuggacacuguccacucccugcugccuuagcugccguugcauaguguccccuccugugccugggagcuucuagcccaggugugguguucucacccaccccugcagacuuacagaacuuguaaauagacagcaccuugagauuucaucacuuuaugcagauuuccacuugggucguuggggacagggucuuggccuaacagccguccucugacauccacaggcucccaccacaccacgauugcagucaucggggaacuucuuuuggugucaggaaugauuggcuuaaauuaacauuuguuugcaagaucaauuauuuuuuagcauauaguuucucuccaaagaagcaacuaggucuuuaaagaugucccagugcuucuguuagauuuuugacucuuaccugcauaauauuccaaagcacucagaucaaaauaagacuuuucccagcaaguagacucaaagaaaaaaaaaaaagacuuaaaagaucuauuaauacuaguugugcucguuuuagcagcauauauacuaaaauuggaaugauacagagaagauuaguauggccccuuuacaaggaugacacacaaauucaugaaguauuccauauauauauauauuuuuuuuuuuuuuaauuaaaaaagaccuauuaguuaaauguguuaacugagaagccacauacaaacagaagcgagugggaggaagaaagaagagcucaaccuuggggccugaggaccaggagcuccagagcuccgagcuccugcagccguccugaggugugaggguggcagaaagagacagaugcuuccagguggagccgcugggagaggggaugggacgccuaguuaauaguggcaauagcugagacauucacccagagcagcacauagguugcagucaaguccagacugaccacgaguuuggaaauacugccugaggcucucagaguuggccaucaccaaaagugggcccagagaaaaaugcccaggcaugcugauaggauuucuugguauccuuucuugaauccacaugcaagaagauuaaccaaguggugcaggcuaucagcccagaguggggaaacccccacacuugaauuuggaauggaauguggccacguucuuccaguuuuuaaaacucagcgagaggcccagucccuucucugaagcagaccacuugaaggauuuagacagaaagugugugccuccgugcucaaaauagcugcacacccacccuucccggcagcugugcagcacgcucaccugcuuuguuagugagcacagcucugauaaccaggccugggcuuccugguguggcuugcucccauccuggggcaugccuaugucgcucuagggaggcacaggagaguuuggaaagcaggucuccugucauguacuuguuagaguuagcagaggugcuaagucauuggugcccuucuuuaagaaaagaguaagaaagaagacacaggcuagaaggaaggggagccuguagccugaucuuacucccucagucaacaccugagcauuaagugaccagcuggagguugucagcuggcuaguggcagagucccaacccccagcucccagaaguggacucuauguacccccaacccacuguggguugagaggcucccagcccggugcccgccaggccacucccuauauguggaauggccuugguucccuccagcagacaagucccucaucccuguuuuacgggccuuucaccgugucccuccagaccagacacagccagccucugcccacgugcucucucuuccuuccugugggucccaccuggcagcaacgcaggaagguccaggguuggcugguuuccauuucauagcagccuguccccaccuaccauaccaacuucucccaggaagaaauggggcacaguacagucacagaaauaagagguagaguugacugguaacacccuuuucugaaugcucugauggcauugcugagaauccccagacagccccagggauccuguucagggcgcccaugguggagcaagcucagugaaugcccagucacagcugggccuggacagggugggauuccuggcuccuuuauuuaaaagggcccccaacuuagagguaaagaaagaagucgaugaagucccuuuugcauuuugcaggccacgugcgagcgaggguuugcagcaauggaagaaacgcaccagaagaagauugaagaucuccagaggcagcaccagcgggagcuagagaaacuucgagaagagaaagaccgccuccuagccgaggagacagcggccaccaucucagguuggggggugggguaacccugagggcaggguggguggccagcuuuuuuugagcuagacacacaacucagaggaauggcagccuuuaaauugccuuuuggcugagauguaaacuucauuguugaaggguucuuugacuauucacucugaggcaaaggccaauuuuaggucccuuuugagagcuuguaaacugagagcgcacacuucgaccccugacagccccgucguggccggcugcacacaaggagcugucccaaccugugacuuuccaguuccaacaaguagacugaccagugucaguccagccagugacuuucccccugacagacaccugucaacgugggaccaccucuggccagaaugccccugccgucagcgugaagauauguagcuucaccggcagguggcccuaaacaagcacguccccuccgccuugugcugccuucccuuuauguaaucgccaccucagugguuuguuaauuuaguuccaaggaagaaaauacaccagcacaaaagcuugcuuguuuuauaaacucauguuggaauuuaacaaugacauuuauuuaaucaguuugguuuucuucuaacaccaaaaaaaaagccaaacgugcauuccuuccagggggaguucaugaagaauucucccagccugcacccaccucagagaauugguucaugaggggccagccugucaugcaaaauccaacugcugauugacuaagcaagcaucagcaguggcaggcgccaucccauuguguggagcuccccacccccaccccugucagcaggaagggcguggucccucggugcugaggccguguccuugccugcagccaucgaagccaugaagaacgcccaccgggaggaaauggagcgggagcuggagaagagccagcggucccagaucagcagcgucaacucggauguugaggcccugcggcgccaguaccuguaaguggcugggccugcccaucugcccuugggagggccccucuggggugcugaccaggccacagcugggcccuuccugugucuuugcagaggccuccagaaguggggccuggggccccugggugcugagggcagcucagaugcccucuuguccagugcaggauauggcccaaguggggccuccuuuauucagagagacuguuccucgaaaugccaagaacgagauguaacaaacgaaaucuuaaacuccccucuuguccagggcugaucccagcaacugcccagauguguucuucgacagcugcccugcuagcccaccaggagccaggcagccgggcuuggucguacagggcagaagugagaacuagcacugugguuuaaaaccacacgugcugauucccucugcacaggcaggauagaaaaauaccagaaaaacugcuguagacuuuuuucacuugguagaauugacacagccagaagcccacagauuggccaccaugagccucacggcacucaggcucuaccaggagccuuuauagcauagccgaagccaggggcccugccucaggagcuggcagcagucagcagcacccuguagaggcucacgcugaccuuggucagagcaggguggcccaccuggaagccccucaucccugguucaccugcaggaggacggcccuccuggauccaggguggcagaacagccucaggaagcuuggguuuuugggucuuguguagagccugguccuggcugucagacacagauggcuucaaaaguggguuuacugaaaacaaauucugagucagaagagaguucuagaaauggggguucuguguggcugcagacuggacucuguccugacuggcauccccagagaagugcuagcuguaggacugucagacugugagaaaggaccagggaggggcgugaggccaucucuguaagggaucccuuacucuguaugacccaggcugauuaagacaacagacugugugggccugaccugugcuuggcugugucuggugucaaggagggacaccggccucugagaggccuuguccagaagcaggcagaggagugagugcugcccucuccccagggaggagcugcagucggugcagcgggaacuggagguccucucggagcaguacucgcagaagugccuggagaaugcccaucuggcccaggcgcuggaggccgagcggcaggcccugcggcagugccagcgugagaaccaggagcucaaugcccacaaccaggugagccugcagccaggugagcccaagguuagucaggggcacucaaggucagguagacccauagucaggugaguccacacuggagcuggagccaggccucacccucaaaguggcaugaaggucccugaaccacagagugguuaccugccccagggcuucucccugccacccagcguggccaucuguguugucagaaacaucaccgcggauagcuagagcaacgcuguacugccacgugcaccaccugcuuacacaugacaucacucuugcuuugacccuuucugagacucucgggugucuuggugucuucucugugcuccucugaaccucuggcucacuguuucugggcagggccuggcagggucaucccaauccuccaggauccugucccccagggauugagcugacacuucucagggucaggcuuacggcucacauuuauuuuugucagauuuuuuuucuuaagauuugcuugcucuguccgggcgcgguggcucacgccuguaaucccagcgcuuugggaggccaagacgggcggaucacaaggucagggauugagaccauccuggcuaacauggugaaaccccaucucuacuaaaaauacaaaaaauuagcugggugugguggugggcgccuauagucccaucuacugggaaggcugaggcaggagaauggugugaacucgggaggcggagccugggugacagagcgagacuccgucuaaaaaaaaaaaaaaaaagauuugcuugcuccuuaguuaauuggggugcauuuaaauccuggcuaauggaaagguucaagccaggauucguucaauauuggcuuuucugugggcaccaaauuaaaacagcccucuaugacccugcccugcacaaacacccccuggggcugggaacauagucccuuucucaccugaggccuucccaaggggcauggcugcugcacagggcuguguaugaggcugcucaggcaggacuggguccacucacugcugcuguggcuuaaagauuaccccacaggagcucagaugggaccagccauggaacagauugacacuaguuauugugacagaaaggaauuaaggguuaucgauuggauccugccuacgcaguuccacagauacacaaagaaccuagggaaauggccuucccggguugugucaugcgacuuggccccaggcagcucuggagugucacuguuguguugcugucccccaggagcugaacaaccgccuggcugcagagaucacacgguugcggacgcugcugacuggggacggcgguggggaggccacugggucaccccuugcacagggcaaggaugccuaugaacuagagguaccaucaggagccaggcccugccugacucagcucugcacccaggaaccccaggggagugcagcauggccccugucuuacaggguugugggaggaacagaccugagacagcaggagucacaggguccaggaagauccaaaucacccgaaggcggcgaggagcagugagcugccagguggcaugagagccacuagccgaguggagcccucgaggggcuguggggauccugaccccaucucacuccacccacuccccuccauuucugcuaugccacaaacacugaccacucaaaaggacacguucuguagccauguggcugcugcagcucaggucagggaggcucgcuuuauguuagaaugauggauucuggaguauaggguguccuuuuaggaaggcacuuagauuucuccacauucaauuaaaauuucacccuaaaaugugcuaaaauuucagcacucagccagccagagcucacccagcugggcugguucugguggcuuugagcuuugucucugucguggagccgccuccuggcagugacacugagaggccaaggcugggagggaccagugcuuggugugaucagcuccugccccgaguccagguguugggccgcugucugcugugccugugccuuguacuaaaugagugcuuuaccaaaagggcgggcaagagaggcugagugagucugacacaagugucagugguaacauuuccugauucucgcgggcuugguccccagagacaagcaggucuaguucacagcaccccaggcugaggagggaguccuuggcacugggaggaaucacggccauuuccuuccucuuccuguuucuguaugugaggcugaagcugugagcgguguuuaaacgaugcuugcccgcauugggcaccacgaggcugcccugcucacuggugauuggagagcccucugcacgcuucagccugcuguggagacucuggagguuucuuugcuccugaauauuggucccugaucucucugucauuuuaggucuuauugcggguaaaggaaucggaaauacaguaccugaaacaggagauuagcucccucaaggaugagcugcagacggcacugcggguaaggccaccgcaccacaggagggcggguacgggaacaggcucuaggugacaugcgccuccugaacucaggcuggugcucagcgcgggcucuucugaagcagauuuuacucuugugaggaaggagguuuccaaaaucaagcccucuuaaaagaccagccugcaggcaggugcugugggaacguggacaugagcaaccugccuggccuggcuccagcuucaguguguaugugcuuuuugugugccuugggaggaauguuccagagaaaaggccugugaagugaggcaaggcuugacuuccauuugagccgcccccuggcuuccaccagccuccuccagggacuccuggagucaggggagaugacagaaucauugguggucacucagucaccuagggaaucuaggacacagagaggauuuccaggcugaagcccacaagggaggggccugggcacucagggccacaccaggcuggucgggcaaucccggaacugccuccugcacucaccgggccuggagauuauccugccauguccugauggcugugcccguguccuuaggccccgugguuuuuccucucuguccacugucugccucuagaagacagaggugaacaagccuccucuuccgcccacagcaagccucccuaccguguucaguccccaggaagacaggccauguuguaugugcuccucuuuccuggauguaacuaccauucucugucauuucacucccaaggacaagaaguacgcaagugacaaguacaaagacaucuacacagagcucagcaucgcgaaggcuaaggcugacugugacaucagcagguugaaggagcagcucaaggcugcaacggaagcacugggggagaaguccccugacagugccacgguguccggauauggugcguccucgggucaugcccucucgguuauugcuggggggcuuauggggguuuggucguagagguuucccggugcuugacuugaagcagaagagucccagugaugcuuguagacccaggcaucccaguggagcaggagcaccagcuucacacggcugccccagacaggccuugcucuccccaucgcagcaguggaugcugugcugauugcucuagggagaacccauaguaucagcauaauauuuucgaaauaauaacaagucuuauuuuucuaaagaacucaaccacugggcagaaguagcucucacuagcugcuugauccuaggauuugacuauaauaucuguaaaaggccauagaguggagaaugggagggagcucccugcuuucuggaaugaacaacagaacuggcccuuuuuuucuuggcuaaaaacauuuagguacccuguaaaaaauagauggcaggaaggaugaaagaguuaacauuuuaucaagcauuuucagcucauacguaauuuuuuuuuuuuuuuuuuugaaacugggucuugcucuguugcccaggguggaaugcaauggcgugauuucacugcagccuccgccucccaggcucaaggauucucccaccuuagccuccccaguagcugggacuacaggagugcaccacaaaacaccuggcuaauuuuuguauuuuuaguagagacagaguuucaccacguugcucagacugaucucaaacuccugggcucaagcgauccagccaccuuggccucccaaagugcugagauuacaggugugagccacugcaccuggccagauuauacauaauuucauuugaccuucaucuugauuuuuuauacagagacgcacaaacaggaaaagaugugcuagcucacuaauaucaaaaaagaaaaaaucaacuuuuuuucugucaggcaaggaauagugauuauguacugacagaugcugggaggaagacuucauuuuuccauaaauaccuugaguagucaggcuuggugguaggccuggcuacccaggaggcugaggugggaggaucacuugagcccaggaguucuaggcagucacacacaaagcuaagucgaucagguguccacacuaaguuuggcaucaauauggugaccuccugcgaguaggggaucaccagguugccuaaggaggggugaacuggcucaggucaaaaugaaagaggucaaaacuccugugcuggccaggugcaguggcucacaccuguaaucccagcacuuugggaagcuaggugggcagaucacuugaucucaaaaguucaagaccagccugggcaacauggcaaaacccugucucuacaaaaaauacaaaaaaacuagcugggacugcuggcaugcaccuguagucccagcgcuacuugggaggcugaggugggaggaucacuuaagcccagcagguggaaauggcagugagccaugauuacacugcugcacuccagccugggugacagaaugagacccugccucaaaaaaaaaagaaaaaaaaaaccugugcugaccugugguggaaucacaccugugaauaggcacugcauucuagucugggcaacacagcaagaaucugucucuuaaaagaaacagagggcgggcgugguggcacccgccuguaaucccagcacuuugggagguugaggcggguggaucacgaggucaggaauucgagaccagucuggccaacauugugaaaccccgucucuacuaaaaauacaaaaauuagcuggacaugguggcacaugccuguaaucccagcacuuugggagguugaggcggguggaucacgaggucaggaguucgagaccagucuggccaacauugugaaaccccgucucuacuaaaaauacaaaaauuagcuggacaugguggcacgcaccuguagucccagcuacucgggaggcugaggcaggagaaucgcuugaacccaggaggcagagguugcagugagcugcugaguuugugccacugcacuccagccuggcgacagagcaagacuccaucucaaaaaaaaaaaaaaaaagcaaaacaaaaaaccccacacaugcacaggaugugugauaugacucaguaucuguuuguguuacagguacuuaaguagacauuucuaagaagccuaaaggacugcuaucuggguggguggacaaugagaaggccuuggccuuaucaucuugcuuuagacagcccugugcuaccaggaggaagguagagaaucauggauaauggggguaggggucugcucagcauugaggucccacaccagagugaggggaccaagucccuuugaagggaaugcuguugugggcuacagucacagugcaggaagcccuggcggggccccacauacacauucucccauugugcugguguuuuaugguggucugaagagaucuagcauguuuuaugguuauuggcuuugaauucccuuagaguuguuuaaggaauuguccuaaguaugcugcaguaggaagcuugggaaauguuucaggauuuagucugguuccagaggguuuuagaaagcaaagguaacaggucuguuuguuuucauuauauaccgcagauauaaugaaaucuaaaagcaacccugacuucuugaagaaagacagauccugugucacccggcaacucagaaacaucagguccaaggugagucugggguccagcccccuggugggaggggcuugagggacacuggggagaguagcccaaauugaaguaugagugcucccaugggccacagcugccaaagccccagggcccagcacugagccagcccgagcucacccugcugggcugguucugguggcuuugagcucugugucugucuuggagccaccuccuggcaaugacacugacaggccagggcugugaagagcagugcuuggcaugaucagcuccugccucgaggccagguuucacccagcccugcucaugucggccugcugucagcugugccuguguuguuccuugcacaucacuguugugacacuggugccgccuccaagagaugaugcugccugcucuuguuccccagccaggaagcaguacaucuuuagugugcuguccagagccagccaugcacaggagggcgggcggaggugggagcggcaccgcguguguuugggauugguugugugucucaugucugcucucuccucugacaguccguaauugagcaggucucgugggauaccugaaaugcacccgcuucccggcccaugcaggagguaaaccgccucucccaccgccugcaugcacugcucacacccccauggcaaacgccugugucaugguuacuuuauuucaauucauccugcuccaacaaacacauaccaaauccaagugagguuucuuuaaccugcucuggggaguuaauuggcacucuaaccucuuaacagagaugacccuggcagugaggugcuccucuagccuggugggcaggcagagagccaggcacccaucagcaugcauguuggauaaucugugcacaacggcugaacucacuccacccccucaggggacacuugucuugcccucugucacgagguggaauuuacagauguccacacuggcaagugaagucuaccgucaccaaaggccucgcccaccuagugagccacuuaguggccucugucugucaaggcuaacaggguggucauucuaggaauggauaaaccaggacuagagcuuggugaagaugguucagaagagcgugauaacuacaagcaauaggggcgaaauauuuaccaguauuuuuuuuuuuaauaaaacaaaagcuucucacuaggugccauugaaggcccuaugccagagaggaggugggggagggcccauggugggagacacccugagaaugaguaguugccggcucaguagcuugaucucguucaucccggaaugagaacauggaggaaagcaagaaccacgucuuccuccccaugcuggcccuuucucaggcacacccacagcaccccgccguccgaaggacuucauccugaggcuugguuaaagaguugaagguuuuaagccuagucaguuugguuuuauuuuucuacaguucuaaguccccuauacccaaauaugguuuaggcuugauugaaaacuuagcuugggcauuuuucuuuaaacauaacguuuuguuuagcaaaaggaaacuuguucuuuuuugguucacgguuuucuuacugaagauucuacuacuuauuugaggcuaaacuguagcuaguaucuuugagcuuuucuugaaggaguuugaaguucacuauuagugauuugggcuuuuggaccaugucuauaagugacaugggaccggcugucacugacaggacccuuccagggaggcugugcaacacccacgggccccugacaguaacucugugcagugagugggugggggccucucacaguggcugggaaccagccagagcagggaugagggagcagacugucugggccccagggcagacugaaaaggauggagagaaaccccaggaugggguccuccuccuuauguguuuuuaaguugauguuuggcuuggcuggguuuccguaauaaaaauccuuggagugcagggcuaguccugcuggccccagcagaaagucgaggacuuccuagaugucuguggugcaacagggcaggauggggccguguucgcgcucccaggagacauuaggaggcacaggcaugggugggugucauccuuuuccucaacuguaucugaagacuccacccaacccuucaagaagauggaaaugcaguugcccagaaaccguacuucucagugguguuuuuugauguggcaucugaugugcacugaucugugucuuuuguucuguucuguuuuucuguccugccucgcucgaaaggaccgcaagucucagcugcuacaaaaucaaagacagcaaguugcuuaggagcagcacagccuuuucugggauugagaccagagaaugcuucccucgggguucuuaaggggcccccgugucuguggucagcucaguauguggggcuacaggaggcacucaguggagacaacagccuagggggagaugaaccccagagggagcuggcugagccuugggcugagcagccaccgggagagaauccagaggacguagagagagaaacagccuccugcagccagugugggaauaacguaggggauuucacuuacuucccacccuuggaauuguagcaagcccagcaucaccugagccugagcucugcccuuugucacuggggcaggagccaguagcgagcaugcugggugcuguggcugucagggcgcuccccuccccugggccugcuguagcaggaaucuggggcuucugacgcagugccugcaaggagcaaacccaggccuuaggagugaucaaacucacuacaguccugacagaaaguccccaacaagcaggaaccgggaugucagugacaucccccagccaugcuccggggccugccucugaguagcacuuaggcucagggcugccugccuggcuuggccccagccccuucaauggugaccagaugucuacccagguccucugcaagacugacugcugugagaacccugcacucuguggggagggaccccccaagggcaccuggaagcaggcauggguguugagguacaucugggcucagaaugggagauggauuuuccccccauucccccagccacucucuguggcaggcuuccaaagaaacccucucagaaacacacaauuaucaagcugugacaacugcuugaggugaggcucaccuggaccagugagguuguuuguuuguuuugagacggagucucgcucugucgcccaggcuagagugcaguggcgcgaucucugcucacugcaagcuccgccucccggguucacgccauucuccugccucagccucccauguagcugggacuacaggcgccugccaccacgcccagcuaauuuuuuguauuuuuuaguagagacgggguuucacuguguuagccaggauggucucgaucuccugacaucgugaucugcccgccucggccucccaaagugcugggauuacaggcgugagccaccgcgcccggccuggaccagugaguuuuaaaaugcuuagcagcagaacccuguauuuaaaaaucacauuguuuauuuauuuacacagacacauagcuccagaauauagcaaacaagcaggucuguucuggguagagcuggguggggugggggacaguggagcucccccuucccuugagcuuuggagggagccucaagcugaccagcccaugcucaguccccagucuaucacaccagagucuccaggacagugccagagugugccugagccuaagcuggcgacuucccaguagaugggguacagccugcaguuucacguugcucagguuuuugguugaaacugguagaaucaggcagacccugagcuagagcccaucccuucagcuuccaguuucucaguaaagccuguaccugcaccagcucuggcaaggguaagccacagggagucagcagggcugagugugauggcgacacuuagcgugaagagggagauaagugaagagccacagcacuuuccagucaguacuggaaugcccuucauuuccagucauucucugaaaagugcucuuccuuuucuuauucagaaauuaaaucauugaggaaagucuguaagaaugagaugggaaauacucuguccccuaguuaguaagaucucauucaucucuggacauacagauuuaagcuuuagcaagauuccacgugaacagaguauugguuuuauguuuugaaaaucuuacuagauacguuggcguguucccacauccccauaacacucacaggccucugaugagggaaugccagaaaugggucugagggcagcaggugcugcggaggcacuguaggagcgaggcccugucccgggacacccauccugcuggggauucccuggagcaucugguccuccucagcugaggcugucaggugaagaaucucuggagcuggauguggacaaauccauucacaagacaagacacggggaugggcagucuccuugcucauugcacuguuuucccuggcuggauucguuugaucacugcuucucuaaagagcccuaagcucagaauuuagcugcuuaaacacauggucuugucucucugauuuuuuuuuccuuuuucauccaaguaauuuugugaaggggaaaacauccuccaauaacagcauuucccggggacucuccuccuggcaugcccacuaaccgcaccugcacccggcucucugacugaugccggcuccaccagcgguccggucugguccgguccgguccagugcagggggucuaacgguguguuuauuuucuccuccugcucugucucuacccagagucugaaggaaggccugacggugcaagaacgguugaagcucuuugaauccagggacuugaagaaagacuaggugugucccauccaaguugagcacgcgccuuccccagcuugcagcagcacaccccaagcgcugcuuuucaccuguaccuuuguuuuauuauuauuauuauuauugcuguuguugucaucguuaacugugggcauggaaugcgugaggcuggcuucuggguuguccacaccacucucugcuguguugacuuccuguugucuucaucaaagcuuuuuuccgugguauucuaaaauuaggccagcagugggggcugggagggcaucuguguuaguccuuuccuggcugugacccgccacacucacugucaguauuaaggcccagcagccuguugauaagcuacccugucucaccaugugcugguguggaaacggggcccagccagcacgccucaagguagauggaauccccacuggucagagaaaaagcuaugcggacacuccagcuuggccugggucacagcacugacuccucacccgcuagucuggcuguuaagaggagaaagugcacugccuuccagcccaggaggaggacagcauuuuguauuuguuccacugaugcagcuuagaaccacaccccugagagucguggcaaaccuuucacaaccuggaaaauguugaaagcaaccauuccuauuuuuguuuguuuuuuauuaaaucuugcacaaaauccccggccccucuccuuccuuccuuccuuccuuccuccgcucguuccuuucuuggucuccaguaacccuggucuuuucauaacugcucgagauuguugaccugcagcccagguuucagacucugauugcaaaaaacaaaugaauuccccccaggaaucauucaaaaugggggaagguuuggggguuuggguuuuuuuuuuaccuuuuggaaaagaaaccgucacauugcuuuggaaaagguugagaggagaccccuguuaagucaagaagaaaguacagaggaugucagaaucugaugagaacagcacauuaguguuuauugagacuccgaucuuaacucucauuuaauuaaucugagcucugaaaaccuaucuugcagcauuuaucuuuaaaagagccugguuaaaguaaaccuauacuaacaauuuugcuuuuucuaacaguuugaggaagaccuuuuuaaccaccacaaaacauucuauggcaauucuugaaaaucucuuaaauuggagucuauuauggccccaugaaaaccauuaaucccauuaagauagggaguauaaaccccuggcugguggaacagguucugcuacuuuaggagcaagguggggugugaguagaugguuuucaugccaagaacaugcuuucacuuuguauucaugcuuguguuggugugauggucucuguggguggguggaugcuuugggcguugaaaucuagaaauccuguugcucaguuucuagaugaagucaugagcaaggccaucaguggagcucuggccccgcccccaaugugcagaagggccgggagcaaggccuggaguuuucauguguuuucagacccagguuuaggugcucucuucucacugaaauaacuaagugcucuccacuggcaucgagcccuuuccacaaguuuuuaaggcucuuaacccacacuuucacuccucugcuacuagucuucaguguuguuaacagcaagagaaaauuggguuuguuuaaaaaucuacuucucugagguggcacaguugcguagcuguagucccagcuacucaggaggcugagguaguaggauugcuugagcccgggaggucgaggcugcaaucagucaugaucgugucacugcacuccagccugggugacaaagcaaggccccauaucagauauagauauacuuaucagacccccccugaccauuuagauuggcagugcuuugagaaaugcacuaugaccuuucugugucaaugggaauauacagaaggaacauucgggaccccgcugucccccacagccucauuguugucuccaggacacugcugggucacacgaaugcuccaggacagacagggaccuggagugcaucaggaucugaccagauaggaguuuuugccucgugucugggugcuacgauuuugugccguucucugagguccaccaccugcccuuccuggcaugguuuccuucgugaccaucccugcugccccuggggguggaccccacuggcccuucugcagacagcucccugccuucugcccuccaggggguucuggccagaguccaugcuuggagacaggaucaucugccuucagcccucacagugcuuuaaauuaaagcaaguuugcccauaggacaaaagagcauuugauucccuuuuuucugucacauaucccuugaggcuggacuucaggaauccuggaaaauuaauaugagugcagcaugugaggggucagagacaggccagcagggcgucugcauuccucccugccacaggucucuccccagaggcugguuuaguguaggguauugccaggaaacggacugaggcugcuuugcuaagagcuccugaaaaugcccugggccuguccuggcguuucugaagagcccucauacagggacagccaccaucugggucaaggaagucuggguucccugcuggugggcuccauccugcgauggagugaaccaggcgagaaaggaugacgauguucuucauguugcaccuggacaugccccaggaacagagacuugcccagguggcaacacuggcacagauguugacggcugcccaacuggugccacacugagcagggagccuugugcugcacagggcugggcccucucuccaguuuccuuccugcaggcauccaaauacccuggaagggauuuaaccccugaauuccagagggaagaaagaagaacagugaagaaguagaacugguuucuguauggggagaggaaagucuuagggacagcugcaggcggggucucaggcugcuccuuggcaccagcuacacaguagugagcuuucccagcuuuaccgaugaggaagaaguucaaauagauagacuucagcauuuuaauuauuuuccuauaaauguauuuauguguaguaugcuagcaccagccaguaagcugugccacacauaugaaugggaaagcgaggcaguugugcucgugugaguuucugcaggcuuguggguaauuaccuugugugcacgccugcacgugcagaauagucacuuucugcuggucaguuucuuuauccacccauggugccccagccccaggcagguguggagaccagcauuucagaggacgcgcuguccacagccucccgggucugaguggaucauugggcagggguggagacagugcgcugcccucugagcuggaagccugugcuucagggagucauaaugggccugugcuaagugggugaugcaguggacaucccagggcgacuagagguggcaguaucgcgaauuugcagguuuauugaacaagagguaacaucggagaggaucuugccuucggauucagcaaguaugaaggcagaagagcauggagagcaaggccccacagccugcuuagugaguuggaaggcccagcaagaaccuguuucugcagcagccaccagcucccaucaccccuugacccuccagcucaugcuggagaagagggaauuuuggcuguuuaaagaacacaguugugaaucucagaaugugccugaaaggaauacugacagauaaggccggaaacaaaacugauggcuugaaaaacauuuuuauggaauguauuuacuaucauuuuguuuuacuauagagguagaugggacucuuaacuuuuggguacauggaaacaugcugaaaacugaacacaauccugaucaucacuccugccuggcugucuccugggaggcugccgggugccacggagcugggacacagcagagcccgcuagguguugcagggcccuggaggccaaggccacccuguguggggucccuguuggcagccaggucccuacacaaacaaguaauccuguuuggccuccuagguuuugcauaugaccugcagccuaauuugggguguaggggaagcucugcuggccccugcuccuuuguauguugggugacuuuaauggcuggccacauaccccuuucucccagcuacucauucacugacuuggguaaguucuaagacaguucgcacuuagaaaagaaugugacacaucaacauuaacuuuuccugaaaagaagaguuugccuaacaugguccuaaagaagcuuggaauuuauaagacuuuccuuuauaagauauaguggggguuuuuuuggguggagggggguuguuuuuuguuuuuuguuuucaagacagagucucgcucuguuguccaggcuggaguguaguggcaugaucucggcucacugcaaccucugccucccagguucaugccauucuccugccucagccucccgaguagcugggacuacaggugucugccgccacgccuggcuaauuuuuuuguauuuuuaguagagacgggguuucaccauguuggucaggauggucucgauuuccugaccucgugauccgccugucucggccucccaaagugcugggauuacaggcgugagccaccacgccuggccuauaagauacgguaaaaaaaaaaaacugugaccccuuugucacuaagggagaaagaaauuaaguauugucaaaguucuauaaagaauggaaauguaugauauuauacuucaaaggaauuugauguugaaauuuuaaagaaaauuugucauguugaugagaagcuucacuuuccugggaacuucauucguuuuagggcaugagauaaaaguccuggcuaggggagccauaggucuguuguacaaggaauuugcuuucuaaacaaguuguaacuugcccuaaggucccuguuggagcacuaagaggugacacaggccagagacaacguuucguuuccccuucccugcaagcugggaucagcccuguguuuucuccuuucagcugaagugagcgaagguucucagugcuggcaaaagagcccacuuucuaaaaggacuugggaagaaagcugcugggaacuugcuuauuaaaaaguuccuuagaauuaagguaucuacccacuguuuucgcaccuuucaccuuccugggcuuuccugcccuccagcauucuucucuagagagguuccuagcccgcucagcgcgagcgucuccaguagguaauagcagcugaacguggguuuuccacggacuucaggcuuggaggugccauauacaagcacacuucuuccuuccccuggcuucuccaugccaccacccacuuuaaagauguaaacucaguagauuuuucauccagugaacggucaucuucacaucgaaaggugaaggccaccacuguucucaaugccaagcaacagaacguucugagauggccguucuuccuugcacagcagcuacggcagguuguucugcagccaccccuuagagggggcucuucguuuuaccuuuguacaguucuuguguuuacacauuugggccaaacagcuuucagcaagggcauguguccacagcugaugggcaguuaagaaccagccugagcugaaggcuaguaauaccgugcuguaggcucuuuaaaaggaaagccuggcauaaacccagcauggaaaggaacauuaucaguuaucucaaauuuugucugccagggacaagacccuguucauucuuuugcccuuuucagaacugugagcuucaaguauucuugcuucucuguaaagggaagacaucucccuucucugaaauccuucaacaaaagaaaaggcucuuggcaggguaggggagucaguagcucaacacuagaucaucccuagagauggggcaaguuucugucugaacacgucuuggguccgaguccuuagguguucggaugcaguacuuugugaauacuuaagcuacugcaugcuugguguagcuugcaauuucucuguauuuaaaagcagcuguguuuauuuucuucaaaauaaccuguauauuauuuagagcaagcaauguaaauauuacugagaaguuacugcagggauuuuugugacagaguuuguauggguuuuuaaaaaaaucuuagacaccccuuuuuaagauggggagaacaggguugacugcaccguugaagcccgcccagcauuauaaggaaauguuuuuaaugacugcugcaucuuuguaaaacguuuggucaucuaacagaugguuuuaaaguguacaauauccaaaauaacgauagcccuguauccauacauuguuucauugaaagaauucucuauugccucuucuugguagagccagaguccuuaaggaaaaucaggaaaauuaagaaaaugauggugccaucuugaccagacuucugcacaguaauuuaacgcuauccuagggagacuugguugaaggcacaguucugggaucagggucuaaaugugcaguuucugagaaccuucaagaccacucacugggcagggcucuguggagcacuggagcuguuuggauuccccagcccuuuggucauauccuggaauuccguggaggcugcagaacuuagaugcagcuguuuuuuacagcaccuauuuuugucagauugguaaggaaacacugagucacagaauacuuaagaauuggagacuccaguaauguaggauggccugagaggacguccaagucccaagggguggacacggcauguuccucgggcacagccucagugggggccuuccccaggcgcagcucggccaccugaggaaaggguguuucggaggcgcagccacacacacagcgcuggcagccucacggucacgcccaucacucccugccccccacugcccuugagaaguuaguggugucacauccuuaguuuuauagacagcuaggaauagauugugaagaacacucaguucacuacuguguuacauuuauaucacaagcuucaauuaaaauggauuuuaaaggauuuuaggauuuaccuuuaguauuaacaacguaucuacugacauacuguuaggauucaaaaccaguuaaguauaagaauuacuucaugugguuuuccuaggguacaauuuauaaaagguagaaagcauccaaguggcuccucaacaauuacaauucuuaaugauuuuucucacagcugugcccuucugucagggucagugucaaaauucguuaucaaaggcaaaaccuacugugccaagcuggggcgcuauaugugaacggaguggaaaugcuucagucaccucugccgcagcuugugauuccagcaguucucacaaacguucugucacaugaugaaaagaagcagcuuguauaauuccaacugguguuucauuucuguucuaaugcuaagugguaacgcuuaacaaacagacuaaaagcugugugcagaagaaagggcugaaugaguaccgccucccuagguuccagcacagcgcucgggucuaagaaguagagccccgggguagggugggccauccacugucaggccagugucucaagaaagccugaccagcugagcugcugcuuuuuuuuugggggggggggggggaggggcgucuugaggcuuuuuuuuuuuuuacaaaguuaguuugugaucaacgauucacuacaauugaaguguuacuuugucagaauauuuauuccuuugugugacaugcuagauucccuggauguagcugaucauuuuuauuuuguaaauauuaccuaacuuuacauaaacuauaucauaauaaacuauuuuugcaucacccuuug

SEQ ID NO: 192245 - RNA, 149889 nt, Homo sapiens
caaagggugaugcaaaaauaguuuauuaugauauaguuuauguaaaguuagguaauauuuacaaaauaaaaaugaucagcuacauccagggaaucuagcaugucacacaaaggaauaaauauucugacaaaguaacacuucaauuguagugaaucguugaucacaaacuaacuuuguaaaaaaaaaaaaagccucaagacgccccucccccccccccccccaaaaaaaaagcagcagcucagcuggucaggcuuucuugagacacuggccugacaguggauggcccacccuaccccggggcucuacuucuuagacccgagcgcugugcuggaaccuagggaggcgguacucauucagcccuuucuucugcacacagcuuuuagucuguuuguuaagcguuaccacuuagcauuagaacagaaaugaaacaccaguuggaauuauacaagcugcuucuuuucaucaugugacagaacguuugugagaacugcuggaaucacaagcugcggcagaggugacugaagcauuuccacuccguucacauauagcgccccagcuuggcacaguagguuuugccuuugauaacgaauuuugacacugacccugacagaagggcacagcugugagaaaaaucauuaagaauuguaauuguugaggagccacuuggaugcuuucuaccuuuuauaaauuguacccuaggaaaaccacaugaaguaauucuuauacuuaacugguuuugaauccuaacaguaugucaguagauacguuguuaauacuaaagguaaauccuaaaauccuuuaaaauccauuuuaauugaagcuugugauauaaauguaacacaguagugaacugaguguucuucacaaucuauuccuagcugucuauaaaacuaaggaugugacaccacuaacuucucaagggcaguggggggcagggagugaugggcgugaccgugaggcugccagcgcuguguguguggcugcgccuccgaaacacccuuuccucagguggccgagcugcgccuggggaaggcccccacugaggcugugcccgaggaacaugccguguccaccccuugggacuuggacguccucucaggccauccuacauuacuggagucuccaauucuuaaguauucugugacucaguguuuccuuaccaaucugacaaaaauaggugcuguaaaaaacagcugcaucuaaguucugcagccuccacggaauuccaggauaugaccaaagggcuggggaauccaaacagcuccagugcuccacagagcccugcccagugaguggucuugaagguucucagaaacugcacauuuagacccugaucccagaacugugccuucaaccaagucucccuaggauagcguuaaauuacugugcagaagucuggucaagauggcaccaucauuuucuuaauuuuccugauuuuccuuaaggacucuggcucuaccaagaagaggcaauagagaauucuuucaaugaaacaauguauggauacagggcuaucguuauuuuggauauuguacacuuuaaaaccaucuguuagaugaccaaacguuuuacaaagaugcagcagucauuaaaaacauuuccuuauaaugcugggcgggcuucaacggugcagucaacccuguucuccccaucuuaaaaaggggugucuaagauuuuuuuaaaaacccauacaaacucugucacaaaaaucccugcaguaacuucucaguaauauuuacauugcuugcucuaaauaauauacagguuauuuugaagaaaauaaacacagcugcuuuuaaauacagagaaauugcaagcuacaccaagcaugcaguagcuuaaguauucacaaaguacugcauccgaacaccuaaggacucggacccaagacguguucagacagaaacuugccccaucucuagggaugaucuaguguugagcuacugacuccccuacccugccaagagccuuuucuuuuguugaaggauuucagagaagggagaugucuucccuuuacagagaagcaagaauacuugaagcucacaguucugaaaagggcaaaagaaugaacagggucuugucccuggcagacaaaauuugagauaacugauaauguuccuuuccaugcuggguuuaugccaggcuuuccuuuuaaagagccuacagcacgguauuacuagccuucagcucaggcugguucuuaacugcccaucagcuguggacacaugcccuugcugaaagcuguuuggcccaaauguguaaacacaagaacuguacaaagguaaaacgaagagcccccucuaagggguggcugcagaacaaccugccguagcugcugugcaaggaagaacggccaucucagaacguucuguugcuuggcauugagaacagugguggccuucaccuuucgaugugaagaugaccguucacuggaugaaaaaucuacugaguuuacaucuuuaaagugggugguggcauggagaagccaggggaaggaagaagugugcuuguauauggcaccuccaagccugaaguccguggaaaacccacguucagcugcuauuaccuacuggagacgcucgcgcugagcgggcuaggaaccucucuagagaagaaugcuggagggcaggaaagcccaggaaggugaaaggugcgaaaacaguggguagauaccuuaauucuaaggaacuuuuuaauaagcaaguucccagcagcuuucuucccaaguccuuuuagaaagugggcucuuuugccagcacugagaaccuucgcucacuucagcugaaaggagaaaacacagggcugaucccagcuugcagggaaggggaaacgaaacguugucucuggccugugucaccucuuagugcuccaacagggaccuuagggcaaguuacaacuuguuuagaaagcaaauuccuuguacaacagaccuauggcuccccuagccaggacuuuuaucucaugcccuaaaacgaaugaaguucccaggaaagugaagcuucucaucaacaugacaaauuuucuuuaaaauuucaacaucaaauuccuuugaaguauaauaucauacauuuccauucuuuauagaacuuugacaauacuuaauuucuuucucccuuagugacaaaggggucacaguuuuuuuuuuuuaccguaucuuauaggccaggcgugguggcucacgccuguaaucccagcacuuugggaggccgagacaggcggaucacgaggucaggaaaucgagaccauccugaccaacauggugaaaccccgucucuacuaaaaauacaaaaaaauuagccaggcguggcggcagacaccuguagucccagcuacucgggaggcugaggcaggagaauggcaugaaccugggaggcagagguugcagugagccgagaucaugccacuacacuccagccuggacaacagagcgagacucugucuugaaaacaaaaaacaaaaaacaaccccccuccacccaaaaaaacccccacuauaucuuauaaaggaaagucuuauaaauuccaagcuucuuuaggaccauguuaggcaaacucuucuuuucaggaaaaguuaauguugaugugucacauucuuuucuaagugcgaacugucuuagaacuuacccaagucagugaaugaguagcugggagaaagggguauguggccagccauuaaagucacccaacauacaaaggagcaggggccagcagagcuuccccuacaccccaaauuaggcugcaggucauaugcaaaaccuaggaggccaaacaggauuacuuguuuguguagggaccuggcugccaacagggaccccacacaggguggccuuggccuccagggcccugcaacaccuagcgggcucugcugugucccagcuccguggcacccggcagccucccaggagacagccaggcaggagugaugaucaggauuguguucaguuuucagcauguuuccauguacccaaaaguuaagagucccaucuaccucuauaguaaaacaaaaugauaguaaauacauuccauaaaaauguuuuucaagccaucaguuuuguuuccggccuuaucugucaguauuccuuucaggcacauucugagauucacaacuguguucuuuaaacagccaaaauucccucuucuccagcaugagcuggagggucaaggggugaugggagcugguggcugcugcagaaacagguucuugcugggccuuccaacucacuaagcaggcuguggggccuugcucuccaugcucuucugccuucauacuugcugaauccgaaggcaagauccucuccgauguuaccucuuguucaauaaaccugcaaauucgcgauacugccaccucuagucgcccugggauguccacugcaucacccacuuagcacaggcccauuaugacucccugaagcacaggcuuccagcucagagggcagcgcacugucuccaccccugcccaaugauccacucagacccgggaggcuguggacagcgcguccucugaaaugcuggucuccacaccugccuggggcuggggcaccauggguggauaaagaaacugaccagcagaaagugacuauucugcacgugcaggcgugcacacaagguaauuacccacaagccugcagaaacucacacgagcacaacugccucgcuuucccauucauauguguggcacagcuuacuggcuggugcuagcauacuacacauaaauacauuuauaggaaaauaauuaaaaugcugaagucuaucuauuugaacuucuuccucaucgguaaagcugggaaagcucacuacuguguagcuggugccaaggagcagccugagaccccgccugcagcugucccuaagacuuuccucuccccauacagaaaccaguucuacuucuucacuguucuucuuucuucccucuggaauucagggguuaaaucccuuccaggguauuuggaugccugcaggaaggaaacuggagagagggcccagcccugugcagcacaaggcucccugcucaguguggcaccaguugggcagccgucaacaucugugccaguguugccaccugggcaagucucuguuccuggggcauguccaggugcaacaugaagaacaucgucauccuuucucgccugguucacuccaucgcaggauggagcccaccagcagggaacccagacuuccuugacccagaugguggcugucccuguaugagggcucuucagaaacgccaggacaggcccagggcauuuucaggagcucuuagcaaagcagccucaguccguuuccuggcaauacccuacacuaaaccagccucuggggagagaccuguggcagggaggaaugcagacgcccugcuggccugucucugaccccucacaugcugcacucauauuaauuuuccaggauuccugaaguccagccucaagggauaugugacagaaaaaagggaaucaaaugcucuuuuguccuaugggcaaacuugcuuuaauuuaaagcacugugagggcugaaggcagaugauccugucuccaagcauggacucuggccagaacccccuggagggcagaaggcagggagcugucugcagaagggccagugggguccacccccaggggcagcagggauggucacgaaggaaaccaugccaggaagggcaggugguggaccucagagaacggcacaaaaucguagcacccagacacgaggcaaaaacuccuaucuggucagauccugaugcacuccaggucccugucuguccuggagcauucgugugacccagcaguguccuggagacaacaaugaggcugugggggacagcggggucccgaauguuccuucuguauauucccauugacacagaaaggucauagugcauuucucaaagcacugccaaucuaaauggucagggggggucugauaaguauaucuauaucugauauggggccuugcuuugucacccaggcuggagugcagugacacgaucaugacugauugcagccucgaccucccgggcucaagcaauccuacuaccucagccuccugaguagcugggacuacagcuacgcaacugugccaccucagagaaguagauuuuuaaacaaacccaauuuucucuugcuguuaacaacacugaagacuaguagcagaggagugaaaguguggguuaagagccuuaaaaacuuguggaaagggcucgaugccaguggagagcacuuaguuauuucagugagaagagagcaccuaaaccugggucugaaaacacaugaaaacuccaggccuugcucccggcccuucugcacauugggggcggggccagagcuccacugauggccuugcucaugacuucaucuagaaacugagcaacaggauuucuagauuucaacgcccaaagcauccacccacccacagagaccaucacaccaacacaagcaugaauacaaagugaaagcauguucuuggcaugaaaaccaucuacucacaccccaccuugcuccuaaaguagcagaaccuguuccaccagccagggguuuauacucccuaucuuaaugggauuaaugguuuucauggggccauaauagacuccaauuuaagagauuuucaagaauugccauagaauguuuuguggugguuaaaaaggucuuccucaaacuguuagaaaaagcaaaauuguuaguauagguuuacuuuaaccaggcucuuuuaaagauaaaugcugcaagauagguuuucagagcucagauuaauuaaaugagaguuaagaucggagucucaauaaacacuaaugugcuguucucaucagauucugacauccucuguacuuucuucuugacuuaacaggggucuccucucaaccuuuuccaaagcaaugugacgguuucuuuuccaaaagguaaaaaaaaaacccaaacccccaaaccuucccccauuuugaaugauuccuggggggaauucauuuguuuuuugcaaucagagucugaaaccugggcugcaggucaacaaucucgagcaguuaugaaaagaccaggguuacuggagaccaagaaaggaacgagcggaggaaggaaggaaggaaggaaggagaggggccggggauuuugugcaagauuuaauaaaaaacaaacaaaaauaggaaugguugcuuucaacauuuuccagguugugaaagguuugccacgacucucaggggugugguucuaagcugcaucaguggaacaaauacaaaaugcuguccuccuccugggcuggaaggcagugcacuuucuccucuuaacagccagacuagcgggugaggagucagugcugugacccaggccaagcuggaguguccgcauagcuuuuucucugaccaguggggauuccaucuaccuugaggcgugcuggcugggccccguuuccacaccagcacauggugagacaggguagcuuaucaacaggcugcugggccuuaauacugacagugaguguggcgggucacagccaggaaaggacuaacacagaugcccucccagcccccacugcuggccuaauuuuagaauaccacggaaaaaagcuuugaugaagacaacaggaagucaacacagcagagagugguguggacaacccagaagccagccucacgcauuccaugcccacaguuaacgaugacaacaacagcaauaauaauaauaauaauaaaacaaagguacaggugaaaagcagcgcuuggggugugcugcugcaagcuggggaaggcgcgugcucaacuuggaugggacacaccuagucuuucuucaagucccuggauucaaagagcuucaaccguucuugcaccgucaggccuuccuucagacucuggguagagacagagcaggaggagaaaauaaacacaccguuagacccccugcacuggaccggaccggaccagaccggaccgcugguggagccggcaucagucagagagccgggugcaggugcgguuagugggcaugccaggaggagaguccccgggaaaugcuguuauuggaggauguuuuccccuucacaaaauuacuuggaugaaaaaggaaaaaaaaaucagagagacaagaccauguguuuaagcagcuaaauucugagcuuagggcucuuuagagaagcagugaucaaacgaauccagccagggaaaacagugcaaugagcaaggagacugcccauccccgugucuugucuugugaauggauuuguccacauccagcuccagagauucuucaccugacagccucagcugaggaggaccagaugcuccagggaauccccagcaggaugggugucccgggacagggccucgcuccuacagugccuccgcagcaccugcugcccucagacccauuucuggcauucccucaucagaggccugugaguguuauggggaugugggaacacgccaacguaucuaguaagauuuucaaaacauaaaaccaauacucuguucacguggaaucuugcuaaagcuuaaaucuguauguccagagaugaaugagaucuuacuaacuaggggacagaguauuucccaucucauucuuacagacuuuccucaaugauuuaauuucugaauaagaaaaggaagagcacuuuucagagaaugacuggaaaugaagggcauuccaguacugacuggaaagugcuguggcucuucacuuaucucccucuucacgcuaagugucgccaucacacucagcccugcugacucccuguggcuuacccuugccagagcuggugcagguacaggcuuuacugagaaacuggaagcugaagggaugggcucuagcucagggucugccugauucuaccaguuucaaccaaaaaccugagcaacgugaaacugcaggcuguaccccaucuacugggaagucgccagcuuaggcucaggcacacucuggcacuguccuggagacucuggugugauagacuggggacugagcaugggcuggucagcuugaggcucccuccaaagcucaagggaagggggagcuccacugucccccaccccacccagcucuacccagaacagaccugcuuguuugcuauauucuggagcuaugugucuguguaaauaaauaaacaaugugauuuuuaaauacaggguucugcugcuaagcauuuuaaaacucacugguccaggccgggcgcgguggcucacgccuguaaucccagcacuuugggaggccgaggcgggcagaucacgaugucaggagaucgagaccauccuggcuaacacagugaaaccccgucucuacuaaaaaauacaaaaaauuagcugggcgugguggcaggcgccuguagucccagcuacaugggaggcugaggcaggagaauggcgugaacccgggaggcggagcuugcagugagcagagaucgcgccacugcacucuagccugggcgacagagcgagacuccgucucaaaacaaacaaacaaccucacugguccaggugagccucaccucaagcaguugucacagcuugauaauuguguguuucugagaggguuucuuuggaagccugccacagagaguggcugggggaauggggggaaaauccaucucccauucugagcccagauguaccucaacacccaugccugcuuccaggugcccuuggggggucccuccccacagagugcaggguucucacagcagucagucuugcagaggaccuggguagacaucuggucaccauugaaggggcuggggccaagccaggcaggcagcccugagccuaagugcuacucagaggcaggccccggagcauggcugggggaugucacugacaucccgguuccugcuuguuggggacuuucugucaggacuguagugaguuugaucacuccuaaggccuggguuugcuccuugcaggcacugcgucagaagccccagauuccugcuacagcaggcccaggggaggggagcgcccugacagccacagcacccagcaugcucgcuacuggcuccugccccagugacaaagggcagagcucaggcucaggugaugcugggcuugcuacaauuccaagggugggaaguaagugaaauccccuacguuauucccacacuggcugcaggaggcuguuucucucucuacguccucuggauucucucccgguggcugcucagcccaaggcucagccagcucccucugggguucaucucccccuaggcuguugucuccacugagugccuccuguagccccacauacugagcugaccacagacacgggggccccuuaagaaccccgagggaagcauucucuggucucaaucccagaaaaggcugugcugcuccuaagcaacuugcugucuuugauuuuguagcagcugagacuugcgguccuuucgagcgaggcaggacagaaaaacagaacagaacaaaagacacagaucagugcacaucagaugccacaucaaaaaacaccacugagaaguacgguuucugggcaacugcauuuccaucuucuugaaggguuggguggagucuucagauacaguugaggaaaaggaugacacccacccaugccugugccuccuaaugucuccugggagcgcgaacacggccccauccugcccuguugcaccacagacaucuaggaaguccucgacuuucugcuggggccagcaggacuagcccugcacuccaaggauuuuuauuacggaaacccagccaagccaaacaucaacuuaaaaacacauaaggaggaggaccccauccugggguuucucuccauccuuuucagucugcccuggggcccagacagucugcucccucaucccugcucuggcugguucccagccacugugagaggcccccacccacucacugcacagaguuacugucaggggcccguggguguugcacagccucccuggaaggguccugucagugacagccggucccaugucacuuauagacaugguccaaaagcccaaaucacuaauagugaacuucaaacuccuucaagaaaagcucaaagauacuagcuacaguuuagccucaaauaaguaguagaaucuucaguaagaaaaccgugaaccaaaaaagaacaaguuuccuuuugcuaaacaaaacguuauguuuaaagaaaaaugcccaagcuaaguuuucaaucaagccuaaaccauauuuggguauaggggacuuagaacuguagaaaaauaaaaccaaacugacuaggcuuaaaaccuucaacucuuuaaccaagccucaggaugaaguccuucggacggcggggugcugugggugugccugagaaagggccagcauggggaggaagacgugguucuugcuuuccuccauguucucauuccgggaugaacgagaucaagcuacugagccggcaacuacucauucucagggugucucccaccaugggcccucccccaccuccucucuggcauagggccuucaauggcaccuagugagaagcuuuuguuuuauuaaaaaaaaaaauacugguaaauauuucgccccuauugcuuguaguuaucacgcucuucugaaccaucuucaccaagcucuaguccugguuuauccauuccuagaaugaccacccuguuagccuugacagacagaggccacuaaguggcucacuaggugggcgaggccuuuggugacgguagacuucacuugccaguguggacaucuguaaauuccaccucgugacagagggcaagacaaguguccccugaggggguggagugaguucagccguugugcacagauuauccaacaugcaugcugaugggugccuggcucucugccugcccaccaggcuagaggagcaccucacugccagggucaucucuguuaagagguuagagugccaauuaacuccccagagcagguuaaagaaaccucacuuggauuugguauguguuuguuggagcaggaugaauugaaauaaaguaaccaugacacaggcguuugccaugggggugugagcagugcaugcaggcggugggagaggcgguuuaccuccugcaugggccgggaagcgggugcauuucagguaucccacgagaccugcucaauuacggacugucagaggagagagcagacaugagacacacaaccaaucccaaacacacgcggugccgcucccaccuccgcccgcccuccugugcauggcuggcucuggacagcacacuaaagauguacugcuuccuggcuggggaacaagagcaggcagcaucaucucuuggaggcggcaccagugucacaacagugaugugcaaggaacaacacaggcacagcugacagcaggccgacaugagcagggcugggugaaaccuggccucgaggcaggagcugaucaugccaagcacugcucuucacagcccuggccugucagugucauugccaggagguggcuccaagacagacacagagcucaaagccaccagaaccagcccagcagggugagcucgggcuggcucagugcugggcccuggggcuuuggcagcuguggcccaugggagcacucauacuucaauuugggcuacucuccccagugucccucaagccccucccaccagggggcuggaccccagacucaccuuggaccugauguuucugaguugccgggugacacaggaucugucuuucuucaagaagucaggguugcuuuuagauuucauuauaucugcgguauauaaugaaaacaaacagaccuguuaccuuugcuuucuaaaacccucuggaaccagacuaaauccugaaacauuucccaagcuuccuacugcagcauacuuaggacaauuccuuaaacaacucuaagggaauucaaagccaauaaccauaaaacaugcuagaucucuucagaccaccauaaaacaccagcacaaugggagaauguguauguggggccccgccagggcuuccugcacugugacuguagcccacaacagcauucccuucaaagggacuugguccccucacucuggugugggaccucaaugcugagcagaccccuacccccauuauccaugauucucuaccuuccuccugguagcacagggcugucuaaagcaagaugauaaggccaaggccuucucauuguccacccacccagauagcaguccuuuaggcuucuuagaaaugucuacuuaaguaccuguaacacaaacagauacugagucauaucacacauccugugcaugugugggguuuuuuguuuugcuuuuuuuuuuuuuuuuugagauggagucuugcucugucgccaggcuggagugcaguggcacaaacucagcagcucacugcaaccucugccuccuggguucaagcgauucuccugccucagccucccgaguagcugggacuacaggugcgugccaccauguccagcuaauuuuuguauuuuuaguagagacgggguuucacaauguuggccagacuggucucgaacuccugaccucgugauccacccgccucaaccucccaaagugcugggauuacaggcaugugccaccauguccagcuaauuuuuguauuuuuaguagagacgggguuucacaauguuggccagacuggucucgaauuccugaccucgugauccacccgccucaaccucccaaagugcugggauuacaggcgggugccaccacgcccgcccucuguuucuuuuaagagacagauucuugcuguguugcccagacuagaaugcagugccuauucacaggugugauuccaccacaggucagcacagguuuuuuuuuucuuuuuuuuuugaggcagggucucauucugucacccaggcuggagugcagcaguguaaucauggcucacugccauuuccaccugcugggcuuaagugauccucccaccucagccucccaaguagcgcugggacuacaggugcaugccagcagucccagcuaguuuuuuuguauuuuuuguagagacaggguuuugccauguugcccaggcuggucuugaacuuuugagaucaagugaucugcccaccuagcuucccaaagugcugggauuacaggugugagccacugcaccuggccagcacaggaguuuugaccucuuucauuuugaccugagccaguucaccccuccuuaggcaaccuggugauccccuacucgcaggaggucaccauauugaugccaaacuuaguguggacaccugaucgacuuagcuuugugugugacugccuagaacuccugggcucaagugauccucccaccucagccuccuggguagccaggccuaccaccaagccugacuacucaagguauuuauggaaaaaugaagucuuccucccagcaucugucaguacauaaucacuauuccuugccugacagaaaaaaaguugauuuuuucuuuuuugauauuagugagcuagcacaucuuuuccuguuugugcgucucuguauaaaaaaucaagaugaaggucaaaugaaauuauguauaaucuggccaggugcaguggcucacaccuguaaucucagcacuuugggaggccaagguggcuggaucgcuugagcccaggaguuugagaucagucugagcaacguggugaaacucugucucuacuaaaaauacaaaaauuagccagguguuuuguggugcacuccuguagucccagcuacuggggaggcuaaggugggagaauccuugagccugggaggcggaggcugcagugaaaucacgccauugcauuccacccugggcaacagagcaagacccaguuucaaaaaaaaaaaaaaaaaaauuacguaugagcugaaaaugcuugauaaaauguuaacucuuucauccuuccugccaucuauuuuuuacaggguaccuaaauguuuuuagccaagaaaaaaagggccaguucuguuguucauuccagaaagcagggagcucccucccauucuccacucuauggccuuuuacagauauuauagucaaauccuaggaucaagcagcuagugagagcuacuucugcccagugguugaguucuuuagaaaaauaagacuuguuauuauuucgaaaauauuaugcugauacuauggguucucccuagagcaaucagcacagcauccacugcugcgauggggagagcaaggccugucuggggcagccgugugaagcuggugcuccugcuccacugggaugccugggucuacaagcaucacugggacucuucugcuucaagucaagcaccgggaaaccucuacgaccaaacccccauaagccccccagcaauaaccgagagggcaugacccgaggacgcaccauauccggacaccguggcacugucaggggacuucucccccagugcuuccguugcagccuugagcugcuccuucaaccugcugaugucacagucagccuuagccuucgcgaugcugagcucuguguagaugucuuuguacuugucacuugcguacuucuuguccuugggagugaaaugacagagaaugguaguuacauccaggaaagaggagcacauacaacauggccugucuuccuggggacugaacacgguagggaggcuugcugugggcggaagaggaggcuuguucaccucugucuucuagaggcagacaguggacagagaggaaaaaccacggggccuaaggacacgggcacagccaucaggacauggcaggauaaucuccaggcccggugagugcaggaggcaguuccgggauugcccgaccagccugguguggcccugagugcccaggccccucccuugugggcuucagccuggaaauccucucuguguccuagauucccuaggugacugagugaccaccaaugauucugucaucuccccugacuccaggagucccuggaggaggcugguggaagccagggggcggcucaaauggaagucaagccuugccucacuucacaggccuuuucucuggaacauuccucccaaggcacacaaaaagcacauacacacugaagcuggagccaggccaggcagguugcucauguccacguucccacagcaccugccugcaggcuggucuuuuaagagggcuugauuuuggaaaccuccuuccucacaagaguaaaaucugcuucagaagagcccgcgcugagcaccagccugaguucaggaggcgcaugucaccuagagccuguucccguacccgcccuccuguggugcgguggccuuacccgcagugccgucugcagcucauccuugagggagcuaaucuccuguuucagguacuguauuuccgauuccuuuacccgcaauaagaccuaaaaugacagagagaucagggaccaauauucaggagcaaagaaaccuccagagucuccacagcaggcugaagcgugcagagggcucuccaaucaccagugagcagggcagccucguggugcccaaugcgggcaagcaucguuuaaacaccgcucacagcuucagccucacauacagaaacaggaagaggaaggaaauggccgugauuccucccagugccaaggacucccuccucagccuggggugcugugaacuagaccugcuugucucuggggaccaagcccgcgagaaucaggaaauguuaccacugacacuugugucagacucacucagccucucuugcccgcccuuuugguaaagcacucauuuaguacaaggcacaggcacagcagacagcggcccaacaccuggacucggggcaggagcugaucacaccaagcacuggucccucccagccuuggccucucagugucacugccaggaggcggcuccacgacagagacaaagcucaaagccaccagaaccagcccagcugggugagcucuggcuggcugagugcugaaauuuuagcacauuuuagggugaaauuuuaauugaauguggagaaaucuaagugccuuccuaaaaggacacccuauacuccagaauccaucauucuaacauaaagcgagccucccugaccugagcugcagcagccacauggcuacagaacguguccuuuugaguggucaguguuuguggcauagcagaaauggaggggaguggguggagugagauggggucaggauccccacagccccucgagggcuccacucggcuaguggcucucaugccaccuggcagcucacugcuccucgccgccuucgggugauuuggaucuuccuggacccugugacuccugcugucucaggucuguuccucccacaacccuguaagacaggggccaugcugcacuccccugggguuccugggugcagagcugagucaggcagggccuggcuccugaugguaccucuaguucauaggcauccuugcccugugcaaggggugacccaguggccuccccaccgccguccccagucagcagcguccgcaaccgugugaucucugcagccaggcgguuguucagcuccugggggacagcaacacaacagugacacuccagagcugccuggggccaagucgcaugacacaacccgggaaggccauuucccuagguucuuuguguaucuguggaacugcguaggcaggauccaaucgauaacccuuaauuccuuucugucacaauaacuagugucaaucuguuccauggcuggucccaucugagcuccugugggguaaucuuuaagccacagcagcagugaguggacccaguccugccugagcagccucauacacagcccugugcagcagccaugccccuugggaaggccucaggugagaaagggacuauguucccagccccaggggguguuugugcagggcagggucauagagggcuguuuuaauuuggugcccacagaaaagccaauauugaacgaauccuggcuugaaccuuuccauuagccaggauuuaaaugcaccccaauuaacuaaggagcaagcaaaucuuuuuuuuuuuuuuuuuagacggagucucgcucugucacccaggcuccgccucccgaguucacaccauucuccugccucagccuucccaguagaugggacuauaggcgcccaccaccacacccagcuaauuuuuuguauuuuuaguagagaugggguuucaccauguuagccaggauggucucaaucccugaccuugugauccgcccgucuuggccucccaaagcgcugggauuacaggcgugagccaccgcgcccggacagagcaagcaaaucuuaagaaaaaaaaucugacaaaaauaaaugugagccguaagccugacccugagaagugucagcucaaucccugggggacaggauccuggaggauugggaugacccugccaggcccugcccagaaacagugagccagagguucagaggagcacagagaagacaccaagacacccgagagucucagaaagggucaaagcaagagugaugucauguguaagcagguggugcacguggcaguacagcguugcucuagcuauccgcggugauguuucugacaacacagauggccacgcuggguggcagggagaagcccuggggcagguaaccacucugugguucagggaccuucaugccacuuugagggugaggccuggcuccagcuccaguguggacucaccugacuaugggucuaccugaccuugagugccccugacuaaccuugggcucaccuggcugcaggcucaccugguugugggcauugagcuccugguucucacgcuggcacugccgcagggccugccgcucggccuccagcgccugggccagaugggcauucuccaggcacuucugcgaguacugcuccgagaggaccuccaguucccgcugcaccgacugcagcuccucccuggggagagggcagcacucacuccucugccugcuucuggacaaggccucucagaggccggugucccuccuugacaccagacacagccaagcacaggucaggcccacacagucuguugucuuaaucagccugggucauacagaguaagggaucccuuacagagauggccucacgccccucccugguccuuucucacagucugacaguccuacagcuagcacuucucuggggaugccagucaggacagaguccagucugcagccacacagaacccccauuucuagaacucucuucugacucagaauuuguuuucaguaaacccacuuuugaagccaucugugucugacagccaggaccaggcucuacacaagacccaaaaacccaagcuuccugaggcuguucugccacccuggauccaggagggccguccuccugcaggugaaccagggaugaggggcuuccaggugggccacccugcucugaccaaggucagcgugagccucuacagggugcugcugacugcugccagcuccugaggcagggccccuggcuucggcuaugcuauaaaggcuccugguagagccugagugccgugaggcucaugguggccaaucugugggcuucuggcugugucaauucuaccaagugaaaaaagucuacagcaguuuuucugguauuuuucuauccugccugugcagagggaaucagcacgugugguuuuaaaccacagugcuaguucucacuucugcccuguacgaccaagcccggcugccuggcuccuggugggcuagcagggcagcugucgaagaacacaucugggcaguugcugggaucagcccuggacaagaggggaguuuaagauuucguuuguuacaucucguucuuggcauuucgaggaacagucucucugaauaaaggaggccccacuugggccauauccugcacuggacaagagggcaucugagcugcccucagcacccaggggccccaggccccacuucuggaggccucugcaaagacacaggaagggcccagcuguggccuggucagcaccccagaggggcccucccaagggcagaugggcaggcccagccacuuacagguacuggcgccgcagggccucaacauccgaguugacgcugcugaucugggaccgcuggcucuucuccagcucccgcuccauuuccucccggugggcguucuucauggcuucgauggcugcaggcaaggacacggccucagcaccgagggaccacgcccuuccugcugacagggguggggguggggagcuccacacaaugggauggcgccugccacugcugaugcuugcuuagucaaucagcaguuggauuuugcaugacaggcuggccccucaugaaccaauucucugaggugggugcaggcugggagaauucuucaugaacucccccuggaaggaaugcacguuuggcuuuuuuuuugguguuagaagaaaaccaaacugauuaaauaaaugucauuguuaaauuccaacaugaguuuauaaaacaagcaagcuuuugugcugguguauuuucuuccuuggaacuaaauuaacaaaccacugagguggcgauuacauaaagggaaggcagcacaaggcggaggggacgugcuuguuuagggccaccugccggugaagcuacauaucuucacgcugacggcaggggcauucuggccagagguggucccacguugacaggugucugucagggggaaagucacuggcuggacugacacuggucagucuacuuguuggaacuggaaagucacagguugggacagcuccuugugugcagccggccacgacggggcugucaggggucgaagugugcgcucucaguuuacaagcucucaaaagggaccuaaaauuggccuuugccucagagugaauagucaaagaacccuucaacaaugaaguuuacaucucagccaaaaggcaauuuaaaggcugccauuccucugaguugugugucuagcucaaaaaaagcuggccacccacccugcccucaggguuaccccaccccccaaccugagaugguggccgcugucuccucggcuaggaggcggucuuucucuucucgaaguuucucuagcucccgcuggugcugccucuggagaucuucaaucuucuucuggugcguuucuuccauugcugcaaacccucgcucgcacguggccugcaaaaugcaaaagggacuucaucgacuucuuucuuuaccucuaaguugggggcccuuuuaaauaaaggagccaggaaucccacccuguccaggcccagcugugacugggcauucacugagcuugcuccaccaugggcgcccugaacaggaucccuggggcugucuggggauucucagcaaugccaucagagcauucagaaaaggguguuaccagucaacucuaccucuuauuucugugacuguacugugccccauuucuuccugggagaaguugguaugguagguggggacaggcugcuaugaaauggaaaccagccaacccuggaccuuccugcguugcugccaggugggacccacaggaaggaagagagagcacgugggcagaggcuggcugugucuggucuggagggacacggugaaaggcccguaaaacagggaugagggacuugucugcuggagggaaccaaggccauuccacauauagggaguggccuggcgggcaccgggcugggagccucucaacccacaguggguuggggguacauagaguccacuucugggagcuggggguugggacucugccacuagccagcugacaaccuccagcuggucacuuaaugcucagguguugacugagggaguaagaucaggcuacaggcuccccuuccuucuagccugugucuucuuucuuacucuuuucuuaaagaagggcaccaaugacuuagcaccucugcuaacucuaacaaguacaugacaggagaccugcuuuccaaacucuccugugccucccuagagcgacauaggcaugccccaggaugggagcaagccacaccaggaagcccaggccugguuaucagagcugugcucacuaacaaagcaggugagcgugcugcacagcugccgggaagggugggugugcagcuauuuugagcacggaggcacacacuuucugucuaaauccuucaaguggucugcuucagagaagggacugggccucucgcugaguuuuaaaaacuggaagaacguggccacauuccauuccaaauucaaguguggggguuuccccacucugggcugauagccugcaccacuugguuaaucuucuugcauguggauucaagaaaggauaccaagaaauccuaucagcaugccugggcauuuuucucugggcccacuuuuggugauggccaacucugagagccucaggcaguauuuccaaacucguggucagucuggacuugacugcaaccuaugugcugcucugggugaaugucucagcuauugccacuauuaacuaggcgucccauccccucucccagcggcuccaccuggaagcaucugucucuuucugccacccucacaccucaggacggcugcaggagcucggagcucuggagcuccugguccucaggccccaagguugagcucuucuuucuuccucccacucgcuucuguuuguauguggcuucucaguuaacacauuuaacuaauaggucuuuuuuaauuaaaaaaaaaaaaaauauauauauauauggaauacuucaugaauuugugugucauccuuguaaaggggccauacuaaucuucucuguaucauuccaauuuuaguauauaugcugcuaaaacgagcacaacuaguauuaauagaucuuuuaagucuuuuuuuuuuuucuuugagucuacuugcugggaaaagucuuauuuugaucugagugcuuuggaauauuaugcagguaagagucaaaaaucuaacagaagcacugggacaucuuuaaagaccuaguugcuucuuuggagagaaacuauaugcuaaaaaauaauugaucuugcaaacaaauguuaauuuaagccaaucauuccugacaccaaaagaaguuccccgaugacugcaaucgugguguggugggagccuguggaugucagaggacggcuguuaggccaagacccuguccccaacgacccaaguggaaaucugcauaaagugaugaaaucucaaggugcugucuauuuacaaguucuguaagucugcaggggugggugagaacaccacaccugggcuagaagcucccaggcacaggaggggacacuaugcaacggcagcuaaggcagcagggaguggacaguguccaagccccugggaggggccucaucccgaccugcaucaucuguuucucccuccuagugacacuggcccagcacaaucucuggucaguucucaacauaaggcaguccucuuuuuucugauuucuugcucacuguugguauaauggcaccugcauggggccuccccugcaccugguuggcuaaccuaaagcagccucgguguggaggggccucuuauggaugcagacaggaagcagggcauugcugugcccaggcccugcccccauggacccugcugauugucugggaagcugcagggaagggcacuagcaagcguauuuggggucaaagcaaagguuugugcaauuaacuuuucaaggugcaccuggauccacccaucucagugcugcucuuggugaacugaccacagugccaucauauacacacacuuugaaaacauagcuguugaaaccuucucacaacucauaaugguuuuuaaaagguuuugacugauuuggggaaagaauggugaaaaagagcuucucaguucuccugaggugcucgcugacaaccacaccugugugucuggguggggccgaguccgucacacagaggugacaugugagcugcuguuuccauucagagcuacaggaguaacgggcugggaaaaacagguguccugcuagacaguggcugugaggauguguaggcaggagcaguggcagccaccugggagucaggagcuugcagcacaauggugcuggcugugugcgcgccuggcucugccacaugagcguggaaggcaccaccugaacauggcuuuugaggggccuagucauccuagucauuuacuggggcagcuuccugaguggaaggaacauaagggcacagguaucaugguaaacuuuugagucuaagggaugaugcuugacagccacacaugguggguguggccugcagcuacaaaggguggggccagacagcugggccuccacucagcccaccaccaccuccagggccuggcauuucgccuuugugcuccaggaccucaggggcggggaugcaggacaguucuggggaaaaucuacuuguaaagguccuggggaaggggacaggaguggcuggaggcugugcuccgugggaaaguucuucucaccagagcacacaucaaaugccaguuccagagagggacccuccgcccgacugugcucuccuagggcaaucaggaggagacugcccuccaacugggcccuggcucuccgggguguugcugugaguacaaggcuguccucaggcagcugccucagauuugggcugggacugggccagacgggguucccggggcaggggcaggaaggaggcaaggcuggcaaggggauugggggcugcucucaggaacacggagaggccgcauuaggcaggcagggaagugcugggaagacuacgugcuccucucccaccagggacccuggcggcccuccugcuaguucuccuccugguggaggacacugggggaugccgaacaagaggcuaagccugcggcccaggcccugcugagaccacaccauggcuagcaaguagagggacagcagcauauccccucaauucugccugcacgguagcugagccagacguccccacacccaccccauuaucaaggaagaucugcucugcaaauugaauggggcguuaagaccuuaaggcucuccaagucccucugguacuucucacgcaguguggccgcgucgcccuccagguccuugugucccagcuccucccgcaugacauccaucugggccuccagcuccuggaugcgcucccucagccccgucauggagucagccucucccuggguggccugccaguugggggcaggggcuggcagggccuugggguguggccccugguggaggcagaggguguccugaaggcaccucaggcucugcgaguagugcuccugcaggguccucagcuccuccucguggaucgucugcagcucccggaccuugagcuggaaccuguccuccagggucuguaucugcucaccaugaugccucuccauguccugccugucucugaccgaggcauccagcuggcucaggacccggcugcgcucagccugcagugugcucucgguccuggucagcugcuccaccacacaccgaaucuccuccucauaccugccccgcagggugaacaugcucaugcugugcuugcucucugcauccuccagacacugcugcugauggucuagcugggcggccuuggccuugagcucugcauucucccuuucaacaauggcgaucacauccagguacucgcucuucugcuugcggagaagcuccucauacuccucccucagggcccgggcugccugugccugcucugagcaggagggcucccggguuugccaggacuccuugcagagcuggagcuccuucucauauucuagccggauucugcaggacgcauagcaaaccugggccugaauaauggcauccugaaccaacaaugaagaauacugaccgaggccucccaaacaaguguuauacgagagacucugggacaccuggagaagcuucuggcaaucucucagcgauuccacagguggcagagaugguaaggcagccgcuaucuccucuaagaggcuggccuucuccuucagcugcugggcaagcuccuccugaauagcaacaaaggccccagggcucuggucagacacaucgaagggcuccugagagcugucugagucucggcccaggacuucuccuaaggggcucaggucccaggacagcugaacaccaucuucauggcccgcuggaagccugagggcuuccaagaccugcugcaucacucuuucaaagucugggguuugguaggcucccaggauuucccucagcaggcauuugugcugccgcagggccgucugggugccccgcagggucuccuggaugcucuguagccugcgguggaacgacucccucacugacuguguggcaaagcugagcucugcccugacccauguggcauuggccaggaugggggccaggcccugugggaugcuuugcugcccgucuccugaggcaccgacugccucuccucccaguguccccaagugcuuccucagagacucaaccuggcuccagaacucaccauccacuaggaccuuccuggcccaggugucuacgggggccccagcagauuccaucgguggcuguccugaccaagaaaucucauggagcauucgggagacaucugauguuguguucuucagggaaucugcuaucuggcugaucagcgaggccuccagagcaaucuggucagaaagaagccucaccugcuccugcucugucaacucagacugggagcacugcugcagggaggcaggcuucccauucuccucggugccaccugucuccagcugugcacgggccccgccaugggcuggggccggccagugcugcagggcuuggauggcgcugacgagugcacucuccacacuggccagggaggcugcgcgugcguccugcucauccuccuggcuggcccuaggcagagaucucaguuguucucggcaauuuuccaggcacaucagggccugacuauucuugaccuggaaguccccaagcucuccaacaugcccuucaacccuccuggcccucuccugccucuccugcuccagcugggaggccagugcgccaaccuggagcaggcuggcgcggagcugcucacgcagcugggccucggugcccgcccacugguggugcagugcgagcagugccucacggcucugacccugcuggcucuccagccucacggucacgucuuugagcuuuuccucugugacguagagcuuggucuccagggaguggaugauggagagguacgugucagagucgccaguugcaggcaguacacugggugcaggcucugaggacaugcuuucuuccgagggugaccgguccuggcuggugucggaagaugugcugcugguccaggucuucucagacccuucggggugaauguaucuuuggcacuggauuguggagaaccggauucuuugccuuuuaacaccaggugccccuuggucgaguuuggcugugcccugcugauggcccucccugucaagcacuuccacugacuuugggggcaccaugcugucuucccuacuggggcugccaucaccguacucuucccccggaggagcccccagguccucguccucauccucgagccuugugugugggaggccuagaggugcccuaguggcuuggacugguuggccugggagcaaagugccaucccuuucugucucuucagggguacuccguggcucuuccauguccuuuggagauucacuugcaaauuuccuuaaaaucucuucuuuugccuggagcuuaauuucuguuuccucuaagcugcuccccaaggcaaccauuuuaaccaaagccucauugagguccugcuccuucuucuccagaaccuucucaugugcuuccuuaaugcgcuccagcucuuccuccuucucucucagcagagugugcaugcucugcagcuggcuggagacccucugguaggagugcuccaggcucugguugucagccucucuucuccucagcuuuucccggagcucagccacauccucgucggacguggccacgcgcucugucagcuccuggaaccgcugucugaggaggucccgcucgucacagaggcucugcacgugcucugcgagccugcgcacgcuggccucucgugccuccagcugcuccuccagcuggugcaccugcucacugcccucgaaaguggcgcucagcuucuccuucugcagggucuccaccugcugugccugacccugcagcugguccucauaggcgcuggccuugucuuccacuuccuuuagguucugcagcaaugccugcuucuccuucucacagcucuccagcagcagcucauaguuucucugcagcuucuccuccaucagccgcugcgccugcucacuggcgcccaguugcuggcugaggucggcaaugcgcuccugcagccucuggaccuccuucugccggucccgcugcagcgccugcugugucuccaggccccguagcuccugcgucuucuccagcagcagggccucagcacucuugagcuucugcucgcuagcccucagcuggcugcucagcgccgccucgcuguguugccgcuccuccagcugcucgcggacccggcccugcucccgcuucaggucgcccuugagcuuggccagcgccugcuccuugauggcuagcucagcggccgcauugcugagccgugccugaaggcuccggaucucagccucguggugccggaucguguccuuggccuccccauagcuacgcuucagggucugaaucugguguguaaucagcuccuggcgcuggcacugggcuucaagcucacuuugaaggucuugguugacucuauggagccucugccaggcacccgauggggaggcggccacuucagucuuaaaaaaaccgauuaaauacugguuaguaacacucgggccucccaguucugagugucacaccucuggccaggaacaaccacagaaagcuccuugauggcuuuggcuuuuauccuuuguacaacuuuauuuuuuuuucccauuaaaaaaauccaacaaauuuucuuuuuuuuuuuuuuuaguaaguagcugcuuccagguaaacagaaaacauggacaauaacaucagaaaacagcuuuaaccaaacagcuucuaggagaaauaaaccaaacaaaacugaauaauggaacacacuaagaagcaaaacaaagacuaaaggacaagagagcgccaggaagagggacaggcgggaggagcacagcaccugcagcuguuuguuucacaaaacaaaaaguacgcagucuugacaacaaauccuaaacaagcgcaggacacaagguguagguaaaugaugccacuuccuucuaagacaggaggagaaggaaggaagguaacacucgggagaugucagcaaggugacauccaaacauuuuccuguggaaaguguagucaguccucuagaguaacaggaagaacuaaucucuaccuguaagaagucaaaacgaggggggaacgggaaccauggaguaagauacaauaaucaacaaaacaaacaaaccuuuguggaguucaaaauaagaaaaagugaagcaugcaaaaacaaaacacaacguaaaugaaacaaaacuccccacacugaaaggcaugcagagacagaacucauuaauauagggaaaaacaacacaaacaagagugagccgagcccagccuaagaaucuggccugccuauggcucccucucggucugcuggccggggaagccacagaugugacacucaguuauguuaaguucaaguuacacuucacacucaauguccaaaucaugcaagcuccucccagcaguuaguauagcacccaccccaguagcuggcuccugacccuuaaccccacagacccccugcucauucugagucgugauuaaaagcauuuccaaagcauaaaggguggugagaagucacagguuauuagacuuagggaaaagguauuaaagaccagcuuugcccagugcugaccaacaggggcuucaguguaggcucaugcaauuaugcaaguuagacagagguagguuccuagguuagcaaugugcaaaguccgcugcuuaguacaaguugaguaucccuuauccaaaauacuugggacaagaacuguuucggauuuuaaaauauuugcauucuacuuacugggugagcauccccaauccaaaaauccaaaaucugaaaugcuccagugagcauuuccuuucagcauaaugucagcguucaguuuuggauuuuggagcauuucagauuuucgaauuugggaugcugaacuuuuaucuuuacuaccugauuugaagccaguucuuauaggaugaggcccaaucaagaauuaaaaagaugcuccucaaaccuggagggcaagcgcaaaugaccuuggcagggaggcccacagggaggcccuguucaccaggucugaacagggcauggcaaugacuauggcagaagaggcuggagaggagagucuagggcauguggggcagaaagaaagagaaggcccagggagcacacaggagaagaaacagcagagagucugcaaagaggcagacuauggucagaggccagcugagugccccuguuccaucugcugccugggacaacucagaccaaggucagcgcacugcggucugcaaauguagacaauacgugacagagacucggggucuaagagccggaagggcccucagggaucacugggucuaagucuacacaggcagcagacugccgcuguagaggaggggacacaugcacuugcuuugggggucaguagcagggccaagucuugaaccuaggaccuugauucuaauguuauacccucagccuuugccgagaacuuaggcucccuguucugguaccccacuucacuucuccugcaguauuuauauaucaaucuuccuaucacaaucuccucuaccacucaauggggacaagaguauaucuguuuuaugcccaauaccuggcacaaggccuggcacgcugcaggaaagucagcagacauaggcacgcccuugggccaggcuagcuccagccuugugacaccccuauaucagggcucugugguacaggaucucaguggagguaucccgggguugggcuaguagugguaagagccccagcucugccugccaggugugguauagaaacagaugggaaugggguccaguacuagcuuugccacugacuugcuguugguuguaagcaggcacuggacuugcugugugauucaaugucuucaaucuguacaauagguccaauauuacuauagugaaaacuaugagaaaucacaugcaaauguaugguauuuacaauaaauguauauuggcuacuuucagagucaaagggaaaggucaccaaaaucauuuuauuaccaaaaaaaguccuuagauauagagguuucagggagauuccccaaaaugucauaucaggagggaaaaacaaacagacccccccaagcacauugaguguccaguccuguggcagaaaagcccaggggcaugagcuccugggagacaccccugcucagccaaguuuugcacacuccuagccugccugagcaugaacccuucacacugaagcuccugagcgcaccaugggccacagcagccccuccacccuaccugcagcacguagcccucacgggcgcucugcucccggcccagggccacccucagcugguccugcaggagccgguucugcuccagaaggucugaggccuccuucuggcucugcuccagcuguuggcaaaaagacacacacuuuuaugcaaaaugacaaugauaaacaaagcagcugcacagcacagacucuuucacuggucuuccauguggcccaagaguuuuggagucuccacauuucagcagaugugcugauauggccuuuaccagcagcauuuggaagugaagguuccaaugcaagccaucaguaacaauggcagacuugguaccuuaugggcaccaagggacuaccuuguccuucccuacuccaggcaccccuggaugcccacauacuucccacaccugcucaagguuccaacaugcacgcccuauauaggugccaaggcccauacgggguguucauuucugagaaggggaauguguccacuggggaacaaggguuuugcaucugcaucuggaggaagcaccccaugggguccuuuggguguccucagcuggucacacaggccaggcuaggcucuacagggaccacugugagugguggccccaagcaggccucacuccagggcccacuauggucucaacugaaaccacuccauuugaccagcuuuacaugauggauuccacaaaguucuguuugcaaaaagaguucccgcaguucccucaaacaagguguggauacccaugaguaagcuauuuuacacucuucuugcuuucaacagcuucagcuacucauucauccauccaccucuucccuacacaccucccaggugccuccugaugccuggccaugugcagggcuacccaaccugcucccagagcucgugcugaauggagcugugugugugguggacagucaggccagugccgcccagggugcugacagacugugcugugagaggcggggagaccccugacuuuuauuuauuuuuuuugagauggacucucgcucugucgccaggcuggaguacgauggugcgaucucaggucacugcaaccucugccuccuggguucaagugauucuccugccucagccuuccaaguagcugggacuacaggaaugcaccaccaugcccagcuaauuuuuguauuuuuaguagagacgggguuucaccauguuggccggauggucuugaucucuugaccuugugauccgcccgccucggccucccaaaguaccgggauuacaggcgugagccaccaugcccagccgaccccugacuuuuaaacagugaagacugaccccccagauuguugagccagugugucgccugcuggcuggcccauuuugguagccugaaguaaugugaguuucaacuguuauuuuauuucaucuugccuuuguuacuuguuaauggaugaggaaaaugaaaaaguacaaguauuagugcuggugguaacucagccucauacaguuaauaaaauacaaaaaagaugagaagcuugaggcauacccaaguggcaaaucuuuaacaagcuacuuacguaagagaacacauuugaaacacaguguugaaaacugucccuaaauggagagugaaacagggaguucuacaaaaacuguaacgcuacaccuccccagcuacgagacucccugcccagacaugucaaucuaccacugaaguucugcagacuggauuucugcauacauuuccaugaaagaacaucuuauuuuauaguucgggggccagcuuguucaucuauguaccuaggugcacugaaggccucguggaggagugacagucacagggcagccuucauccacagccuacccugccucaccacugucuucugcuucauauccucaugaccuaggacccagcugucaucuccugcuggaugccccuggcuucagaucugaucggccguccccaagccacuguaagagcaccuggggcuggucucugccuacagcuuugaccuguccaagccagggcugcguaaugcaaaagccuugcccugcucgcgccccuccugccaucgggagucagaacgaggaaaccaucuaggcccugcaacgccgcuugccucucaauggcaggggcccccaccaucggaagaauuccucugugccuggaaggccccuuucccugcccugcaugcacuggcacgcucccacagcucucaggucugccucaacuaugaggacucaucuaugcgucugucuccccuaggggucugcaagucccucgcggguaggacugucuagaugaaccccucaggccacagcugggcacagcugaugcucuggaaaggcugcugggagcaggguggggaucuggucccaggcuauuaccuccuucucgagcagagaggucagcucguguguggagagccggucacccccaucuucagaagacagguggacgggggcgaugggcaccugcuucucuucccggagagguguggucuccaccugaugccaccgcugcucaaucuccacguggacguuaugcguuuugaggucgcucauaggcagcccugggcuccgguccaccuccaugcgcagggcugcauccucagugccuggcccgucuguggcgucgagcaucccgaagcgcuugcggcgcuccucccgccuccgugcacgcucccgcuccagcuccccaggcuccgccucagggcgcaggggcucgugggugucagcaggccccacgccgcccacccgcuccugagccagggccugcuggaugggacggaacucagcccagucaaaggucuuggagcggcccucucgccuccgcucccgugcgcggcuccucuucugcucaggguccggcucccccagcucugccucuugcuucucaguaggccucgggcaggucucaaaagagcagcugcucuuguuuuuuuccucuggcaacgagcuguggggcaggaggauggacauagccugucaggggcggcucugguguggccugccaggcagaagcuggcaaugcugagccacaacccagccccugugagcaccacauccuuuuucuauccuaaucccagcuuccuaagugcagggaggacaggaauacucugccuuuaccccacaucccuucccaaacugguucugagugggggagggggagggggacggggaggggaaggggaaaggaagggaaaagagccucagaaagcugagguuucccacauaaugacacugggggggucccuugacugaagaggcugugaggggcucacugugguggucccguugccaggguauggagccaggggagucccaggacucccacagccucagaggcaggacgggccagcccugccuugcucagggccaagaacuacauuaggcugcaccugggcacagccaccguaccugccaggugaggccugggcccugugcaccccuggacuggacaguggugacagaaugagggaaaacuagcacuuucuagaagggcuuaccuuuuaauaagcagguaacgugaucagaucuauguuuuguuuuuuuuuuuuuugagauggaguuucacucuuguuacccaggcuggagugcaauggcgcgaucucggcucaccacaaccucugccugcuggguucaagcgauucuccugccucagccucccaaguagcugggauuaccggcaugcgcuaccaugccuggcuaauuuuguauuuuuaguagaaacgggguuucuccauguuggccaggcuggucucaaacuccugaccucaggugauccgccugccucccaaagugcugggauuacaggcgugagcuacugugcccagccugaaucuauguuuuaaaagcccaauccagcugcuggcaugacagauggaucaguaugaaagacugggaccuccuaagggugagggaaacaggaggcccagguggccacgaguucacaccaugcaguagccagaggcuuggagaggaaggcagaaggggagaaggacacuggguuaccugccaccuugagcaggcaagcggcagccagcaacgggacaugagcugcgcaggucgugcucauggugcugcuaccugcccugcaguaaguggagugaagccaggucugccugaggaauccaugucuaguccccaucugcuagaagcagagauuccuggggaggccucgucugcaguagggcagggacagggacauugcugauggcaauuugucaaggaggcugggaguguuugaggcaaagguuuguagacucuagagauaggccccacagacugccagcugguccgaggcugacugaggggccccuaaucucacccaggcccucagaaggcaguugcaagcccaccugaggacagugagggcccaaggaggagcuccagggagcacauguguuucaauuagggccaaaaggaaaggagucuuuagagagagaaccaaggaaaagaggaaaugguugccgucaccaccuggagcaagggucaccuguccaggcagcaaucgagugagaggcaaagugcuucacagcaacaggaucugcagguguccacuguaagagcacgcuaacaucuggaugaaaacgacacagggcagaucuugugacgucacugaacuaagagcuccuggccauggagagugucaggaugacacauagggcagggcaugcauggaggcccccagccuggcccugacagccgccaaagucacagccacaccagaaccggccgcacucccuaggagaaaccuccccacaaggcuccucuagugccaaaggcgggaagcacccugcaacuuccccaccccaggacuucaagauggcgaugagagcaggacgaggacagcagcuucugagacugcaguuuguuuucaugccuccuugagauuuugccuggcagcacuaaaaaacucacauuuuuccucaaauaauaaaagccuacacagaggaagaauaaaugcugaaaacaaacugguggagggugagcacucuaccagacuaugcagauaugcuagguuaugaaguaauucuuagucaggaggccaacugccaggucaacuuucaugugagagccaaacccuugucuccucauucauuccccugggcccauagccccugcacgcagggaagcaggcacucaagcguggaggcgccucuccugagcugugugcaggcacaggcaugugcacaggugcauuccugacaucugcccugggacaucccaaagcugacuucuuccagacaggauugccaaucuacagcaccgagcccaggccuggcugggaagaggggcaggagaggaccucaggccagcuacccauaugcacugcccaccacuccccauccuggacccccgugauaagcucugucugcugccaauagcuugggcaaagaagcugaggccuuucucacuuugcucugguggcuuccuaaaggugcuuggaaaagagcacuuagcuugucaagcuugggugucugcuccugaugggagagccauggaagcaguagcugaggccaccacaggauguggccccuggagggugggagagcuugcugcagcucugggugccuccugcuggcugugcacaaagaggacuugucacuagacaacaagccagcucucugcauaggauccugagagacagagggcaaccugucccggucacggccucuuggccuuacuagacaguguuuguuuaauaaaugaagucaugaacaaaugacagacacagaaaagaggacuauaaagaaaucaauuuaggaguucuuuccuucuuauguaaagagguguggaguccgcaggaagaaggcaaagguuuggauacagaaugugccuuuaggccggcugugguggcucaugccugcaauuucagcacuuugggaggccaaggcgaguggaucaccugaggucacgaguucaagaccagccuggccaacaaggugaaaucccgucucuacuaaaaauacaaaaauuagccgggugugguggguaaucccagcuacuugggaggcugaggcaggagaacugcuugaacccacgagguggagguugcagcgagccgagaucacguuauugcacucuagccuaggcaacagaacaagacuccaucucaaaaaaaaaaaaaagaacacgcuuuuaggucaaagcuuccauggacagcccccgcugugacauugccacacccaagcagccuaacccacagcacaagaaacacauucgagauguaaucuacaucacaugaccugagaaauggcaccagaggugcucagaugcguggaggcucugaagguggggacagcagaguucuggccaucaaaggaccagcccccacacuggaaucuucucugcuuuuuuuguuuuguuuuguuuuagauaugucugagucuucugauucuccaucuuuuaaaaugagaacuaggucuuuaaccuucagggcaggaggaaaaaagcccaaagcaaaaucugagacacaugaaccacagaaugcaaaaacaggagaggguuuuucaaauuggcugcacagaaaucaaacagacguaggagugaggugaaaagaaggccaagacaaagaagcacuggguggccuauggaugccgcacauggggccacccuuagagcagcagagcccaaggccugagagcaccgacugcggggcucaggcuggucuggccaagugccugcugacacagauggaagauucuccaccaaagcccaguucuaaugaccagcacacaugcuaccugcaagaugaaacgcuugggcuuacaagagaaaagaaccagaaauguuuguucugauuacuugggacaggaaccugagcaacagaaggacacaggaaggaaggagcagcagacugggaugcacugagcucaggucucagacuucagaccugagucugacacugcccuggcgggaguggcacccacaagaggcacaaagggcucccuggugucuucaccauccuaccuggucacauccggggcaguggucgggugcacgugcuucaugauggucuggauccaguuccgccgaaucccagaugucauggccgacaggguaaacucgcccuccuuugucuacagagaaaagaugaggcaccaucagugacuguccccuagggugccugcugcccuccaucuccaaagaagcucccugcacuggguaaagucccacagggagaaaggcugugacugggugacccuucuaggagugccacaugugcccacuacugggacaugagggagcuggagagcaggagacgucaaagcugugggagggacguguauuuguggcaaugguaaauccgguaucuucucucaguaacaagcucacaguuacugagcacccacuacgcaccagcagccuguccacucagacagaggaggaugcugcaccccucuuuaaggaguucccagccucgggggaagggcagaaucagcaugugcugagcagugguggagguggggaauccggaagggcguguguguugggcguggggaguggcaccugcagucugcacucacacaggcacauggcaugaugggcccagggagugguuaagaacaagggguaucagggucuuguugguggcacugagaaaaggcagggagaccugcugggugguuacugcagcuguccaagugaugagaauuaaggugauggcaggggacagggcagcucagaaguaacaaaagggguaugaacagcgucuggcugguuggguuggggagcaccuagacaagcccuagacuccugcuuggaugagguggagucuagggcuuguccucggugcuugugcaagguagcaggggaggagccuguuuugggcgaggaacggggcagcagguaggacaaagcagcaaagagcacauggcucugggacaugaccacugcgccccugagcagaccugccuggguaccaggcaggggagggccaguggccugcauggagcuggaggccugcuucugcaccuacaggcaccugcccaacagaagcgagggcugcagccuugaaccgagagcugcucacaagcagacucagcagccaggucaguagggaagcugacggcaggaugcaaucaugaggaugguuuucggaugggugcuaguggccuggccagaagccaaaacaggagaucacgcaccggccugacgugccacaaagcacagcugggagggaccugaccugccccuccacaugcccgaucaagacaccaccacugcccagcucgguccuccuucaucaguucucauauccaugugagcugaguuggggggguaccaccuucuccuggguccauccuucuccacccccaggugugggcguugcuggaguuuggccucagcacuccacauacagcuguuuucuccagcugaauuuucuuucccagcggcugccuaauguucucugagagcccaucaugccucaaauggaucacagccggaauuccaggggaucccccugcuucugugaagucagcucuucugcuggcuucucagugggcggggccuucuugccagguccuggcccugcccucaccucuuccucccaggugcugcuccuuccuuucuugcccagcuuuaccgugccagccugguuccuuucuaauggaccugcaugucccgccagacauguaucaugaacgcacaacugacuggcaucuucuaacacccuucagugcucuccacaaaggcuggaccagcgccaaccugacucuccacccagcacucuagccccagacuggcucugugcucucugugccaccaggucuggaguccagucugggacaugcuuucacacucaucccuccugcugagccuugagggauccuucuccaggaagccucccccaggaagccuucuccacacuggaagcaucuccucauuccuuagaacucucaguaguuggggaucaccgaaagucaucaggauaagcccuaccagggugaagugaggagggguugaucagugggugagaguggcugaugcccucauuugucacuaggagagcggggugaguucucagacuucaggugugcccugccuggagaaagcugcucaugaagaugggagguggacggcaggagaggaggcucaccgggcacuaugcccgccuaccccucccacagcggaugaggacagaggagccuugaaacuugggcagugcaggccacuaagagcagacaacucacacccggcccuggugccaggcugucaguguagccuccaacugugacucagcuccucucgcagaugccugcacgcaggaagccacagccagcagcccagugggcuggcggccaggauuuucuuaguaaaugaacacacuggccuuugggucuauacuucagucuccucuaaguugggccaaacugagugagccccaaauacuggaucaacucucaacacagcaauaaaauugaguuucugggccccaaaauuugaagguaugacccugcuacaggugagcccaccagagucuagccuugugugagaaccaagucccagggccagggcccagccccaugggggcagcucucuacucaucacacucuccacccaucuuaaagcccuugcgagugacgaacuaacuuuacccaaagagaggccuggccucuguccuagcuccugggagguaacuuccaaaccuuggaauuuccugaaugacuagagucuuuguuacucauggugguacccugggaccccaccuaacacuucaugcugacaagacaacucaggguagaggcuggccuggccagaagcaggaaauuagaggaaacccauuaaaucagaggguugggguuugggccaugugaaaguagccaaccauggcgggaagggcuuuagguggaguucaacuaugaggacaacaacuccaucaaccacagcagcuacagagccuccuaaaacucaacaccggggcucaggugggcuuccgggcaaugcucugcgcacugccccacaucagggcuaagaggacaccguguccccaaggaugcagaaacuuuuggcaucugugacucccccagucccagauucuacuccacauggcucucccuuggcugguucugacuuacauacuuucucuauaauaaaacucauuguaaagacaguacuuuccugaauccugugagucauucuagugaauuuuugaaacugaaggugguuuuggaaaccuccggacucacaacuggugucagaagugggggcaggacugggcacagugauucaugccuauaaucccagcacuuugggaagccaaggcaaguggaucgcuggagcccagggguucaaaacccuccugggcaacauggugaaacccugucucucuaaauaaugauaauaauaauaauaauaauaauaauaauaauaagcugggcaugguggcaugcaccuguagucccaguuacucuggaggcugagguagaaggaucguuagagucuaggauuucgagccugcagugagccaugauugugccacuacacucaagccuggacagagagugagacccugucuugggggaaaaaaaaagaaauggaggcagauguggcagucaggaggacugugcucuuaaccuggagucuggcugacugcaggcaguccuugauccacacaguuuugaagaaacagccaauaagaaccauuuuguccuaccaauaagauuuuuuuuuuuuuuuuuuuuuugagaacagugcaaugccuugcucaucugaguaccucacaagauuuugggaaaaaauagccuuguaaguaaaugaaugaacaaacacaugaauaagugaguaaaaagcggauguaaauaauugacuaacacuuucauucuuauuccccauaccccacauccuuccaauugccccaacuccagcauuacaaaaaacaaaagaaaaaaggaaccuucagaaacaaaaaagcuuuaagcagucuucagaaaaaagauacuaacgucuaauguacuguucacaucacaaauuggggaauagggucaggugccacaggacagaggugucaaggguagugggaaagacuaagugcugaccauacacgcugcaucaggccuguccagaagugcccccagcccagacauuaggcacucugacaugcaucccugccugucaagccuguggccccacuuccaucccuggacucacauguaucuggaagccauaguuucucugaacuggauacucugugacaucguaacaugcggacaagucaauuucuccauccaagucggcugccugccgagggaagugagaaugucuugagauuuuuaggaaguagaaccaaugccuagaugagcaaauuuccguaagugauuuucugcacugacuuuacuuuuaauaguauacacacugacaagugaggacaccgucuauccuacuacugcaugacccaggccccucacugggugcaaucacaccaccaucugucccuguauccagccaaagauaguccacgccagugguccucaaacaugcugcuguugaaaucccuucacacucuuaaaaacugguggcccuagaagagcuucuguuagguggauuucaucuauugaugguauuuacuauguuagaaauuaaaauguaaauauuuuaaaaauuuuaauuuaaaaauauuuaaauauauuuuaaaauauauuauaaaauauauuuuauacauuuaaauauauaugaaaauauauauuaauauaaauguaaaauuuaaauauauuuguucauuugagaauaaaauaaauucauuuuaaaauaaaaaucugauuuaacaaucagugauaagagucacauugcuuugaauuuuugcaaaucucucuaacaucugucuucagaaaggacagcuggauucuuguuucugcauuccaucuguucaauacggaaguuuuuuuuuuuuuugagauggggucuugcucugucacucaggcugaagugcagugacacgauuucagcucacugcaaccucugccucccggguucaagugauucucuugccucagucucccgaguagcugggacuacagaugaccaccaccaagcccagcuaauuuuuguauuuuuaguagagacaggguuucaccauguuggcuaggcuggucucaaacuccugaccucaggugauccgccugccuuggccuccaaagugcugggauuacaggcaugagccaccgcccccggacaacaaaggaaguauuuuuaauagcuuuuucagguaguuguggcuguucuuugacaagcaguaggcucuuaaagguuaacugcaaugugguaucugaaaucaugcccaugaacucucuguacuguguuacauuaaaacccaggcaugcuuuuguaacauuagguacuggucacauggaaaauauuguuaugcacagcuuccaauugucuacacauuucauuauguaauauuaaaauaucgccuuugcuaauaccaccaccuauuucaucaggagaguguaaguaaagggaaguucaugauggugaauacaaauuuucccaaguucuaauuuuugcuuggaagcucaaauuauaucacuggcaacaaauucugucaguuguuuuccuuagaggaaugagccaacuugguucauuuucaugaaaauauaugccaaacacccaaaauuaaugaccacaguuuugccuaucaguuguuuuucaaguaaacguggugcuccaaaagaagcugcuaguucagcuggcaacucaaucacacaaguccuuuccaugagaaagccugcacacucuaguaugcagccaggcgaugcuuacuucccauuucaaaucacagaauauuaaaaagaugggcauuuaaagauugaggcuucauaaaauuaguaacuucugcugcucuuucaaggaccuuauuuauuuuaaaacgauuaauuauuuaaaauguauggcagugaagaauccagugaccacugguccagccuguugcuacagauggggcugugccaagugcuaguggcuuuaccucccauugcuuuugcaccaucagugcagauggucacacgcaaaaaaaagucaaugacaucuuaauauuacaaauuauuuuaaccaccacugcucuccugaaagggccucagggacccccagaggucuacagaccacacucggaagugcucuucuaugcacaugcaaccaaacacuuacauaggcuccuuacuuccccaacgcuggacaccaccagaggcccaccgcccacacucuccuaccccuacuucuuaucacuaccaccuuuucuccuucagucuguaaagacuggcucagaguauuuaauacauaucccggcccuuaaugauggguauuuaggcucuuuccaaucaucuggcuguuacaaacgugugggaaugacuaaccugaaacagacguuuuuccacaugugggaguuaucugagggauuccuggagugaaacuacuggggaaaaggcaaaggagacuugccaaacuguuuagaagagguuauuuuauuuguaggugaagaaaaaaagaaccccuucuauuugguccuugaccacagaaucaggacuguccaggggcccaaaaaagcucaucuauccuauccuguccuuguccagaaggcagggcacaagauguaguucaauucuuccaacuccauuuaccaugaaaucucuuuguggaaaaaacaaaauuguucauccugaguuuucaaauuucaguguuuuucaaagaacagagaaaagaaaagcugcccaaacccacugcacugggcacuuaauucaaggccuugacgaagcccagcaucacagccaggaaaaugaucacaaggacaaaggcuggucuugugcucaccuucccaccaggucgggacugggaaacccaagagggcaacauggacauaccuucggcaagguaacaccaccgaagggcgcuguccucagaaguggggacauuagcccagggggaagcagaucuacuagccccagaugccgccuggaccccuccagcugucuccacagcagaggcaaagcccagacacucaccuccucagccacugaaucccuguaguaucucaggcuuugaucggcgaggacaaaccaguguuucuuccacuaaaggggaagaaaagaaaaaugacucgacuaccaacuccuauacagcaugccugccacgccacggcggugcgcagccagagccuguggggcccucccagagcacagggaaagcaggggacaggcuggccccucccuugacagcauacagaggacucugcucggacugcaggcagccaugcgcucacacccucaggacgcucacuaagcugugacccuccagugaagaggcagcacagacagcugagcaggccuuggcugugggcucuaugaccaaugguguggcugguggccaggccgugcgguccucaguaacuacagaggcugcagacaacaggcugggcccaucagaacggaaagguggcugugaaauggcaucuccaccugcagguggcagcccgcaagccauggccauguggccuccuaaccagcagggguaacuaaccagcuagagaccaagucuucacugugagcaguaaggaagggaacuugagucuucaugccaggccaagggcauuugauauggaggagaaauaaagaggaugucuugggauagcagcucaggaagcaggaagggagugaggaugggcuaggcaucagggccucuuagguaaggacccagcaggcuuuucuucaugccuccuugggaggccuggccuuccagcccauggcacagggucaaggugggcuggcagguccagccucagauggcucuuccugcuugagucugauggcaagaauguaccauguuugcuccuuccagggcuaacacugccacugcagcugaggggucucuggcaugagagucuugcagugcuaggcuacugucuacuuggcuggcuugcauggaaacacaagccaaucccacagccagagaguuucuuugucccuggggaagccaggccccuaaacaacuuuuaggaaagaucaccaggugggggcuaguguuacaaggcaucccuaaggccgggccaacacccgcuugccaucagcagacaggccuaccgagugccccuccagagcaccccccacugcagaaaugaaggcugugugccugcacuucuaggagcagaugggagucucagccacagcccuggucaugaagacaaggggcauggaggaggaaggcauggagccagcacuugcagacuggcuggggacaaggacagcucacccucacccuguccccagaucccucaggggccacggcaacccugcacacucaccuggccguccucauacugcuuagucagccagccuuucuugaaauucagcaggucgggcugagaaagggagaaaaaagaacagcucagaggaaacucuucuagugucaugagugucugauggggccaguauuucuguccagaugaggcggguaccaggaaagggguuucuccaccugccagacaagccugugcagcccccucacccuggugggugcugccugcaaccagccuucuguaggcacacgcgaccuugaggaaggagaugcugggcuuggcaggcuggcaggagagaagguauggucucauugcccugugagcagugugggcuccggccuguacagggcccacugcacagggccuaucugggaggcagaaaacaagcccagaugaagagucacagaacauuuuauuugaagggaaacaucugcagggaaggcugaaaggagaauugauucaaaaguucuugcagaagccacaggaagccugggaaacagagacgugcgguguugaggaagcagcagcugcagccccgcugagacccucaggccauuucuccaccaggaauaggcuugaccuguauucccccacaagaagcaggauggcagacaggggggcagcgcccaggcacagcgcucuuguccuuccuccaccugugccgcccagacacaccugggcccugaggaacagccugagacagcacugccaucuacagcccaccuggcuggccccacagagacaugggucaccuuaucucugguccgaggugcucucuuuucuacagccaucugagcagaagcuagcuuugaugucuguuuguauuauuccaaggagugagagugagaacaggcaagaauugucaggauaacuaccagaacaaagcgcucugggagccucugcucagaacccugucucugaggagugaggaaggaaccacaguccgcugcugccuaggucuggccaagacugacccagauagauaagaagucccucuacagagcccuguuucaaccccaacguccugccaagcugugcaacuguccuugccgccagaguuauuugaagcacccaaucaaaagcaacacugugaaauuaggacacccuaccccaaguagcccuuaaauagggagguccucuccugcaagcuuguaguugccauugcggcacaggaccugagacgugggacugccaccugcccccucucugacagccugcuuagcuugcagaucuuucuuuuuuuugagacggagucucgcucugucgccaggccggagugcaguggcgcgaucucagcucacugcaaccuccgccucccggguucaagcgauucuccugccucagccucucaaauagcugggacuacaggagcgcgacaccacacccagcuaauuuuuguauuuuuaguagagucaguguuucaccauguuggucaggauggucucgaucucuugaccucgugaucugcccaccucggccucccaaagugcuuggauuacagacgugagccaccgugcccggccuagcuugcagaucuuuaacaaaaacucguaauuuccauaucaugguugugccauugaagccaagccugcaaucugaccccaauggcaaggccuaugcagguggguucccugcugguguucucuguuggggaaggcgcucccagcuaaguuaacagagaaacaaggaguuuuguucaagacaccugaagcaaaacccagacugaaggaaaaacccaaaccuuacuccuccucacacuccauguuacacaucaaucugugguuggcagcccccaagcccuggggcaggccggaggcccauggugagcugcugugcaggcagcaaggaggagacaagaggcagugagcaggccccaggcuccccuggaggcugaagacagagcggguaggagcugggucagcaugcugaguuggccuugcuccuguacccugaccacuccuuccgcaccucuguugucauagcucugaggcccauggagaaccuggugcaaggccugcucuuccacuugaggcaugacacggagaacgagacaagcuccagcaagacguggccucugccuccgaagugccacaaaaagcaaugcccaaagccagaggagcggagggucccugcugcagcccugccgccuagagucgggagucugccuagcccgagguggccuccuccgcagggccuccucccagagcucaggaugccauggagcccuugguucugcugggaccagaaaagggaagaaacagaaucuguguucgacggccugugggucggugggugggggugcucacggacacgagggccugugcacagagggacagcuggcauggacgcauagacagaaacagacagcgccucagagugaccagaagcagaggagcacggccuccggaggacgcggcgccugggcucaccgucacggagggcuccguggaccuccuguccagugacuuggcucuucgguguggagacaggggggaagccgaggcgucugggagaggagcugggggggcuucauuggugaaguccuguggcagagagcagccgcuggucagugcagcccagggcaaugugggcaugugagggacgagcuggugcuguccaccccuccaagagccgccagggccuugcuccuggcgaggggcagugaucugccuagccaccauagcaagucugcagcagggccaggacaggacccggguccugagaugcccugguugauagagcagccuuuucuuuuggauucccagucacugucacuuuccuggccccaccccauccuccagcuucucugggucacagaaggaagagcccugggcucugugguggcagguggcaagcugugggccagacaguaggcacuaggcaccuugugaacaagagagaagccaggagaagaugagcuuagacuuggccggcuacaaaagcagcaggcgggugcccaggaggauuucagaagccgagucuaccuugggcugaguggagaaacgagggguguaguuguacugaaagaaagaguuaggaaggugugacauucagccuuguugcugggcugucucagauaggaagagagugauccuaauuaaaucugggaucuaaaaugcaugagaauauccuucagcagagacggagaaggcucugauaugaagcugcaggagacaggccugcucucaagaagucacuaugcagaggaggugguuggagagaagccuggcaggagcacaucccaggccuguguggaggggacuuggcgcauggggugcaugcugacccgcccccgagccaccccugaggugcugcccagccccaggagcucacccgcuuccuagggaacgcccucuucucgcugcggcccuggcgugugucgcuggauggugagggccccacugcauuggucuccaugugcucugccuucucaauguccaaggccucaaacuuuucaaucaccugggaccuccugcaagagaggacacgaggcccugagguggcagugaggugagcugugagguggcagugagccgacuccucccaugcccggccuggcccgggccugauuccccucaggcuugcacagcaccgagguugucuagacacgugcucagcugacccgagcucugccugcaccccuccacggcccucccucccaucaggccugcgcuugccccuacccucugcccccgcgcuagaggcccugcaggcucuguggugcugacccacucggcauucacacagcuuggcacccggcagccucuccugagccacagacaugaucaaaaggcaaccaccaccacggaaggcagccuccauucucauugcaucccucauggaucacagugcaccccccaccccaaaauuuagcaaggaagaggcccaggaauuaacauuguuucugccaacaguaaaaggaaucaaagaccaaauuaaaacaaaaacaaagcaggcugauuucaugugaaagggcuggcggccuccucaggcugucuacggccggagacggagcuuagaugggggcgaagcggguggaggaggcgcagcgccacccagcggcacagcaggagagcgcagaggcaagaccugaaagaaaacaaggcugggaaaugaauacauggaagagcgcugcuuuuucaaaucaaauaauggugaaccaaaauuauccaaagaauuaaagaagcaaaaacccaagguaaucacugaagagggagagagaccaugauuguccuccagcugcaagaagucacccugguggggucagaggugggggacgcaccagcugaggcucagcucacagggccgggccuguucucccaggggcaccuaaguuaccuggcggggagggugucacugcugcucuggacaagaggauaagaacccagaggaagugggugaagggcucccaagccuggaagccuaauuaucuccacaaggaagagaggaaacaagaucaauuccugagaccccaccucccccaagaggccagcugcuucucagggagugcgagggaaaacuggcugccuaaggcgucuucacccccggagagaggagggcgagggccccgggcucugcuuccucccugcgcuuagacacaaagugucuuccucagcucagcuuccucccugugcuuagacacaaagugucuuccucaggaaagaagcuugugccgggccagccugcuagaaccagcagcggaggcaggcgcugggguaggggagcagcagaggccgcggcauugugagagcaggaagcuaaggaagcugcuggaguuccaggacacccagggaaagcuugguaagugcaagccaggcguccaccacacuugagcgauuguggugggaucuuggugagauucaaggcucaccaacaggccacuuccaggaugagggcuccucugcccaacacuggggccuagaaagccccaggaaagcagugaggaacugcugggcuuuaaccucaugcaaaucgcaugccgugguacuguggggauccagacagaggagucgugguggagaagaggaaaggcacuugcuacagucacucugcaugggggccuggggagauccuguaagaccacaggcucgcacacuggcugcccugaucuacugggcgagguggaaaguuauuacuuggugcccuggaagcugcaggugggacagcaagcaccuuacuggucagcacagaaaacggggccugcacccugcagcuccaggguucccagggcacuaaccgcugugcugagggcagggggguuagggcuacauggggagcuguccuugcugccagucaccagcaggccaaccaggaaaacaacuucccccacucagcagccagaggugacucacuauccaagaaacacucuggaagucugaggaacggacacaucgaagcccagaaccggucagguucagauaggcuugccuagaugacuguggcuugucaaaaaaccaacccuguggucccagcagucuggcuccugggcacaccuauuguggcugccauuucagguagguguggccaagaaucucuugccaauuuggagauucugcucuaaucaaccaggggacaggaauccaaccaagcacagggugggcuacuagggauccagugagcaggccucagaaagcgacagcagccaaucagaugucaccagggucaggagaaagggaugcugcaguauuaguaugcagaacuggugggggguggggccagcaccaggugaaaacccauccccguguggcagugcaugcagaguacaaagccccagagacugcaccugucccaggcgacaggagacaagaacgaguucaaaaggagucucuccgagaagaagccaagccaagcaggugugcugaaugcuaauucuguggucuggcgcuaaaccaggacauagcugauccugcucuggagccaccacgacacacagccugcuugccagccagcaugaagccuccccugcccacccacuggccuccuccucucucuagcaaaacccuuuacuuauauauuuucuuaauugcuuaaaagagcauccuuggcaucaguccuggaucacaggaugggagcagggacuuccuggcuaaggccccacugggaucugcaccagcuauccauuguugagaagucaccuacuccugagccucaguuuucacaucuauaacugggggcgguaguaacagauccucaucaggcuacuaugaaacauuaaggcagccaagugcuuagcagagcacccuggggcacuaggcaggggcugggaaccacuuggcugcccuuccuuucccuaggaagucaacgugucauuuuccucucaccagcaguaucucugggagaugcuuccuuauccuggagacuaaccugcaggcucacaggccuuuucaucugggacguuuggaagagugggugggcugucagccaauggugggugcucagaagaaaagggggcaggauguaaagacacuucccuccaccugcccuucgaggcacgggagcccauggcugccuucaccugucccuccugguagcgucucuaacucugagcuccagguuguggcuggggaagggaggacacucugagaagacuuccagaacuaugguuugaaccucuuuucuggacagugaaccuugggaaccuaaugaaaacuaugggucuucuucccagaagagugccuaacccuaacucucuucugggaagaauacugugaaauuguuuuauugagggggcaggucaucauggaccuccagaagucuguaagucuauccauaaaccuggcugaggaacccugcugucaaggcaaagccucaguauacagaugcaggggugcaagccugauugaaggcgugcuugggcacuugcgucuggauuugggcuuggaggccucagaggacauccaacucuuucucuaguucuccaggaaacucuggagaacaagggcagggcagggcaugggcccucaucuucuucggcagcagucaaguucugcaccugugccccuggucccugcccuaggcccggauguccaaacuuucucucucuccagccagucaaagucuuagagggcaaaaagcaaugcuccccuggagggcaaaagcaaugcuauuuggugcucagcugcuucacagguugccucagguuuccuggggcuguggcuccccagggagcauguccuugagagaggaaccugugcugcccccaccuuccugggcaugccugucugccucugaaccucucagugcccuuugcccacccugggacugccagggugaggagcgccucugucaccacauguagcucuagggacucccugccuccaugccacuucagagaauagaaauggcccaggaggaaaagauccagccccacaaggaccaggcagcugagaacccaucagggaaccuuaaggucccaguccuaggaggcacugaugugaaaacugcuauucuuggcgucgaccucugaugcucagaaauucugcauucuggcuacuagagcugaguucugggcccagagggaaaauaccccuaugcucugaacagaaagcaugcuccgccaagggaggcuuggggacuguaugugagagaaacagagaguaugaguguaugugcguggguggaagugcaugugugugggccuggguguucaacccucuaaccugcuccuuaccuccgcucguugccaaacagacgggccaccuccucccugccagggcuccgggcccgaguucuacgcuccagccgccuucucuccaccuggaaggcuucucgguggcugauccugauggccuuagggacgucggccaggguggcauauugccugcuggcuuuaaaggcaaaggcgcuccccagucucucugucccccgcccccuagugcugccagaguccacguaggcagguggcuggcuggccacauccagggagcugagggagaugcugcagaccauuuggugggggagucgaggaccuggggaaggaagaggaccaccgagcuccugggagggcgacucggggcaacuguaccugugguugggggugcuggggcugggaggggagagcggcgggggcagcugcuguucuucagccuucaaguccuguuuggucuucuccagagagaaguagccgcucuccacccggacuuugcggccacaguccaugcggucgcuacucauggcgcucuccucuggaagagacagugggagggaggagacgcacucagccugcuggcagcuuugcuuugaggacuuuuuuuuuuaaagcccauguaggauccaagcaggggccuucuccaccucccgucucuaacauccagcacaccccacucaagggcagagugagacggaaagaaccauggaugggaaugaaauauuucgugcaugcuuuuuucucucauccaucucuccccugcagcuggcugccucucagccagacuggcaggcaggcccugcaguucuagucugggggcuuggcuggaagaucagaucuguaccucaggacgcaagacccccaccaccaaccgcuucucaccaacaucaagggggaagcugacagccaacaagcccuucaguauuuuuuuuuuuuuuuuugagaugcaaucucgcucugucgccaggcuagagugcaguggugugaucucagcucacugcaaccucugccuccugggcucaagugauucuccugccucagccucccaaguagcuaggacuacaggugugcacccccacaucuggcuaauuuuuguauuuuuagcagagaugggauuucacuauguuggccaggcuggucucaaacuccugaccucagguguuccaccugccucagccucccaaagugcugggauuauaggcgugagccaccaugcccggccccuucagucuuuuaaugcauucugguggugggaaggggcaggggacuucuacagaagugagacagagugaauagauuuuugaauggauaggccugagaggaagauucagacaccuuccacccagagugcauguagaagaugcagacagagcgagcugggcuggccccugcugcucacuuauuuuuaacaaucuagacaaaauacagaugggaaaacccagccugugucuuacagagcccucuagagccugggaacaagacagacaaagauggaagaccugcuccugcucagguaauuccaaagugcuaaaagacagggcacgaggaugccaacugcugccuccccagcaccccuuccccuccuucugccaggggcccaggcagaaugcggauggugagagggaugagacugacugcagcuucuuggggcaggaugcacacagaaagaaacacgauggugcagugacagaggccuucccauccacagacccugcugcaaaacguuuuugauucuccugacaagcaacuggggcugacagaacaggagcugucuuccuccuuuaaagaugggauuuaagagcuagaaggggcaaggccaagacuggagcccgggaaucucagaacauaccaggccaggugcuacccccagggcugauggacaaagggaaucgagguccaggcuugcgacugggcucuacaggccuuggcugaauccccagggccagcucugaugggagggagggccauucccgugcauacaagccagccuggccuccgcucaccuucuuugcucucuagcccagguucccgcagggagcuggcagcaggaggcuggcucuggcugggacucugagcuggacucaggcugcugccaucuggcugguccuugguccucauuucuuccugccagaguguggacuuggugguggggacuuucucagcacuggggaugcugcugcugcugcugcugcugcugcugcugcugguaacagccaccuuggcaggcccaggcuccuggaggaggagaaaguggugucugugaaggugcaggagcacacagcucagguugggucacagguccuggcugccuagcuauagggggcacccgggccagcuacacaaugucaggggccuggaaucuucagauacugccccaaaacagugagaccacaguaguugcuuuggagucugucauuccuagacauccaagacucaaauaaggugagacagaacagaguaaggaaagagaacacacccucgagacagguccagcaucaucuguagcuccuuacagugaaugcaagaacaaguucacagcgcccaagucugggccagcccuguggccuuacccacccucugcuuuuugccccuaagaagcuaaaauggagugcccagacgcuaugugaaggaaagagucgucagaugcaaauuaaaugcuaugguuucaaugucugugucuccccacaacucauguguugaaauccuaacccccaaggugaugguaucaggagguggggccuuuaggaggugauuaggucaugagaguggagcccucauguacaggauuagugccuucauagaagaggccucagagagcugccuugccccuucuaacaugugaggaccagcaagggggcccucaccagacacccaaaauacuagcacuuuaaucuuggacuaaccagccugcugugagaaaaauuucuauuauuuauaagcugacuagccugugguauuuuauuauagcagacagaacacacaaagacaccaaauaccccacuugaaucugcacacaggcacacacucacaaaugcauauacacauucaugugcacaugcuugcucucucacacucacaagcucacacacaaagcuagauacaagccaguagcccagauggaaaaggugucaauccccaaucucuccaugguucuggaagugguagcuccgagggagaaguguuuguggggcaggcauuuaggcagaugcagaggcagucccugggcagagaacccuaacuugacucugcaaacacagaauccaggcaacagcagggcugugauccucagcugcuccgcagugccaggucacauccugggccccaacaacccugcccagagggcugccaacaggauggcuuuggccccucuccaaaagugaagcacaucucagcucucucgcaaaagacaagagcaugauauacaagugcccacuucccacucccauccugauggccaagccucauuuuuagaaaaccaccuuagucucucucuggcuugggcccuuggagaggcuugcagaugacacagguucuuuauaugcauguaugugcgcacacuugcagaugcagcaucaccaccagacuauuuaucaauagccuggcugggauccauacauccagucucacccacccaccucccaagggaggccgcaggcgcugacagaagaggcagcaggcccacacgcacacagccagugaggggcagcaugggggucugaguguuuccaccacgugcuccagaagcaggaaggccauggggugguggggcacugccuuggguggggcucuggguccaaagcuguuggcacuuuugcaaggauuccaggccucacggacaggauaaaagcagggaggcucuucccacagacccaggacgcacaccugaccaccuacucagcuuagggcugccagcagacagacucccaggcugaaggcuccccucagaagaagccagcuucucggaagcaaacagugaagguuucuccugacaaguuucccaagggcuccaaugacccaaggggaugccgccccaggacgaccugucccugcaccaagcacagcauccugggcugcuuacccaugggaaaccagcagcugugcugcccugggaagaagacccagggcagaaccacccuaacugcccaccccggcagcagcgcuuccccaaagcacaaguugcucuagagccuugcuugccaagcagggccucucucugcagcaguuucagaaggcuccccacuucccuagcaggaacacggagcauggcaaccaacgggaaggaagaauucuaacuuggagugggggugacaguagacaucccaguaaaaaacaggauucuuaaggaaggagacacacaugugggccugguggugcuggcugggcucacacugaacucagaagaaagccagagaaaagcagaagaaccuggggggcugggagauggaggagcgggccuccuucagcuccaccagaggaguggagacccggggccugcacaccuggcuggaaacacagcucugggcuucccaaccaucuccauccuuccgcccuucacaccuacaugggucaucguuuccuucugcuccaggcuuuuuccuuuauugccuggagcccacgccucucaggccacaggcuuuggaaacucuugucagggccaagcccuucucuucucccaggccuagacucuauugagacucccgcccucagcugaaaggcugucugcugcucccgcagugcgauccuuggccccaacuucuggaagcagaaccuuccagaaggucccaccugaguuccuuaaggggagaagcugauucuuacugggcacaacaggcagccaacgcuucaagcucuccacugguucaaucugaaacucucccgggccaacacugggccauggagaaagaaauauagggucuuggguucucgccucuccaggugcucugaaggugugagguuuacccccagccccacccuaggccaugagaaugccuuuagcaucaggcugcaugcagaggggaggccugaccaaagaucccaucucaaccauggacccugcugcuccucugcagugcccccacgucaccccacaagacugacuugacaaagagauggccucugauuacaauucaaagcuucuggaaacaagcagccucaaaugggaugcucucgggaccaaaggguagaaaggagagaccccgcaagguugucuuaggaggggccugagugcagaaggcuaggaacccugugcuccagacucuaagagacccucagugaaguggguaaccuacccacccugggaucauguggcuccuucuaccaacaaaaaaguugaaacuuggucauggguagcuguuuuggggagcugggugucaugagggagggagagcaagcaaguucccuggacugggcugagagcggcuucugcacuuggaguuaccuuauuagaggcaggagcuccgcuucugcacuguuuccaaggcaucaccauggaaacgcaguguaacccuaaacgcuguuauucugccugugauuuuuuuguuucucuccaacugggaagcuuugggggauuuacguauuaacugcuguuccccagcaggaagcuccauuuucagucccaggaaccacucuguauuuuucgcugacuucuugcuagcgacaucuccuuuccagcggauguuggcuugggugucccccaccugccucccugaccccaggauggaggguggaugaccaugggcugagaguggcccaggcugacuccaucagcaggagggccaauacagcagcccagggcagguauauccaagggcagcccaaggggcugaggagagaaagggacccagaccagugcaugcucccugaccucuguagcccgugggcuggcucucuucacuucugugggccucuggccuugugaugcccaagggacccccauccccacccugcucccucucgggugacuaugaggcucaggacuugggaagaguagcguaugguacagagggaaaggaauuacauuuacugagaaccuauaauagguccaaaacuuccuuucaugcucacaacaaucuuggcgauuaggcagcaacaggccugcuuugcaaguugauuaacugaggcucaaaaaagguuaccucauucccccauggccccaggaacguggggagugugguaaggcgguguaggacccuucuaugcccuaagccuugcacacuggccagggagggaaggaggaucauggccuguggggaaggacugggccuugagggaccaccccagucagccacgcccugcucaggucacaugggaguugcagcaagggccccugugagcuccuuaugggccauaccacuccagaauucuccuccccauccuacugcauccggcugccugcagggccaucugugggugcagaguccuuuugacuguggcugcaggcugcccgugcugccccuccccagcugccagcaggauagcgaggggaggggucacagcuguguacugcuagcuggcuggaaacuucccuugggcagccccagagcacacuagcaggccacccugucccuguugugguuccccuguggcucagugaggaucuugcagauugcagcccaaagcaaggaugugcagaguuggugacugccucagcccuggccugacuguguccucacccucuaaccucagggagcccucacuucuucccaagcccuggcuccacugaggggaugccaucuggcaaacccacugccuaccugugguguggggggcuccacuuuccguuucuucuucugauucugcuuguugguccggggauagaccaugagcaucuccagccaccugggaagagaaaaggagacaaguaccagguaagacccuggcacucggggacuaggagcccuggcccuugccgggugguccaggaguagagcagggcauuguccccagugacagacugcuacgcuggggccagaagugccacagagcaagccuggacaaugacccugccacacccacagcaggcucaggacacgacacagacuccgugcuggcagagaggccuggccuggccauggccucagagcauaggauguguaacuuccauuacugacccugucuccagggccuggaauugcccuaacacugcucucccagagugggcuuggugagaguacagacgagcugugcccauuuagggcaacagaggcaggugcuggcccugaggccagaaucuaggagcugugcuggucaaguucccacaauggguacucuugagggacuagggugugggggguugcugaacucccacagucccugcagagggagggugcugggcacccuggcuuugaggaaggcugggcagagcugcccagggacccaucagggauuguguguggcaaguucacucuggauagacaccaggggugcagcaagggaacacagcaaaagcaggcgcugccagcaggacgacucuggaucugguucugccacuaucccagcacaaucuuggguggcuccuggccccuuaggagcuucaaucuucucauuucugaaaucaggagcuagaucagaucauggcacaacuacuuccaccauauagaauuuuacaacagacaaaggaaccaacagcaguugccuugccagagcugccugucaguccugugggggcuagacgacgggggugggaggagcggagggcaguguagguccugccucugaagccccagcuccagcccugggccugguugugcaagggcagcccuaguguccucuccagaguggaaggagccucagaagacaccgcuccaggucuucuuucagcaccaggguccacgcugggccugcuggcagccugggcccaggguuggggaugggggggucuguacugcuguauccugcuagagaucacacgggugcagcacccagcagcacacugagccuggggcaggagaagggcucgagucuucugugcccagagguauuucuuuaauuugagguggagaggagaggaggggagggggaaaagggauagaggagcgaagagaggaagagcauggggaggagggagggaggggaggaggacaggaagagagggaaggagaaaaugaagaaaggagggaaggagggacaaacagacaaaggaagggucagucacaaucacuggcuucugagacagccucaggaugggugugcuguugacaggugguggcggcagaggccaggcuuaaugcacggaaccacagcaacagagcugaggggccacccucagcccagcucagcccacagccagugaugcucgauuugcugagagaaugaauaaacaccugcaaugccagagauccaagccacagguccugugggucauuccuccacggccccaaaacaagaaaggaggcugugacuaucugcaaagccagcagacaggcaggccuucugaggguccugagccccucuccucccuggucacacuucucaucaaggcuggcugggagcagaggucccaggagagggccucgcucauacaaccugggauguucacaagcccuaugggauuaaagagguuugccuuuccagucugccauggcagcugccacuucuucugaccacucugagggacugugccugcagaaggcugcacuuaaaacuucaccaagguguggagcaugcuggaggugcagaacccugccagguaccccaggccccugcagacuggcccagguuccaucagucagcaaugacuaauggccuugcaggauggaaccuggaggggaggggagaaggcugcaccgcaggugcucugcugacuacguggagcugcugagcucuccugggcuggcuccagcaagccuaggacucgggaggagucaggacagcaggugucucauguggccucagucccauuaugcaacuuaaucucuguucagacugcagucuguggcuggagucgcagagaugcaggguccaggaauagaugauggaauguguccucugcacuuggauuucucaaggaagcccaauaggaagcgucuaacaucauccagauguguuauaaauguuaacaaaacaaaccccaagaagagaggagaggggugugaauaugggacugguaggugcuggggcuccccggauagggacggcagagcccggaugagugagaacaggggaguggguaagguuaaaaggcagggcagggagaagggaaguccagacuucacccagcugagagcacagaagagcucccuugccaacuccuacccaaacccaccucgucuaaaagagcuauguaaaguguggcccagaauccuggaagugggaacuggaaagagcugccaacuuccucuacccaggcccaggagagacccggcagcccacgcagcugucagggcuaugcagagaagaccugggaagaagacugggugggacuguccccaacccacccagcucccagcugccugguggaagugucugcaccuucuuagggaccagcuuugaugugaccagagagcucagacccagaauggcgcuccagagccuagggaugagguuacugggaagaggaguuauaaugggaaacagagggaggcaagagagggagcagaggaagggggcugucagcgagggcaggagacagaggaaugggagaaggaggcaaaagcacuuguccccagggugcauaggccacaccugacucccucacgcagcugagcaucccagcuugugggaaggugagggcggaucacgagguuaugccacgugagaaccugccuguuggacacgaacuaacguggcccacaaccagggcgaggggaaggggaagagcgucaggcagcuuauucuggcuuuggauacgccacugagccaccacacacguagggcccagauggcaugugcacccgguaccuugguccauuaacgaucuugucuacccaagcugcauggguauggcaagccugaauaugcaacagaagagagcagagaagugacccaggagaggggcuugggauggagugaggacuucuggcaggacuuaagcugccugcuggaggcaguccaaaugcuaaacaucacccucuccuaauaccacaugguacaacacauaccucuaugugcugguccuagaaccaacccugcuccagacacuccccagcuugcccuggagacccaggacucccauccaucccaccuguuacccacacccucccugggacccagcuccuguggaaagggugaggguuuccuagggaagccaccugggcagaggaagccucggcugugugcugcccggccaacagcagaaacaggugugagccagaaagugcagaaggugccccuggccaggcuccugucucuaggcccugggucuccucgacuguaccacgaggguucuucagaggcccuugacauucuugaucauaugguucuggauuaagauugugggagacagaagugcuccuccagcucggcuccaggugcucagaaaugcaaaccugccucucuccaggggaggacucuaggggagagcacacccccgcagagagcgcccccgggacccagcacuggcuccuggacgccuugccauguggcccuggacuuccagcugugcucacucaccaggcuuggccaggcugcagcugagaggcuaaagaaaggcuggugcuccgagucaucuguguguucaaacucaagggcuucguauuccugauucccucuacucuguacugcuacagucagccuggcccagcaagccccagguuuacuuucucccagagcuucuuagacucaugugccuccuucucagccuuaagcaagacagggauucucggagauccaguuugugagcuccugucaggcccaaugagccuguucaccugcacggacuauguacggcuuuucaccauggcccaggccauguggguagcaaagaauucccugcuagacugggagcucugggaaggcagaugcugcccugggcucagcacugcgcucaggccccuggacugugggcucucucaaccugagccaguucgccacucucaggggaccugggugagugagacacuuacccauucucuccacucacagaaaccaaucugugcaguggcagcagaguggcucgggugugaggugcuggggaugugacugagacaccucccacccccaccaccacugacagagacacacguggacacagcagauaaccuggcgcuuucauaggugguggagcccagcaccagcccuggaaggaggagcagccaucccagacugggggagggcgugcccaggucauaugauucagggacugauccccuuccagguggaggggcaggugaguuggggguguggugagugcaaugguggggaggcccgaggaggguaagguggccagagcaaagaggggccccagaggcugcagguggaauggugaauguccugauuucugcugugcucagcacacagcgguguugagaacagagacagagcccaagaauagaggcacacggggaaguagacaacaucgacacugccacaggggcaggcggcccaucugguguuggcccuguggcaggugguggugccuuguuccacagugccagcauacucacccacugacgaucuccuuggucuccgcccggaugaaaugcuccuucucaggcgucagaauacacagggagaacuucuggcccgugcggcccuccccauccaccacaucugugcacugguucauguugauggugcccugaggaagggucgugggcuggaagaaggcggcagagagucacccagaggccagccaauggggccacagaugucguacagccccaggccauuccugacccucccagccuguggggccucuaggagugcucucccucacuccagccccagcuccucuuccuuugugcccaucccagggaggacagggacaggccuggccuucuccagaggacacccagcuaaacaucccuccuacguggagagcgacaucccacuugcacuggaggggauaugcaggggaggacaggauggggacagcugcggugacaggggcagcugagauccuggucucagaagggcugcugaucccacagagaagcaagaaaaagcuccagaggaggcaguuucaaaauagcaggguuauuuuuagaggcaaggagggggccagagagaagccacauccuugagagcaggcuguggggugggugcacugugccuucuuuagaggcggccaaggagcacgcccggcagccuggcccacggcaccuucccagggccauagcagagcccagcaaaggcugccacaccagcucuggcauggcaaacaguaacuuuuuuucuuacagcaaaaacuguuacacacugaaauuagggacagaaaaccaaaagcaggaaaggaugccuuuaagaaaucccuacugaggcaaagggcuaggcaagaggaccuuuauggagaugacuuguuuagcccuguacccucuggccucuuucuuacucucccaacguaaggaugcuuugggagagcagauggguugccaugguuaccaccacaccaggggugccccuguccuuaacacacuccacacugacuccaccccacuaauggacagcugcuggcuucuccacugagcacccccaacagcccaccauuuccuuguucucauucuugaagaagcagaagaugcuucugauccaucugagggguggccugcaguugggcugccuuccacccagaggccauccagccucaagcuccuugcugacagucaaugggggcuuggucucaagagcaggaugcugggucuggugcccaugcugagcucagaccaaccacucuccacaccccgaccuucuuccuuucagaaacagguuaggugcaaccuccuugucccuccaccucaagcuccugugaucuuccuguuacuuccucugaccuacuugccaccucuuucuacaccccuugaugccugccugcaggagucagaccggagggcugcuggcuuugcagagcccuugccuacauggcugcuggcucuuuucuccaugguuaaauguccagguccaagaagccuuuccuuguggggucucuggacucagccaucccccguggguccagcucagaagggagguggcacagcaggugggauggaggcugggcucacagggaagccuccuucaguggcuucacccuuucagcauacaccauuggcauccugccucaacacugacccuggggggacacgaggaggagccacauucaagcccagcucagugcucuccaucaguggaguggcccgcaggugucucuuccagacacucuuggaggguccuugagaaggagccaggaaagggagauggguaggguugcucugcaaccaagcaguggguguuucuugagaaggagaggguacaggaggcagccucagaccccaucuuuauguuaguccaggaagccuggauccaagccccugccaccuucugguuggggagacccacacugagugcuauggccacagccacaggacaggugggccuuccugcccaagguggggguccuggcuuuccuaaucuccucucuccagcuccagccccuuuacucuauuugacagaaauucucauccugggcauccuggcauagugcaggugccugucugaacccucugggcaaaugaaggguugcucugacuucccucuugagcccaacacccccaugcaaaagcgcaccccaccuccaccucccuagacaaggcaucuugucucucugagguggacucucuuguuugcugaggaaacuccauggaccacagugaggacuggaugacaugaaaugguaaaguggccagugcacucguuacuagagugucagaagccauccugaaggaaccacuguggaggcagaggggcuuuccuaagguggcccuuccucucuggucuuugacucccacccugguccuugggaccguggucucaaacugcugacaguacaggcccuggaugagcuguguauccauaccauggugccagucuauuaugagugugcaugcgugugcacacacacacacagagacauauguuagauggaauauaucaacagaaauuccaaaguuuucuucucaagggaucauccaccggcccccuggaggcacagaccccacuuugaggccacuguuccaggguucagugucaccaaauugcucacugucccugaagcccacucuucccucuuacgcaguaauuguuugggcacuuggcccccagcugaacaaagccccugcucugcugcugaacgugguugugucucagccucaccaaaugaguaugaagcaaugccuuccaccucuccaccucucugggccucaguuuccucaugugcaaagugaggguucuaucuccuuccaaaaaggauuucagaagcauuaauaaaaggcaaaaacauaccaagcugagccaggacugaaggaaauuagcauguauuaacuaccugugugucaagauuucacaguuacacucccuuuuaugcccucuucaauauuacuuacugugaggcgggcaucaccuaacccuaucacacacagagaaaggagagcaaauggggguaaauacguuaucaaagaagggaauauuuuaacuccagagcccaaucuauuuccauggaggagggaaaaaaaacuuccugcucuuaaucagaugaucucauuuuuauuuaauccugguauuaacuuuucguuuuuucuuucuuuuuuuuuuuuuuuuuuuuugagacgaagucucgcucuguugcccaggcuggagugcaguggugugaucucagcucacugcaaccuccauccccuggguucaagggauucuccugucucagccucccaacuagcugggacuacagaugcaugcuaccacacccagcuaauuuuuguauuuuuaguauuauauuuuuguauuuuauaguaauuuuuguauuuuuaguagagacgggguuucaccauguuggccaggcuggucucgaacuccugacaucaacugauccgccugcuucagccucccacagugcuggcauuacaggcgcgaagccaccgccccuggccuaacuuuucuuuuuaacaacagcuuuauugagauauaauuuacauacaauuuaccuaaaguguacaguucaauggcuuuuagcaucauguucacagagcuguucugcaaucaagugcagaacauuuccaucucccccugaaaagccauucgcagucacuucccuuugacaccuguccccaccucaacaacugcuaaccugcuuccugccucuguggaugcaucucuucuggauaccuugcauaaauggaaaaaucuggcuuccauuuagcauauuuucaaggauuuagcauauuuucaagguuccuccgcauugcagcaugugucagucuuucaauacuuuuuacagcugaauaacguuccauugugcggcuauaccgcauuuuguuuauccauucaucuguugauggacauuuggacuguuuccauuuuuuggcuacuguguauagugcugcugugcacauuccuguacagugcuccugugcucucauuucucuuggguguguaccuaggagcagaagugcugggucauauggaaacuauauguuuaacucugaggagcugccagacuauuucccaaaguggcugugccaucucacauucccacuagcacugcgugaggguuugggacuaacuuuuuaaauuguauuuauguacugcuucuaaccagcacucuuggaagacagguccagguacguacugaggaccugcuauaaaauagcucccuuuggccaggcgcaguggcucaugccuguaaucccagcacuuugggaggccaagacgggcggaucacgaggucaggagaucgagaucauccuggcuaacacggugaaacccugucucuacuaaaaauacaaaaaauuagcugggcgugguggcagucgucuauagucccagcuacucgggaggcugaggcaggagaauggcgugaacccgggaggcggagcuugcagugagccgagauugcgccacugcacuccagccugggugauggagcgagauuccaucucaaaaacaaaacaaaacaaaacaaauaaacaaaaaaacaacaaaaugaaaacaaaaaacagcucccuucgauuguggagagaaaggaacacuuauacacuguuggugggaguguaaauuaguucagccauuguggaagacaguguggcaauuccucaaagaccuaaagauagaaauaccauuugaugcagcaaucucauuacuggguauauacccaaaggaauauaagucauucuauuauaaagacacaugcauauguauguucacuguagcacuauucacaauagcaaagacacggaaugcccaucaaugauacagaccagagaaagaaaaugugauauauauacaccauggaauauuauguagucauaaaaaagaaugagauaauacccuuugcagggacauggauggagcuggaggccacuaucuuuagcaaacgaacacaggaacagaaaaccacacagcacaugcucucacuuguaagugggagcuaaaugaugagaacauauagacacauggagagaaacaacacacacuggggccuuucagaguggggagggugggaagagggagaagaucaggaaaaguaacuaaugggcauuaggcuuaauaucugggugaugaaauaaccuguacaacaaacuuccaugacacaacuuuaccuaugugacaaaccugcacuugcaccccugaacuuaaaaaaagaaaaagaaaaagaaaauagcucccuccaagucucaguagugcaguguucccccuuccccugcugccgauggggaagcagcaacaacagcaccagcacaggcgcagggcacaauggugcucauguuugcgcccaugcccuugaauaccacgcacugcugcaaacucuucccguguccucucacugaacauuccgaacacacuaugaggcaggcacuacugucacucucaucccgcagacaaggaagcagacugcuaagaagcuaggugcagucaugcaccgcacaacgauguuagucaacagcucccucuauguuuugcuagguuuggauacaucaauacuugccacuguguuauaacugcuugugauauugcaguauaugcuguacagguuuauggcuucgcagcaauaggcucuaccacaaagccuaggugugcaauaagcuguacugucuaacuuuguguaagugcacucuagaauauuuacacaaggaccaaacugccugagaaaacacauuucucaggaugugugccugucauuaaacaacgcagaacuguaauuuugauuuaaggucacaaugcuaggaaguagccaugucaggauucaaacccaggcacucugguuccagagcuggucccccugcugcucugcacucagcagcauuuccagacugaacagacucaaccaauggcuccagggagccccucagccagcaccucuccccuccccugccucugccuagggggcaggauacaaccaucugugucuggguaggccugaaucuugugcugcgagaguaagggcaaauaucuaggcuguaacccaaauccagccagaaggaacgccucagcucuaacgcugucagcaaagcaacucugaugagcuuccugcccuaauucuauaccuccagaggucaggaauccagguuuccuaggaggcugagcuucaccuaguuuuguuugauucauuuuccaaaaaaagagacggcccucuguaggccaucgacucugcuaugucaccaaguuauggguucagcccccacauagcccuccagcuaucuggagccucugguccucuucugggcuccacccuaccccagcuaaggggcagaguugcuacaggcugcagauuguuuaggcaggaggacacaggacucaggcuucucuccaaagagaugagcacacccugcuccuccugccgguccucuguccacaggcccaugggaggcuggaagcucugugcacugcagccagggcaucuugucagaggccagagugaccuuccuggguuaggauaauacugcuauagcagccucuccaaccggggacucuccaccacaccccuggcccaagcagaagcacuuuugggaaaacaggccuuuguuucuuguugaccccaugagugugggaaggcaagcuucuaagagccagagggaaacaagaggaaaguaagcagaaauauggugagaggcuguuuggcguuaucaucaggaggaccuuccuuccaggcagcugcuguuacagaaccagucgcacgugagaccugggugggagucuucccuuuaucccccaaucccucauucagaccagaaaacagagacccaagaaacaaaggcuuuccccuagggcaaagaauuacucccaaaaucucaaggucagaaaggggauuucaaggugaaaccugacuuccccccacaccugagguccugagacagcauguuucacaaacucauccaaccaaggcccacauggaacaccacauucacaccaugaugagcacacacacaagugcacacaugcacaugaaauggaaaacggugagucaguauuucuaccaugugcacuguauuuauuauuuuuucauaugcacugugacccacuuaaggaguaugaaaagcuuugucugcaaacuuuggggcugagcggucgccuugcucaucugcacucuggcagggacaggcagcucggcacguucuagggaggacacagggaauugccuugcaguagaagcaggaaguguauucaccacuuccugggugcucacuguggccaggcccugaguagcuacagguacugaugacagcuucaggaggcaggcacaucauuguucugacuuucaaauguacaagcuggggcuccaagugauuaugggacguggcacucugugggccacccagaacaagugugguccucucugacuggcacccuugccccucucuccuuggcaucuuuccucccuggacuuaacaauuguuugcacaaggucaugccuaaguuuaucagagaaacuguaggcagggcuacccagccuggaccacguggagacuugcccagcacggccccugccuucagccuggcacuucacugagcuauggccugauuaggcagcgcccaggcaggaacaccaccucccuccucccuugggcuggugggcugugcugcagacauggucuggcugcucgagccaggucuaaggagagguccuuccuuucuuuggaauucaggacauuggcuccagaguuuucucaggaaggaacacagcccuuggggagcaccagcugaguuccuaggcgccccuggaacccacauccugggaggcacaacacaggagcagggcucaugggggcuguguggcuggcucaggucaaagguggucucccggcucuucuugcugcagccaaacugcuucuaggagcccgaucuaacaaaucacaagccccucucuuuugaggaggugcuggugacuaccccaaaggccaucaaguguagaaagggcacuuaacucuuggcccaaagucccucuggggcugcagaccuccccagggagcagcacucuccacagacagauauccccaaagcccaaguccucugaggaaacuggaaagagccgcagaaaaggggucaugaucccaugcaggcccagaguaagcaaagccucugccuggccucugugccacaacucagagaaguguuaggccaaccacgccuagggacugacaaugggccuagcagguacccaccaggcagaacucccuucccccuucccagucgucaccgccaguccugguguacuccacaguccucaugguucaaagggcaguuccacaaucauccuccacacuguagccuccugaagcugcauggaacagccccuaggcugggcugagcccucaucccaaugccuguccucaggugucaggucugauuccagguccuaucaccuccuugggaagggagccaugauucugcacucuuccccacccuucaggugucccacaugaaaccugcaugcuacaaccuggcagaccccagagaggguccugcaaccccagagggacuuugggccaagaguuggaugcccauucuacacccgauggcuuuuggggugguccccagcacauccucaaaagagaggcuugugauuuguuagaucaggcuccuagaaguaguuuggcugcagaaagaagggccgggagaccaccccaugaccugggcuagccacacagcccccgugagacucccaggaccuuaggcagcuuuggccagccagggcuaccuaggcuggaccuacagcacaggccagggagaccagcucauggggcuuccaucagcccaggacaggaggaagagcuggagccacaaaccacugcucucccagcuguuucccucugcagaaguucugagaucuaagguagacucuaagcaaucuguuuucagagcucucuagccaagaagagccuacccuuggagucaaguccuagcucugcacucacuagcucugugauucugggcaagucgcaaauugugagccucaguuucccuaauguaaaaugguaguaaauauaggccucguuuugauuguaaagugguguagcuauuguggaaaacuuuagcaguuccucaaaaaauuacagacaguuuccauaugacccaacaaguugauuacuggauauauacccaaaagaacagaagacagguacucgaacauauacacaaaucauaucguagcagcauaauucgcgauagccaaaagguggaaacagcccaaauguccaucaguggacaaauggauagacaaaaugcaauauucauacaauggaauauuauuuuauucagccauaaaaagaaugaaauccugacacaugcuccaacaugagcaaaccuuggaaacaucacgcuaagugaaugaagccagucacaaaaggacacacacugugugacuccaucuuggugaaauguucagaaaaggccaacccauagagaaaaagcagaggagugguugccaggggcuaggggaggggaaugagaaguggccuaauguuuuggccuagagauuucccuuuggggugauaaucuacccccuucugucacaagacuacaaacgauacugcacagcugaagcgggacucgagcucaggcucgggauggcacacccgugccgccugcugcuucucagugcacaucaccacucuccuaccaagcaagggugguggucagaagacgauggguucaacaacuuuccucgaauguuugggaaggagggaggacagugucgggcauguuccgucuucuacccuguggcagagaggcagggcucaguggacugaggagcucugggcaucaugggccaccgucuucugcaaggggagggggcacauccucuacucagagaccauggccaucuacuugugcuaagauggcugauaagggcucuugaaaacaauggaccaagccgaagggucaauccaaaggcagcugaguaccgugcagauucucccugugccucucuggcccuugccuuggggcccuggggagcaccagaggcugguuucccaggccacauuccaggggagagcagggucugccccucugcugagccccaggcugacagcaccuggccccagacacuaccugcaaaacauuucugaccccucuccccagcugcagaugcaugcggggcaggcccuuucccacugcccaccaauacagacuggggacuggcaggacggaggccucagaccugugauucugggaguuccgugggaggcuuggcuagaugaggccagcugggaacaccugguacacagugaagaggcccauggguucuacccuccuaggcacagcagugcugggagccucagaaugauucaacaggaacagccccagaaccauucuucaugaacauagauccggccaagccaacccacaacucaacugcuccaacagcucccagcccaagcucugcucccugcaccaauugccccaccuugccuccuggaccuacuugcuggccugggagacccacgguuacccgcugcacagagcagccuccuuuaucacuguccugccggagaggccugccuggcacaucuccccuccuggaucauuguccugugcucccugaagggagccccugugcagaggccauggcccauccacaggucugcccaacugcucugcauacuaagccacaaggugccugauaaaacuccuuguauuuacucuauacaccuaggucagcaccuuccaauaugugcuucaguaaacauuucugaaugauggaacaagccaacccugcuagauuuauauuauagauuuaauuauaauauaaauauuugauuuacuuauauauguaauagauacguuuuauuuauaaaauagaaaccaucauuuuaaccaaaaucccauauucauuaaggguuaacaggaugacacgugugcaaagaccagacaguggcaggcucugcagggcaugagguagagaagcugucuggaaagagaugcaggccccugaggaauggccuuugcaugaucagcaccuaggccaccaaguccaugguguuggucugaagccaccaccccagccuugggccaaugacucugcugcaaccagcagaugguaaaguugugagaugaugcugcaugacuccauuuacaucaagcguccaggacaggccaaucgauaaagaugggaagcaggaggggaggaguggcgguggcagcuaagggaugcaggguuuguuuggggguugaugaaaaaugcucugaaauuagauuguguuggugguuguauaaccacgugaauauccucaaagacaaugaccuguacacuucaaacaaaacaaaacagaacacugcacagauaacagggagaaaccacaggcucagcagcaagcaggccaggccuuccaacaggccuucauggcuccaucacgagaaagagcucgccucccugccaacccaggccuggaaggcccucuacaccccaccucucccuaacgucuggacguggaaacucaggcccaggcuuccuaacuccuagcccaccacagcaugccgccuccaucacagaagaagcaggaaccaugcagucagggccaaaaucccgaggcccuaccuuuccuucccucuacuggaaugugacagugggugucaccacagacgcagagcuaccgcucccaucccaaguaggcccucuucuaagauucagcucuggccccagagacagugcaugcuuucugaggcauucguggauuagcaggagggggccuccaagaugugcagcaucugcuaaugccagcagcaacaaugcagugugggccucgccccagccuuggugcugcagugcgugggcugggccuucugcuacaagugacuuugugggaugcugaggaaaugacccguucagggcuuucccaggggcauaguuagaaccacuaaacuacuuuuuuuuuaacggagaaaauaagaaaacaaggaccuuuuucacuugcugccaagaccaggaaguuccuccucacaccugcuacgccaggcuggccugcuggcuucggccgcugccugggcagcgagauaccagggcccccgccaaauggccaagggcccucugccagaggagcuucccuugggagcccucacccaguuaaggcccaccuuccuccuaaaacugguggugggugggcgggggguagaugggaagaagguaggagaggcaugggaacuggggaagaacagcuuuucaucccccucacccaccacaauggucagcuagcaggauccaccaaccaagggugacacuacaccauaugcaacaaugaacuugaaauggagcagauaccucaaugcaagaacaaaggcuauaaaaugcacagaagaccaaggaaaaaagcccuguaacacuggauuuagcaaccauuucuuggauaugacgccaaaagcacaagcaacaaaagaaaaaaaaaagauaaacuagacuucaucaaaauuaaaaaccuuuguacaucuaaggaccaagagagcgaaaaggcaaccuagggaagggaagggaauacuugcaaaucauauaucugacaaaguauuaguaucuagaauaaacagcuccuaaaacucaacaacaaaaaacaauuaaaaauagacaaaggaugugaauauacaaagaagauauacaaauggccaagacacacauaaaaaggugccugacgucauuagucauuagaaaaugaaagucaccuagcacuucagaaggccaaagcaggaggauugcuuggggccagaaguuugagaccaaccugggcaagauagugagaccucaucucuaaaaauaaaaauuaaaaaauaaauagccagauguggugguguacucuuauagucccaguuacuugggagcagggaggaucccuugagcccaggaguucgagguugcagugagcugugauggcaccacugcacuccagucugggcaacagagugagacccugucucuuaaguaaaaaaaaaaaaaaaaaaagaaaagaaaagaaaagaaaaugcaaaucacaucagccacaaugagaugcuaguucacauucacuaggguagagguaaguuaaaaaacagaaaacugucaguguuggugaggucauggaguaacuggaaccguggugcagccacucuggaaagcaguauggagcuucuucaaaaaauuaaacuggacuuuauagauuugcuguuucauccagcaauuccacuuguagguauauacccagaggaacugaacacagggacucgaacagauauuuguacacccacguaccauggcagcauuauucacaauagccaacagauggaagcagcuccaguguccaccaauagauagaugaauaaacaaaauguaguauguauauacacugccauauaauucagccauaaaaaggaaagaaauucugguaugugcuauacuauggaugaaucuugaaaacacuaugcuaagugcaauaagccagucacaaaaggauagauacuguaugauuccacuuaugugaagcacccaaaguacucaaauucauagagaguagaauggugguugccagggugagaacagcuacuggcaaauuucuuuucaaaaauucuguaccugaccuauaccccagcuaccuuucucuggcauuucugucccugucuucauagaaaacagacccuugagagcuauaccacuagugauggacucagcuggggagggcaggcagggauaccaaucaguggaagaagagacugcagggcagggccaggagccgucugcaagggcagccucaaguugccaccccccagggcaugaaacaguuccagccccaacccuggggaguccccaaguggacagcucccaaagcucaugggagcuagugagaccccaaguuccaucccagcugucugagcucggaggaccgcugggaaacagcccagggcugaggaugccucacuggccuccuguggccagggagaaaggacagagugaguuggcugugucaccagcagaaaugccuagccucucccaaggcccgcgugcuacucaguggggauggaacgcaguacaggcacagccugagggccgccucauccucccucccucccccucaacgccaccggcugcgcugaaacaccuuuguccaguggcaccaacccacagcccaguugcagcccuguccucaggaggcuguccuccucccgcagagcugggcuccccuuaaaggggcagaggggaggaggcugggaguaaguggaacucaguucaugggagcgaugaaccaugcagaugacgguccugagugagcccugcaggagcagacggcaggagccaggacuguuccacguacagaggacaggggcagcuggggaggggcuggggcugcggggcagggccaccaucccccaaauccuuuaacuccauggcaucuacuggacaucaggcuuggggucacagugaugaggaagacauggugccugccacagacuucaugauacggggggaagagagggcauacauagcugcugugagaugggcacuugugggaugcaggggcaaggaggccggguuuggaggauucagaugucuuaaagguggccccaggcacaaggcucgagacuuguccugggagaucccgacagagagagcuaggcccaaggagugggagggcagagacagagcucagcuggagauaagaaagcgccguuacccaggccuuucacacaggcauguucugucccgcaaguaugagguguaucacugccaucgcauacacagggacaccaguuggaaaagcgcagcagcaugcccaagguggaccacgcugcccacagcacccgcacaccucguaaauauuaauauuuacccaacaccugcucuguggggugccgacgacugucaugcgacaaugaacagaacugaugaaaccuggccuggacgguugcccuuccaagcagucgggcaagcuaaacaaaugccaggguggguagcauguggggaagggccucggugagaagccagcagauauggugggaaaggccuccugggaacagagagugagugggcagugcuggggaaggcggcccgcuugagggagacugggcacaggucugaccagacaucacacucaggaagguaggagacugccugcuguugguaccgcccguaacagcugagucaguccgcaguucccacuugguccugcugccucgguuuaacaggcagaagagucugaacaaguccuacaacagaacaugcggucccaagagggacgcuggcuucacucuccacagcuguuccccagcauggucucucaggggccacccguugccaggucucccuccucagcagaagcagaaaacagagaccccccuggacacacaggccagcaggcaggugcccaggcugcaggggagaugggaaaaagccccuggugaggcucccugcugagcccccacuuccuagcuuuccucucaugaccuggggcccugguccugccucaggacaccugcuggggccuucauggccagggugcuggucuucccuguccuucaagggcaaggccacuggcaccugcuuuccagguccuucuuagcagccuggccuacaguggcuuccucucucuucgagucucuaugguacuuuuuuuuuuuuuuuuuuuuuuuuuugggacuaccccuugugaaacagggcucucccacgacacugugccuagagguuuuuucuuuuuuuuuugguuuuuuuuuuuaaacuuuuaaaauaaccuuuuaauuucagaauagauucacauuuacagaaaagaagacaagagugugugaagaguucuccuacaccucucacccaguuuacccuguuauuaauacaucagugcagugcauuugcuacaaugaauaaaccaauacugaccuguuauuaacuaaagcucacaccucauucagcacaacuugauucagguggccucagcuugcaucuacuguucuccugcuccaagaucccacucaggaccccacaucacauuaaguguccuguccccugaggcuccuuuuggcugcaacaguuucucagaccuucuguguuuugggugaccuugaugguuuugaggagugcugaucagguguguuguagacugcaccucaauuuggguuugucugacguuguucucacgacuagacugugguuauguguuuaagggaggacaaccauagaggugauaccccuucucuucccauccuuccaaggcuucacgacugaucacuguugaugaugaccuuaagugccuggcuggggucgugccugucaguuucucugcugcagagcugcuccccaccccugugcucucuggaaggaagucaccacucaacacggaguggggagcuauggccaucuccuuaaguaaggaguagcugcauaaauaaccuggaauucugcacaggacauuuuguuucuucucucccauuuauuuauuucuuuacuaaaugauuuccuuaugccaauacggacuuguggauuuuauaucuugucuuagucuguuuugugccgcuauaagggaauaccugaagcugggucaucuauaaagaaaaagaggguuauuuggcucacaauucuggauggcuggaaaguucaagauuggggaucucaucuggggagggccuugugcugcucuacucaggguggaaggcaaaugggcgcuggugugugcagagaucacauggucagagaggagggcgggagugagaaggaagcugccaggcacuuuuuaacaacaaggucuccaggaaacuaacagagcaagaacccacuugcugccccgcccagggcagggcacugaucuacucaugagggaucugcccucaugacccaaacgccucccaacuaggccccaccuccaacacuggggaacacauuucaacgugagguuuggaggggacaaacauccacacuacaccauaauccaacauuacaguauuuauuuuguugcucaaaguguuccagcuuuggacacugggagcuuuucagccggcucccaugucccccugacacacccccauccgcaugugcaccugugcagccucaaagcacuuccuggcauugcaaggugcuucauguaccuuuaggguauauuucccgccccagcccuagaauugaucauuuccuccagaagcccugguuuacuuuuauuggaaagugccauuaaaaaucaagaucuggauggcaggugugcucauuguuucgcgggucucacagcuucuaggcccucuccgcuaauggaacaaggaaauagagguguauauaaccugggcauaccacauaucuauaaacacuucucucuguauccuuauguaucuuuauuaaagucucuaucaacuaaacacacuagcaccuccguggaucagucuagccuccuucccuugccugccuguuccuugucacugugugcaacaguggcuccugccaccugccguccauuuacuuaacuguugaaucccaguacacaggcauuguggucucaaaagugucaguacucgugugagagaacugcuuucccuugcacacagagccuauguauggcuccucuggccucuuggcuugcagacuccacucuacugcaaaagugcacacucccuuuuacaccacugucuggaagucccucuggugaauucucagagaagaaccugcaacggugccccauauacccacgagcucagcagugggcagaacggauacugauugaauauuuuauaccuucagcaugaguuuuugagaccuuuccaaggcauguuuggauaagaagggaggggaacaaaguggcgaggguaaggagaggacacagaaggaaagggagagaagggggcuaagggcccuucagccuguuugagcgcuuucagaaaucugcgcaccacagccggcgggagaaguugcacuggagaagaggcagugcuagcauacaggugggcggagugcugccacugguggcuucagauggagcuuccugugucccagcuugccuggucuccaagucugccugagccugagagggagagggcgcugccaugccacaugguguaacugccuuuucugcccaaaggccugccaggcagaucuagagaaaacaagcugcuguuugcugcagugagacugaaagcaaugcagcugugaggcccauaacauucacccggccccacccccagcacccucccggucaccccugagggaucuacagcagggagaagcagcuucagggggcccagaccucucuagaggcuagagacaaaggccagcuggcuuaaaauggaagguuuuagagcuuaaagcaaugguuccaaacuuuugcugaauaauguaaucaccugggaagauuucaaaauagagguucuaugcccagagagagacucagauuuaaauucucagauguagggcugaggcauaggaauucuuaaaagcuucucuagugauucuaauguucagccaaggcugggaaccacugccucaaagggagaccuugaucuauauuugaugccagaggcuuggcuccgauggcugucugucccaggcuggccacccagcuguauuaagucacuuacagcuuuuugcugggccaaagagggccugaugaaagcaaagaaagacagaagaguguggagacaaaaugcagcuguaaagagccugcuggcagugggggugaauggacaugcuggagcugcgauuaugauucauaaagugcuuggggacaguacccugaaaggccaugccagccacaagaaaacgaaacccucaggcagccugagggacaaggcaggagggagggccauccuucuccagcaggccugggaaaaagggagaggugguggcugugucaggcaacugcucuaucuacagggaaauggcccuugcagguaugugaggcgggacauguggccagggcuccgggcaggccccugagcagcgagcaaccucugcagcccuggcccuaagcgggcauaccauagguucucacacaugcaccuuccugccaaccacuuacagacacagagggcagcaggcaggcacagaggaacccaugcaagcuggaagcccaaaggacuucaaaucaccugcuggggagaaacuuaagauuccaaaccagcuagagagaugggaacucaagaacgagcucaaugcacaacaggaaucucuggguuucccccgccaucagagucucagacacgaaggggacaaaggaggguagggauugcucucuagcaggggaugugcaggaccagccugggccugugugccaaauccaccugaauacaggccaggccacagcccucccuguugcgccccaggacacugaacuccagaggaagcugcugcgugagaugaugcaggugucucccugcaccaacagugucaggcucacaaggcaccugccagccccaagccuucuaaggacaggucuugugcccaaaugccagaugccggagcaaccugaauagcacccagccucugucuggcuccugcuccccacaucuacccaaaccuggcagcagccuugaaguccccgcccugcccaggcucugaggcuccuuccugaagacucuugucuucagugacuuugucacugggaggaauugggccuccuggcaguaaguccagaacccugaaagaagcucucugguguucucagaacugauucacagagaaaacccacaaacaccaauccacccccucacucuaaagggaggggcagggggcuagagcccauuaaaucccgacacccuccaggcuacguuuccaaaggacaggagcagaagcuaagaauagaccaaauguguuguagauaaaacuuuccuugagaaagggguaugacauuaaguuccucuuuggcuuauuuucugcuuccaaagacuuccccacccaauaaaauaauuauuaagaacugagauccucugccagcauuccaggaaggccagcaucugggaaagaagucguuaucuuggaugcucucaucugccucucucccacugggaauucccaaucugcuucucagaaauccaacuuguuaugggagcuuugcaucaacagugauguuugaagaccuauccuucuagccugccacuccuaccuuguccuuccaagguugggaaaauguaguuggucaguuaugauggcauaguggugauuuccuuccauguguggcgucuuuuuuccuuguguucagcccugacccacccauccucugagacugaccugccucccagacuaaacagcucugcaucccggaucucuccagcaggccuggccagccuucaccagucaaagccacugagggacucaggaagauccgguucuggaaggaggagaggaaacacuauguggauucugucuggugggcacuguccaggucucaaagcaccaagcucuguggagggcaggcuccagagcgcucuugcugcccucucucugaagugguggaggcucaacucuuucaagaucacagguucugcccacgccaggcaugguguguuccugcugcugccugcccaggaucaaguccucugggcagaggggcuucuacaagucgaccacaaagagugaagcagcagaaacaccaagacacagacucccuggaaaagaccaagaguguaggaauccaguugccuuucacccauucagucacucaguagaaaacgggguacugagcaccucugcuguguuggacgccggcagggcugagaaagacaugguggugaggccaccccgugccucacugcaacacugcagacacuucgcccuggacaagcucccacacccaccuggagaugccgugcucugagaucccucaaagccacugagggacucaggaagauccugaucaugguacuggcuacacaggugugcuuaaucugugaaacuucaucaagcugaaccugggaugcacauguuuuuuugucuuacggcuugccacaauaaaagguuucuuuaacaugccucccuuugaguggcagauguccuauaugggguaggaaaaacuauuuuaaagaucaaaaccuuaaccuaauccuaacccuaaauaaagaucaaaacuauuauaaagaucaaauccuugaaaggaaggcccugccuaggccaccaggcugguaauggcugagcuggaauuagggcccaaaucagacccccuucccauaguccuggagucacacuguuuccagggaacagcccucacugaaaaguaucucauuacaggacgucggauaaucagagacagcgucucucacaccaccaccagugagugacugccugcccuccucugccucaguggccugacucaguggccaagggacccauccaucucugaggugagagcuuuccugucuugacuggucuccaagacaaggugaacagggaccucaccucuaccuccuucuuagggggcgagaacaguacugccccagucaagaggagcacgggggaauggagggguccccacccaguuucaagaccgacuccgccucccuaggaguauggauguagaaagauaugugaccccacaauagcaaugggcaacccuggacucuuaggagacuguuggccagagagcagcaacaggggcugccugggggugcuggcugaggccugcagugaaaaagcccaagagcaucccuguugggcccucgaccugccccaccacgagggugggugagacaugcugugggacagcaggcagugcucccugcccugggagaaagcgaugcccaucccagguuccaucgaauggaauuagugccuacuugaggaugaacaacaaaagucuauuuguaggcuucugugugugguuuauauaacccuaaaguggacugugacagggaagacaggagaaagcagcaaacacgcccaguggauaccugggaccacucuaccaaagcaccuggaagcaacaaggccccucucaacuccaccacaugccaaccacccucccuaaaccaagaagaaucccaacagagaaaccugaacaagugcccacacugggccccagagugggcucagggaaauaaugaagaggggucuuaaggacaaagcugguggcccauaccacugagccacaggcccaugcuuuuaugaaagauggaagggagacuggaagcgugggugcuccgaagggaggcagcggcucccugcagcaagcuagcuggcacagcacugagaccucguggguggcugagggggaggcaaggagcagacgcagcggaaagaaaacaauuggggcucugucucucugugacacaggacagguacucugcuagcagccaggggaaggugacagggacaaaaggaaggacggagaaacgguucugccuucacggcuccccaccaggcuugaacacagccguggacuggucgggaggaaggaaggaugaaagacacggccacccagcuggcaggaacaauccuugcccacccuucaugccacaucuccucaggacacagaagcaauucucuaccaggaaggggacaaugaauucuguuaguucaccaaaaacucgcucauggccaaagguucuaugcagcagcaccccacggucaugcagccugguacacugcuguaugcacauccagaaaacagacacucacguccacacaucaggagcgcuggcaccauguuagauggugcaggcacauggucacauagcagugggacgacucagacucucuaggccucaguuuuccucaucuguauaauggagguaagcaugaggccuauucccuaaaggcugucacaagaauuaacugagaguguuuacgagcacuuagugucugugucacaugaauaucugacacaaaucaaacagacauuauucauuaccaucuuaguuuuauccugaggaaaugggcucacacgccauucccagagccaccagggacacacagaguuccuuuccuuugggaaaaagcuaaaugaugacuguucccgagaaaacaccuggucucccauccuaggagauaucucacugcuaaaaaggaacaaagaggcuuuacucgaagguuugguucuucggcuuaaaauaaagugagggcaucaaaagugagagaaaucaugugcgaagggccaucaucugaggcaggauguaggacagcauuuuuaaaaccaaucuguuuuccugcagagaguaaugcuuccaucuuuuucaauacucuuuucagcccccaccccugauguccugauauagcagauaaaagggggagaucuuauuaggaaggaaccaacaucaaugcugacaacccacuggaaauuacuuaagagacagagcaggggccugggaaggggcaguuuuuuuuaacagcaaaagccuccgucuccugcaaaaacaaaucugcuuuggucagggcaugaacuucagcucuuuccacguaaaaagagaaggccaaacagaaggaucaaagcacaaggugagcugguuaagcuccaccaggaccuccaauuaggcagcuuacuaaaaauagcagccgcugcucccaaagagccacugcaagauacccucacggcugccggcccuggggucugagcugcuuucccagcagugcugauggggacacauggcuggggacagggccagcuccuggugacaagccugaccuccuuagcuccacacgucaccaaugcuuuuuuccauacuuucaccagagcgcaucugacauaaccuccucaucuuacaaagaccccauggccagaguggaagugacuuaaucuguggcugccugaacugccugggccuucugacuuaguccaguacucgcuccaccacaccacucugccucaagggagacaaggccuuggcauggaggaaacaggcuagcuguaccuggaggcuggcacacaugagucuuccaacccccagcacucucacacuugugucaaaguacaugaggccugcaugcagcaucaacucuuggagcccaugccagacagaagugguuacaaacgggacaaacagagguccacccccagaagggugcagguuuggcuggguaagggcaggaagaagaauuacauggagcugccuguccacagugucgaccucaacguugcccagcagggcccuaaccuuucagauguuuccuucagaguccucuguggacagguguccacuagcugggcuggaacugcagaagacagggagggugggugugcugccagcagaugccaccugggccacagagugagggguaccugugucagcccaggccuggccucucuuggggguguguauaccaagcgcaugggacaugagacauggccaucucacuaccuccuuaaugacccugaggagggggcugucaccacugcacaggugagaaaguggcuuagccaaggcugcuccacuagucauggguggaccugcucgcacacuccacacgugcccugacgaucaccugccccaucacaaugaccuggcagagaagaaagccugacagcuccgcacugcaccagcccuuuggaggcccaggugucucagcacugaaggggcagcagagggauuggcuuucuuggcaucucccacaaugccuggcacaacauagaguacaaggcaggugcucauguaggccaaaggagaggcaagggccuuguacacuuggggagcugaugguauagcccccuuccuggcccaaggccuggccuugacuauggguaacgcagacaggaguggcccauaaagacaggaagggaggcugggugcgguggcucaugccuguaauuccagcguuuugggaggccgaggcaggaggauugcuugaguccaggaguuugggaccagccugggcaacauagggagauccugucucuauuuuuaaaaaauaaaaaaaauuaaaaaaaaaaaugaagauaggaaaggaaagccuagaagccagaggacuacacccaccuggacguuuccucuuccucagcccccagcucccugcgggugacauuugagccaaggguaagccagcccucuuuuaggccaagccugaccuccuggacaucaggauguagagccaaggcaggcaggcuuucugggcauggcuugaaggcagcccauggccuggaaagggcacuugaacugcagcugccugagcagucugcaaaccugccacaggagccauagcaguaccuacccuacgggccuuuuccauucuauuucuagaacucuacccucaggaaacaauuccccaggcaggaaaauauauacacaacugaaguccucacugcugucuacacuacuguuuaauguugcugaagguuuuucuuugaaguaacuauauauauauuuuuuuuguuguuguuguuuaaaaaaaauuuuuuuugagauggaguuucacucuuguugcccaggcuggagugcaguggugcaaucucagcucacugcaaccucugccucccgaguucaagcgauucuccugccucagccucagccugaguggcugggauuacaggcgccugccaccaugucuggcuaauuuuuguauuuuuuaguagagaugggguuucauccuguuggccaggcuggucucgaacuccugaccucaggugauccaccugccuuggcaucccaaagugcugggauuacaggugugggccaccaggcccggccuuuucuuucuuaauauccggauauaacauuacugaaauguuaaacucugcuucuuaaccaguuggcaggugucacugggccugagaccaggaagauacuuuauugagggugaagcaaggcucucccuugcucagagggccacacaagcauagcaggacauggcagaagguuccccugccuucuccccaacucuuaagauaaauucccugagugaagcagaaggguggcagagaagacaggauauagcgcuccacugaguucugguuuaaauccacagucauccuaaaaaacuguucuuauucuccccauucuacagaugaggaaauuuagguuuagugagauugcaaaacuguucaagguuagcuaaugcagugguccccaaacuuuuugguaccaaggaccacuuuuguggaaggcaguuuuuccagggccacagggaauggauggaugguuucaggauuauuuaagcgcauuacauuuacugugcacuuuauuucuauuauuauuacauacucaccauaauguagaaucaaucagugggagcccugagcuuguuuuccugcaacuagauggugccaucugagggugaugggagacaguaacagaucaucaggcauuagacucucauaaggagcacacaaccuagaccccuugcaugugcaguucagaacuggcuucacgcuccuaugaaaaucuaaugcugaaagagguggagcucaggcaguaaugcuagcucgccugccacucaccuccugcugugcagcccaguuccuaauaagccauggaccugccugggcacuggggaccccugagccaacagauggcagaacugaaauacacacacacacacaccaauucauguauuuucugacaaagugcuugaagacagacuaauccaauuucguuuguuuugacugguucgacaagggggaaaaagcccagcuugaaaugagcugugagucuggccucuguacccuggacucacugggucagccgugccaugcucuccaagccagacugaacuuggugauucaggaagggcauugaggcgcucuggaaaccuuggaucucaagucagaaucucuuuggaauggggaagguaggcuuccaaauuaacguguuuccaagucaauucuaaaucuguacccuucuauucaacccgccguccaggacagcuauagugcaggguggagccuggucagagccaccaaaggaccuccaaaaggugggccuccccacccagcgccaucccaggaggagaccaccacacaaggauaaguguccccuugccugccacgagugacaucagguggagaugucccaucugauucuuccuggaaaacaucuuuugaucuuugugcuuaccuauuuucacaaaauguauaauuuuuacaaaauuuguacaagacauauguuaguuuuauaauugggaaaaacacuugggacagcagaccauuuucauggcaucuacucucuugcauaugaccacuccucuugacuugagaucaaauccaaucuuuauauauuuuuuauugucuacauuuuuuuuaaaaaagagauggggucucccugucugucucccaggcuagacugcaguggugcaaucaaggcucacugcagccuccaacucccaggcucaagcgauccucuggccucagccucccaaguagcuaggacuauagguaugcaccaccacauccagcuaauuuucaaaauuuuuguagagacagcggucuugcuauguugcccaggcuggucuugaacuccuggccucaacugacucucccacuuuggccuccugagucacugugccuggcucuugucuacauuuuagcuacagguuugcuucacuuuaaggacucuuaguaggaaaauucaaaguugcaagaaaagugaaccaaaggaggacuuuucacauuuccucauggguuuucacaaaaagcugugaccgccuauuaagugaauuuagaugcaacucaguaacccuauagggaggugcuggacccuacaaggcugcaggacugguuggcccagcaagagccuggaaagaaggggacugcagaggacggggaguguguccagggaggagggagggagaagcaaauggcuuucagcuggcucuucucggcugcuauuugcaauguaugugccuuugacauggcuauuuuuggguuucugaguaggggaaaaugaaagaaaagaagccuuuugcacaucgacccuuugcccuagcccacccuccucccuccaaagccccucuaggggaugguggaagcagauccuugcguauucuucaucccccaccccacuacccccugcuuuuggaauaucuguaggccucacccacgugcuugucucuuuauacagagcugggaaaauguggagauaaauaaagccucuauuaggcaggcauccaaugcugggggguggggcagggaggggucugaggcucugucccaaucuaggaaugccugagaaagcuccaggggccucaggcagccuggagguuggaggcuucccacagacuccuuuugccugugcugaccaggcguggcuggggcuugggagcccugggagccagcuucuuucccaccggggacccacagcagggccuggcuucucuuggccaucccauaugcagaggggagaaagggguucuugcucuuuuccccuuccuucuuucuccuggauucccuccuccgagugugggccugcaccgaugccacgccagcccuccggacccgacaaaggcagcccuacccuuucaacucuggaaacucagccuuucguauuuauuccguucuaauccugucaagagagggagaucucauuuccuccccuagccgagggucgggggagagaagugggcucuguggggacaggccugggugggaagaggcuugcagauauuuuuagagacaugggaauuaggcaggcaggggccuucuggagcuggaaacaauuccagucccaauuccaaaaggccaaaugggugguggagagugaggggccuuggagguggagugggcaggcgcagguucuggggaaagagguugaggcugagcgcugagcucccuggagcugcuuuaccuuucuuccugcugccagcgguuuccucgcuuaucaaaaggugcgugaaugccacuacuuggcauuggaacccuggugccuggccccagcaggacacccccagcagcccacucuuggcagaagcagcgcagggaggcaacauggcagguggaugaaggcccaucacccccagcuuccuuugcugcuggcucugguuugauagcagaagaaugacacaggaucuaaaauaagauuuuuucaauuaucugcaggcuuccaaugggucaggcuaccucgguucucaaagaccacaaacuuagucuuaaacaucuguguggugccucacucaaaaagcuucucucaauagccucuggaaaagucagacaaaucuggggguaggauguggagaaaggaaaauugaaaggaaagugagagacccugggugccuccugcugcuguugggagugagccaguucuggacagagguaacuaucagcugucucaaacaugcuugcaccucugcacuggcaacauuacuuccaggaauguucucugaagcaucauauuaaaaaaguaaaaaucugaaaacaacuuggauguccgaaaguacagaauaaaggaaucaaauacagccacccaauggaaugggguguagcuauuaaagaccaugcauagaaggauaggaaaggaauugugagauagaauuuguuuuguuuuuuuaagagacagggucucccucugucacucaggcuggagugcaguagugcaauccuagcucaccgcagccuggaaccccuggcuucaagcgauccgcccaccuuggccuaccacaguguugggauuacaggcaugaaccaccaugccuggccagaauauucuuauuaaaaauaacugguuuauuuaaaaauuauuguuuuuaggucuuacauaagcacauaaauacacaucauaagagaauagauacauaaccacaauaugaaccgauuuuuaccuccgugugggguuuaauaggcaauuuugcugcaugauuuuguuuccccaaauuuucaccaugaacugauuuuacuucugacauuaggugggggaaucacugcuucuucagccccucugcuuuggcugauccugccuuuugcaugugacacucccuuccugcuccacaccccagaauguuccuagauuguucuuccccagggaguugcaaggcugccagccuggcuacgauagccgggcaggcacgugugccugucucagugcuuaugcucccugcgauggcuggccccuuggucuucccagcagccgacgagauucuagaagacaaggaugcuuuuucauauuuauuuuccaccucugagccccucugaggcacacagcaaggcagcaaugggugaaugaauccaagcucccuugugguuuccccaggccccaaggagagucacugggaagacaucuggagugaggaaaaggaaaauauauuagugcucugaggcccuggguaaggacagggcugagccccagaucugccugaugguauugcucaaggcagccggaguaucagcuguggaaccugcccagucaacaacaagggucuuauuguuagucccagguaggugauugggccccaucaguaaauggccuuauucaccagagggaaaugagauaaacugucuccucucccuccaaccuuucuggaacaacagucaucauuaacccuuggguuuccaaccagaagaaucuggaauuucaacuauuuaugaaaguaucuuuuccucauaaaauuuucuccaagguacuggagcaaauuauagaugguacauuuaaugcaggaugccaacacacacagguccccuggcaggcaugugcauugacucugagacacacacacacacacacacacacacacacacacacacacacacacacacacacccugcacacacacacacccugccaagcacaaagagcuacacaggcccagaccaacaauaugacccacacaggggacagugugggaaaggacagggaacaguggcauggaaacagguggguacaaggcaggcacgauaugcccaugauggacaccaacacgugucgacaggcugcgggccaguuccugacacacagaggggccuccaguuaaacacaggugacuuaacacaccagaauguucaauugccugcuaaaacccuaauuaauaugaccauaaagugugugugggggggagguauaaacucucaaggaugaaaagcuggagaggagacaagagcagauauaagauaucaaguaaacuuugagugggaaguggcuggauacauggaaaguggccugguggcauggaagaagcuuccugaggacagcuaggaggaggcaggcuggcacugcugcagacaccagaaagcucagggccugggggcagaggggacuccaacagcaggggcagggcugagagcaggagaacugaucagcacccguacaagggcaggcagaucccagggcuuggcucuggccagagaauccuauauacugaccagcacggaggguugcccuaggagggccccuagagucaggggcagcaggcacagcugagggggcaggggaaguaggggugaaggacuaacagcaggaaaaguccaagaaagucugcauccuaaaaguugagucccucaucccaagcccuucugcugcccacaggucuuccuagauuggagaugagagaauuccuaucaggggaaaccaacaagcccaagagaaagaccuccuaaaacugucauucuccauguaauggagacgagagggcucguacgugcggacauucuagggucucucccaaaacaaacuggugcccugccugccuguccuucuaaggcaaagccugccagucgauauuccuacacgcaccccauauacacacacagccuccuucugaagggucgccacucauucgagaaagcccaagaccauaacaaacagaaagggaacuaggagaaugaaagucagaccagagacagaauacaacuucaaaauaacugaaaugauuagagaaaguacugcacccaugaaacacaaacaggaugcuacaaaagaggacacacggaaaacaaaaaacaagcucuaagaaauuaacaauucaauagguggaaucagaccccaacagaaggguuagaaggcaagguuaaugugaucucaggcaaaacgaagccacagaaaaagacaauaaacuuagagaaucgagucagaaggaguaauagccaaauaacaggaguuucagaaguaaagaccaggaaaaauuuuaaaaaaaaauuaccaggaugggcacaguggcucacuccuguaaucacagcacuuugggaggccaaggugggcagauugcuugaguccaggagcuugaggcuggccugggaaacauggcgauacccccaucucuaccaaaaauaccaaaauuagccaggcaugguggcacauaccuguagucccagcuaccugggaggcugaagcaggagaaucauuugaaccugggaggcggagguugcagugagccaacauugugcuacuguaccugggugacagagcgagacuccauuaaaaaaaaaaaaaaagacagugaagagaggagagggaugaguuaaaaaagaaagaaauuaccagaggaagaaaauauaagacacacucuggacuagaaggucagaacuucccacacugaaauauacacaagccucuagcuuaauaaaacaaaacaaauccacaccaaggcauaucuucaugaaauuuuagaacucaagggauaaagagaagcuccugaaaguuuucggaaggaaaauucaguuuauuugcaaaggaucaggaaucagacccuugcauaugaacuucucaauaccaaugauaaaguuaaaaaaugaacaccaccuucaaaauuccaaggaaaauuaggucccaucuaacauucuacagccaguccagcuccuggucaagagugugcacaggacaggcauccugagacaggcaaggccacaaaaccuuuccucccugugcauuucucaagagguuucaccaagugaaguaaaccaaaaaccaaaaaacaaaccaaaaaaaaccccacaaaaacaaaaacgaacaaacaaaaaaacaggugggggagaagguggaagagagagagagaaagagagagaggcuucccaggaugauggggaaggucaagcccagauggagagcuaugcagcagguccagaggacagccagagucagucuggaacgugaggacggccagcucugugaguaacauuaccaggaaaaacaaggguagcuggguaggagcaaggagccaggccgaugaaagagcuaaauccuaucugugguguauaaaaccaauagauaauaucuucuaaaacucaagaaguagcaguaaaaaccaguuauuuacaaacacagagguaggcaccggaguauucuggcuagaagagcugaaauggcuuccucugggaacaggacucaggaguaagaagaaauggagcagaaaacucuuuuaguauaagcuuugugguuacauaucugacuuuuugaacuacuguacauacacuauuuugaaaaaacaauuaaagccccucauugccuuuaaaauucccaucuggcccauuuucaaccuucacauauaucagggagcacaguaagauccaaggguaacuauugcaugauagggagagaaauggguaaaucuuauguaaucccccugccccggaaaaaauaacaacaacaaacuacugccccacuaucacaccaaugagaauacagaauaaguuuuaagggucugagagacugcucccaagguccucaggucaagcauuuuacacuucucuuuagguguguuuauacauaaaauucuucauuggaaauaaagauuguuucccuaacuccuaggucaaacuccucagacagggcauccaaugcaggagaguucaugcagggacuaugcgaagauccuuuccaagccuccaaaguuguuacaauucaaacacuugacuuugggggaaauaggauguuucaaccaaaugacugauguguucuaaaauuaggcaaaugcuuuuuucccagccaggaaaaggcuaacaauauaugaaggaaaccagcauggccguugccacccguuuauccaaaauucaaauguguuacucuaaggcuagacuucuaugcaacagcccucuuaccccuccccacccuucaaauuacugcacaguccaccucacagcacccaggacuucucaaauggcugguaagugacagaacaaacaguaaaugcacacuugcacgucuauuccuuuccaucgacaacugaccccugguguggccggggcgcucuccucacccagugggggccacgacagaagggcgaggcugugguccuagaacacaaguuggauguccuuugacauuaccuacaccuguguuucccugcagagucucuguaggagacagagagagagagagauagagaacaagggugaaaugaccccaggaggaaaacuuuacuccccuuuccugcucuggaaaggacagggcuugcauuuacuucagcaacagacacacagugaaggagcucagcgcagggucugaucccaugggcugcaggagacagaaaacgugaauagaagcaagcaaggagaaagaaaaggaugagggaagccuucgggaauucccaccaacugggcucuggccucuccgucccccacucccacucuacuaagaagggaggggcuaaagauuagaaguguccaccuaccuaaccugacccucgaggacgcagcugucacaaugacauauucugcacaucacagugccuagcacaagucaagcagaugaccaaacagugugcaccugacauauauucacagccacuccccuucccuaaaauucuagcgcuggacauuuaacacgacuauaacacgccucagaccaugagaaagaggaagcugaagucuggccacauggaugaugugaaugaggcugacaccuguggcucuagccaucugccccacuuuguagggcuuacaccacccaucuuuggaguggggagaggaugccauggggaauaugguggaagaagcgacaagaugguacaggcagucaaacaaagcaagccaggcagggcccagggaguuaagggguuguucccacagagggcccuggccugacgcugggcuccagcacccuccucuagugugggucgccauagcaucacccaaaaagagcacaaguccauuugcaacaauauucaacuggaccucucucccagaugucgauguuuauauagaaugcugccagguccacuggaguggggcuguuuuccuaaucuuuucucguggagcacaaauaguauucucuucuccaucucggaauggaggccccaagaaacaagaaacccaaggcguucuugcaacacacaucccaccucucccacugcaaguccaugucucucaucacagccucucacccuccccauucuuugcacccucgguuuuuccugagggagagccgcaccaacccugccucuuuaagcagggccgggaggaccgcaagggaugugauguagugaaaagggcacuggaaaagggucggcuguccagccaugguucugggacaaccagccgcaugacccuggacaacacauuccauucagcccccagucacccagcaccuaauacgcacgagagcaucugcugggcugagccuugaggagugucucucuuggucgcucacugcucgcugacaacugcccuguucacaccaauccgggcagggagggaugcugcacggagcaagcggcaucugucucugaagccuacugggagugauaguggggacccugccugcccccugggucucaguuuccucaucugucaaaggugagggcuggacuagaugauguccccaaagacccuccuucccagaccaccccacaccuaccguucucauggccccuucagauacagcuagaacggccucuggguccgcugcugggaccagaauauauggucguccucggugggucucuugcugaaaacccacuggaagucagggccaggcaagcauguccuccauauccaggugcaagucaaaccccacccccuccccaaccgcccccgagaucuucaaaccucagcugucuugggggaugaagccaagaggacuccuggcccuguguuccccuguggccggcacgcuccacagguauuggccaccugacagcguuagggcccaucacuuggcagagguguaaauaccugcuccaguuuauccuggcauagccgagaucuucaaacauuaaccagguaaggcuccaaaaccuucaggcuagggcgugucugggccccagcucacagaaugggaauggagccagaguagcuccacccaccaggucuccaaccuguggcucaacgcaaaacccccagaucgcccagaaaaacccugauuuugggcaaguuacugcucuccucaugcgaccauuuucaggauuaaaugcaaacacagugaggacgcuagcacugugguuugugugugauuucuuuuuaccucuacacugaucacagacgcuugcugguuccaaaaacuguacucaguguccagaggaagugagccuuggacuuuugccccaagacagccacugcacccugcagacagacggccaacaccacugaugaaccccaacaccacugcuucucagcugggcccugggcaucacaaagcauuccccagccaccaggugcaacccuggugggcucagaggaagacaaugacucacugcuuauuagacuuuguggagcagcccaucuaccacccuuccaucgaggcagaggaacagacagaagcccaaaagcaagcauuagcuacaugaggacaggggacggguuggggccguaagacccuucugccccugcgggacaagccugccuuagugcggcugguuggagguaggucacagcugggacugcacaguccuucagagccuuguggcuccagggagucucucuccuccuccaccugcucugucccuguuccuucaccuucgugccccaaggucuuggucugcaacaccaugccugucugcaccucacacgugagaaacacaaaaccagucucaccaacaagacgacccugcucaaggacaaggagucuuuuccgucuccccaccucccccugggguugaaucagugaacaggaggccaggcgucgugucugcugcgcucuacacauugaggggcucagcuuccacgcugacuugagucagggaaaccuucaaagcucugcagugccaggcuccacacugccccaaccggagcaaaagccacuucuccaucgcccccaacugaggacggggcuggcucuuccagguccuuuccagcaaugacauucccugauccugcuucacacugaaaacacaaaugcucuggaaguggggugaugcugauaccuagguggugacuaugucauccaucagggcagucucugguggccccaucuuccuuuccccguuucucacgccuacaccucacaccuagcagcacccccacaaguccuacuuagcccugcugaacuccccagagcucaacaccggagcaucuguaaucccagauacucgaaaggcucagguaggaagaucacuugggcccaggagcucaaggcugcagugagcuaugacugcgccacugcacuccaggauaggugacaaaaaaaaacccaaucucuaaaaaauaaaaaaugaaagaaaaagucauccagauucugaucuaagagggaggcagaggaaaaugugacaaagaggauaaggaaaugugaugacaggagcaagagacuguaguggugacaggaagaggccacgagccaaggaaggcagguggccacuggagccugcaaacaguggagaggggauucucccccgggaccucagaaggaagcugcccugcucacaucuggaccuuagcuaagugguacucauuuuggacucucaaccuccagagccaucagagaacaaagauguguuguuuuaagccacuaaguuuguggcaacuuguuacaguggccacaggaaacaaacacaccugccauguugugugcugugacuggcaccucccacaaaggaagccacccuggaguucgauucugacacacugagggcagguguuugcaagugacugguccgugccugugugugggcuggaccagcccucaggccaguacauggcauaaggugaaggacaccuccuuccuaaggucccugugcugcugaccugcaucucugagaucccaccagugcaacugcuccccggguucagagaguuuuccccaccauaaagaacauuuccuucccggccaaagaaaagauuuuucugaaaaacagucuugcagaggccaggagaggcuaagacacuaacauacuacauugccugccagaaguggugcccuacguggaucagcucaucagacuguuuuuggacaugauauauuuuccaggaaugccccaggcaaaagacauggccaggcagguggggaucucagcagggggcagagcaagggaagccuaaaaggugagaguggaagggaugugccccugggggacuuugcagucuggcuccaugcugccagcccuguuugugcaagugugugagcacugcacaaacacgugaagacacuagcaccagccauguggcuuugcuuuuucaacccuaaauauuuucuguugcaccucccaugaaaugacuuuuuuugacacuucuuuccccgcucuuacuuaauuaguuuccuaaccaacuauuccaagcuuuucacuuucuuaauaucuaaagucauuucucucugugugggagggagacgcccaguacguuaucacgagccuucacgcugcaggguaccgucacagcugcugcagagaaguccacccacagcucugaagauagaccagcaagggugccaaucacagcccaucuuccuggcugccuccccagugcggggugugggccacagaaaccccuuuacccucacgacagcucucgccgcucccaucaccuuccaucacugaaagagcugugcacauggcaaaagucugaacagagagcaccuaaguggauaaccagguggaaccccucuucagccccuugauaaucaauuguggguggccagcagucacuccacucaggcaacacagggaaggcagagagagaauguggguaucucauuauagcccugaacacaggcuggcagcuaauucccauuuuguguccuugacucaccacuuauguaacaggaagguaagcgcacgggacaguccugaugagacagaaaggcacucacugggcaccugaggucaccaaauccucucagugcggccugagauucaaagaagggggacuuuugggaguggccuaccugaaaucuuuacaucagaaacucaagcaagaaagagcuggggaggacagcugccugauucgccagccaaccaacaugugcccugucuacgcaggcagacaccagugcugccuagaggcgcucaccguccuguagagggagauccucguggaaguuaagggcaaggugcuccgcaugcucugacagguguccucggguuaggaacacagggaggacucgcgucuggccagggccaaccugugucuucucuuggcucuccagaaugacccagggugaccugcagagcccucucaguaccugcagaggucccuuccucugauccucuuugccugcucacucuggcacguucugcuccaacuucuucccucuacagggcucagccauccacguaugacuccaacacuggagguacagaacaucuaauacuggaggcacagaacauucaaacugccccacacacuucccucucccucuuuccuucccugaagggcaacucccaggcucuaagucgggacaggagauccagggacccggcugcuuguccacaucugugguucagucacucccucccccucccccuagcuaagcuuccucacuacaaaauggaaggucuggaucaggucacagugggaacccccaacugucacccucaggaguuggcuguuuuugguccacacagucccaugauuaaccuuugcuggcuuccauucccugauucuuucagugugggaaaugucacuugggccucugggcagaggugcaaacaacaagaaagcucccaaaggcagaaccugccccugccuaacaguuccggguccaagagacuuauaagacugggucccaagcccuucccggaccugucauuagcucuucucccccaaccucccaacuaugacaaaaggaagggagggggcuuaaagcucagccuccaguuuccagagaacauccaucuugaagcucccacggagguacagagaaugcuccgaccucuacgugcuccacucaaaugggugaacuuucaugagucaccguaaauuacacuucagggaaaaaaagugggugucacuugucagcaaacagcucugagcuucccuuaugaccccuacccucuacuuucacagcacuuaggaagcguuuccauccuaccuggguucaccugcacccagaccuggcucacucaccuuuaguguuucaaaauaacuuaaaucuggccacagaugcucuaaggcaaaguggccuacaggaagcucagucgagcagggcccucccugccccacuuauuaucccaccaacucccugcugcugaaaagagcaucgcacagacuccaccgcacugguucagaccucaucuuccagccaagaaucuaccuuccuucauuaaggaauucauuguuacaaauaggcaacaucucaauugucaugaccaaaucaagacgggauggggacucaucuaaggcucuguguccugaaaagucaagucggguggagggcagggguaaaaaauccucaacacccuggaagaaccuucucaacacccuuggcuugucuucaauuucuggaaucucguggccaugccagcccugaaagccaauggacugugcuccggacccagccgcuucuccuugugaacacaagccuccgugugccugagaguucaccuauaaacaugggcacugcucauucaccagucaccacuggcaaagagcuugaagacauugacuacuuugggaaaucuuuaaaaaauaaauuuauucauuuggaaaaauuaucaaaugauugcacaagaagaggugccuuuccugaacaggucugugaucugggccucugggcaccuggauaauuccgcagagaaggagguugguccggucuggucaguguguauuccuuuuuguuuugagacagagucucacucugcugcccaggcuggagugcaguggcgugaucucagcucacugcaagcucugccucccgggaucaugccauucuccugccucagccuccagaguagcugggaguacaggcacccgccaccaugccuggcuaauuuuuuuguauuuuuaguagagaugggguuucaccguguuagcuagauggucucgaucuccugaccucgugaucugcucgccucggccucccaaagugcugggauuacaggcgugagccaccacacccagccgucaguguguauucuuuucugcagcugccaggggcagggguuguugaugagggaggggucagaaauauuccaaaacuucaaauaaagcagcaccugacuguauacauuuuaaaacuuguauuaagacuccgugcagaauuccacuuaaagaccgaagucucucaaccaaaagucugaaagcaccuagggaccccgcgggaaugcgaugcauggggagggccugcgggggcuaccucccccauuaacagccccucauaccuugcucguggggcucauguaaagaugaaaacacacccgaguccaaaguuguuuuuuuaaaugaucugauucugaaaacacacagcacagaaauagaaaugagcagcugagcagaggaggaaagaacacagggcuuccugugguccgaauagcccgggaggugccuacacagggagagagggccugggugaccccacaguuacugaccccacuccaacaagcccucccuaagguacuugggcuccacgcaccacacaacaggaccugccuccuuucccuugcgaccaggaccucagcacaaaggccagggcaaggcugaaacaugacagauuuaaagcuaaaccugaaaguauaagacugacccauaaaacaucuuccccgguucccugucuugccccuuccuguccuuuaaacaugaagggccuccaggccuaaggaagcuucucugccucucagacaguuacaggcucuauguucuuauuguucugauuucuguaaaucucucugaauauauauucauaugcccauguagcaaagaaggcagguggacccuacagcguugcaggccugcagcuagcuugguucaauggcauuaauaaagacacaggucagcuacuauaguugggucagucugcagcaacagacaaaccagagggucaggaaggacacugagagcccugccuggccuccagcaagcccuauuuuccacccgcacgaggcagcaggugcugguggagcggccucucugaaugugaaggacaagaucacuuggugaaggaaagacaccaucccucucucagcaggagucugccuugccuacacaucaaggucugucacucauuaguugagccaccucgcaaucucucugggccucagucuuuucaacugugaaauggacaugguaucuaccauugugagaaguaggauagagaaugggcagaaagugccagcaaggagccccggccgggcacauggcuccucccgaaucucugugaugagcgaaaaggcagccaagugccaccugucuccucccagaagacuucucugccuccccaaccacccaccgccuuuaagagccuacacaucaugguucugcuagggauuuagucugcauauguucauguggguccugaaagguaugagcuucaccacagaagaggccuuccauggccuaguguccucucaaccgcucuguuacggacacagcagccacuaugguucccaaagaaucagaugcccgggaggugccucagcaccaaggaggagcagaugguuccucucgccugccugggaaagcuccgagcuagaggaaacaaagucagagcuugaagcagcaguucucaaauggagugguuagaaaucacauggacucugggaggccgaggcgggcggaucacgaggucaggagaucgagaccauccuggcuaacacgaugaaaccguuucuacuaaaaaugcaaaaaauuagccgggcaugguggcgcgggccuguaguuccagcuacucgggaggcugaagcaggagaaucacuugaacccgggagacggagguugcagugagccaagaucacgccacugcacuccagccuggcgacagagugagacuccaucucaaaaacaaacaaacaaacaaaaacaaaaacaacaacaaaaaaacacacaaagugguuauuuaaacugguuucccagccucgcccugcagauucugaugcagggcaacaucugcaaaaaaauggcuuagggagcaaugggaacugggcggucagcugcagaaaagggagagaaaccucaaaugauagauccuaaagacagcagggcucagcgguaaugccccuccuccuaggcucucacaggccuaggcaacguugggcugcucauggcuuuaauaccaccaaaaauugcagaaauuugucaagagugaggugagcagaggucccaagaacaaggcaaccuccuggacacucuccuauaggaagcaaacucaaaauaaaccagaauccuaaccugucugcaccuggagugcucugaagauccuuuggaccaagccuguuuacuuuauacacaaguacacaggcaccccaaauuaauuucucaggcuggaacuucacaucuuacgggacugacaaacucccagguugccccugaaaaaggcacauauccaagagcuagaaguguuuucucuacuauguccgaggaugugagcugagauuaugaguccuuagcacagccccuacacagucaggcagcucucaucucucgugaugcucaaggacucuccaggcuaggauggagcagagcuccacaccauggaggccggcccucagcaccaugccugccacagaagguggccucagucucuccauggcuuccaugugugagaggcuuggggucagcagacaugguccaagaucaucagaccuaccacaaucaggagggaggaaauucugacaccaaccaggaugaucuuucaggaccuuaugcugagugaaauacaccagucacaaaggacaaacacugcaugaucccauuuaugugaggugcuggaggagucaaauucauagagacagagaauagcauggggguuuccaggggcuggggaagggaguuauaguucaaugggugcacaguucaguuagcaaguugaaaaggguccuggagagagaccggugguggugguugugcaacaaugugaauguacuuaaugccacugaacugcacacuuaaaaacgauuaagauggugaauuuccaguguacuuaccacaguuaaaaacauucgaacagaccgggcacgguggcucaugccuguaaucccagcacuuugggaggccgaggcgggcggaucaccugaggucuggaguucaagaccagccuguccagcaugaagaaaccccaucucuacuaaaaauacaaaauuagcugggcaugguggcccaugccuguaaucccagcuacuccggaggcugaggcaggauaaugguuugaaccugggagucggagguugcugugagccgagacugcgccauugcacuccagccugggcaacaagagcgaaacuccgucucaaaaaaaaaaaaaaaaaaaaaaaaaaauuggaaaaagcauuugaucagcuuuuugccuuggagagcaggcccuugagaaucccaaagccucauggccuggccugcuccacccuaaacuccuggcgcucccacucuccuucuagaccuggagcuccucccaagagccuucuagugaugucuggugacauccacaccucagcucgacaucaguccccaaaaacuuggugacagaauuagguaaaaucaugggcagcacuuuacagguggagaaacaaaggcagaggacagaggcagcaaucuggguuucuagauuguugcuuuguccacuccugaaaaaccaggggcccagccaaaucucucaggcuuuuacuugucugugaggcugcccggaccccaccucaccucagccugcauuugagaaauuucuuuuccuuuuucgggaaauuugccucuccuccacacccaccaguuacaggguacguggguguaucgagaaagaaauuucccaaaaaaggaaaagagauuccccaaaguuagccccaucucagggcugccuggagaggcaauggucagcuuccggaacuggaugaaguccagcagccccagccccagcagaaguccccgagcagaaagggcuucccgaagccacuguccccagauccagggacugcugcugccuuccucccucuccugcacgcugugaccuccugauguccaccuuccucuccaggucccaacccaguggggcugagguaaccgaauuuuccccaucccaguuaucuggagcucuugggagguuuucucccuucugcugaguaaucccuaaaggucacuacauugcuaaucucccuccgaggaacaccccuuuuccuaucuucucucuuuuccuacccgcccugucuuaagguuuucaagcugggagcagaaauuacgcagcaaggcauuuacaaaguugguaguucaacuccacacauauuuacagaacaccuggcuagauuugugccgcccaaaccccaugcuagacaauggggagacacaccaagaauuaucacgggcccaacaacaacaagaagucagucuaguuggcaagauaacacucaagcaaaugaaaucaaaugguaacaucauauaagucaguaacaauucgaaauagaugcugauugaguguggagggcacagaccagccauaaaaugcuauaguuuauuauaugagccugggagggucagagguagccacgggcugcuuagagcugcugcuuuuggagacaaaugcccagguagggauugcuuugcaacaucacggucugagggcaccacguagggagugccaccuaugugcucccugguacacacacacacaagcaguucugcaggcccugugguugccuggugugcaggggaaccccguagaccucucuagaucagaaacaggcccaccccauucuacgacuggcacugcaccaucaucccccucacuccaggaaaucugacaggugagucccgugcuguuuaagagcagagcuaauagcaaaucacauuuacauuuucauuuuuaaaaauaaauaagaauuuaaauaaaccccugucgaaacugcucaguuucuuggccuuggcacuguugacauuuugggcuggagccuuccuuguucugggggcuguucugugaaggagauucaguagcaucccuggccuccacccacuagaugccagcagcauuccugccccaggugugacaaucaaggaugacuccagacauggccaguggcccugggaggcaugacgcugaggaccacuggucuauuuccaggcacucacaaaggaagcuuccagcuuggcuggaguuuacccacacauaagccuaucugaaauggaguuuuccugcuccaggucucaggauccugccagccuguuuggggugggacucucagcucagggcgguugaccguuaagcuggagcuccugggcuacaggcugucugcucacucuggggaguggcucugaggagcaaacccugaugcagagcacugggugcuagagaaaucucuccagccucugccuccucccaccuggcuucuacccuaagugccuccuugcaaccuuccccugugaccuuccugauacaacagggaaaccccuccacagccucggcugggcaaagcaguauuuacugaugggcucacugggucaguuucuccagcucccaggucaucugccagaaagcagcccguggcccaaaacucccagcucugggccugcccccaugcccucucucaguccaaguuuucccugggacuucuuucuuuccccacaucccuggcacagucccaccucugccugagcacuccaugaaauaauacgcaacucauauccagguugcugggagaccacagugcacugugaagugucggugcuccuggcuaagcggccucaauuauccagaagccgugccugggaggcagcaugugcucugcacuugugccagcaccaaggcguccccagaagcuacccucuuugugcuugugcaacugagccagagggaauaauggauuuugcuggacuuuaguuagaccuaaagaaagauuuccugacugaaauuaucaguccccaaggaaacagugcagggaacuuuguuuuuuugggaugguucaugacccagcccagccugaauguaauccagugaccucuugaggcuccucugauacuguuaagucaauugcaggacucagccagucagucagccacagggaggcaagauaaaccucacagcugcaggagcccagcucugaccccagggcuacucccuguguaagggcuaagccaggagaacacgaagugugaagucuaauccuccaggucugcuuucuugccucaaaggaacggaguguccaaaugcuuugucucccugcuccuacuuccagccaaguccacaaucggugcucaccuccaguacacuacccuggagcacagacguucccauagcaaaaacccccuaugcucuaaucaugauguacaaauaugcucaccggaaagaaugaaaaggaagacaauucuuuuuaaguaggaaccagugaggugacaguugauacaggauuaugguaccauccucuuaauucaccccagaaacaaaaguagaaaacauaucacaucacaaagguuaggacucgaguacaaacacgcccacuucugaccuuugcacaugugagcuguaaugaccacccaaaaaucccaggcacccccgccacccccugccgcagucuggaagguaccucuagggacaguuaucuccacucauacuuccagagucugucucgccccugcagcaaagaaacaaacucuggguaggauaggcaggggcugccuauuuuacauagugagacuaggcuuuccaggacagucccaauuuuaaaaugcugcacauaugggcacacaaacauucacccaccaaguggaacuggaaaaggcgaucaaaucucgcaucuucaacccuuuacaaaguuuggaaugcaguccuacuuuagauuaauuaggagagacuaaucuccuuuagagaaaaagucaggagauaaaauggguggaaaaagaaaagccagaaauuccaccuaguugauuuucagguuuggccucuggggcaacagcagcaaacacucauccagcccaggaagcaacuggaaaaccagggagguggggaggaggaagaagccugucugccugguuuagugaccagaagaacgaugaccuugugaccaggaggccucugaagucagcucggaaaacuaagccaagcucaaaugagacaagcaaaaccaauuacagucgcagaauugacaggcaaccccaggacuaggugcgugagcacaugugccagccccagggccagccccugccccacgcccacagguccacagccugcacacgugauccaggacuuugcccuugcuuuccccuaaccaggagugcuccagugaaguccacacuauuagccuucaacagaaaugacuuccucccucacuucuuccucucacucaagaccacagaagaugauguuucaaaccaaaggucuggguuuuuaaagcugucuccagcaggugccacaaguucuucaaaacauuccacacucccaaacagacacaagcaggagcacauggcugcugugcucucacaugacaacgcaagggcacuguaauggagggacuuggugaaggcuggggacagggagugggcaaggauaacacuuaccaucucauccagggcguagcgcaagaggccgugcucguaaaggaugaagaaccgucgcugccauuucugcaacggagcacaaggugggugguuaggaggaucuggguccuggccccagagcuuggcuucuggaguucccacgucugacaaguccauaucuaaggaaggucacuccacagauuccacuucuggggcagguggcaggaaaagagggacccgaggcacaagaauguugauucaucagccaggacugggcugggagacaggcccaaaucacaugagugauugaggcuuaauaagaagucuuuuuuuuuuuuuuuuuuuaacacuuggaagcuccucaggagcagaaacaacgugugguuaccuuuuuguauuccugauggugcucagcauagaaugcaucacaugacaugugucaauauuuauuugaugaaugaucugacaugacauggaauaauccaggaaugccaaggcauggauucaccacuucugaaaaaaccugggaaacugcuacaaaagggguuguucugaugauccacuggcaaagaggaggcacaaaaacagccaggcuccagaauucacugaggugaaaugaguuaaugaaaaucaaaacagaggagcagcaagaccaguggaaauaacuccaauauccaaggagugaccaacuggcacagaucaucccccgcucuacucucccuccaaaagccagaccacugggaaguguccacggcggucagaugccaucaggagcugaaaugaaauggacuaugcgguguaugucuuccuuuguguggggagaagggacuuguccauaaugcgagucugcuggcccaggucaugaaugacaggcacagcucccagccccaaaucaucacaaggguccaugaccuauuuucaacauuucaacaagcccaauccagccugggcagcauggugaaaccccgucucuacaaaaaauacaaaaauuagcuaggcauggugaugcacgccuguagccccagcuacucaggaggcugagguaagaggaucacaugaaccugggaggucaagacugcacugaaucgagaucaugccacugcacuccagccugggugacagagcaagacucuguuucaaaaaaaaaaaaaaaaaaaaaaagcaaagagcccaacaauacucagaguuuaacuggcagugaggccacgugaacugacuauaaaagcacaucucucugcuuugggccaggguuaucauuuauaaaaagacuccugucagaggcuggaaauggcaauuuuguacaaccuugauauaaaauaggaaagggaacuacucccuggaaacugcagcccagcuggaccagugaugccugaguucuccugucuggguggcaugaacagggacucaaagggccuugcaaagaggccuuguagagggcuggucuaugcuggguguguagaggaggccaccugaacauguuucccaggaacauuuccaagggccuuaugugcagccucugaaaucaaaacccauucuagaagcaaucccaaagaacagagacacaaugcaaggccugugggaccagaauacacagcccaaggccccuacuccaaaguguaauauucaggguggggaaaggaugagcagcagaaacuaagaagaagaggaaagggagcucccggggauggagggggcugaguggaagcaauuuauagggugcaagcggcagcacuguaagaaaguuugugaggaaggagaguuuuguaaccggagucaaauccagaggggcuuccuggcagagaaacaaaccacaggucaggccaaugauggucccagcucuagcggggcccugcccugggcaaugcacauuuuaguaagagguaagccaaggccucugggcccccaacccuucacuagugcuagugugcugaaccccuggcucaggaagaagggaggugcuacaggggcaggccuuggcauggaaggaauugggagcugcucgguauaaugcaaaccuuuaacugcucuuuugccucuuccauuuuacuguuccuagagucaaccugacccacaaaacaggcaacacccacaugagagcuccucauucugaagggagcacuacacacaacuauguauaauugagaccuuuucuguacaacguacaagugcaccaaaugggggagcccugcugguccugcuaucccaggauccacuguucaacucuccaucucccucuuccacucugccaguucacccuuagaugggucccuucucugguuccucccugagaguuggcucugaugcccuuacccgagaccggugcacuggguugucaaagucggucccaucuggagccaggagcagccaaccgccauaaauggguuuugccuagaggagaaaaaagagggcaggucaccagcagccuucaacccagaagagagaacaggucaaguuaacagcaagcacucgcuggaaacagauguugccucugcucugcagaggucaugacaccuauuuccacugcggugcgucugcagcugcuugagagucagaggcuggcggggauucugcagcauccgggguggagagcauacaggcccuggcaggagugugagaaccuggagaguacaggauccccuaagacaugcugucuccugcaaguuacugaucaagccaccaagaucaggaaaaaaugacauguuauucaacaaauaugugagugucagugugugccaggcgccaggaaauaggacaugaacaacacagucaaaaagcuucauccugaagauacaaaacagggccuggagaagagacugcuuucgugaucaaagccagcucuggccaaagaaucaucaacugacuggcugugugacugcgugcagaaacucuuugaguucaaacucucccauuugaaaagugagagugaugacaauucuaccuaaaccucaugacucugaugugaggacugaugagauaaugcaaucaguaaaacccagcacagggauguaaaacggugcugccaccuuggaaaagucuggcaguuccucagaaaguuaaaggcagaguuacccuagggcccagcaauuucaccccuauguauacacacccaagaaaacggaaaacaggggcucaaauaaauaccugcacaugaauguucauagcaguauuauucacaccugccaaaaggugguaacagcccaaauauccauggacagaugaauagaugaacaaagugugauggguccacacaagggaacauuauucagccagaaaaaggaaugaagcacuaacauacaccacaacaccgaggaaccccgaaaacaugaugcuaagucaaagaagccaggcacaaaagcccacauauuacagaauuccacuuaugcaaaugguccagaauaggcaaauccacagcacagaaagcagauuaguggucgccagggacuggaggaaaggaaauaaggagagacagcuaacagguaugggguuucuuucgugggugacuaaaauauucuagaauuagacaguggagaugguugcacaacauuguaaauaugcuaaaacucaccaaacuguauacuuuaagagagugaaucuuaagauaugugaauuauagcucaacuuaaaaagcugcacaaagaacacugagcacagugucuggccugugaggucucaacaaaugugaggcacugcuauauuuuaccagccacagaguccccacuccccagaccacgggaggagcucaacaaggggaaucuagacagacacucuggcucaaucuccuuccucagccacacccagcuggcgagaaugcauuggaaaagguacaaccagucccauuuauccagugccuuucggagggcgguaacacaaauuaaaacccaaguucucugacugcugcuuacacacacaggaccccucauggguccuccugaugugcuuuuuauucagugcucuccaaacuaggaggccccaccacacuaccucauuugguagcugcagaccgugacucagagagggcaggccacgugccagaggccacacagccuccaggcugaaccaagaaccccccuuuacuuggcuuccgccugcaggguccucaagguccccaggagcacuggcuuuccccaugaauggugcaaguggagcugugugccuggggucgggggaaagcugcaaggacaggagaggcuugcuuugcugcaacaggggaguggguguuggcugcagacauaguccaggagggccaaggaguaugugguggaaaucccaccugggaaggcagaagcaaaggcgaggagaggucugugcucucuacgaacuccagcugugcccagcaaaccucaaggugggcacacacgcucggccucuccacaccccacccaggagugcacauccuaagcagaccccacccagaggccuugcaugggaaagccggagcuggacaacucccuguguguaucuggacucugugacucccagcucggccucucaccggccacaagugcccaccugugaggccagaggcuagccugccaagccauuccucuaucuccaucuugacuaugcgccaccacccuggccucuggaggcagggcuuggggugucaucacauaaucagcuacauuuaccugaccuuucuccaggaggaacuguggggagccaagggaucagcaucuguucccucagaacccgagcccuggucucaacccaggcaucgucagcaaaccucugcucaggaaccccgugugcauggcccugggugcuguauaccagggagccugcagcagccacuuugcuuggcugugacuuccugauauggaucaccacagaggggacugaugcaggugggcgggcggcgcagacacagagcagagagcgagauguagggccucuggguggaggagcaggcugggaugcaggugacaccccacccagcguucaucaaagcaauuccagagugauagagagcagaggaguggcugccuggggcugggacggcggaagggguuggugacagccaagaggugcaggguuucuuuuggcgaugauguaauguucuaaaagugacugugaugauggcugcacaucaguuggaauauccuaaaaaucauagaauuguaucauuuaaauggguuaaacguaugacgugugaauuuuaucuuaauaaagcuauuaaaaaaaagcccugaagguaaggaccccauagauaacagggggaggccugggguggagaggacucucugggcaggggcgcagcugaugcacaggugcagaggcaggaaugauggcgccauggggccaugaggagccaucuguaauuacugagaacucacuccucaaguccagggagccagggacaggaacuggccagcuauaucaccaccacucuugccucucacagccagccacgugggcugcgcagccucccccagccuccucagcuccccaaaaccuggcccucucuaccaucccucagggcuuccccgaaaugucccuuccucaaggggacaguccugacccucccccucagucucuaacaacucacuucugccauuaccgucacugcacaucacagaacuaauuucuaccuaccauuucauuauguacguaauuacauugcuaugacaugucuugccccccacccccaccccagaaccuucgcuccaggaaggcagggauggggucugccuagcccuggcuguguccuugauccugaggcaggugugcagagggaguggaggugagugcccaccggccuaggccagcaguggguggguggugcccucucugaguuaccuucuccuuacauaaccuagguccugacucagacaaccuguccucauccccaaggcgugggaaaggccucccaggaagagcugcugcuucucuaugucucagacuaucuaaaacugcugcauccucccccgcacagcagaccacagugucuuuaagugcagcaaugcccacgggcagaggcucccacgcacgcccaccugguccuggggcagcaccucuaaaaggcccuaaaguauucucuuccagacgguccuauaauaaucugaaacugggacacuaaaacagacagcccaaaaggcagcaggcaggagggagugugcucuggaaaugcugcguggguaggcuuagcuuugcuguuuucugguugagcugcugggcauuuuggagggaggcaggagaagcagguaucuguuguugacaugggggaucugagcugggcuguaaggacccaaaggauggggcccgaguccuguuucaagcagcccugcacacagggccccuuucuaugcagguccucccagaggaugcauguggcuccggaucccauauaaaagugaccacaugagagacucccccgagcuaccuccucuccaauuaaacucggccuucacucaugacccacacaagucggaggcuccacuucuggcuggccucuaggaagaggcugcugguggucugggugugccuucaaccugaagcucuuucaaaaacagugccuugaaacuucugcuuccuggacgauggggcagauguagauuucuccugcuaaguacaaccaaaaaccuggggccaucauguauaagacaaacaugagaagacucugaaagguggagaaaaaaagguaagugggccagggacccaggauccaaggaaggacaccguggugacucucccaggcuuucuuuuugucucacuaucccagaguggguacuggagaaacuggcaaccugaaaacgccaaugggcacacaaccaaaaaaaacaacaacaaaaagcuacuuuccauagcugaagaaccagaaaggagcagcccaacaagacagaaaacucuuagacaagaaccgccuuacucuggccaaaagucacaggaaaggcagcaccccacccccaagugagcaaagguuggacuuccacccuugugaggugccccacaccccggccaggguggugucagaagacacaagggccuuacaucccaccaacagcaacgaggacccuucuugcuccaugcuagggugugucagagggcgcccagaggagggucaggguuuuuaccauugcccagugggaagggaacccaugaugaggagccucccaguucaggcaucaguggaggccgagggauggacuucugucuccaucuaaguaaccagguggucauggugacucccuucccccacggaagcacugucagaaaaauccacugaaagagaagguucaaaugagacccagagucacccaacagaauacaaaaacacuugguuuccaccaaaaaucaucaucauaccaagaaccaggaaggucacaaacugaaugaacaaagacaaccaagaaaugccaacaccaagaugacagccaugcuagaauuaucccacauuuaaagauuuuaaagcacccaugauaaaaugcuucaacaagaaauuaugagcacacuugaauuaaagggaaagacagcaaagaaauagaagcuguaagaaccaaacaaaaauccugaaauugaaaaauacgguaacugaaauaaaagcucccgggugggcuuaagagcagaaggauugggggcaaugaaagaaucagugaacuggaacacagaacaacagaaaucaucccaucuaauaacagaggaaaaacagacaggaaaaaaugaauaaauaaaagggaacuguggaacuguaacaagaagucuaacauucaugucaucagagucucugcaggauaggaggaagggugaagcggaaaaagggcucaaagaauggcuagaaaccucccaaauuuggcaaaaguggcaaccuacacauucaagaaguuuagugaacaucaaaggauaaacccaaagaaauccagaccaagacauacaauaacuaaacuaaagaaaaaccuaaaagacaaagaaagccagagaaaaaaaaucucaaaagcagccagagaaaaauaagaccuuauaguuuugagaaaacuaagcagaaugacaauagauuucuuaucaggaaccauggagaccagaaggaaguggcacacuacuuuucuggugcugaaagaaaacaccugucaaccuagaauccuauaaccaguaaaaauauccuucaggaaugaaagggaaauccagaccuucucagaugaaggaaaacuaagagaaguuuuuugcugacuuaccccuagcaaaauggccaaaggaaguuuucuaaacaaaaaggaaaucauagaagaaggaauccuggaacaucugaaaggaagaaagaacacaguaaaauaaagggagggaggggguaaauaauuaggcuuuccuucucuugaguuuucuguuucgugacuaaagcaaaaacugucuaaugugguucuaaacguaugugaaguaaacacuuaagacaauuauacaaggaaaagguaaaggagugaacagacagguacucucuugaacugguaaaaugacaccaccaagagacugugacaaguuaugucuauauaaagucacgucuuauuauaaccaguaaaaaauauauacaaagagauacacuuaaaaaacuauauuuugauauauaaaucaaaauacaauucuaaagaaaauguucaaguaacccaaaggaagcaggaaaaaaaaaaaagcaaaacaaaacagaaauaauaaccagagacgcauuaacuaugcccuaaguuauccguaaauauuuuaaauguaaaugaucuaaauacaccaauuaaaagauugauagaguagauuuuuaaaauaauucaacuguacacugucuacaaaaaauucacugcaaauauaaugaugacaggcagguugaaaagaaaaaacuaaaagugauacauccugaaaauauuaaucuaaggagagcagaguuguuauguuaucagauaaauuauauuucagcacaaagaaaaugaccagagacaaagaggaauauuauauaaugauaaaagggucaauucacugagacauagugagccuaaauguucaugcaccuuuaaacaucagagcugcaaaauuaugugaaguuaaaacuaauagaacuaaaaggaaaaauaaauaaauccacaaauauuguuggagacuucaacaucccucucaauaacacaauuaaagcaguccuaggagggaacuaacguaacuaugaugcucacauuagaaaagaggaaaggucucaaauaaauaaucuaagcuucuaucucaagaaccuagaaaaauaaguacaaaauauaucaaaagcaagaaaaagaaggaaauaauaaaagauaaaaguagaaaucgggcugggcgcaguggcucacaccuguaaucccagcacuaugggauuacagaccgaggcaagcagaucacaaggucaggaguuugagaccagccuggccaacacagugaaaccccaucucuacuaaaaauacaaaaauuagcugggugugguggcacacaccuguagucccagcuacucaggaggcugaggcaggagaauugccugaaaccgggaggcggagguugcagugagccaagacuguaacacugcacuccagcaugggcaacagagugagacuucgucucaaaaagaaaaaaaaaaaaagauaaagguagaaaucaaugaaaaaaucagugaaacaaagagcugguucuuugaacagacugauaaaacugaucaacuucagccaggcgcggugguucaugccuguaauuccagcacuuugggaggccgaggugggcagaucaccugaggucaggaguucgagaccagccugaccaacaugaagaaaccccgucucuacuaaaaauauaaaauuagccgggcguaguggagcaugccuguaaucccagcuacucuggaggcugaggcagcagaaucgcuugaaccugggaggcagagguugcagugagccgagaucgcuccacugcauuccagccugggcaacaagagcgaaacuucaucucaaaaaacaaaaaacaaaacaaaaaaacacugcugacaagaccaaaaaagaaaaaaaaagacauaauggcacaaauuguuaucagaaauaaaacagggauagcaucacagauucugcagacaucaaagggauaaugaggaauacuaauacaauucuaccaacacuaauuugacaacauauaggaaauggacccacuucucuaaaaaacacauaauuuaaaugauuauauaacuauuaaggaaauugaauauguaauuccauaacucacaaaaaagaaaucuccaagcccagaugguuuuacuggagauuucuaacaaguguuuaaggaacugacacuaauucuauauaauuguuaaaaaaaaaaaaaaaaaaaaaaaaggaagaagaagaagaagaagaaacacuuuccaauucauuuuaugaagcugguguuacccugacaccaaaaccaaacaaauuacaugacaaaaccccaaaauuuuuuaaaaaugaaauaaagaacuauggacuaauauuccucauuaauacacaguaguuccccccuccuccauccacaguuccacgguuucccuuacccacggucaaccacagccuuaaaauauuaaauggaaaauuccugaaauaauuuacagguuuuaaacugcaugccauucugaguagugugaugaaaucuugcaucguccugcuccaucuucccaggauguggagccuccccuuuguccagcgcauccacgcuguauacucuaccugccccuuagucacuuaguagcugucaguuaucagauggacuguggugguguugcagugcuugugcauccagcuaguauuauacauaauggccccaaagcacaagaguagugaugacagcaauuugaauaugccaaagagaagccauaaagugcuuccuuuaagggaaaugguaaaaguuuucaauuuaagaaaaaaaaucauaugcugagguugcuaagauguacaguaagaauaaaucuucuaucgcugaaauugagaaagaaaaagaaauucaugcuaauuuuucuaucacaccucgaacugcaaauguuacagcccuugugcgugaugaagugcccagguaagauagaaaaaguauuuauggcugggugugguggcucacaccuguaauuccagcauuugggaggcugaagcaggaggauggcaugaagccaggaguuugagaccagccugggaacuacaagacccuguuucuaccaaaaaaaaauuauuaauagcuaggugugguggcaagugcuggcagaggcccagcuacgugggaggcugaggcaugaggaucacuugagcccaggaauucaagguugcagugagcuaugcuuuuaccacuacacuccggccugggcaacagggcagggcaagacacugucucaaaaaaaaaaaaaaaaaaaaaaaaaaaaaaaaaaaaaaaaaaaaaagaugaaaaaaguaucuguggguuugacaugaggggauaucuagguuguuuccaaucaaaaaugaguuccaacugaaagcaaucagguucaguacuauccgugguuugaggaauccacuggggcuguuggaauguaucucuugcaaauaaagggggacugcuauagaugcaaaaaucaacaaaauauuaguaaauagaauucagcaauauauuuauagaauuauaaaccaugaccaaggggguuuauuccagggaugccgguuuaauauucaaaaaucaaccaauguaauccaccaaauuaaugcucuacagaagaaaagccacaugguccuaucaacugaugcagaaaaagcauuugacaaaauccaacauccauucauaauuauuuuuaaaaaccucucagaaaguaggaauagaggggaacuugcucaauuucauaaaagcaucucuaaauaaccuccagcuagcauuacacauaauggggaaaugcugauugcuuucccucuaauaucaggaacuaggcaaugauggccaucucagaauucuuauucaacauagugcgcgaauuucuagcuagugcaguaaggcaggaaaaggaaauaaaaggcauauagaucaaaacugacaaaauaaaauauucacagaugacauagcugucuguauagaaaaucccagaaucuacaaaaaacuccuagaacuagugaguucaacaaaguuucaggauacaggaucagcauacaaaaaucaauuguaucucuauaugcuagcaacggacacguggacaucaaaauuaaaauacaauaccacuuaaaauugcuucaaaaaaaagaaauacuuagguguauauaccacacaauauguacaggaaaugcugaacacuacacaacacugaugagagaaaucaaagaagaucuaaauaagagagacauaauguguucguggacugcaagauucuaagaugucuauucucacccaacugauauucaguuuaacacaauucccaucaaaaucccagcaagacuuuuuauagauauggacaagauuauucuaaaauuuacauggaaaggcaaaugaacuagaauauuuuuaauuuaaaaaaaaaagaggguauaaucuauuuacccaaucacaagacuuauuauauauccacaguaaugaagacugugugguauugguggaaagucagacacauggaucaauggaacaguaguuaguaauaaaccaacacaaauaugcccaauuuugacaaaggugcagaaagaauucaauggaggaaauacagucuuucaacaaauggugcuagagugacccuucguccacaggcaaaaaaaaaaaaaaaaaaaucaucucaagcugauacagaaaguaguguuauacaaaaaacaagacaaaaugaaacauauuuaaauggauaaacuggacuucauuaaaauuaaaaacuuuugcucugcacaaaguccuaaggaagaugaaaagauaagccacgaaguaggauaaaauauuuugcaaauguccuuuugcaaaggacuaauaucuagacuauauacuaguauuuagacuauauaaagacccucaaacucaauagugaaaacacaaaacaauccaauuagaauaugagcaaaagacacgagaagacuuucuacagaagauaaauagcaugaagagguguucaugcuauuuaugaacaucuuauuuuauaauggcuaaaaaaaacaaauggugacaacaccaaaugcuggcaacgucacaaaguaaguauaucuaucacucauacacugcuggugugagacaguuuggcaguuuuuaaaaaaacuaaacaugcaacuaccuacaaccuaggaacugcacuccuggauauuuauuccagggaaugaaaacauacacucacacaaaaacuacaugugaaugguuauagcagcuuuguucguagcagaccaaaacuggaaacagccuagguguccccucuuaccauggaaugcgagucagcaauaaaaaggagcaaacuacugauccaagcaacaaccuggaugaauagccagagaauucuaggugaaaaaagccaaucucaaagguuccagguuguaugauuuucuucacauaacauucuugaaaugucagauuuauggaaauggagcaggauuccuggguggcugggguuggguugaugugggagggagaaggcgauggagacacugggugcuuucugcauuguagucaguaucccagccguggugccguaccacaguguugcagaaggucaccaucggaggaccugggcaaagggguacaugggaucucuguuauuuguuacaaccacaggggaaacacgauuaucucaacguaaguaguuuaauaaaaaaggaaaaacaguggcacgcaccuguagucccagcuacuugggacgccgaggcaggagaaucgcuucaacccaggaagcggagguugcagugagccgagauugcgccacugcaccccagccugggcaacagagauagacuccaucucaaaaaaaaaaaaacaaaacaaaaaaaaccgaaaaacaaaacucagccacuguggccucugcagucaguccucaggggucuacaggguauggccacgggccuucuucagugacgccugccugccauggcccugagcugcaccgcguaugcucugcuggccucuccaacuacuucccuggaggccacccacaucccuucucucaaggguucuucugucccuuccccucaccacccuccccaggcaaaucugggaugcaugccaggaugaacccagcugucucaacucuggguugcccaacugccccaagcggguggccaggggcaagggacagagaaacaucucagccuacuauacccaguguugucaagcugccaccacugaugcgucucagacgugcacaggucucuggacacagccaccccaucacaaccagcccacacaacaugcuuggcucucacuccguguggccuguuuguggcuccaagagaagggaacagucggugacaagaucucuaacggugguuaacccagguuuccuguccccuuggacucaccuguccuuagacugcaguggguggggagaaagguagucagacauauugcgcaauccggcaccaaagagggcaggccucaaacagucgaugcagacaggugggucucacucuucucaccccaucacauccugccacccagaaggcccucuauggucccaugcccccucaccucccauacacaaacaucuucuauuccauggaauaaggagauucacugucucauacacagaccccucaaaaucccacaccuccuucaagaacacuaaccggcuccaggccaaauguauuccuucucucucacaacaccacaucuccucgcuggggacaagaauccugccucauccagugaagcacccaguacaaaguugggcuccaaugaccaaauaaauaaacacaagucuacagguacacuuauuagucacccccacccagcugaaaagguaacugcucccuaacagcucugagugcugcuggaaggcccucccagccaagaccugggcaagccaggcugcacugcaccucugccucccacaccugagcucccaggucacuaggacaacgcuggucagcacccaggagugagggacgaucagcacugaggcgcaaguagacacaagccagggccugcccccgcacauggcugaauccaacuuguacuucuccuuucucgaguccaagucuccaguugugccacugugugcacuaugccaccaaggacaagagacaggguguggacaaagcuggcacucagacagcagcacacggccacaugcaagagccacgaugcuuccacacuccugauacagugagcccauguccagagccugggccugaagaacucacaaagagagaagcaaacagucucauuccugaugugggaagagcucaacacccaacagagaaacaguuucgagagugacuauacaucuacucccuaacacgcuaccuggccauuaauuaccagcgaggacaaggauucaagaugcccuccagggcaccgcccacacuaucaacgcagcuggccuguccugcgcaggccuucauggcuccgcugcucuguccgcuggugaacggcacccccuggaagugugcaacagaauuucuccagcagcugcccugaagcuggcaccacucaaggcccugcagauaaaaacaugaagcacacacaucucccaaggggcucguggucaguucuguuuauaacacauguaaggauggacaaagauugagaguugaugagaaaacagcuauuaugcggacugccaagaucagcagcagguuugggggcuuuugcuugauuuuaccauuuuuguaauguaaaugccacuacauggcacuuaccaguuauuauuuaagggaggggaagaugccugccugaccgagcacgcaggacuucugauauaacccuggcagaguggcuucaauaggggagaucuuggucauuccuggcagaacaagaaguagguguaguuagggaaccccuacacucuacuguccaccaacaggaccucacagcuccagguauuuaauguacacuggccugggaacgagaaggccaauucaagucuuggcuccaccaccuacucgauguguggcccagggcaaggcaguaucucugugauucucaguuucauaaucuacaguagaaaaauacacauacuccuuccaugccauuuuuuauuaaaaaaaaaaaaugaucaugucagacacaagcauacccuagguaacugcacaaucaagaaugccucaaggucaggaacauacacccaacacuuguacugguacucaaaccaaagcaguguucacgggagugcuccacaguggaaggagccagugggagccccagaacagcaccggucaguccaagggcugcugggcuccugcuucugaggguggggcaggcacccaaacccuacgcuggcucccucacaccaggcuccaccccagacuccaagcagaguggucauccccaggaaaguucuucaaaaggaaaaguuccacacaguccugaagaaggacccacaccuguaggggcugaugccccaacucugggcagauucuuggggcaaagacuucucuggaccaaaggugggggugggggcugcacucaggcacuggaugggacagauggccccucacuggagucacugaaagauccauaagcagaaugcgugcaaaccguggcuaauauauccucuguaguuuucagguugauucuugcccuuuucuuuuucccaaaaaggugucuguggaaacacuuccacacucacagcaaauaggcuguuuaauaauguucucugcauuucaauuccaaagagaaaggauaccuggguagcagccgucuggcccucuuucuaagcuuguaaaucaugggagacuucaagguuguccgucuuuucugggacauucugauguaagucaguaaaagucaggggugagcacacagcaaaguccagucucaagccucaccccugccaagaccuuguguguccuguggccacccagauggacugcaagaggaucaguggcucugaaucucagcacuuggggagggaagcuucuuggcggagcugugcccaccugccucacccacaguggguucucagcacacaccucugaccaugcucagaaugggggcuucucuuucagaacaagccugccagggccgacgaacacuggucaccacugcagaccccucaagaggccacaggcuuguccuguguugaccaaacugugcuagaacuacuaaaaguuguccauggggccuugaguccuggagaauacuguucuauugcucuacagccacacaguuguggacccaaacuaccuuccucaauauaggcuuccacaaacagccagccacugugcagauacuaaagauggagcuacagcccccgcaaguguuucaacaucaucaggacccagagcccugucccgggaggaagccaagccuccgagggagaacaccugcucaccagcugccaggaaugcauucugcagggaggacauacaucccagcuaugggagcacgagggcaggucugcacuccuccccgcuggcaguggagcugaccccagggcuuagggcauaugagcucucaugaccuccauuuuauaccccaggaaaccgaggcacacagagacucaguggucuguccaaguaaauagagccaggaagcaguggaagcaaaacaggcaccaaggccaccugguuccacacuggcccuggcccaugggacacuccuccccaguuuagcaggccauuccagaagguaaagggugacacaggugaagggcauguucccaagugagaugugcucccagggguaggggucugguccucaccagcacagcacucaguucugccccacauccaugcagcuggggccacggcccugggaggcugcaagugggggcuuagggacccgguggggccccaaagcacauugcccaugaggcacacauggaaggaagagcccuacagccuuuacuuccagaugagccagccacagaccacccuccugcagcacacacccagccuggccaucugcgcaggaggucaggaagcuggcggagauugggggcuguccuccagaaggacucuuuccuaccugugcaaagacaucaaggcugggugcaggcuaccaccuccacccaccccaggaaaagcugggccaauaagccaccuacuucagagccucaucaguaaggugcucaacguaauuuauugucuuaauugggaguacuuggggaaggaaaagggauucugcuaauuaugccaggacugcuggucccagaacucagaacagccaugcccacccgggacccugcagacugcaauuggcucaccucccaacugggccacuccccauccccacauucugcugcucucuauggaggcaggucagggaugccccugaugucuaccagccucugcaaggccacugaugcaaaguucgcaaagccucugggaauaccaacaaggagacgaagacacgaaagguggugcaaagggaaaggaacucagcaccaugccagggagcaaaggggaggagugugggagacuucccugggagggggcaaaugacagacuucagaaauggaagucaggggacaccgucugugggaagcugacacagccacagccgagcaggccccaaggcagcggcgcagccuggaacagugaacugcacugccccuccuauagaggccggcaugcuccucaagcccauggcccaacuuaagcucgaccaguggucugcaaaggugggagucccugaggcccuuuuuggggucccugagucaaaaccauuuuaauaaaaauacuaaaacauccuuugccuccucucucacucuuucaugaguguacaguagagcugcccaaaggcuacacaggacaugcuauggccacagacuguagaagcucugagaacccagcugucuuucauuauggcagaccguaaagagcucugcaaagaguuaaaaaugugaggcuuuucagcaaauuuuugucuuagaaaaguuauuuuucagaauauauguuacgugacuacauaauaggcuuauuguuacuuuuaagugaauucaugaauaaacuuuuucaguuuuaacuucuaauacaagaaauaccaauggacauaacccagguaaacuaaagcguucugagggccucaauaaucaagagcauaaaggggucuggaacccaaaaaguuugagaacugcugaccuagccacccacuccccuagcacguccccaccccuucugcaccuuugcuuggggagcagcccugcugaucccacuucucaguugccaugugcccaaacacaaacuugccuuuaagucuaucuccugguuucuacucaagaguccuuucuauccaacagcacugccuuaaaaggcgacaucuaaccccagacuugcuccugguggcuguguuacauaugguccaucuggaaaugaaacagacuccaaggcacaggcagacaggaaaaccuuucucucaacaaugcggaccucugccuuggugaggaggccaggaggaggggcugugacagaggcaacaccuguuucucaauggaccuggagcccucccuggguccccacuccccacagucccuggagcucuccucccuggguccccacucuccauggccccuggggcucuccuccccggguccccacuccccacggcccuggagcuccacuccccggguccccacuccuaacaguccuagagcucuccuccccagguccccauuccccacggcccuggagcuccccucccggggucccuacuccuaauaguccuggagcucuccucccuggguccccauuccccauagucuuagauccccucccugggucccugcucccccuggccccuagaauccucuccccaggucccugcuugcaaagaggggcuugaaggaccacaaacauaagcaccuuuacugugccacaggacuaacgucccugagccuguggagaggagucagaaaagcaggggacuccacuggaaugugcuucuguccguguucccuagaacagcucgaccagcacuggugugaagggcaaugccugagcuacccaucugggccucggcucccaccccuaaaucaucucaggucaccucugugaaagggauaccacuggggaggggcgugaaggaugcuuugaauggaugucaguguucucuuucuuaaguuggguggcagguucacgagcauucauuuuuauuauuuagauuuauauuguaaauguaugcugcuuguauccuuuuguguacauccaauauugcauucuauuaaaaaauauuacugcaaguauuagaguauaucagcggcucuucaaacugugaagaucccuggaggucaugcuucaggggccaccucggguguaggauggggcagcgggugggggucaggguggucucauagcugaugccauuccucuuccuguccuucaacaugagaacauucgugcaucauauaugugagcuccacguuucauuucaaggggguggguguuuugcugccaaagaaauaaagguugaaaacugguaacagugaugaacagcguagcaaaggccuuuucccucuagcugaccccaagguccucuggggaccacuguggggcucugugggcccucugccagcagcucccagcaccuagcacugggaaggcaccgcgucucccuggggucuccagccuucagcucccaugccccacagcccuccuuccaacaauguuuaaggauuaacuugccucuuucuuggcagucagaugaucuucaggucagacaaaaagggaagaaagaaggcguguaccuccgagcagcugagccaccccugcaccgccccgugacacugccucauggcggcauuucaugugugcgacucuugagggaugguccaggaacccaguuuccaucccagacuccucugugaagagccccaggcucugggcaggccuuauuugggacccacccauagcccucccacccagcagucugcagggcugacauguggcuccaggugcugaugccaaacagcucacugacagaauggccacaggccagcaaguccucuccugggguccgcugaaaggagguguucagacaaaugcccgcacaccuguguucacagcagcacuauccacaacggccaaaagggugaagcaaucccacugucuaccauccauacaaggaaugaauucugaccugugcugcaagguggaugaaccuugaaagcauuaggccaagugcaagacaccacagacaaaaggucacauaugguaugguaugauucuguuuugaugaaauuuccagaauagguaaauccauugaggcacaaagcagauuuguaguugcuggggacuaaaggcgggggugacugcuuaauaguuaaggugggggguucuuuuggagcaauggaaauguuuucaacugaagagggguggcaguuguacaauacuguaggcuaaaugcaauggaauuguacaugcuaaaaugguuaauuuuauguugcgugaauuucaccucaaaaaaaaaaccccucaaaaccaaggaaccacacacacaguucaccccaucauagcacggggacagcagggcccacagcugcuggcuggcuguaaacuacccccaacucccacugggcuccuggccucccucugcccacacacagguccugcaagcccagccccggccccugccccugcuccccacuguauucaagcuggagggggaaagugacauuuuaaaagccucuucccuguuuggucuugacaaacagcccguggccacaggauuuuuggaacaugacgccauucauggcaaagggaagagggcuggagaaugcguggggacaaauuucuggggcaacgucuucgcagggaagagucacacccuguuccucaaaaagccguccuucccauucagaaacagguaggacagaagcacgguggaaggaggagcaaaaaaagggcaggaaagcuaaaugaggucagccccacccuuccccgcacaugccaagguggucagccccgcuccuggacacuaggggccaagggggccacacacagccagacauugauggucucaaggccaagcucaguccucucgagucauguggagacagggaaggccuggagucccacagcuggguuuccucccggcuuugccaccagaggagcugcucuaggcauauuauacuaccucucucuacccuucucuuaacuccgccuucugagacugcuggaaauauaaaugagcuaauaguggccuggcacauggcaauuccugucagcuaugaauaccaccaacagcgccacaaaacaaugccagggcaggccacccuucagcaauuuccguauaggaaaaccuccacaccauagaaggccaggugcuagcuggccgggcccccuaggaagaggacuccuaagcucccaggcucacgggguuuccaggcgggaagggagauguggaauugagaaguagugggcugucugccgaggugacaucugccuauuagaagagcucguucucaggcucaaaagaagagacuccuccuguuuagaucucauagaaggguccccucagcagaggugccuuucccugcaagggugaaugacuuguaaaggcuggggguaggguggacagagaggcuggaaggaccugccugccagcugaggggacccacucaacacuggugaccagggggccacgaaacguccuggccagaucucccacccacccagugauuugggacuagacccggcuccccagcucugggauccucucuaccuuccuugggcauuucaaccaggcccggcacaaggauuuuccuucccagacaacugcaaggcaguugcuccauggauacgagugggauaagcauggcuucucuuaaucuucucccacacugcccauggcaacucauacacccaucaaagaaauuccuaaaauugggaucugcucugcccuucaugggaccugcaugacuucucugggcuugacaggggcacagaaguggccucuaacauuaaauccuaagcugaugaagccuggccccuucacuuccuacccucuaaaaaaaaaagaaauuuuuuuuuuuuuuugauacagggucucguucuauuacccagguuggagugcaguggcgugaucucagcacacugcaaccuccaccuccugccucaggcaauccuucuaccucagccucccaaguagcugggaccacaggcaugugccaccaagcuuggcuauguuuuuuacuuuuuuguagagacaggguuucccugucuugcccaggcugaucucgaacuccugggcucaagcaaucugcccaccuuggccucccaaaguuccgggauaacaggugugagccgcagcaccugaccuaaaaauucuuaaaaucaguucaguccuuacacagcagguccucaaauaaugccauuucauucaacauugauuuguuauaacaauguugaggaaaaaaaaaaaagaauuccugcacccacugccuguguggaguuugugugcucucacgacuccguggguuuucucuguacucugcuuucuuucacaucucagagaugugcacauucagugaacuggacaucuaaguggucccagucugagcaggugugggugcaaguguguccugugauggaacggcguccuguccaggcuuugugcccugggagaggcuccagcuaccggugacauugaacuggaauaagcaagcuggaaaacgcaugaaugaauacagguaacugccuacuaaaaagucaucaagucuacgauaaucacacaaacacaugacaauaaacuaugcaguaagaagcacucagccagcccaccgcuuuuguccuuguuuuugaacuuccuggugguaggagguaugccuuacaauuuucacuuugcagacauuuauuccuugauuuaaccuaccaccaugacugucaucacucacugucaucacucaccaaaacuuguauagauaaugaucuuacuuguuuuuauucaucuuccugaaauguauauaauagcucacauguauuuccauguuuaauauuagaaauacuuuggaucuuuauuuagaaguuugguuaauuuuuauaaccugaaauaugccguagaaacuuaaauccuguuuauaucaauuagcuuaugauaaaauugguuugguuguguguuguuaugcuuacaguagcaguuuccaagagcccaucaaugacggugaggacuuacuguacuuacacauucugaaaaaucaaacacacacaaggcaaacugacuacuuccuuccaguccucaaggggcugacauaagaaagcugcuaggguggugcagagcagcucagugggagaggagacagccugagcaucuguuuaaugggcaugggccugagcuucuguuuaaugggcaugggacagacagaaacagguuugagggccagcuugcccacaaaaucacaguggaagguccccucccugggcuguuuucucugcaguaaccuaagagggauggggaccuggugcuccccgcacugccccugccccaucucgcccauggccuggcccaugguggacauucaagagcagaugggccagcaugcuaagugagagcuucccaagggcaagauccgugucccacacacagcuccauacuacaugguuuauugcugauaaaacggaccccauuuacuaagcacccaccauauaacccaguauuuacaaacucugcccuugccacagauccugcgguugcugaggacuuuggaagcaucuuccugcauccucaucaggacccaaagccauggguacuauuauuauaaccccccaguuuucagaugaggggcauagaugcuucagcucuaaguaacuugcuccauuagcauggaaaauggagcuagaauggaaacucaaaucugggcucgccaccauuccaauucccuugccugggcgcacugaaaugaaaagugggacugugucagauuucuaggucagagcagguccccaagcagaagccaugcaaaugcccugacccaccccucccgcggcccugaggcuccugagccucaaguggcucacccaguccugauagugaggcucuggguauggcaucaggagacccaggagacauggccccuuucucuggcucagcuggggcucccugcagcugcucccccuucccuuggccccuuuaucuaugggaaggaccacgaggaggucagaaaccuuguguggaaagugcgccacgguugcuugugggucuguuaaauccagugccucagaaccuacagagaucaaggacaaagcuauuuccugauucugaauuccucuuucagaggaaaaaauugugcuuccuguucagagcugugccaaagguguggcugcugccuaggccaguagcccauguuggggauguggggcaccccgaggcugaggagaggugaagaucugggcgaugcccugcacaacagccugcaccguucacacacacgccccaccacacacucaagaacuaaggaguccaaguuggggcaaggcccuguuccugauagcaaagguuaacacuuauuagagacaagguggccaaacaggacuuuggaaaaaaucgugcuggacuuccugugaccuaggcaggucgcugaaccucugcugaaccucuccaggucucggcggcuccaucugcuaauugaagacaaucccucaccugcauaaugugggggaaaggcagggagggcaggugcagacagccccagcaggucccucuucccagggcuaggaacuagaaguccaggaaacagcugugauuuauucugcagcacugcaauauaccaaucucccuacuacccaucugccccggggccaaacaaaaacacuaaggaguuuacaaagcaaaguggccuucccaaggacagggaggaugagucuggagccaggguggagucuggagccaggguggacucuggcacgggagccucauggagcugaaaucuguaucacggccccauugcugagcagcucagugaccuugggcaggccgcucaaccacucugaaaacucaggguccccuccuccgagggaggccuugcugccaccagcccugcuggccacccuugccugcugaggucugugugaaaucacgggcuaugacacaauauaguagguagagguucaaaggauccggcaggcccauccacucagagucucgcugcaaagcagcucugacaccagggccaccucuggcacagcaugcaaccgccaagcugcgcccaaggggaaggagccagaaggguuacaggcuccaggcaaaaaccaggcugugguuucaugugaacuaggaugacccugacugagaaaaccagugagugguuuggaagauuucaguuccagcuuccagagacaaaaugucagugaaucaacccccuaggugcucuugcccccaacggaagugacaaugccuugagagcucuggguagggcaugggggcuccauuccagagcagcuguaagacugccucaauugcuaaaacuggaaaaagcacaaaaucuagggcagaguuuucgaaccugccccaaauggccccagagaugacccaaggcccucccccgccaccccgccccaggaugggaggccaagcuccaggcuuuggcugccuugcccagagcugcacugcuuuugaugaaagcuugaaaaccauccaccugguccaacggugucauucagcugagaaagaguggcuuggggaaugaguuucccaggauaagagaagagcccguuuucuuaggucagaugcuuccaaauuagcacccaaugauccuccauguccaguaguaggaugucuuccccugugccucgcugccacacucucucccucuuucaagacuaaguggcagcuugggaacaauuuaaacauucugaguuaaauuucuuuauuucugcuaaagaacaugagguugcccaaagaaaggcuacuucccccagaggcggcagccagcgugcuuccuggaacaucccucaccacauggggggcucaggaacuccccauuccaucagcacacuacucugcaaagagaaggcaggcacccgcuuuacaggugggagacauaagucaccuuccugggucacccugcacauuugugucaggaagagaacauaggccuuggacuauaguccuucuguguggcaagggaaagagaaaucagaggaaaagaucagguaacaggcuagaacccagggaaaaaagcuagggugcaauuacauaauacuggaacauugcacguccaguuuagagggggauacgccagccugcccaccacggcccucaccggcuccccacaggacaggccugaggcccuggcaaggaccuuccucccuucugccccuaaacucugccucugggcagggaguggggaucagagcccagaagagaacuucuaacacaccaaaagaagccaucaaagaugugauagucaaagaaagaaacuucaaaaguuggcaauagacaccaagggccaaggaggaguggggacacaaacaggaguaacaagucccagagaagcagcacuccaggaaccuuccaacccaaggcccaagggagggacggaggaaacucaccaccaccuguggcaccccagggcugccaccaggacugcgggcagcggccacaccaccaggcuacuaagcagugggaaaguggcucgucugagcugaaaugugcuguaacguaaaaugcgcacgucauaacuuuuuugcaugguguaaugacaguauuuuggauauaucugguuaaauaaaacauaauuaaaauuaauuucaccucuuuuuuuuuuuuuuuuuuuuugagacggagucucacucuauugcccaggcuggagugcaguggcgcaaucucagcucacugcaagcuccgccucccggguucacaccauucuccugccucagccuccugaguagcugggacuacaggcgcccaccaccacgcccgauuaauuuuuuguauuuuuaguagagacaggguuucaccguggucucgaucuccugaccucgugauccacccgccucggccucccaaagugcugggauugcaggcgugagccacugugcccggccccgacuaauuuauuguauuuuuaguagagacggguuucacuguguuagccaggauggucuugaucuccugaccucgugauccgcccgucucggccucccaaagugcugaaauuacaggcgugagccacugcacccggccccucuuuuuacuuuuuuaacguagccgcuggaaaauuuaaaauuuccuauguggcuuccauuacaguucuagaggacagggcuggucugagggguggcacacugugccccugugccaaauuggcccaccagcugcuuuucuaagaccccaaaaccaagaauggcuuuuacauuuuuaaguggcuauauccuacacaaccuccucgauuuugccuguuggccugcaaaaccuaaaauauacaagauuucuuuugaguaaaaggcuccgggauuugaugaaagcuugaaaaccaccgaccugguccaacugugucauucaggugggaaagaguggcuuggggaaggaguuccccaggauaaaagaagaguccuuuauaaaaaaaauugccaagccuuggucuagacucuagaaacaaucagauauucacuccaggugacacaaggagcagaaggcaggugugugugugugagagagcgauucuuguacagacagucccugacuuauaauuuugacuuugugauaggucugauggguuuuaccuggauguacccccaccauaagucccaucauaagucaagaagcauuuggaagugaacaauucaggggcauuuaguacauuucacaaggcugugcaaccagcacuuuuaucuaguuccaaaacauuucaucacccccaaaauagaaccccagucucauuagcagucauuccacauugcccacccaacccucaggcucuggcaacaaccgaucugcuuucuguuucuacagauuuaccuguuuuggacauuuuacauaaauggaaucacacaguaugugacacaugaccuuucaugucugccucuuagcgcaauguuuucuagguucguccauguuguggcaugucucaguacuucgcuccuucuuagaacugaaugauauuccaugguauggauacacuaugauuugcuuaucuacgcauuaguggauggacacuuggauuguugcugccguuuggcuauugugaguagugcuguuaugaacauuuguauacaaguaucuguuugaauacaccuguccucaauucuucuuggcauauaccuagaagugggaaugcuggcucacgugguagguuuuaugcugaacuuuuugagaaacccccaaacuguuuccacagcagcuacaccauuucauucccaccagcaacgugcaagaguuauaacuucuucacauccucgccaacauguuauauucuuauuuuuuuaauucuagccauccugacagguaugaagugauaucucacugugguuucaauuuggguuucgcugaugacaacgcugagcauuugucauggugcuuggccgucugaaaugggauuuugugugucugagauuuuugacacgcucccugccaagcaacacaccaacuccuguuacagaucuucuacaagggggggaugcgaaaucuccccguuguuucugagauacacauuaagucaaaucaggaaguccuaugccuuagaacuucuacgaaugucuacaggaacaaagggaaaccugaugaaaugcuucccugagaccucguccuggcccacacccucuaugucugaaauucccaccugaggcccccgcagcuuuggagccuuggcagugggguaugggcacagcaagggcagaaucacaccaggaagacuaagaacccugggagagaucaagaccgagcucauuuccagaugggaaaacaggccugagcaaugaaaaugacccagccaaggucccacaaaaaaacagggcuagacaaagaaguagaaacaggcuugcaggcuccuuccacagaggcaaugccugaaguuacacagucagcaggagaaagagacaucacccccagaucaacacgcggauguagaagcugagcacccuggguuccagaccugcuucucccacuaaugcccaccccucugauucaccucccagccucugcaccugcuccccuuuugccugcccacuacaugggggcuuccuaggcugguuccucuccuuucacucuaugcagccuccugagugcucacacucacucccaugauuucagcaaccaccuccacauccaagacuuaagaauuccaacccagccucccucuacguccauaagggucaaacuuaccauauuauuuuuuaccccuccccaucccccaaguuuacuccaaaucuguucuucucaaucucuguuaaagguacuucuaacuaccccagguuccucaacacccaccucugaucaaccaacaacauccugucccuagagucugauuccuuccauccucaccagcacugaucuggagagaaugccuugauuguaauuuacccaguuuaauagccuccaguagaucuucugccuuuaaccagaauuauuuuccuaaaaaacaagucugauagauuaaaaagcuaaguauaaaaauagcuauaaaagaauaugagaaauuauuuuacaaaucuuggaaaguaggccuuaaacaugacauuaaaacuacaaacuauuaaaaaaaaagaccaacugcauuuauauuaugaaaaagaaaaauaaccacacaaaaaagacaaguggcauucugggaaaaaauaccugcaauacguggcaagcaucggauuaauaucuaguucagggucagcaaacuauggcucacaggccacacaucaugccagcugccuguuuuuguaaauaaaguuuuuuaaauuuauuauuauuauuacuuuuuugagaaggagucucacuuuguugcccaggcugcagugcuguggcacgaucuuggcucaaugcaaccucugccuccuggguucaagcaauucucgugccucagccucccaaggaguagcugggauuacaggcaugugccaccacacccagcuaguuuuuguauuuuuaguagagacagaguuucaccauguuggccaggcuggucuugaacuccugaccucagaucauccacccaccucagccucccuaagugcugggauuacaggcaugagccacugcgcccugccgguaaauaaaguuuuacuggaacacaguaacucauucgaacucauucguuaauguguugucuacggcugccuuugugaugagacggcaaagucugcacaguugugacagagaccauauagcccacagacacuaaauuauauuuacuauuuggccuuuuaccaaaaaaguuugcagaccccugaccuaaagcacuuauagaaagcuccuacaaaucaacugggggaaaaacuaaccuuacagaaaaaugggcaagcaauacgaacaggcaauccacaaaagaaacaaaaauacucaguaaauacuauaaaaaaggcucaacuucaugaguaauuaggaaaauuauuagagaauuaaaucauuugauaauauccaguccuggaaauguuaucacacagccuuuuuuggaaggcaauuucgugguaucugaaaaaaaaaauuuaugcgcuugaugucaacccagccauucuauuuauagguaucugcccccagagaaauacuugcauucaugcaugcacgcacacacacccagaaguauuuauaagacucuuugccgaaacauucacuguauguaacagcaaaacccauaagcaaccuugaugucuaucaauaaggaaacggguuaaauuauaguacacuccuaaaggccuaauaugcaaaaugguucuggcaucuuuauaugcaacaccaugaaaagaacguaaagauaugcugauaagcagaaaacaaaaaauaugucgcagagcaaauacaugcacacaguucaggauaaaaagguuuaacuguauauuugagcugggcacagugacucacgccuguaaucccggcacuuugggaggccgaggcaggcggaucacgaggucaggagaucaagaccauccuggcuaacacagugaaaccucgucucuacuaaaaauacaaaaaauuagccaggcaugguggcgggugccuguagucccagcuacucgggaggcugaggcagaagaauggcaugaaccugggaggcguagcuugcagugagcucagaucgcgccacugcacaccagccugggcaacagagcgagacuccgccucaaaaaaaaaaaaaaaacuguauauuuggguccguaugucgcugagaaaugcacaggaaaacuggaggauaaaugacacucugugaacaggggccuggaacaaguaauaaaggacggucacuuaucacuuaucccagauuacuccaaauuuccgugaggaggaaaaggcaaagaacuccacugcuccaagccagcauucucaaggcaccuccugcaacauaacuaucccugacauuauuguccucaucaugugcucaugguguggccacuguagacccugaacaggaguaggggaacuaacauuggcuucagaauccuggcuccaucccugaacugggcaagucacuucccuucucuggguuucaaucuucucaccgguaagaggaagugguuacauuagcugaucuccaagucccuuccaggucugaugccauaauacagucccugcaagagguuucugugccucucuaggggaaaaacaaacaaacaaaacccacagcugaggaaauaaaccucaaaccaaaaggcucagagaaaugucugcuccugggaagaugacaucuccagagcaaaagccggccaaggcugcccaccaccucccugggcccaguauccucuccucuuaaggagggaguggccucgaugguggcugauguaucuuccagcuuugacggucuaaaauaagcuccaggcugggaggggcagcaggaagcaggggcuugggggagacugaugggaaccgauugguugagguuuucuaauggagccauaaggaugagagugagagggagggccggaugcagagagcagcagagaaggcuguuggcaacagcccugagucucccuccucucuuuucaagagcaguuucuuccugaaagaucccaggagguagaaugcugggcuaaccucucccagcacaaauaaccccacucauuauuucagaaacuaccauuccaguugugcccugaaggucucaggccuguuucaaaacccacaauucaacuuugaauacagugagaguacaguauuuuaaguuugccucuccccgugaauccaauuaauaaucaacagauuaaaaaaaaucuuagcagauuggacucaaacaugcagauuccauccuaguuuaucuaagcuuaagaauucgaaaacagccccuaugagguguaaauuuaccaauuuugacaguugcuuagaauaaccaggaaacuuacaaaccucucucagaacaacccuugcccagaaacuucuuaaaguggcagguuuuuuugguuuguuaaauuguaagagaaaaaaguuucauaaaauaucauuucuugcuuuucacaaaugcucagugaaggagguaagccagggaccaggauucccaauuuacagauaaggaaauuaaaagauacagaaguaaagggauuuguucaaggucacacagcuggaagugacagccaagaccugaagcaaagucuccuaacaacuccucaucgcauaaacuguuucauccaaaaaagcauccagaugagaagaaggaaucaaguucuccuuuacacuccaaaacacccuccgagguaaaugaguucuauccgucccaagcugaccguccuuaaaacccuugguaucuuaaccaucuaugacuuugcagccuugaguguuucguuaagcuuuugggguuuagaugaaaggaaucuuuuccuggcaguuggaaaccugaccucagagaaaggccccgugccccaggccguaaccccugccccaccacccuacuccagucggccauguaaacaagucaaacccugggugcacugaaguggcauuaaaaacaaccaggcccguucacucguuuucagucuaagggguucuucugcgacaggaguggcuacaacuaggucacacuggacuggaaugugaagggacuuccccuggcuucauucaggaggcugagagaaagcucugaagaggauggagaugauggccguggggaggguaccgaggcacaucccaaggaggugcacacaaggcucggaauccuggaacacuaggaguucaaacagcaaucacugcagggguucccaagggccaugggggcugcagccaagccucuuggagccuuucaucaauacaaauuccccaucuccccagucacuccagggcgggggccccagaacucuguguuuaauggcuaugacucuaaugcacguuugggagucauaacuaguucaaagcccuguuugacaguuaaggcugggagacagaaaucaacuuucccgaggacccacaggucuccucaccccucggccagugaccagggaacuggucccagcuccccgcuaaacuacggccugccaaacuaaguucaagaacaagacccuccucgccagauuuggacaccccuucaccucucuccagugcuugacagugacgaugauucagaaucggggcaggcugcgucccacuagacggaagcccacaguccuccccaacaauccgaccccugggccacucuggcuggacaaauccaaguccagucccaagccagaaucucaggggggucccgucaagcggcaugcaaucccuaagcgcuuuguuccuacuaagcgaaaccaggcacuuuugagucacccaaaaagcaugaaucacacagccgggcaaugggaacgggaaaggauguuauuuuucggcauacucgaggauuuucccuuugucccagcucugucaaugcacuucccguccccguccccaugccccaggacucgcgcauuucccugcuccauuuuuauuuucccugcagcccuuggcggcgccccggccgccgacccgcggcucccagaacggagguguccgggccggccccagucgcucaccugcgucagguccucgucguugagcagaugcgacucgcggggcuugaagcaguucugacacuugcucuuguugaagauguuggccuggaauuuccugcacggguucuccuuggcugccgacauggucggcgcggcggcgacggcggcggcggcggcggcgcaggccuggccggccuggcgcucccggcgggcuaggggcucagcgcggccgc

SEQ ID NO: 192246 - RNA, 34075 nt, Homo sapiens
gaguccguucugggugucuuggcucuauggcucgccucugccagcuccuccgcugccaggcggcgcacgcucgggaaccugugcgccuauuuugguccuacagaaugcugcggaagcucucgcucguaggacuccauuucuucuucuuuguuuuuuuuuagccgaggcuggagugcaguggcgcgaucucggcucacugcaaccucagccucccggcuucaagcgauucuccugucucagccucccgaguagcugagauuacaggcgcccgccagcucacacggcuuuuuuuuuuuuugagacggagucucacugucucccaggcuggagugcaguggcgcggucucggcucaccucaaccuucgccuucgagguucaagcgauucuccugucucagccucccgaguagcugggauuacaggcgccugcccggcuaauuuuuguauuuuuaguagagacaggguuucaccauguuggccuggcuggucucgaaccuugaucucaggugauccacuggccucggccucccaaagugcugggauuacaggcaugagccaccgcggccagcccacgcggcuaauuuuuucguauuuuuaauagagaugggguuuuuaccauguuggccaagcugguuucgaacuccucaccugaagugauccgcccaccucggccucccaaagugcuaggauuacaggcgugagccacugcgcccggccaggacuccauuucuagggguagaauugugaugauuuuacucgcacuuuccagguuguuugguucauucauugcguaugaauguaccgaauucuggaccugaaauucgaaugauuagaugcuggcugugaaggcccuuuuaacuaucccgugcuucaguuucuucgucugcaaaauaagucccuaguuuauguagaguugugaagauucaaugagagaaaccauguaaaagcaguuggaacagugccugucauaaggggugcaauaaauauagcugcaaauuauuguuaccgucauuaauugcaaaguucuaggagcugcuugaccuuggacaaauaaccuuuaaucucugagucuuuugcaucuccauuguaaaaauggaggggugcuuuuaccucacugguguaagacaaauggucugauauggagcugcacuuaauaagaauucuuccucuuuuuccuuuuuauuaauagaaaugagguucacagggaaggcacaggcuugccuuuucuaugaauaaaggaaccacugguuuguuaauuuauucgacaaauacuuaguguucuccuuccugggguguaguguaguuagaagcuucagguugaaauccugucgcggucacuucuugggugaaccacuuaauuucccugggccaauuuucuuaauuacaaaacagaacuagggcuguuguggucuucagguuauaggaugcuauaggaacagucugcuagacagagauaaauaugguaacuuucauugcugucggcuacugugccucacacucacuggauaggaaaucuuugaguuucaggccaggcgcaguggcucacuccuguaauuccagcacuuugggaggccgaggcgggcggaucaucugaggucaggaguucaagaccacccuggccaacauggugaaacccugucucuacuaaaaaugcaaaauuagccaggcaugguggcgggcgccuguaaucucagcuacucgggaggcugaggcaggagaauggcaugaaccugggagguggagcuugcagugagccaagaucgcgccacugcccuccagucugggugacagagcaagacuccgucucaaaaaaaaaaaaaagaaaaaaaagaauuuuauuggccacaucucugguuacacugauuucaaaugcacucugugacacuuaaacuuuuuuuuuuuacucugcccuuggcccugcacuaauuaauuaucuggugauuucauagugacccagcuuuuauuucagucucaacugggcacugauuguuaacuaguagagaacuaauggauugcaaugcuuauuucuggguguuacaaauuauuguuaauauauuuagaguaaugguuuacaaaggcaaauuauucaacuagaaguuacuucauaccuaccagugagaucuguaauacaaugaugaugaguugguauuucccaguuaaaucugugugaucucaagaggugacaccuaauaagaucacagcuguuuuauucuuguuuuguaaugcauguauaauaaugauacauuuccuuugcuuucaguaaaauguaucaaauugaaaaguguuaaauuaucaaaaguaccuagcuauagucacuuguauuuuaagcauuauacuauguuguauucuuuuaguaaggaaaagauuaugcaguugcucuguagaaauagagaaguuggaaacuugagguuaaugcccauggacuuaaauauauccucacuguuaccagaaagacagagugugaccaugguaucugucaugacaguaauugucaaaauugaugggucuacuuaaagguaccaauucaggccuaauuuuuuuuuucccccgaaacggagucuugcucuguugcccaggcuggaguacaguggcgcaaucucagcucacugcagccuccaucucccggguucaaggauugucccagguuaaaggauucucccaccucagccucccgaguagcugggauuacaggugugugccaccacacccagcuaauuuuuguauuuuuaguggagacaggguuucaccauguuggccagccuggucuugaacuccugaccucgagauaucugcccaccuuauccucccaaagugcugggauuacaggugugagccagccuggucuugaacuccugaccucgagagaucugcccaccuuauccucccaaagugcugggauuacaggugugagccacagcacccggcugaggccuaauuauuaauagauucuguaccuuaguuguuaaaauguagcauugcaggcugagugugguggcucaugccucuaaucccagcacuuugggaggccaaggugggaggauugcuugagcccaggaguuagagaccagacugggcaacauagugagaccccugucucugcaaaaaacuuaaaaaauaagaugggcauggugacguacaccuguaguuccagcuacucgggaggcuaaggugggaggauugcuugagcccaggagauggaggcugcguugagcugugaucacaccacugcacugcagccugagcgacagaaugagacccugucucaaaaaacaaaacaaaacaaacauaguauugcaguauaggggaaaaauagaucaauuaggagauuaauucaacaaguagcugcuugaugaacugcuaagcaggugauguauucuagagcuggagaaagggacaaucccuccaccugaguuuacugaaauaccuaaccacuacagucccaugcgaggcagagagggcagauacccagcuuagccauggggaagggagcugagaugagggucuagagacgccacaaguugauugcugaaugcuggaugaggcucagucagguagcagaggaugugggggagaaggacagagaacagcauguguagaagcauaaagaggagagaagauagaauguugauuuucugagcuugcugugaucgaagaguaggugugugaggggaaguagcaggagauaaggcuggaaagguagcagggaccaguuauugaagggccuuaguucaggcugaggcguuugcacuucuuaaagucauuggaauaacuugauugaaugcacaguuuauagaacagacaguacuaauauggagugcggguuggaggagagaaagaucacaguaggcagaccauuuagaagauuuaugauguaggcugggcgcgguggaucaugaggucaggaguucaagaccagccuggccaagaaggugaaacccccgucucuacuaaaaauacaaaaaaauuagccaggugcaguggcaggcgccuguaaucccagcuauuugggaggcugaggcaggagaauugcuugaacuuggagggcggagguuguagugaaccgagauugcgccacugcacuccagccugggcgacacagugaaacuccaucuuaaaaaaaaaaaaaagauguaguccagacaaaaaaugaugaggaucugaauuagggcagagaggggagagagaaagaaauggagcugagagacuuuggaaguaaaacuaaaucauuuggaugcagagagcuguuaauaguaacgugcauuucuggcuugggagacuagaaaacagaauagagaaaaaggugaaacauucagggucagagagaagugggagguccaguguaaucucuaauucguuuugagaccacggacagguuguuucacuccucugguccuucuggauccucauccgaagugaaggagauuaagaaucaauuuugggaacuucaggcucugaaguacaaaguugugguuagaguuccaucaguuugguuagugcuguagcugaaaugcaauaguguuguuccuguuuuccagggcaaaugacacagcuuugugaacugaucaacaagaguggggaacuccuugcgaagaacuuaucccaucuggacacugugcucggggcucuggauguacaagaacacuccuugggcguccuugcuguuuuguaaggagcaucuucuuuuauaguucugugcuuguuaaaauggaacacugugcacuuccuggcuuuauuuuuauuuauuuauuuauauuuuuugagauggaguuucgcucugucacccaggcuggagugcaguggcacauucuuggcacacugcaagcuccgccucccggguucacuccauucucuugccucagccucuugaguagcugggacuacaggcacucgccacccgccccagcuaauuuuuguauuuuuaguagagacaggguuucaccauguuagccaggaugaucucgaucuccugaccucuugguccgcccaccuuggccucccaaaaugcugggauuacaggcgugagccaccacgcccagcccuggcuuuauuuuuauuuauuuauuuauuuuuugguguagaaaguaaaccauuguaaauaacauugagcucuuuugcaaaacuaaaguuauggcaguuacaguuuauugauuccagcuaauaauugcuuguuauauuuuguucaacuuuaucauuuuuaaaaacucuuuuauguauccgggcauaaagagguugcagugagccaaggucgcgccacuguacucuagccugggugacagagcgagacugucucaaaaaaauaaaaucaguuguugcagcugggcacaguggcucccgccucuaaucccaacauuuugggaggcagaggcagguggaucacuuggggccaggagcuccagaccugccuggccaacuggugaaacccugucucuacuaauaaaaaaacuagccggguguguuggcgcaugccuguagucccagcuacucagguggcugaggcaugagaauugcuugagccuggaaggcagagguugcagugagccaagauugcaccacugcacuccagccugggcgacagagggagacucucucaaaaaaaaaaaaaaaaucaguuguugcuuuuccugcuuugagaacauacuaagggggccaagagugagagcuaugggcuggcuggaggugggcagcagcuuaaguuaaagaugcugccaccagcuguguggucuaucugagaauaacacugacagaacaacugauaggcaggacaagaggaguagaguggugagaagagggaggacucaggugauccuucccaaguaacucagacugccaugagaaacacuccaaggaggcacuggugauagguuuuaggggagaaaucauguaaacuuagcacuauuaaggcauugguuguaaguaaauuucaaauucuuuaaaaaaaaaaaaaagcacgauugaaauguaauuucaagaaaaauuaggccagacacaguggcuuacaucuguaaucccggcacuuugggaggccaaggcggguggaucacaaguucaggaguucaagaccagccuggccaacauagugagacccugucucuacuaaaaauacaaaaauuagccgggugugguggcaugcaccuguagucccagcuacucgggaggcugaggcaggagaauggcuugaaccugggaggcggagguugcagugagcugagacaacgccacugcacuccagucugggugacagagugugagacucugucucaaaaaaaaaaaaaagaaaagcuaaucauaauuucuacuacaucuuuugguuuaucugcuuccaucuauacuguauuauuugacuuaacaaugucaccauacaucuguauuuacacuuuguaauuaucaagacaugucagaaacaauuucaucugggguucacaauaggucagugaggcauugcgacugccaguuuauaaauaaaaauaugaagcucagggccccacaacucaaaauuggaagaauauguagauucaaaaccaggguccucagccagaagcucaggguucuuuccauaccuuaucuaacauauacaacgguaaacaccuuauaccuucaaaaugcauucauguccauuacucaccugauauauauguuuaugugaguuuauguguguauaaaacaugcaugcucucuguucuuucuugagauagggucuugaugucacucaggcugaagugcaguggugcaagcauagcucacuguagccucgaccucccaggcucaagcaguccucccacuuuagccuccuggguagcugggaccacaggcaugugccaccacacucagcuaacuuuuuuucuuuuggggggacaaggucuuguucugucacccagucaggagugcaguggcaugagcacagcucacugcagcuucaaucucauggacucaagugaucuuccaaccucagccuccugaguagccaggaccacagguguacaccaccacgcccgccuaauuuuuguguuuuuuuguaaagacaggguuucaucacguuucccaggcuggucuugaacuccugagcucaagcaaucugcccaucucagccucccaaaguccugggauuacaggcauaagccaccauaccuggccacuuuuuuuuucuguagagauggggucuugcuauguuucccaggcuggucucaaacagagccucccaaagugcuaggauuacaggugugagccacugugcccagcaucugcucuuucauauaaauaagaaaauacagacaguagaaauccuuaccagcacuguccaauagaacuaucugcagugguggaaauguuacaaaccugugcuaagacaaggacaugugaccacauguggcuacugaguacuugaaacauggcaagugcaccugaaucuuuaauuuuaauuuaaauagcugcauauggcuaguggccaccauacugcagagcauaacucuagauccuuccauucugacaaagcuucuucucuaaacucugcuccggacacauaccuuugucucaggaaucccagcguaagugaagccagacucucacuuuaagucaauuucuucucaguuuauuuauaucauuucaaaugucaugacaaccacaauaucccaauuuauaauacuauaacaucaagagaaaaagaauucuacugucaaguacacgguuacaaggaaccccaauuaaaauaaggucuauuuaauuuggucuuaaauagcuuaaauuuguuugaagggaauucuaagcaauguugcuuuggaucuuugauacuuuuucuuuuuuugagaaaaggucucacuuugucauguaggcuggagugcaauggcuuaauuguagcuuacugaagccuugaacuucugggcucaagcaauccucccaccucagcaucuugagaagcuaggacuauaggcauguaccacuacacccagcuaauauuuuuauucuuugcagagauagggccauauuauguugccuaggcuggucucaaacuccuggccucaaaugauccuccgaccuuggccucccaaaguguugggauuaugagcaacugugcccagccaauauuuucauucaauguauucugccaugcccuguggcaguacuccuccgaacuucuuuuuaauuuagaaaauguggacauuccuguggauuacauggauaaaaguauucagauaaaugcaaacuauaguccccacaauugagauggccauuuuuuaaaacaaauuuucaggauuuguauaaacauaaaggaguuuuuuuuuuugagacgagucucacuccgucacccgggcuggagugcaguggcacgaucucagcucacugcaaacucugccuccuggguucaagcaauucuccugucucagccucccaaauaggugggauuacaggcaccugccaccacgcccggcuaauuuuucuauuuuuuguagagaugggguuucacccgauuggucaggcuggucuugaaauccugaccucaggugauccacccgccuuggccucccaaagugcugggauuauaggcgugagccaccgugccuggccaauuuuuguauuuuuagcagacauggguuuucaccauauuggcuaggcuggucucgaacuccugaccuugugaucugcccaucugcccaccuuggccuuccguagugcugggauuacaggcuugagccaccaugcccagccuauuuggcuucauuuaguggaauuuuucaucuugaaaguuguuccuuauuaaacauauauauauauauaaaacauauauguuuaauauauacauguuuauuauuuaauauauauuauuaaacauauguguguguauguguguauauauauauauauauagauauauauagauuuuuuuuuugagacagucucgcucuuguugcccaggcuggagugcaguggcaccaucucagcucacugcaaccuccaccucccggguucaagcaguuccucagccucccgaguagcugggguuacaggcaugcaugcaccaccacgcccggcuaauuuuuuuguauuuuuaguagagacgagguuuuuccauguugaucaggcuggucucgaacucccgaccuuaggugauccucccgccuuggccucccaaggugcugggauuacaggcaugagccacugcgccaggccuaaacauauuuuucuuaacccuuauuuguguccguucuguauagugauugugcaaaauaaccaggucaggaaaaucucauggauucuaguucuuauuuauuuguuuuuugagacuggaucuugcucugucacccaggcuggagugcaguggcaugaucauagcucacugcagccucaaccuucuaggcacaagugauccuccagccucagccucccaaguaucugcaacuacaggcauguacccccacgccuggcuaauuuauuuuuuguaguagagacagggucucaccauguugcucagacuggucucaaacuccuggccuuaagcaguccuccugccucagccucccaaagugcuuggauuacgggcaugagccacuguccuggccuaguucuuaauucuaaaaaauacuguugcucauuuaauuuuacagaguauuggaggcaggauggauuucuugcauacauuguuucuguauuuuaucccaugaacuaucaggguaauuugauucuuuucuccuuauucuagguuugugaaguuuucuaugcccaguguuccugacuucgaaacgcuauucucacagguucagcucuucaucagcacuuguaauggggagcacauucgauaugcaacagacacuuguaagcuaaauaacauuuuauucuccauugaaaauauuuugcccuugugguuauauuuauauuuugaauauuuuguuauuguaucuaguugcugggcuuugccaucagcuaacaaaugcacuuguggaaagaaaacagguaagaaauacuauucaaguauuccuaguuuuguuauaauauguaacuagcuuacacaaugaauuacuuuaucaagauuccaguuaguacugagcauccaccaccuagauaucuguggucacuugagagcacucacagccauugcuguaagcucaggcaguccccgcauccccugaaugagguggaggcacggggugguuuggcaccucagggaggcugcugcuggaacuaccaaguaguuggaauuaccaagccaguacccuuuauguuguaauaugcuggguuuugucuguuacauuuuuucuuuuaacuuuuaauuaggacauuauuuuagccuuacaaaaagcuucaaaaauaauauaaaaaauucucauacauuuuaccuagauuuuccaaauguuaacauuuuaccgcacuuauucuuuuuuuuuucucuuccucuuuuauucugagccauuguagaguaaguugcacauaugcuauugcuguucuuuaucccuaaauacuucaguggguaaagccuaaaaauuaggacauucuguuacauaguauaguguaauggucagcauccagaaaugaacucuuacuguuuuuuuuuuuggagacagagucucgcucugaugccuaggcuggagugcaguggcgccaucucuggucacugcaaccuccaccucccagguucaagcaauucuucugccucagccuccugaguagcuggggacuacaggugcaugcugccacgcccagcuaauuuuuuguauuuuaguagagacgggguuucaccauguugccaggcuggucucgaacuccugagcucaggcaauccucccgccuuggccucccaaagugccaggauuacaggcgugagccaccacgcccggcccagaaaugaacguuaauauaaugcaucaacaaauugacagaccccauuuagauuuucccccagugaaaaggacugucuuuugcuauaaaaggacauuagcuguuuggacaguguacuauauauuauauagcaaaagaaaaccguggaccauggauugcauuagacugcuuuguuucuuuagugucccuuaaucugaacaguuauuucauucuuuaucuuuuauaauacauaauuuauaauguggauuuuuaaaaaauuuauuuaguuauuuauuuuuuugaaauggagucucauucuguugccuaggcuggagugcaguggugugaucucagcucacugcaaccuccaccuuccagcuucaggcgauucucgugccucagccuccugaguagcugggacuacaggcgcaugucaccuuucccagcugauuuuuguuuuguuuuguuuuuugagacagagucucgcucugucacccaggcuggagugcaauggcgcaaucucggcucacugcaacuuccgccuccuggguucaagcaguucuucugccucagccucccaaguagcugggauuacaggugccugacaccaugcccggcuaauuuuuguauuuuuaguagagacaggguuucaccauguuugccaggcuggugucaaacuccugaccacaggcgauccgccugccucggccucccagugauuuuuguauuuuuaauagaggugagguuuugccauguuggccaggcuagccucuagaacuccugaccucuggugauccgccugcuucagccucccaaagggcugagauuacaggugugagccacuucacccagccagguguuucuuuuuaauuugaaaguaaauuuaagauuagugguuugaaagaggcugaaaauagaaccaguuguuauuuuguaguacuaaguaaccauguuugaaagagaugguuaagaaaaaucaugaguuuuugaaaaagcuguaaguuauugagcuauuuuuagucucuucacauauauauauauauauuuuuguuguuguuguuguuguuguuguuuuuuugagauggggucuugcucuguugcccaggcuggagugcaguggcgcgaucucagcucacugcaaccuccgccucccggguucaagcgauucuccugccucagccuccugaguagcugggaccacaggcacaucccaccaugcccggcuaauuuuuguauuuuuaguagacaugggguuuugccauguuggccaggauaaucuugaucuccugaccucaugauccacccaucuuggccucccaaaaugcugggauuacaggugugagccaccgugcccagcaauuuuggaagagacuauauuuuagucugccaaaaacugauuaugccuuacuugacacuuggucuucuuauuuauaaucagggcaggaaacaguccuuuugaaaucuaugguguuaguuuugguaguaauuuacuaccagguaagggguagacugcccuaugggaaaaugccaacacccuuagccacaaguaauuuuccuaagcauaggcuguugucucuuguauaauaagugauuuggaaaguuuucauuuguuuagauguuaauauaauaaacuguugagaaaguaauacuguuuuugauuauugaucuucauuguaaaaauaaaagcuuuuuaugauuuaaaaaauggugcugaguuaucuaaaaauuccaagaaacagcuuaagaaaaguuuucugacuuaaaugggacagaaauuuccugaaagaguauggaaaccucauauugcuauuuaaaggaaccuaucaauuaguguuauuuuuuauuuauaagugacaacauaagauccaaugugcugccaucuuugagaacuuaucugaaagagaugucauuucugacagccccugcgaggaauuggcauccuuaagcaagccauagacaagaugcagaugaauacaaaccagcugaccucaauacaugcugaucucugccagguaagcaaccaaagugugugauucacaccaagucagagguguagguuguuuaugggcuugcucaacauuggguuugauaaacacaggcaaguuggcgauauugugauguguuauagaaguuggaauauguagguacaucuauuacauucaggcgggugcuggaugcaaacuguaggauggggcucaacuaguaagcuugucgaacagauaggguaauuaauaguuguaacuuuuuuuuuuuuuuuuuuugagacagucucacuuugucgcccaugcuggagugcaguggcacaaucucagcucacugcaaccucugccucccggguucaagcaauucuccugccucagccucucgcguagcugagacuacaagcacccaccaccaagccuagcuaauuuuuguauuuuuaguagaacaggguuucaccauguuggccaggcuggcguugaacuccugaccucaugauccacccgccucagccucccaaagugcuaggauuacaggugugagccaccacacccggcccuaguuguaacuuuuuuuuuuuuuuuuuuuugagacggagucuugcucugucgcccaggcuggcgccaucucagcucacugcaagcuccgccucccggguucacgccauucucccgccucagccucccgaguagcugggacuacaggcgcccgcuaucacgccuggcuaauuuuuuuguauuuuuaguagacacgggguuuuacuguguuagccagaauggucucaaucuccugacgucgugauccgcucgccucagccucccaaagugcugggauuacaggcgugagccacugugcccggccuguaacuuuuuuuaaaaucccgaaucauuuuuuuaaaauuguggagccugccaggugcagugguucacgccuguaaucccaacacuuugggaggcugaggcgggcggaucaccugagguccggaguuccagaccagccugaccaacauggagaaaucccaucucuacuaaaaaaaaauuguggaaccugagacuuaacauagcuaacuucuuacaccuuaaaauguuauucauuuaucuuuuuuuuuuuuauuuuuugagauggagucuugcucuguugcccaggcuggagugcaguggcaugaucuaggcucacugcaagcuccgccucccagguucaagcaauucuccuuccucagccuccugaguagcugggauuguggacgugcaccacuacacccggcuaauuuuuguauuuuuaguagagaugggguuucaccauuuuggucaggcuggucuugaacuccugacuucaagcgauccgcccaccucagccucccaaagugcugggauuacaggugugaaccaccgugccuggccucauuuauuuaucuuauuuugcgauguucaaaguccagaaggcaaaagggcagguauauaaugaagucuccuucccauucuguuugcuagccaucuauuucuucucuacaaaggaaacuauguuaguuauuucucguguauccuuccaaaaacuuuuuauggacauaaaagcaaauacgaauauauauuuucucauuuuuuacacaaauuguaauaaucuaugcauacucuuauguagcuugcuuuuuguauuuaacauaucuuggagaugauucuguagcaguacucuacagguacggaguauucuauaauaugaguaugcgaugguuuuagaagucugcaugggauauuuacauuguuuccuucaagaauaacaugguauguggauuauuucaaacacauguucuaguuucauaugaagaugugcuuuuuaauguuuuaaaaaaauugugauugagguacaacauauagacaguaaaauacuaaaguguauagcucagugaguuuguacgcaugucuacacugcgucuccauuagcuagauaacuguucuaagggcuugcuuucuugaguugcacaauucccuguauuuaccuaaaggauuaauuaaaggaaccacuucuacuuguaucacaccaugcuggucucuuucuauuccacuaguucaguaaagaaagaggacacacucuuuuucccucuaaucagauggguagggauagguuaagagauaagugagucuugucuguagaguucucuauucucaaucaucuauagcaugcuuggccuuauagcuguuuagcuuuuuauaaagaaaugcucccccaggugagguggcucacgccuguaauccuagcacauucggaggccaagguggacggaucacuugaggucaggaguucgagaccagccuggcuaauguggugaaacccugucucuacuaaaaauacaaaaauuagcugggugugguggugcacgccuguaaucccagcuacucgggaggcuaaugcaggagaaucacuugaacccgggagguggagguugcagugagcugagaugacgccacugcacuccagccugugugacagagugagacuccauuucaaaaaaaaaaaaaaagguaaugcuguuuuuuucugaauggcuaagaaaauggaguacagguugacuauuccuaaucugaaaauuugaaacccaauccaaaaauuugaaacccaaaaugcuccaaaaucugaaaucuuuagaaugccaacuuggcacucaaagugcucauuggagcaauuggauuucagguuuucagauuagggaugcuuaacugguauguauucugcaaauauuccaaaauuugaaacacuugugguccuaagcauuucagauagcagauacaugaaauguguugacauuuagauaauuuuagucaauaaaauguaaaacacaauuacauuauuuggaaauuucuggaaucaaugaauuuucuccuucugcuaauaccugccuaaguaaaauuaaagugaugauuuaauaucaauuuguucacagcuuuguuugcuagcaaaaugcuuuaagccugcccuuccauaucuugacguggauaugauggauaucuguaaagagaauggagccuaugaugcaaaacacuuuuuauguuacuauuauuauggagggaugaucuauacugggcugaagaacuuugaaagagcucucuacuuuuaugaacagguaaucucucuaaaaauuagcugagguuguucugaacuugugugaucaaaaaagugcucccauagguuuguggcuagaguggucugaucccagggccuccguuucagguguugguccuuucagagacuacuucucugugaucauguaaauagugguaaccugaucccuaaguugaggagcagcgccagugcauagaagagcacuugucuggggguucuaaucuaggcuugcacuuauaccuuaucugauuuggaauaaguuaugacaucucuugaccuuuauagcuuccuuugcauauaaggaagagauugaacugagugaucuugguugugucuuauucuaaaaccaugugugguauuuuguuaaguuuuauuuaaucagugaaacauucucuugauucaaaauuuaaaggguagaaaggaguacacaguaaaagucccucccacccuuucugugucuguguaaugaaacauaguacacaauuugguagaauauucuggagguuuacucagacucugaaaaagagauacacaauauugauuaauaaaccacuuuacuuaagguaaauuaguuagauguucguaaguuccuauuuaguucauagcauguauuaaguaauaaaggauauuuaaaaccuucagagagcucgguuuaguuggaauucuaauacauaauacacaugcauacauguacacacauccguggcucugaaccauaccacaaugagugguugauguguccuguugaggggaccugaggagggccaccauaaggugccaguaggcagagauggugucauuaaagcacgugucuagucagguuaaaucuucaagguggcuucucuuuaagacuacgcauucggaaaauuauaaaaaugcacuucguagccacuggaugcauuaucauugcuguagccaaauauaguuaacucaugagcaaacuugaucuugaaauaucaggaugaguggguguuaaaaagguaagaggcguccgagugcgguggcucacgccuguaaucccagcacuuugggaggccgaggccggcggaucaccugaggucgggaguucgagaccagccugaccaacguggagaaaccccaucucuacuaaaaauacaaaauuuagcugggcaugguggugcaugccuguaauccuagcuacucaggaggcugaagcaggagaauugcuugaacccaagaggcggagguugcagugagccgagaucgugccauugcacuccagcuugggcaacaagagcaaaacuccaucucaaaaaaaaaaaaaaaaaaaagaaaaggcaagaggcugggugagguggcucacaccuguaaucccagcacacugggaggccgaggcaggcaaaucgccugaggucaggaauucaagaccagccuggccaacauggugaaaaugucucuacuaaaaaugcaaaaauuagcugggccuggcagcaggcgccuguaaucccagcuacucaggagacugaggcaggagaaucucuuuuuuuuuuuuuugaaauggagucuugcucugucgcccaggcuggagugcaguggcacgaucucggcucaccgcaagcuccgccucccggguucacaccauucuccugccucagccucgugacuagcuggaacuacaggugccugccaccacaccuggcuaauuuuuuguauuuuuaguagagaugggguuucaccauguuagccaggauggucuugaucuccugaccucgugauccgcccgccucggccucccaaauugcugggauuacaggcaugagccaacacgcccagccaggagaaucucuugaaccaggagauggagguugcagugagccgggauugcgccacugcacuccagccuggguaacagagacucguccucaaaaauaaaaagacaagaaaguggccaggcgugguggcucaugccaguaauccuagcacuuugggaugcugaagugggagcauugcuugagcucaggaguacaagacugaacaacauagugagcaacauaggagucagccugagcaacauagugagacuccauuucuacaaaaaauauuuuuuuuuuugagacggagucucgcuuugucgcccaggcuggagugcaguggcgcaaucucagcucacugcaagcuccgccuccuggguucacacccuucuccugccucagccucccaaguagcugggacuacaggcgcccaccaccacacccggcuaauuuuuuuguauuuuuaguagagaugggguuucacuguguuagccagguuggucucgauccccugaccucgugauccacccaccucggccucucaaagugcugggauuacaggcauaagccaccgcgccuggccucuacaaaaaauuuuaaaauuagucaagcaugguggcccacuccuauagucccagguacucaggaggcugaggcaggaagauugcuugaacccaaggaguuugaggguacagugagccauaauuacaucacugcgcuccagccuagaugacagagcgagacccugucucuaaaaaaugcauaaauaaaaauaaaaugaauucuaucucaauaaggcuguuauaaaaauaaugggacauuuaaaaaguauuauugacuuauaauuaaugugauacaugugguugauuguuguuugcuacugugguauguucucuuuacagcaagcauucuucucuugccuaggcuauaacuacuccugccauggcggucagucauaucauguuggaaucauauaaaaaguauauuuuagugucuuugauauuacuuggcaaaguacaacagcuaccaaaauauacaucucaaauuguggguagauucauuaagguaaguuuuuuacauaaaacugauuucuuacgugagcauguugaguauauaaagaaauugcaaugauacaguucuguaacuucguuuuauacugauuuagcucuccuagcagcuucaggugagcagacauuuauugaaugucugcuacacauucucauuaccugauuggaauggaauauuucucaggaacccguuuucaaacuugugcucuagauacuuacagcuauagauguuuaagcuccuauaacaguugauuuuuuuuuuuuucccuagagacagagucucgcuauguuggccagguugguguugaacuccuggccucaagcaguccuucugcgucugccucccagagugcugggauuacaggugugugccacugagccuggccuuuauuuuguuuuguuauauuuuucauuuuauuuauuuauuuauuuauuuagaaauggaguuuugcucuugucaccaaagcuggagugcaguggcgugaucucagcucacugcaaccucugccucccggguucaagcgauucuccugccuuagccucccgaguagcugggacuacaggugugugccaccaugcccagcuaauuuuuuguauuuuuaguggagaugugguuucaccguguuagccaggauugucucgaucucuugaccucgugauccacccgccucggccucccaaagugcugggauuacaggcgugagccaccaugcccggcccugucuuccuucuugcuagcagaaguagcagauuguccuguugcaucuggugaggugugagaaagagagagggagaguugggaaugaugaauguuuugacuccuuucuucucuauaugauuuaucaguagaaaaacagaagcacugaugaagacgugugccuucacuaaauucaguggguuuucaccugcuguguuauuacuuggucuguaguacaaaauuuuguggaaaaugaauuacuccauagugacuuucuaucccuggucuuaaaaaccaggcauuugcuuuggguaaauuauaauuuguaggguaacaguguguaguuaccugacaauaugggauauacuugcuuaaaaaauaguauguaaguguguuuuugcuuccuauacacauuugagucuucugaaguuuguuuguuuguuuuugguuuuuuuuuuuuuuuugagacggaguuuugcuuuguugcccaggcuggagugcaguggcacgaucuuggcucacugcaaccuccaccuccuggguucaagcgauucucuugccucagccucccaaguagcugggauuacaggcaugugcuaucacgcucaguuaauuuuguauuuuuaguagagacgggguuucuucauguuggucaggcugguguuuaaccccugaccccaggugauuuguccgccucggccucccaaaguguugagauuacaggcgugaguccccacaccuggccucuucugaaguuuuaaucugaauuuuuucccuccuuugcaucuuuagccucuuagcaaugcauaccacgaguuagcacaaguguauucaaccaacaaccccucagaacuccgaaaccuggugaauaagcacagugaaaccuucacucgcgauaacaacauggggcuggugaagcaaugcuugucaucucuuuauaagaagaauauucagaggcuaacaaaggugaggaaagugccaccuucacagggcagcuccugacccccugggggccauguuucccuuucucucccuuuucagagcugaggaagcagguacagggauaaagcauggcaggauuucugugcugagagagaacucucuugugauuggcuucuuagaaagaauuugauguauaccuuuggucuuuucagggcuagagcaggguauuuggagcaggugaagaggaagaaagguaggagacaaggcuacauugggagacagugaaaggcagccucagagaggucagcagcuccagcagggcagaugagggaugcuaaugaugcagaccucagugcacugucaccagccuugcaaccugucuguucugucugugcugaucucuauuagaacauuuuuuuuuuuucucucuugacacagugccuugcucuguugcccaggcuggugugcaguggcgugauuucggcucauugcacccucugccuccugagcucaagugaucugcccaccucagccucccaagcagcugggaccacaggugugagccaccacgcccagcuaauuuuuguauuuuuuguauagacaagguuuugcuauguuggccaggcggucucgaaccccugugcucaugugauccaccugccuuggccucccaaacugcugggauuacagacaugaaccaccgcacccagccaaugagaacaccuuaugugaacauaguacuacucggacauuaccauuuaggccaggguuguacaaacuuugugcaauugacuucuaggauguaagccaauuauauaauuuuuauuuucuucuaggauguaagccaauucuauaauuuuuauugucaagaugaaaauaaccugcuagguuuugacuauagaaaauaugcuuaaugucaaacguucaaacaguacagaaaaauaaugaaaaaugaaauuuuuuguguuuuaggaagguauaggcugcaaguuacaggaauccuguagcucaacaaauagaggauugcuuuuuucucuugggaagucuggccagauaugcauaguucacagcugcugagaacacagugcaucuguuccugugcacauccuuugccuugugucagccauggugaugcaugguuggggacgagccaaggaaccagaauaggguagcuguuuuuuugcuaggcuacccagcaauggaaaaggcugauggauuuggcuacgugaggacuuaggggagaggugacuuccccuagcccaauggagaagcuagagaagagaggugggucgggguggccguugaggugggcagaccucauacaaggauaaaggauccuaaggagaagaggaaggaaggugaggagagggucaaugggcaagaaaaagaauccuuccaaauacucuagaaagacuagccauagcuucuagaauagaaggaaaucaguagugaauuuguaaaaaguuaauuuuuaugagagaaaaaugaagaacgugaaagagaaaucaagucaaagaucaaaaccaguguaacuugugagccagaaaaaccagcuugaccuacagguuuaaaagaccaggaucuaagagacuuaaauaacaagcagccuaauucucuccauaaaauuuucuuuuuggcccaagugccaacagaaccauucuaaguaaauuucugucuuuugccaucaagagguagccauuaaaaaacagcugccauuaaaaacacaaacucuguuugugacuaguaauugaaguuuagauaaaagaacccaaaugcuaacaaacauaaaagauaguacauguuacaaaagauguuaaauugcaaaauagcaaaugaaaauuaaauaacgguuucaaaaauuagcugggcgugguggcacauaccuguaaucccagcuacuuggaaggcugaggcaggagaaucauuugaacccaggagauagagguugcagugagccgagauugcaccacugcacuccagucugggggacaaagugagacuccgucucaaaaaaaauuuuuuuuugaucaaacaggaagagucucaacucgaaauggucuuuccagggcugggguagugacucacaaagucaucaagguccuggguccuucguauguugacacgaagugguggauugugguacacugagcucacaagcacugccugccagagggaccuggggagggcuaccauaagguauggugggcaggaaccgugucuuuaaaggacauagcuagucagaagguuacaucugugauaguggcugcuccauuuuuggcaugaugucccagugcuaaaaugaaaagaacggggaaacaucaaaggauuuuucuagccaaguuuuucuuacuagaaaauccaaagaagucucaacagguagacuguaucaguaggugauggcauggcugggauggaaggcagcuggggauggguuaaaucugccaccucucccauugaaauauuacuuuguguuaacauuuuaguagauguuuuucuuuuucuuuuucuuuuucuuuuuuuuuuuuuuugagacggagucuugcucugucucccaggcuggagugcaguggcucgaucucggcucacugcaagcuccaccucccggguucacgccauucuccugccucagccucccgaguagcugggacuacaggugcccgccaccacaccuggcuaauuguuuguauuuuuaguagagacgggguuucaccguguuagcuaggauggucucgaucuccugaccucgugauccgcccgccucagccucccaaagugcugggauuacaagcaugagccaccacgcccggccuaguagauguuuuucuagguuccucuucucuguuucuuuucuauguguaugcauagacucucccaguuauauguaauuggggucauacucuacgugcuauucuugacccugcucuuuuguuuguuugguauuuuuucuuuuuuuuuuuuucugugacugagucucgcucuguuguccaggcuggagugcaguggugcgaucuuugcucacugcagacucugccuccuggguucaagcgauucuccugccucaaccuccugaguagcugggacuacaggugcacaccaccacaccuggcuaauuuuuguauuuuuaguagacacgggguuucgccauguuggccaggcuggucucaaacuccugacuuuaagugaucugcccacuuuggccucccaaagugcuaagaugacaggugugagccaccgcgccuggccuacuuuuacauuuuuuguagagaugggaucccacuguguuggucaggcuagaauguugacuuuugagucuuuguuuguguuaaacuacuuguguacuucuuaaaguuagcaguaauuucaauuucuuggguacuauucucugaacuaaaguauauguagguuuuaaaauuauuggcucaucaagaauuuauggccaggcacaguggcuuaccccuguacuuccagcacuuuggggagcugaggcaggaagauacguugaaaccaggagcuugaaaccagucugggcaacuaaguaagaucucaucucuacaaaaaauaaaacaauaaaauuagcugggcacaguggugcacaccuguagucucagcuacucaggaggcugaaacaggagguucccuugaacugcuaugaacugugauugcgccucugcacucuagccugggcaacagagcaagacuccaucucaaaaaaaaaaggaauuuucaagaugaggguuuuaauaugcccagcucugaaaaugccauuguuguaaauauuaccagcugccauuaagaauagagcucuuuuaauauguuucugaaaggggucauuuucaucagaucccaagagagcagugguaaacacugguuucccucaucacaaguguguagccucuuuuauuuaacucccccauuuguuuaaaaauguuaacuuugaauuuugaaugaugaauguuauuuuuucaauuauauuuaauagauuauacauuuauaauacaaaauucaaaagaugaaaaucuucauaaugaugugcauaccuuggauuccuuuucaguuuacauauauauauaaaauuauuuuucauuacuccucuaggaaauugacaaaccacuggguucaucaguuuuuauuuuuuuauuuuuuuuugugacagagucuugcucaguugcccaggcuggagugcaguggcgugaucuuggcucacaacaagcuccaccuccuggguucacgccauucuccugccucagccucccaaguagcugggacuacaagugcccaccaccacgcccggcuaauuuuuuuuuuuuuuuuguauuuuuaguagagacaggguuucaccacguuagccaggauggucucgauguccugaccucgugauccacucgccugggccucccaaagugcugagauuacaggcaugagccaccgugcccagccuaucaguuauuuauuuauuuauuuauuuauuuauuuauuuauuuauuuugagauggagucucacucuguugcccaggcuggagugaaucacgcgaucucggcuugcugcaaccuccaccucccaaguuuaagcgauuauccugccucagccuccugagcagcugggauuacaggugccugccaccaugccuggcaaauuuuugcguuuuuaguagagguggaguuucaucauguuggccaggcuggucuggaacucuugaccucaauugauccacccaccucggccucccaaaguggugggauuacaggugugagccaccaccccucgcccaucaguuuuaagucaucuacacaaaucuauucuguacaucaaugggaagagcucuguacacuuuuuuuuuugaaauagagucuugcucugucguccaggcuggagagcaguggcgcagucucagcucacugcaaccuccaccuccuggguucaagcaauucucugauucucuugucucagccucccaaguagcugggacuacagacgcaugccaccacgccuggcuaauucuuuuuuuguuuuuuguuuuuuguuuugagacagagucucacuuugucacccaggcuggaguucaguggcucagucuccacucacugcaaccuccgccuccuggguucaagcgauucuccugucucagccucccaaguagcugggacuacaggcgugcaccaccauaccagcuaauuuucuguauuuuuaguagagacaggguuucaccauguuagccaagauggucucaaucuccuggccucaugaucugcccaccucagccucccaaagugcugggauuacagacaugagccaccacgccuggccgcucuguacacauuuaauaaaauguccuuccuucguuguuccuaccugugacuaauucugcuucugacuuucagaccuuuuuaacucuaucauuacaagauauggcaagucgugugcaguugucuggaccucaggaggcagagaaauacguucugcacaugguaaguggauuuucuuuuucuuuuucuuuuuuuuuuuuuuuuuucuuuuugagauggagucucgcucugucaccaggcuggaguguaguggcacagucuuggcucacugcaaccuccaccucccggauucaagugauucucuugccucagccucccgagagcugggacuacaggcaugcgccaccaugcccggcuaaauuuuuguauuuuuaguagagaugggguuucaccauguuggucaggcuggucucaaacuccugaccacgugaucugcccgccucgggcucccaaagugcugggauuauaggcaugagccaccgugccuggccuugauuuucauuuuuuugaaaauuaauuacuggauuuuuguuacuguaagaguaacagauguucauuguggaaaauauuaaaaaggagaaaagcggggggagccuccaaagucuaccacuauugacaauuuggucuguuuccuuauaguuucuaguuuuagugugcucauaugauauacacaucaggcuugcguccuauuugugcuuccuuuuuuuuuuuuuuugagauggcuucaucuuguugcccaggcuggugugcaguggugcaaucucggcucacugcagccucaauucccuggguuuaaguaauccacccaccucagccucccaaguagcugggacuacaggcauguaugugucaccaugccugacuaauuuuuguauuuuuuugaagagaugggguuucuccauguugcccaggcuggauuugaacuccuaggcucaaucugcccuccuaggccucccaaauuguugggauuacauacgugagccacugugcccagcccuguacuccuuauuauuuucuuuuauuuuauuuugaggcggacucucgcuuuguugcccaggcuggagugcaguggugugaucuuagcucacugcaacccccaccuccaggguucaaacaauucuccugucucagccucccgaguagcugguauuacaggcggcuauauuuacauauuuucauuaucagaauuuuuguaaaccucauaacccucaugaaauauuuuugguauacaaagagguauaagguagggcuacuuccucugcuuaucugugaugagaucacaagcuuuugccaguacguacaucaagcaacugcugcagcaagaaaucuugcugaacaauguuugcugaacuacacagugugcuuagcgacaucauugacugacauucugacuuagccucuuccgucacugaggguuuugguccauaagcagcacugacauaaaggaggccagagcacacacccaggacuuagcauccagcuuaggaaaugaaauagcaccagugcccugacacucccucuuuaucaccugccaguugcauuuccccacucucagccccaccccaaccaggcaaccacuccugauuuggauaagcaucauuuaaaugacuauaugauaacccaccacauugauguauuguaaucuaccuaccuauucaguuacauaaguacauaguucugaucugguuuuaguucacugaaaaccuguguccuuagcucaggacaggcaaagcuucauaugaccccuuguaugauuucagaauuuggaguauuuugauugauugauugauugauugagacaaggucuuccuguguugcccaggcuggagugcaguggcguaaucauggcucacugcagccuugacugccuaggcuuaaaugauccucucaccucagccucccaaguagcugugacuacagaugugugccaccacacccagcuaauuuuuaaauuuuuuguacaggcagggucucuuuauguuggccaggcauaacuugagauuucuggccucaagugaccuucccaccuuggccucccaaagugcugggauuacagcuggauacagccacugcacccagcugaguauuucauuuugauaguugaauuuacaaguguucuaaaggguuuuuugcuucaaccuaccauucaaaacaugcacacaccaaacaaaaccauaccucuaugacuugugucugcuaagagcaucuugguaaccccacagggguuacacagaauaagcuauagacgcuuuccccaagaaauucccucuucaguggcgagugagaagaaauacaugagugguuaugacaccagacaggacauacuagcuagcaacgcguugcggggucaaagugggugugaguuuugagcccugcuuaaccagcccagacacccugacaggcucuggagcagugguucuccucugagggugauuuugucugccaggagacauuaggcaacgucuggaagcaguuuugguuuucacagaugggggugcuacuggcgucuaauggguacgggccagggaugcugcuaaacguccugcagugcccaggacagcccacacaccaaagcguuaucuguacccaggacagcccacacaccaaagcguuaucuguacccaggacagcccacacaccaaagcguuaucuguacccuggacagcccacacaccaaagcguuaucugcccccaaaugucaggacugccaggcuugagaaacccuucuggaaugaaaggucugugagaccaggguuuuuuuuuguuuguuuguuuuuuaaaguaaacauuggaaaaguacacuuaaguguacggcuaaacacauuuucacaaagauuccaacaccuagaagaaggaacagaauaugaccagcacccggaaaauaucccuugugucugcuuccagcccugugccucucuagaaagguuguucccauccugacuuuuuuuuuuugagacggagucuugcucugucacccaggcuggagugcaguggugcgaucucagcucacugcaagcuccaccucccagguucacgccauucuccugccucagccucccgaguagcugggacuacaggcgcccaccacuacgccuggcuaauuuuuuguauuuuuaguagagacgggguuucaccauguuagccaggauggucuugaucuccugaccucggccucccaaagugcugggauuacaggcaugagccaccgugcccggccucccauccugacuucuaacauccuauuuuaguucuguuuguuucugaguuugauguagaaggaaacacacagcacauucuuucugggaaucugguuuuuuggcucagcauugugagagucaugcaugaugcuguauguagccguaguucauucguuuucagggcuacaauguuccaguguuugauacaccuuuccauuuuaauuaguuggacaggcugggcguggugccuguaaucucagcacuuugggaggcugaggcaggcagcucaccugaggucaggaguucaagaccagccuggccaacauggugaaaccccgucucuacuaaaaauacaaaaaaaauuagcuaggcaugauggcgggcgccuguaaucccagcuacuugggaggcugaggcuggagaaucgcucaaacccaggaggcggagguugcagugacuggagaucacaccauugcacuccagccugggugacaagagcgaaacuccgucuccaaaaaaauaaauaaauaggccggguaugguggcucacaccuguaauuccagcacuuugggaggcugaggcgggcagaucaugaggucaggagaucgagagcauccuggcuaacauagugaaaccccgucucuacuaaaaguacaaaaaauuagccaggcgugguggcagaugccuguagucccagcuacucgggaggcugaggcaggagaauggcaugaaccugggagguggagcuugcagugagcugagauugcgccacugcacuccagccugggcaacagugcaagacucuugucucaaauaauguaaauaaauaaauaguuagacauugggguuguuuccaguucugguuaauuuauuaugaauagugcugcuguggugaagguagguccaaauuuugcuuagauacauuccaucugcuuaaagaggcagcucucugugaucacauagagaacuaugcauuuuguauaauauguauugggcugguuacuguuucacuaaauagcaucuaucccuuccaaagcuagagacaaguaggccagcaguuucacugcuaacaaauggacaaguuauuaucaccguguggaacaucuuguuaggaauaaaauaccuguuuuguacuuuuauugguaucucacuuuuuaacuucaugggcaggauuuggcuuugaggaucagucaaauaauuccccaguaacugaugcaaauaaauaauauauagaccuugaaucuaccuuggaauccccagugguaguaaaguuuucuugaagaaucggaagauaguuuccacugggaugaaaagaaaacguguuaggcuuuacuuuuuaaaauacaguggcccagccuggccaacauggcaaaacgucaucucuacuaaaaauaaaaaaaauuagcugggcaucguggcacauaccuguagucccagcuacuuaggaggccgaggcaggagaauccccugaacccaggagguggagguugcagugagcagagaucaagccacugcacuccagccugggcaacagagcgagaccccaucucaaaaaaaaaaaaaaaaaaggcgauguaaguuauauuucagugcagcugauguugaaaaaugcaagggcaccucaaauacaucaugcuaagggaagccagaccacaaaagauuacauaguauaugauuccauucauauauccagaaaaggcaaauccauacgagacaagaacagauuggugguuuccaggggcugggaggagaaggagggaauggggagggacugcuaaugggccuagggccucuuucuggggugacgaaaaugcuccagaacuagauagagauggugguggcacaacauuguagaaugcauuaaaugccaauuaauugcucacuuuaaaaagguaggccagaugugguggcccaugccuguaaucccagcauuuugggaggccgaggcagguagaucacuugagguuaagaguucgaaaccagccuggccaacauggugaaaccccguguuuauuaaaaauacaaaaaaauggcugggcgcgguggcuuacgccuguaaucccagcacuuugggaagccgaggcggauggcucaccuaaagucgggaguuggagaccagccugaccaacauggagaaacccugucucuacuaaaaauacaaaauuagccaggcgugguggugcaugccuguaaugcuagcuacuuaggaggcugaagcaggagaauugcuugaacucaggaggcggagguugcagugagccgagauugugccauuacacuccagccugggcaacaagagcgaaacgccaucucaaaaaaaacaacaaaaaaauuagccuggugugguggcgggcaccuguaaucccaguuacuugggaggcugaggcaggagaauugcuugaaccccggagguagagguugcagugagccaagaacgcaccacugcacuccagccugggggacagcgagacuccaucucaaauaaauaaauaaauaaauaaauaaaaugguuaauuauguuguguggacuucaccucaauaacaaaaaugcaagggcagggauuuuguguguaucaguuuuacaccucuuagcaucuauaauggugccuagcaaauaguagguauuuaauaaauacuuggauaaacagauggcgcuuaaaaauauacaaguuuauuuauauccauguugccuuccaugcuuuucugugauuauacuggaugacuauucauauagcauucaggucuaaacugcuuuccugauuuuuuuuuuuuucuuucugcagauagaagauggugagauuuuugcaaguauuaaccagaaggacgguauggucaguuuccaugauaacccugaaaaauauaauaacccagccaugcuucauaacauugaucaggagguaaacaugaaugccagguuuuuauuuuuuuaauugaugguugagauguauuugaaaauugcuccuauguuccaggauaauuuuaguuuuaaguacagguaguucccagucugugaacaucuuaguuacuagaaaguuaguuucaaaaugggcugcuuaaggagaauugcuugaacccuggagacggguuacagugagccgagauugugccacuguccuccaccuugggugacagagcaagacucugucucaagaaaagcagcaacaacaacaaaagaaacccagaaugggcugcuuaaaacucuuccaggcugggugugguggcucaugccuguaaucccaacacuuugggaggcugaaguggguggaucagcugaggucaggaguucaagaccagccugcccaacauggcaaaaccccgucucuacuaaaaaaaauaaaaaaucagccgggugugguggugcacgccuguaaucccagcuacucuggaggcugaggcaggaaagucucuuagaaccugggaggcagauguuacaguaagcugagauugcgccacugcacuccagccugggcaacagagggagacucugucucaaaaaaacaaaacucucucagauuguauggcuguaaauaaaugguggguuagauaucccagcuaacucaucaaaaccucccuuaacugugaaaacacuuaaagggcccaguauaacuuuaucuauucccagcugccaccuacaacauagagccuuauguuuuugcugaaaugucuguggaguuccagguugggagguuaggaaacaucucucccuaugugagaagcagagucgggguggcuggaggagaagagcaaagcccucccugacgguccccuuuaggcaacagccuggcuacagcugcagcagucaccucugugucuccugagggcaugcugccucugauucugggggcugaagggggaguuuuguggguggucuguguuucuuaccucugagcagggaagugaacugaauauuaaaucucagaaaacuauguuuuuuuguaauuaauuuaauggcaaaaugucaccugaaauggugucuagucuucauuuaucucagcaugaauauacucguuucacugcaaaagauacuauguguuugauuaugagguuugccuagauccugcugggugggauauuugguauuauaugauagauguauuagcuuucugaguccaaaauacucuggcuccaaaacccauguggccccagggguuucacaucaagagauugugaaccuauagcacccuugugaacaguguaaguuagaaaggaugcagcugaccuaaacccgccgcugaccaccuucuaaugugccugucaugcagaugcugaagugcauugagcuggaugagcggcugaaagccauggaccaggagaucacagugaacccucaguuuguacaaaaggugaugaggguucccuuauuacaagaaguaggcuggguggagaaggagggguguugucacaucaggcacaggaacuaaguuucagguuauuaaauauuucuugaaaaccuuaccaguacggucauggagaaauacuaguugagagcauuuucaaaugauggccuggaaguacacuuagggaugcuuagggugguuccuggaauugccugcccuuguucacagggggcuuuguucugggagggacagggcaacuggugugcuuauugggcugccggggaacccuugauaaaagcaaacauaaauacauaacuucacuuuaccuuuacagaguaugggcucacaagaagaugauucaggaaacaaaccauccaguuauucuugaaacuaacauccauccugagcuaaacaagagaaacuaccaucuuggccagugacaaguguucggagggcagcagagaggaccaagccugugucaccuggagacuaagaaauuaaguuuuguuuugacaucuucaguccugugugcuuucagaaaaccauuuucucugcaaagaaaggaaacagauuugcaaacuuuaaagucugucguggauuuauuuauccucagauuauuguuacugcauuaaaucuaccuuuuuguuuuaaguugcuugaacauuaaugugucuucuguaucacuuuuuucuccucugaaguuuuuaauaagcacauucauugugaacagaaauagcuggauuuuaggaauuuuuggaagauuuggaucugaaagguuuuuauuuauugacaaauuuguaucuacaaaaaaaucuaaaaguuguaaucauugucuucagaaaauaaaagaaaagaaaggcca

SEQ ID NO: 192247 - RNA, 26401 nt, Homo sapiens
uucaaaauauauuagauuugguuuuuauuguagagcacacauaucagggcgaagugcugcacacacaacuacaaaucauuuuugggaaaaaagcuguaaaaaaaauaaaacugcaacugcuuuaauuaugcagucccgacuugagaaauccacgcuggcaaaggaguucuggccccugagaggggcuucuugaugguggcugccccagauuucugcagccuaugaggucucagacccggaccucuguacacaaagcccccaaaguggugguauccugguugcugggagggccucugcucuuggcaagcccggguccuggccuggcugacaagaagacauuccuaaugaaucuagauccacaaaaccuugcugccuuccaggaucugaguggauagaagcuaccaaagacuuuaccuuuuuuuccuuauuauuuuuugaaagccccuucaccaacucccauacccugaagcggaggaggcaccagcccagucugcaggccugagcucuggccuuggaugcaugcugccggcagacaagauggggcaggcgccuuccuagaaggaugacaugaggaugaggcccaagcuggccaguggagaagggaagggaaaggaaaaagccaggagacuaaagggggaaaaaaaacucaaaaaagaaaacaaaaacccuaccacacaccacaacaauuuuccauaccccaaaugcuagacuuggaaggacaccagucccucuagcuagaaacaauuucuaaaacugacccaacguggcaagucuaacuguuccaaauaaucacacgcauaugcucaaaaggagcaaccagcaaagaagugugcucuugauaagagaggucaggaccacugcacuagccccucagcagcccaaggaacuguggacauggcaggcuagugggcguggguggaggacgccuggggggcuuaacaauagcuuugggauggcaggggcuggcacuguuuaagccccugcccaggcaaccugaacaacucugccgcaggaggaagaaaggguguuugcaugagcuugcagggcguggauggcaggugagaaguggagaacagcagagccugugaggcuccaggagaccucaaccaagugcagacaucagugagggaaaggggcgagcagaagacugaacuuuguuuagaacacugcgaagauuuacacugaaagcaaaauaauuuucuuaaccaaaacauuuuguugcuuuuaaauaaacccagccugauacagccccacuuaaaagauggcugcucugcuccaccaccucuacuggccacuccagcaucagccucuguccccuauugaugccaacagccuuuccauccaggaggaauaccaagaauaugagaaccuagguccuggccaauucuauucuucagcccuaacaggcaacaaaaccaaggaaaaauauauagaaucaaaaaaaacaaaaaacaaaaaacaaaaaccccccaaugaacaaaaacaaaacccucaaaacaaaaggaggggcaacuacguaaggaugagccagaguucccaggagggcggcggguagacucagugccgccgcaucuucaccuuucgggcagggcugccugcugccucagagcaguccucugaggacucguaugacuugcgccaguaguucucagagcugaagcuaccccuccgccggugugugggcagcagcaccgagcgccgguucucuuccuuguccaucuccaggauccguggccugcaaggaaagggagguaggacguuaucugagaggcuggcaggaggcgccuggcuuuaccgcuguaccucgucucauccuugggaugggucacuucagcucagugguccucaacgaaggguaguccuggcagaggcccugguaucggagguucuugcccacuaagugccagugaccaucccagucuuugggacauuucccaauuacccuguggggucugccuggcuuggagucuggugcccugggacacugccagggcugcuggacagaggucuucccuaccacagccucaagacucugcaugguucugccaucuaccuuuacuucccagcucuacccacuuucucucucuugggccucccaacacccccuucuccacuuacuaaccccauuacccccugaaaccacaaagcucuuuuguaucucaggguuuagcucauacaguauuuccugccuagaaugcucuuccaugucuuccuuauccuucuggaaucaacuuaaacauuaccuccuuggaaaccuuccccaacacuuaaaaaauauuuuuuuuuuuuuugagacggauucuugcucugucgcacaggcuggagugcagcggugccaucucgggucacugccagcuccgccucccagguucacgccauucuccugccucagccucccgaggagcugggacuacagguaccugccaccacgccuggcuaauuuuuuguauuuuuuaguagagacgggguuucaccgucuuagccaggauggucucgaucaccugaccucgugaucugccugccuuggccucccaaagugcugggauuacaggcgugagccacugugccggccaaaacauuuuuuuuccuuuaaaaaaaauuaucuccucaaauaccuuuuauccaauccuuuuugaaauaagucccugguucacuauuauccaagucccaagauucccuccugacaucuaaguauaauuccacaagggugucugggugagacugaacaaggaaagucaugggaaagccaugauauugccaucuguuacagucucugccugaccccuucucucuggguguacaggcaguuggccaggguuagaugggaaugucaccaaugccaccaacccagaggaaccagacauaagguuuugaaagggugagcaagccaaggcuccuaaacagccuaccccaggcuucuccacccuucucacccugcagccaggccuuugccagccuuugcugaggguccuaaacugaguaccugugggcagcaucagggucugccuugcggugggaccgcuuggguuucagagcagggucccuguuguuuccugacaggcgaucugaagcauagcugggugguaacacggagcugcucagggacuuuguuuccaaccggggugcaucuaaucuuguccugcaaaggaaacaugcauggggucaccaaagggccuccggugaaggugugggcaccaucagaccaauucucuggccaggccaagugggagccagcuagaccuggaagccagcagucucugcucuguaccucacucuccuugagguucaacuagagauuggucuagcugacuuucaaagacccuccucaaguccaccuuuaggaguaaggaaugggaacacuucugucuggaaacucccaaugacaggcugugcuacccuaggggcaagaucccagggcucgcucuuagcugaaccaagcagccucaccucacuccacuuggacccacagguucucuggggccaucuacuucauuugccagaggaccaacggccccacuggugggucccaacacaggaaggaucccugguccaggccuguagaggggcuggagagaaagagagccagagcuacccuaucuucucacugugcagacagggaugcugagacugaguggcagagccaggguagggaacccaggcccacuccacaaccaugagcagucaucuggcaguuucugcucauuucaggaugcugacaagguaaaggccagagggcuuuugaaggcacaguccccaccaagcagcagguguagccauagguuucaaggaauacacugccuaguaaagggaaggcacacaaauacagaugaggaagagggggauggagaagcuggguagcgguaacucagggcagugauccaaguccuuuaugaagccagaacagaagggagcuggcauggaaaaccucaaagcccucaggcuccuugugugguacagagaaggcuggcaagucaggcaggugggagcaaagggcagaaggacccauguaauagacugggugggaagcgauaggacauagcuagcagagacccugaaggcaccuuuuccagggucugcuagacacaaaguaguaacuuaguuccgaaggaguaggggcugcagucagagcaggacucuaaggauacuagaggaugcuggggagaaguaagcaggagggaaauccaagaacugccuugggcuaggcugcuuggcauccuugguaacaacugcaucugguccucaguuucccccauuccccauggcugccucuccacauuccacuggcuggccuacuguacauagaugggaaggaucagaaaggcaguaagucaugcauccugcaagucacgggggaaaguuuaaagccaaagugagacuucaagccugacaggcaagaguuacucugaacguggguaggaaaucucucuccuaaaggcagcaggggcaucuccuuccuuccagcugggaaccaauguucugaugccucaggcccaaacugguggguaggcagguaggacaggcauccccaucccuuuggguuggccuugcagagggggaugccaguagggcccagcugcagugagugacucuucagucucagacuccacucuggacuccuccagacucauggaugcagaaccuaacaucaacaggaggaugaucuaguuuuggcacugccauucagaguccaagcuagucaccaucccuccucgggccucaguuuccccaucugagcaaaagaaagaaaugugacuagcucuaaggcuucuuugcgcugagggucuaaggaaucgaaggcaaguugccuccuucaaggcugggauucucuggguagaggugguacugggcaacuaccagagaugaguaugugaaauagaauagaaccauucuuuuuuuuuuaaagagagaucguguuuugcucugucgcccagucuggagggcagugguaugaucauaacucacugcagccuugaacuccuaggcuuaagggauccuccugcccaagccucccaagaagcuaggacugggccaccaugcccggcuaaugguuuuuuuuuggcgagacaggguaccaccauuuugccuaggcuggucucuaacucuucuaagugauccucccaccucagccucccaaaguguugagauuacagguaugagccaucaagcccggcuccagaugagcuuuuuauuuuuauuauuauuuuuugagacaggggcuccuucugucgcccaggcuggagugcaguggcgggaucuuggcucauugcaacuucaagcgauccucccaccucaaccucccaagcagcugagauuauagguacccgcugccacacucggcuaauuuuuauauuuucaguagagacagcauuucaccauguuagccagacuggucucaaacacuggggcucaagcgaucugcccaucucagccucccaaacugcuaggauuaugggccugagccaccacaccuggcccaauuaccuuuucuauuuuuuuuuuuuuuuaagagaguuuuacucuuguuguccaggguggagugcacuggcacgaucuuggcucacugcaaccuccgccucccgcguucaagcaacucuucugccucagccucccgaauugcuaggauuacaggcaugcaccccaacgccuggcuacuuuuguauuuuuaguagagaugggguuucuccauguuggucaggcuggucuugaacucccgaccucaggugaucugcccguccuggcuucccaaagugcugaaauuaaaggcgugagccaccacgccuggcccaaugaccuuuucuuuaccaggcuucgugucaucaaguugagagguccagguggcagaaaucagacuaaauaaaauguuagccuuuauacuugacuuaaaggacucuaagggccucauugaagaaagucccuccucugguacccauaaagcuaagacucuauaggugccagggagcccauguucagggaaggaaggccccugugugccccaaaagccccagugaagcccuagugggggcacucuggaguuguuucuucgggugaaugauggaugguaggagaaaagcagagccaccaagaugagagcucuugacacauccccugggacuguuauaaguacaucucauaacagcuggagaagcuccugcccucccuacacuuccaaaaauucaccaagcugcaggaugccaggcuagagcuugacuccaagcccagugcccaccaguagcuuaacuucagaacaugccccuguuaaaaggcaaccaacucucauggcguaggccagguccucaggguuuagcagagagucacaaaucuggauucaggaggcucaguucuagcaguaaggucuggacccaggccuccucagguggcaacaggaaugaagaccugccuuacagaugagucaguauucaaaggucagagcaaagcaccucgggcaugugaccucgggcaugugagguugaccgugauacccagagcggccaccuaccgugucaggacaaagcagggacaagggaggucacaacaaaggauggcuguagcacuaaagugugaaccgaagggaagggagggaguugauccuauccuagguccuccagagaagcugcuggggugaauuauucucccuguagggacuggagagcaaagcuaaaucccagagcaaaucacuagcuugagucacaaagcuacuaccuacuacucugugauggccucuaaagcacagguggggccaggcacaguggcucacaccuguaaucccagcacuuugggaggccaagguagaaggauuacuuaaaagccaggaguuucagaccaaccugggcaacaaaguaagaccuugucccuauuuaaacucuuuuuuuuuuuuuuuuuuuuaaaagacaaucuugcucugucuccaggcuggagugcaguggcacgaucuugguucacugcaccuccaccucccagguucaggcaauucuccugccucagccucaugaguagcugggacuacaggugcacgccaccaugcccagcuaauuuuuguauuuuuaguagggacaggguuucaccauguuggccaggauggucuugaucucuugaccucaugauccgccugccucagccucccgaagugcuggaauuacaggcgugagccaucgugcccggcccuaauuuuuuuuuuuuaauuaaaaaauaaagugcaggugggcccuccucagugcaagagaacacugugcaugcagguggcagcaccaccauuucugggaagaugguaaaccagaccgcacucaggccacgaugacucuggagcgagggcaguccccagccagcuaccaacuacucuccaacgucuggcaccaccuuuaccaggcauccuugugcuaaaagcuuggcuuuccaacaaagcgaggcagagaccaguauugugggccuguccaagcacccucuugccuauuuaguaaccugggucccuagagcuaaggucuaagcuccagcaccuuugagaaucagacucccacaaagcucaggucuguaccuugcuggcucuccugcaguaguacccacuccccucacgggacucuccccacccaucuuccaccagcccccugccaacaucagacuucuguuuuuuuuuguuuuuuguuuuuuguuuugagucggagucucgcucugucgcccagguuggggugcuguggugcgaucucggcucacugcaaccuccgccuccuggguucaugccauucuccugccucagccuccaaguagcugcaacgacaggcgccugccaccaugcccggcugauuuuuuuuguauuuuuaguagagacgggguuucaccguguuagccaggauggucucgaucuccugaccucacgauccgcccgccucagccucccaaagugcuggaauuacaggcgugaaccaccgcacccggccaauuaauuacuuucuuugaaacaaggucuaucacccagccuggagugcacgggugggauuacagcucacugcagccuugaccuccugggcucaagcaauccuccugccucaggcucgcgaguagcucggacuauagguauaugccaccacaccugguuuuuuaaaucaaucaaucaaucuaucuaucaucuaucuaucuaucuaucuaucuaucuaucuaucuaucuaucuuaucuauccuaucuaucuaucuaucuaucuaucuaucuaucuaucuaucuaagauggagucucacccuguagcccaagcuggagugcaguggugcaaucuuggcucacugcaaccucugccucccaugcucaagcgauucucccaaguagcugggacuacagaugcaugcuaccacgcccggcuaauuuuuuguauuuuaguagagaugggguuucaccauguugcccaggguggucucaaacucccgcgcucaggcaauccgcccaccucggcuucccaaagugcugggauuacaagugcgagccaccgcacccagccaggaagaguuuagaagaccaccuagcauucacaaguuuaaccacaacugcccaauuuacaggugcagauaagacugcauuuggagaggaguggcagagccagggcagaagcccaaguuugucaccuuccuggugaucccauuguacccauauuccuugggcaggccacagacacaucagaacagucaggcugccaaaagggcaggguguaugcacguggacacagacuuacugaaccagggaacaaauguaagcuaaaucuaaccacaggagacacaaaucauggagaaaggagcaacaccaagcccuggucagagaaacuaagagcuagccaccccucaccccacugcugaggaacgagguccagaaugagaccuccacuuccuuccacugcucauccauccacucagccucacauucagauugcucugcucucauggaaggucuccugacuccucgaacucuguggaucuaaugaccaaguaagcuauugagcuucgcuuccuacaaucucucacaugcaaaucccucaccccacugcucacaugccuccacggcuccccagcgcgcuuaacauuucucugcacagcgugaagcuuuugcugucuuaggccgguguaucaaguccuccacuccuuaucuauucuguguuccagaacagaguuccuggacuccaagccucuguaaagagcaucucuucugacugaacuaucuuugccccugagccucauucuaugcuggcuaagguccaagcauccuugacuaccuucagguggcacuuaucuggaaagccuucuuugaccaguuccuguugagaugcuaaaugucugccuuuucccaaaggacaaaagagaauaggaacccauacaaaccccauuccggguacuagcacagagccuagcacacaccagcuuagguuaccacuuggcaaagggaucuccagcugcauuucccagcuucagaccacucugagcugaguuccacuugaccaaaagcaaauaaaugggcuauauauacugcuuugugccacuuuaucugguuaacuggagaguaccaaucucaagaauacaagucucacagugcaauccugagggccuccuaaaaaccaagggauugggugcccuagucaccaacucaaggccccgaagacccauaagccaucucuugagaaucaaauguugaccuaaggccuccuucccucuuucauuccucaucuacagaaguccccuauauuucccugccuccuagccuuugagcuuaccauuucugccuggccagcaauuucuagcucaggggccagaucuaccaagcucaccuuuacccuuccucccgcaaagcuggauguaauuuaaaaaaaaaaaaaauuuuuuuuuuuuuuuugagauggagucucgcucugucucccaggcuggagugcaaugguacaaucucggcucacugcaaccuccgccucccagguucaagcaguuguccugccucagccuccccaguagcugggaucacagacaccugccacuaugcccagcuaauucuuguauuuuuagaauuuucaucacguuagucaggcuagucuugaacuccugaccucaggugauccaacugccucgcccuccugaagugcuggauuacaggugugagccaccacgaccggccuggguuuuugggguuuuuuuugcagggcucccagagaauacccugugcuuuuacaccaguguucacucugcuuuguguuggaauggcaggcaaagugcaaacuuauuacaugugaagcaccaagggggcacuaaauuuccuguggugcccaccucaagugccuuguacauaguagauacuugauguuucccucaagucagaaaucccugcucaaaggccauuccaacuagcaaugaccugaggcagcucacuuccuaccugagccccuuuccaaacagaguucauaccuucuaguuucaagguuaauauguggaugcuuggcacagggcagcuagcaaggccuaccaggagcagaagcacagagugcacuagugcaggagcacuagggaaucaugggaaaacuggaagacuccccucacagaugaauuauuauaccccagaaguuugucagccucuugguuaucuaacuaguaauuuagaacuuuaaccacaccuccaguaagguuagguccagccuccccuuccaggguuaccaacgauuacagagaaaagacuugcaugcugcggcagcuugcccucggucggcugggagacaguaacauucagggaaguuugggggugcugaggcaccucaaagagccgacuagccuguagcugcugccucaccccacucucuguagagugcccccuacauacucauaacauucuccccaaucagcacaacucucuacuugcacagcagaggcaagaaagcccuucuauaucugagcuccaguuuccuaacucaaagcauccaucccaacgacacacugggggaaagggcaggacuugggguacuccacugugcaaaccaccaacgaaccacaagacccagguuccaggugucacucagccauuuacuggcuaaguugugaccccaaacauuauaacaccaagggacagucugaggauuccacucuggggagacuuuuuuaaaagguuacuuccagccuccccguaagaaacaagggcacaugugcaugaagacuuggcaccacccauguucacagaagcugcguucuguccaaccagaaagcacuuggcagcugcccacccauuuccuuccgugaggcccuuagaaagaccuuuccagcucugacugaccugagcuggugacagagcucccagggucuccaccagcagccugugcaaucuuuaucugaacuuaugagaaggcaggaccggcucuaacuccucuaccauaaucagggccaggcucaaugcccagauucuacccacuguaacacaaccucaccagaagacaucaaaccagccagguaucuuccaaggccacaucauacuuaucuccgggcaaugccugggccaagaugcuccccuuuuuaaacuugucacaacccguccuuucccaagacaaacccauguagcuacucuggagcugcuccucaccggccugaauuguucuccacacuaguugaugccuccucugggcugcaccucaugcuaggccccagaugaacagggaucuccuuacuccuacagaaugcagauuugaaaauucacaauggcaagcguaugagcugugacaguccaaacagggguguguguaugugucugcaugugugcugaaagggcuuuaggugaugcuaaaaagcuaaagggcuuuuuauaugaugcuuucugcaugucaaaauggucaaucugaacgaugaagaaugacuagguuaucugaggaguugguuaucauguagguuuauuuggggaguugggauaugaaucagaggaugaacauguuagaugagaagguaugcccaauggaggccacauugccacaagagcccaggcacaaauccauaaaccauaacaggagcugcagauacuuuagaguuccccacagcugugcacuuccccagcucagcuaccuggggaagcugggacauccucccacucuucuccaguccccuuacaccacagcucugugcuucugcacuccagcccagucugugaaugguuccugggcccacugaagucagaagguagaagagcuucagucacccaguaacagccauucccaaggucaggccacuggcagggaccuagcuggcugaaaagcuucccagggagcugauuaacggugcagacuccuagcugugcugaggagcaucugacucaguuggacugggcggccagguaugggagucaccauucaauaaaagaguagcagcuggaagacugacacuccagcuauggccacuaccaccugcacauccaacuaagauuuccccaaaauaagcuauuaugggaagaugagaggaacucuugggaaguuacugcucugguucuauguaacauuagaaguuccucuccagguuccuggccugggcaggccacccaucccuggcugcaguuggagguaccagguacagccugagaagaaaugacuggaggagaggcuggaagagugcuacacucuggacuccauuguuuccgaguucuugccuaugcugguuaucacagaaaaauaaaguacaaggcagauaaaaacucuucccuuccucugacaaauucugggaacagucuuaggcuagaaaagagaggcugccaaccccaccaaguugacccaaguuucuggagcucccacguguucacugcucugccuguaccauaggacugucccacagauauggaucauacccaucuacuauaguuaaaacagacuaaaaguuuugacuuggcaaaguggcaaagccauaccaaagagacuucaccacuacaauauucuggaguuaugggcccaaaggaccaggaugccaaaguuauuguuuacugacuaaaguugaugcaccagaaaaaauucccaaugaccaaagcuggaagaauuugagcauaaaauaaauuccuaggaguccauacuuacauaaaaaauauacuuauauaaauaaaugauugaauaaaugaaggagaguagaccaauccccccugcagaagaauucuaaguaauucaccugcaugcucccccucaaggagauggugcuaacucccacacucuuuaacugugggcaugcauggugacuuccuuccuaaggguacaguauggacaaggaaaaacaguaauuuuacaguggaaaaccugacagugcauuggccagaugaucaauaucaauaguguuaaguuacauugauaguauauauucuugguuauguaguaaaaauggcauacacuuuaccauaaaaacaucagacaaauucuaauugagagauuuucuauacaauaccuaaccagucaauaucaucaagaauaaggcaggcugggcaugguggcucacaccuguaaucccagcacuuugggaggccaaggcaggugaaccacuugagguuggaaguuagagaccagcuuggccaacaugggggaaaccccaucuguacgaaaaaauaaaguuagcuggguguuguggcacacgccuauagucccagcuacucaggaggcugagacacgaaaucacuugaaccugggacgcagagguugcagugagccgagauggugccacugcauucccgccuauuccagccuaggcgacagagugagacccugucucaaaaaaaaaaaaaaaagaauaaggcaaagucugagaaacuguuacagccaagaggagucuaagaggagucugaguugauaugucaacuaaauguaacguaggaugaucuugggacagaaaaaggacauuaggaaaaaccuaaggaaaucuaaauaaaguauggacuuuagucauaccaauaaaaaauuaacaaauaggagaaaugggaugcagaguacaugagaacucuguacuaucacaauugucuguaaaucuaaaacuauucuaaaaaauaaaguuuaauaaaaggaaggaaggaagaagacgacagacagcaaguuuuaugggucaagccuaaguuuacgugcuuguuuugcucugcucacugacuucuaugacucugggcaaucaccuaucuucucugggacucuauucaaaagguaggcgugaaccagguaugguggcacuugccucuauucccagcuacuggggaggcugaagcaggaagagagcuugaguccaggacuuugaggaugcagugagcuaugauggcaccacugcauuccagccugagcaagauggguggacaguggggcaaggcuugucuugauccaaugucugugaggcuauggcuucuuccacucaccccgugaaagaaauaaaugcuggugaagccagguuuguugauguuaaguagcacaucccugauucccuccccagagaagagccacaagccaugauucugccgaauacuacauccuaaccucccacccuugucuccucucuucacucccuguuccuuccagcagugaaaacccaggcauuuuuaaagcaggcugcuaaaggcacagucuaaaaauaaucaccaagaguacguguaacaaauaagaacgaaggaggugaggaauagaggcuaagggguggggugagguuuggaagaauguugcccaaaucuugucucaagauuauacccacaaauauugggcguauaugcuuuugcucaguccuaaacucccuaaauagaguacuuaauuuucugauaaaacaacaaaacaacuuuauccucacaggauucaaauaaaaagagaacuuaacaguucugcucuccacucugccaugccacugauacauaggagcugaguucuaaguggacccagagcuacaucuccagacaggccugcaggugaggcagaaggucagacaucaaggcacuuacuuccugaggaugaugacugcucggcgcuccuugauguccugaggccguaugcagugagugauuucaucagcagcauauccacugaaaagaaacacagaacaugugaccaugaagaguagacagacaaccaaaguuccugggggauauaacaggacaggaacauggccuaggucuuacggcugcucucuacccauuacuugagaguuucaaggaucuacauggaagggaauaucauauuaaguuccaggaugcuuuugccaagagacuguaauacucaaggaaaaaccugguaugacacaaaggagaccccuuggccacuuaaggcagaggcuggaagcaagacucucccugaacaggccaggaacccuuuuuuaaaaggguacuccagagaguacacuguagcuccuccucauucucccuccauuuagcagguagagaaagccaaggcagccacugauagcacugagucaccagggagagcuaggacugccucauuccaaaauagaauaucuacaugaagucuccauuuggggggauccaaaauuuugaagacaguuguguuugaauauuuuaagaauuuccggcugggcgugauggcucaugccuguaauccuagcacuuugggaggccgaggugggcggaucaccugaaaucaggaguucgagaccagccuggccaacauggcgaaaccccaucucuacuaaaaauacaaaaauuagccaggcaugguggugggcgccuguaaucccagcuacuugggaggcugaggcaggagaaucgcuugaaccuaggaggcagaaguugcagugagccaagaucacgcccacugcaccugggcaacagagcgagacucuguccccaccacugacccccacccccugccccccgcccaaaaaaaaaggauuuccaucauacucagauaucuguuuauuuucaacaaguuacaugacuuuuaaaaccgcucagagaccaacuaauguggguagaugacuguccucuucucagcuagcgucauuccaauuugaaacucuggaagcaagcucugagcuuccuauaccccucacaugcuaucacuggaagcauggcagccacaagauacucccacuccaaguuacucuacugagcugcagcaguucuacacacccagaaacucagccacaagccuaguaggacaaguauggcuuaguuucccuaccuggcccuguaccacaaacccuucucucauggcugcugaucagcucccuucucaaaggcuaguuguacagacacaaacuuaacuauuaaaaacacugcaggccugggaaggaccccucaagauggccaggcuggccaaaccucagcucuaauaacuggaugcaagagccaacaagagauaaaaagccagacugcuucaggcucagccuuaaggaagcaccucugauuuggaaaucugauuugagcucaugcuggggauagaacaaaccuuuauuuuauuuaauuuuuuuuuuuuuugagacagucucacucugucacccagguuggagugcaguggcacaaucucggcucacugcaaccucugccuaccggguucaagcgauucuccugccucagccucccaaguagcugggacuacaggcgcaccccaccacgccugucuaauuuuuguuauuuucaguagagaugggguuucacuauguuggucaggauggucuugaacuccugaccucgugauccgccagccucggccucccaaagugcugggauuacaggugugagccaccgcgcccggcccaaaccuuuauuuuauagauccaccuucucccucaagcugcuccuagacaagaauuuuucaaaauuuucuccaugaacaccagucccauaagagacaguagacaggcuaggcacgguggcucacgccuguaaucccacccagcacuuugggaggccaaggugggcauguugccugagguuaggaguucguaaccagucuggccgacauggugaaaccccgucucuacaaaaauacaaaaauaagccaggcaugauggcaggugccuguaauuccagcuaucgcagaggcugaggcaggagaaucgcugaaccugggagguggagguugccgugagccgagauagugccacugcacuccagccugggugacagagugagacuccgucucaaaaaaaaaaaaaaaaaaaaaaagaaaaagacaguggacgaaugucuacagugaaaucaauuuguaaaauacugauuagaguuucaaaaagcauuaauauauuuaaagcacaugagaauuacuacagcaaaagaacccacugacuuugagcacuuaccaaagaaccuucucucauaauaccuauuaauacccaucagcccacagugagaaguaccacacaggaguuagugaguugaagagaccuggguucaaaugugagcuuugucuccuacuagcuuugugaccuuuguuaaaucacaugcugaaccuaaaaaccuguacaguuucuucaucuguaauaaggagaacaguagguucuuggguauucauuuuguuaugcuuuauaauuuagcuauucuuuugcugcuacuaauauuacaagauuuuaaaaauggggacaguuuuaaagauuacaagauuaaaguuuuuaagauuacaagauuuuaaaaacggggccuccucccuuccaggcagaaaaacagcauuauaugacuacuugguugacacuccuggaaagggguggugagaggccuaccugcagggguauugcgagaauuaagucagauaaugcagggugccugacacccuacaaucuuuacuaagcacucugacaaaagucagagggcccuggacuauccuggggcaagccagagcccuggauucagcaucugccaaagagacauggucugggcucccccugcagggaucugccaguagugggggccgccugggccccauuuccagagcuaggaacucuaguucucaucccaugcuuuuaucauuccacacugggggaaugggggucuagacugcaagacugucccauauagacacacaauacuuucccaaagagcugucaaaggucucaaaggcacuuuuuuuuuuuuuuaaagacagagucucacucuguugcccaggcuggagugcaguggcaugaucuuggcucacuguaaccuccacgucccagguucaagcaauucuccugccucagacccccaaguaacugggacuacaggcuaauuuuuguauguuuagugaagacuguuuccccauguuggccaggcuggucucgaucuccugaucacacgugauccacccaccucggccucccaaagugcugggauuacaagugugagccaccaugcucggccccagaggcacguuucuaaguccugaaucugcagugcuggcuacaggcaaccuucccugccauugacaaguguuaucaaucuguuugacuuggcuauaugcauaaccaagggcccugacuucccaucuccaacaaggaaccacuuuucuuaaugcaguucuggagcaaauccagauguuugucaaagcuugacugcccgcaugcucccugaccccaucccccaaagggcucuagaacaaacaauaagccaugucagguuccugccacggagcccaggccuuggaagaacuaguauggagguagggcugcacaggcccacaaaaaugacuuuggcacugacccaaccuggaaggcuuauuaguacuggucuucuagaacuuccuagcagcuaugacacagcccacugacccuuuccucagaauauccggcugcucuggcaacaugagcucaaaguccugauuaagggaagcucuccuggccaaucucacaaaaugucgagcagagaccacaggguauuauuuacuauuaaggaaccuacuugcuacaaaauaaauugucugaaagucucagucggccagcuugcaacuuaauaugcccuuggguccagcccuacugcuggcaugaaaaguuccaggaccuccugcuuuuuuguuuucacagggaaaggagaagaggaaauaaccuuaugccaucuggcuugccugcucccucucugggcugagcccccagccccagccccagaggcacugaccaguauauguugcaaaugucacccacuaguccuauaccucagagugacucucgaaggagcugacaugucuaucuccucuuuugggggccuuucccugacugcccaggcuggguucccccuacauugcucaaccacacccucucaugccucuuugcuauuccaucuggccuuguggaaauugugucuucccuucaagacaaagcucuucaaaggccuuacucaucccugcacaguggacacuaaaugaaauguguguugagcugaacuauucuaccacuuagaaccuguuucugccucugcaaaacaaagaucacagcaagccccuccucagaagauuaggugcaaauuaaaugaggugucugaaauuuuuuuuuuuuuuuuuuuuuucggaaacagagucccacucuguugccuaggcuggaaugcaguggcgcaaucuuggcucacugcaaccucuagcuccuggguucaagcaauucucugccucagccucccgaguagcugggauuacaggugccugccaccacgcccggcuaauuuuuguauuuuuaguagagacgggcuuucaccaucuuggccauucuugucuugaauuccugaccucaggugauccacccgcccuggccucccaaagugcugggauuacaggcaugagccaccgcaccuggcccugaaaaauucuuuaaagaaacuaugcaggacuguacaucucuccucuaggggacggucuuggaaacugaguuguuaugacacauuuccaagauggccaccauuuuccaucuacuccaugcccugccuaggccaggaugaaccagagauggagggacuguccaagaucccagccuggugacugucucucuccagcuauggcuaccugccuuacugacagacccacaggaccaagaaggucaggcuuuugggggcagcagaccagccaccuggacccaggggcaggauugugagcucaggcucaauuauuuaccagacccaagccuccaagacgacccauggccuaacuuuauaagaaguccuggggcuuucugaauccagagggaaggucaaccugccaagucccaauucuguacacaccaagauagacaguacuaaacacagaagguagcccaucuccugagacacuuuuagcuaaauuucaagcauucaauagaugacaaagauucaacuuucuauaacaacucuauagcaucauuagacugguuuugcagaugaggaaaacugaggccucaaaaagcuuaauuuccccgaagucaacgaguuaaaaugguggugcuguaacuccaaccaagucugcugucaaacuuucuggauuuuguuguggaggcgguaggaagaaaagcccaucuguguuuccugguagcaagccuguccagggggccuugcuggccucaccaaagggcacacguacacccacuagccccaugaaagagauuugcagagaugaaccuauaucccccagagagcuagcacuguaucagugaaggcuauccaccaacuggccagccagcucugaauuuucuuuuucuuuuuuuugagacggagucuugcucugucgcccaggcugccaggcuggaguucaguggcaugaucucgguucacugcaagcuccgccucccggguucgugccauucugccgccucagcaucccaaguagcugggacuacaggcgcccgccaccacacccagcuaauuuuguuuuuuguauuuuuaguagagacaggguuucaccaugcuagccaggauggucucgauguccugaccucgugauccacccaccucggccucccaaagugcugggauuacaggcgugagccaccgcgcccggccuugaaauuuuuuuuuuuauuauuuuuuuugagacggagucucacucuacagcacaggcuggagcgcaagggcucgaucucggcucauugcaaccuccgccucccggguucaagugauucuccugccucagccuccugaguagcugggauuagaggugcacacuaccaugcccggcuaguuuuuguauuuuuaguagagaugggguuuuaccauguuggccagguuggucucaaacuccugaccucaugauccguccaccuuggccacccaaaguucuggcauuacaggcaugagccacuaagccuggccagcucugaaauuuuuauggccuauuuauucucugcuugcucugagcuucaugauuaacaccaugguucacuguuagcuuccuuucuuuuacugcccucugccuugucaggcucuggcagcagcaagggcagccaaccccccuggcccagagcuccuccugacggugcacagcccugacuucauccugugguuccucccccuccaguggaaucagaagaguccacacaagagauguggcccaggaccuaucugcccuacuuucccaacuauuuuaagccagaaagcuaaauuuugcuuucaaccagcugaacaagaucagacuaucccagaacugacaggggugcccacuccacccaauaccaaccguuaacuggaagagucacaggcugagcucaccagugcaugccccgugccugggugauacagucauuuccagacggcuggccuaggccugggucucugggcauguggccaccacaccacagaccacguagcagugauuaaagauagcagcaaguaagcaauuagccuugaaguaauuauucuaauuaguccaaucagagucuguuuuaaucugccccaugcagccaacagggaauaggagaaugaaugacagauaaagugauaugaagauaaaaaauauuucccuaaaguacagccuuaagaggggauccacccaggccuaacaugggaagguuacaaaaaacaacugacgacuagguuuggaaaggaguuugaagcacuuccagaagauucugugaggccuuguucuaaaugcccagguuuagacacugcugagucaauguuugugacgcaccaacauccaugcugaucacuauuaaauauaaaauuguauucuugccaugcggucuuagagggguacagauaccauugccaccaacaccaacugaagucuaagaugccuacuacuagaaucccuccccaucugcaccgcaccacuguuuucaccagccccucccuuccaaucugcagcuuuacugcucaucaccucugggcuaggaucuguaccaggaaaagagaaagcaccacuucuuaccaguuuauaugcaggauuugacgacgggcacuacuaauaggcagguguucacccaccugcauaccaagguaagcuaaguaugcaggugcaagaagauuuaauuaguggaaggguccagacccuagagcagugacucucaacuaaggauucugcacuuccccugccucggcauuuggcagugucuggacacuuucugguugucauaaaaaacacuauuggcaccuagcagauagaagccaggaaugcugcugaacagucuacaaugcacgaacagccucaacaaugaagcauuaucaagcccugaauaacaauagcacuguugagaagcccugaucuagaguucaccagagcacccucaaccacagucucuacuaaugaacuccaucugccucccaucaacauccacccccucuuaccuauggcuacuccugcuacugcagccaaagacacugcuguuguguauuucuccaccuuucucugcuuggcucauuccuagucacuuuucacauuccaguucauuuccuccccuaaacuuccaacacuccaaaguggaaaagaugucccccuucagugugcuucugcaguuaccuuccugggcuauaacuuauccuccugucugaggccuccauggggcuugaacuacacgaagggaaacugucauguuucaggcuccaccaaaucccuaguuccuuccccagugagagagcaggggaucacugagugguuguauaugaaagcaagcacccauuuaaguaccuacccugugccaggcccuaucuuagacaacaaaucaccacauuuaauucuaauaggcuuuggaaguuggcaucauccccacuuacagaugggaaagccagcucagagaacgccuacaagaucccaaagcaaaugagagaaaagcuggauucaaagccuggggcagcacuuuucaggacauggcugagccucccacacuaacaccacagccaagucugaauccagaaaggguugacagggacugggaaagcuuuaggacuuuacuauucugaggaaaagaugaagagaauuuuccugaugaugcaauccuguugcugaucacuaacagaccugcauacuaagaacucgaaacuucuguucuuaaaauacagggugggcauguguuaaggagaguaguagucccaaaaccaaaaaaaaaugccuugugauccccucauuaagcaccagaccacuacuagaccuccugacaaccacccugagggccaaugacuacgcagaaaauuaauaucccgcuaagagaccaaaugguccuugugugagguaauuuuugcacugagaacccgucaauggggucagaccccaaccugccuuacacagcaagcacccggagaggguguguccuggaaaucccaucuuaaagcauuuugccaagacauccaucuaggagcgccaugaagaucugagaagcucagaagcccauuauaagaaggcaucugacagcuaggcuguccucuaaguuucagaugccuaaagagcuaaaguaucgcuucugcuacuacugacuucccaccuucccaccaggacgucuuggacauuacaaggcucugcugccauccccaacauggaagcagccucagcuguuagacucaaaugaaacagaugaccuaaucucauaucaagaaggcuccagggacccugcuucuccucaugacuuuggcccuacugacucacuucagaaccugggcugcucacgacaaaagcccaguguguccucaaccuuguauuuggugguggucaaccaagcugcucugagaacagcugcggucuaaaccuaagauguuuuggguauuacugaauuacauuacuagguuuaccuuuuucaggacuggaaggaggccgcuuccaaauaaauuuucacuucacauaaacagcaaagguguucccaauggcaaucuccucugggggccagggcacugagcuaauucucagcaggaucugggaaccgaauauaggccaaaagccuaaguucugcugcucacgcaacuguaaggccaaacagucaagagaccagcuguauucuguuguauucaguccugacuacaaguaacacguucuuacaaagaacugaugggcucuucugcagccaggagggaagaauuuuaagagugugcugcucuguaugccuggcccaaccacuaaucuguucaacuccagggaagucacucccccuccugggaauggagaaugugcuucaauuaaauaaucucuggggccuuugccugugacuacuuucucuguuaaggaauccaaaaauggcagaacaagaaagacuuuuagauaaauuaaaaaaaaaaaaaauuuuaaagcauagauuuguaaauggaaggccagaauggaaaaccggaaaaucacaaagggacuuaugcuaagaaauggauggugggaaaaaaaaaaaucaaagggaacagccuucugaaaagauggcuuucgaugaauucucagccaagucagugaucccgucaaaccugccuucggggacaggauuuccacaucgguucccuauuuucuugcuauagguaucuuaaacacaaaacccuucucucgcucccuacaaucuacaaacagaagaacuggucagaacuguaaaaaacgcagacuccuacgggcugcugcuuucugggccaggguggguagcuaaggcagcaggcgcagggccgcccccuccacccggguggguuaccugagcacagucacgcuuccccugcgcaccggcagggaaagcacugguuccgacacccgaauaggcuugaacuggaacuugcagccgaagcacagcgcagagucgcuaaagaaggacacggacacgauggggcgcucgaagauguggaugggguccacgugagacacgaugcagccgccgggcugguagucguugaugacggcgcuguugacgaagcccucggggaugacgcggugcuccaccagcuuuuggaucaccagcuggugcacccacucggggaucucguccacgucgcccggcggguagaggcgcuccuggccgggcccgcgcuucugcagcugggcgccguaaguguagccuucgccgaagaaguacuuguugcgcaguggggcccgguccaccgugugcucguuguacaggcccuucucagcgcgggacaccaccucgucaaugcgggccucgaucuuggcgcacucguccuggcugaagaggcgcaucuggcggaugccgcucuucaccuugcgcgccuccuccuccuucugcagcugcugcuccucauagucgcugcgcucgggguccgaguccuccugauacuugcgcuuggccccggacacaggguaagguucggcggcagcggcggcugcggcugcggcggcuacggcggcugcggcagcggcggcggccucccggcugcccgccuuauaguugucccgggacgucauggacuugagcuucucacgcagguccguguagccgcuggcggccgccauggcccccacgacgcugcucuaggguccuccggggcgggcggggcagccgggcauggcucuaaggggacgcgccccggggcccccggagggagggggguccuuagcgccgaacccccaugcgugagugggggacccggcggggggcgucgaggguccgggcgugggguagggccucaggagcggcgggucaugcaacgguggcgacaacggggcuucuuccuccuccaccuucuccacgucccgcggggcaggggcgccggcagcgccucaugccgcggagggcugcugcggagacgcggcccgacucccgaccagacccucggacgcccggcccggcccgcacuuuaaagcucuccgcacgacgucacgggcagccagcccgacguccgccagcgccgcuccuuagcgggcuccucaccgcgcacgcgcagugcugccggccaccgcggcuccgcgcgcuacgggcaugcgcgugcgugcaggccgggucggcagaggcgccggcgcaagcgcagacaggaaccgcuugccguccgccgccccucccccacucucugaggggcuucaagggaacgcucucaaauagcaaccugucuucacgccgcgccgccuccaggaccgaagggcucccucuacaggggugcgcucauauugccaacagugucgccgugccgcgucacggcaucguccg

SEQ ID NO: 192248 - RNA, 16646 nt, Homo sapiens
agacagcgcggcggcccccagcgggagaggcagccuggcggccaggacagcgcggccgggcgccuccgcgcagugcucugggaguuguaggcacuugccucuccucucuccuucagcuacuggcucucgaaacucaaggaccuaccggugggugggcgccugugacucccaggcugcgaacgccgggaacucaguuucuucagaaaugcucgaaccaggacggcuccuggaguccucgcgcccucgcagaaggacuacgggccccggcgaccccgggggcggggcuuccggcgcgcugccuugugggcacgguaguuccgccgggucuggcuuccgccugccgagcggccccggaccgcaggccggacuacacuucccgucggcccgccugcucucccgaugccgccuuggcgcgagacguuggcaagcagagugucuccaagauggccgcuuggggaaggaggcgucuuggcccgggcagcaguggcggcagcgcccgagagaggugagauccaagggcuuguugcccccagugcaggcggcucagcggccggagagcccagcgcggccuccgagggcugcagcagccuuccuucccugguuuccccgcgcucccccuacccucgccgggcauacuggguuccaguuccggaggauccgggauccgggugggagcgaggucgaaggccucggcggagagcuuaggggaaggggcguuagccgggcugaguaagguaggcagcggccaugcggggcggggcccgaggccgggccgugcugaaaggaacuggcgcccagcgcaggccucagggacccgccuagcugcccgcgggccgaucggcugcugaagcacccuucccgccugggcacgcgcguggccaucucggccgcggccccagacguguagaggaaggcagggcccccggagagagaaagaaggggaagccuucacagagcaggccggccgcggcagggguaguuugaucugcacguuuacuagggagcuuuagcucccgccagaugugucucuuccgagcccagagccggccacuuccucgagggaagauucugaagacuuuuggaugguucugugcaagcgcuccugccguagaaguccuuuaaagugaccuuuccuaaugaauggugugugggcagggagcuaggagcguguuucuuccaacagggaccuccauuugaauaacugauuucuagaagaugagauuggaguaguuuccguguuucauguucaaguugcaguuuuugcaucugggaagcaguuucagcuaguggaaaccacuagaagcuguucagccacuagaaauuugggagaagauguauugguggagccaccuggauuaacuguccgcuaaagcuugauuguuauagcagcggucagcaaaaaaggaaaaguuuuuguuuugcugguucucccccuccccgucuuuuuggugaggauugucuaacagaaaaguuaucuuccucucaacuacucugcauuauuccuuuucugugacugauuccaucccguguucauugcuauugcuugcagauggcuuucccagcugggaagauucuuccuguuuggcaguugugauagaauccuuuagcuugcuugcacuuuauucuuuagcccaguuauccagcguugcccauucugcauuuccucuuccuuggaaaagcagugguaaacacacuuuuguuuuucuaacucccgccugguauuagauuggaccauuuaaauaaguuaccucaaugguuuucagaugcucuuaaaaacuagcaaacauuuucaagauauucaaugcaaacaguaauacgaaauaaccuguuuagaaaacaaaguauuagaaacauacgcccucuuguuggacuaaaagcaucugaaaagagccgaauagggaugccucaggcagggaacaggagccuugccagcacagguuaagcuuuuauugaucuaagaaaauagaugcugagaauuguuuuuguuuuggcuugagacaacuguuuauucaaaauggaucugcaaauuagcagugcauaggcuggauccaguccuugacuguugaaccucaacaguuuuuaagagaauuuaaauuaguugccagcagauuucauauaaaacgcucccugaaaagcuggguaguggcugacucuuuuuggucgggacaagugcuugguuccaguucuugguuccucaccugacagcuugacucaaaucaccugacagcuugacucaaaucaccugucagcuugacucaaugcauuugccugcuuggucucuguagguguucagguugcaccuuuggccuggaacugaaggcucuacucacacacgcagauguugugugucagcaggaauguggcauuugguuuuguaguuuggaugucaccaucuacucuccuagauaacgugguauggguggagacuaccugucuguuugcucuugcuguaaaccccuagccagguucuguuggaagagucauuuccccgagcccagcuucccuaagcucuucccaugcugagcaggggauggaaacauaacccgcuguggggcuagcgagcugacuucugggcaucccuccauuccugcucaguuggugaugacuguucagguggggcagggcggauuagcugauggcccagcacucuagauuaugagaucugaguguauuauuggcucuuaugacugaaguaggcuguuuauggcucucuaaaaugacuuuguuccaugucacauucgugcugacucaaaucucagcuccauguuauacgagugcucucucccguugcugcucacaccugguuagcaucugcuuuugcugaagcugagggaaacauuaucugguuuggggaaggggcuagaacagagugacacuuugggcacacuugccagauuugccagcggcuaccaacucugaagcaugcauuguacuuaaaggucccacccagugccagacugccugcaguauuacugccggcgcuguguguuggaugguccaguuuagcacguguagcguguggguucuugcuuuaccuuguugagucuagaaccacagcucuagaauuagugcugaauuaacacagcaguucaguagucaccagcuacauguggcaauuacauuuaaauucauuaaaauuaaguaaaaugaagaauucagcuccucagucucacuagccacauuucaagugcucaauagccacuuccggccuguggcuaccauauuggacagcauagguggaggacauuuccaucacugcagaaaguuaugauauggacagugcugguuucgacuaagauaggagggguggaaauagcaaaaugguagugcuugcauguugauuuuucucuccacuccauuaaaucuagggaaccaacaguguuuguaaugaagaacaucagacucugagcuguaaccugaauucuuguccaaaauucagcacacuggcaacgagcacaucaaacagauugccacuuguccugucggcgucuuugagacacacuugcccaucuaggaaagcacagugcagguaucuguguucugccaccgugugccagcccggaccagcucacagacagcccugccugucuuacuugggcugcucggcuucacugucucagggccccugaaccucccagagcccuccgugauuguuggaaugugaguauagcugugugcucuugaguuccuguuuuuauaaucacgugaagauguacuugaucugcuucugagcaugauaugaggcaaccuggggugugcagagggccagaugcacggggcuaaaaguucagguuuagcgcgaaguuauuuguuguggccugccccuccccuggcuugcgcggccaucugcuccagcguuuuauaggcagccaguucccugggcugacuuucauggcuuuccuugccaugcuuuauuccccaggaccuguccucuucuuugugaacucaggugugccuggucccagguggcccuuacacguucauccagugagcagauggagcacaggccccgggggcagguugggucauggucccggggugacagcuucccuuucugaucugauccuucccuuuuagacucucaggcuuugggaguauuuaaucucucuugaaagacuccaugcuugcuuuuguguguggcgggaguuuuuguuuccuucuggcugggaugagaugagcagauacgggaucugcacccaaguguguggggguuuagccacugguugugggauucugcucagcucuuuaacaaaggcaaagccacauguucuggccgcagaaguuggauucguagguaaggaugggguucauccucuucaguauugaugugccuucaaguuuucaagaauuucuguuuuccuugguucacucaagcagccuggauuccaagugcauuaauuugugucucagugguucaguccuuuaggucauguuccagggaaggcuccccuuucugaagaggggagggcugcgccuggguccacggagguggggagguggcuccucugccccggcuugucggugugcaccuguucuucaaugagcgaggugcgggggguggaguugggcagcacuccaugaccgagcacacccgggaaccuccugacugccacgguguuccgcccuggugccagcagccacuuuaugggcacaguucucaggaaaagcugacagccauguaguagucauaacaguucuucagagcagggcuguccaguaggaguuucuggcaugacagacuccuggcgugucccugcaguccauuagggcagccauuagccacguguggcucugaggaacugagguuucauuuauuuauuuauuuuaugagacaggucuggcucugucacccaggcuggagugcagugguaugaucucggaucucugcaaccuccgucucccuggcucaaaccauucucccaccccagccucccgaguagcugggaccacaggcauguaccaccacgcccagcucauuuuuguauuuuuuguagaggcagaguuuucaccauguugucuaggcuggucuuaaaauuugugggcucaaggaauccacccgcccuggccucccaaagugcugggauuacaggcgugagccacugugcccggccaggaacugaauuuuuuaagaugucuaauuuuaauuaauuuaaauuucaacagccacaugugucuuaggcagaggggcagugcuuggcgacuguucccaucuucacugcaguccucugggagagccagggccucuggccccguuugacaacaugggaaacuggcucagaggggccggguguuuugcccuaggacacaaagccaguaggcagccgagagggaacuugaauccacccucucgacucccacacuuggugcgccguguuccugcuccccagauagaagggcugcugaguuaccagugcgcagaauaggaaaguguccucugaagcagacgaaagggcuggguguccugugaaaguuccuuggccugugggagccguccucaggccauggggccgcaugcccgugccuuugagucuggggcacgggcuuucacugcuucaguccucugcuuucugugggucccaaagaagcagggcuuaauuaggcagaagcggguggagguccagcccagcaccuccuguaucauaggugaucaagugacccuuucacuaagugaaaagcagccugacggauggguugacuuuucugguaccaguucucuuaauaaccauaauuguuuuucuccuccugugacuccuguggcucaugucuguaaucauuacaaaugucccuccaaccugugucuuuugggaaccuguuacauucaggcccagugcuggggaaacuacgaugaaaaugcagccucugcccucauggagcuucaggccugccugugagcccgggccccacuccaagaaggggccuaauguggaugcuuccacucagauuugccucugcugggucucucagaacugggaaggugauugguggcuggccuggcagcuuagccaguguuugcucaagggaaacggagcuggaacugcccuccucuuuuugggcaggacuacagguacacaccagcaugacaccucagccaugagaagcugcccgcguccagacuucugccuuucauggacaccgagaagguucuggagcaggaagugagccaccucccgcucuucuuggcaguggaaggaggcccucccacggguaucuggucccuuuaccucaagggauauaggguugaacagaauuuuucuuuuuaagaauaaguuuauaauuauuuuuccuguuauaaaagaaacacuuuggccgggcgcaguggcucaugccuguaaucccaacacuuugggaggccgaggugggcggaucacgaggucaggagauugagaccauccucgcuaacacagugaaaccccgucucuacuaaaaauacaaaaaauuagccgggcgugguggcgauugccuguagucccagcuacucuggaggcugaggcaggagaauggcgugaacccaggaggcggagcuugcagugagccaagaucacgccacugcacuugagccugggcgacagagcgagacuccgucucaaaaaaaaaaaaaagaaacacuuuuuuuuaaaaaauauagaaaagcaugaagaaauugacaagucaccuauuaggccaccauccaaagaaaaccacuguugaucuauuuucuuguuucuuuugagacaaugucucgcucuugucccccuggcuggagugcaguggugugaucuuggcucacugcaaccucuaccuccuagguucaagcgauucuccugccucagccuccugaguagcugggauuacaggcgccugucaccacaccuggcuaauuuuuguauuuuuaguagagacgggguuucaccauguuggccaggcuggucugaaacuccugaccuuagguaauccgcccgccucggccucccaaagugcugggauuacaggcgugagccaccgcgccuagccugaucuauuuucauguauagcaccuuugauacuuugucuuauauaucuugccuuagggguuuuuaaaauuauauuauugagacggacucucacuuugucacccaggcuggaaugcaguggugcagucucgguuuacugcagcuucugccuccgggguucaagcgauucuccugccucagucucaaguagcugggaccacaggcaugcaccaccacgcccagcuaauuuuuguauuuuuaguagggacacaguuucaccacauuggccagccuggucuugaaguccugaccucaggugaucugcccaccucagccucccaaagugcugggauuacaggcgugagccaccaugcccagccuuaucuuagauuuuuuaaaguuauauguuaaacacaucaaaaguuauguuuacaauaugugaaaaguaauaaacaugccacagcaugauggcccuuaaaaacauaaugcaaaaugaaagaagccaguuguugaagaccacguuacaggauuccauuuaaaugaaauacccagaauuggcauauccagagaguugggaagccgacuggugguuguggagggcuggggagaugugaagggaccacuaauugguacaggguuucuuucugagaugaugaaaaugcaccaggaucaguugugcuauugguugcacaacuuugggaaagccacuucaucguucaccuccgaugggggaguugcucugugaauucuaucucaguaaagcugugaauucuaucucaguaaagcugccauuaaaaaauacaaaucaggccaggcaugguggcucaugccuguaauuccagcauuuugggaucaccugagaucaggaguucgagacuagccuggccaacauagagaaacucugucucuacuaaaaauacaaaguuagcugggcguuguggcacgugccuguaaucccagcugcuugggaggcugaggcaagagaauugcuugaacccaggagguggagguugcagugcuccgagauugugccacugcacugcagucugggugacaagagugaaacuccgucuccacaaaauaaauaaacaaauaaaaauaaagaaaaugagaccagguacaauggcucuuacuuguaaucccagugcuuugggaagcugaggcuggcagaucacuuaggaguucgagaccagccuggccaccauggugaaaacccugucucuacuaaaaauacaaaaauuagcugggcguggcagcacaugucuguaguccuagcuauuugggaggcugaggcaggagacucgcuuaagcccgggaggcggagguugcagugagucgagauagcgccauugcgcuccagccugggcaauggagcgagacugccucaaaagaaaagaaaacggaaaauaacaaguguuggugaggauauggagaaaugggaaccccugugcgcugcuggugggaauguacaauggugcagcugcucuggaaaacaguauagagauuccucaaaaaaacuaaaaaauugaacugcuauaugauccagcaguuccacuucuggguauauauaccccccccccaaaaaaagcagggacucaaagagauguuugugcacccauguucauagcagcauuauucacaauagccagugguggaaaccgaaguguccaucacagaugaauggauuaacaaaaugugguuuaugcauacgguggaacauuacugagccuuaaaaaggaagaaaauucggauacaugcuacaauauggaugaaccuugaagacucguuaugcucuguggaauaagccagacacaaaagggcauauacuauauaugauccaacuuguaugaaguacuuguauagucagauucauugggguagaaaguagaaugguaguuugcaggggcuugggguugguggggaauggggggaucauuucauggguagaguuucaguuugggaagguaaaggaauccuggagguggaugguggugaugguugguacaucagugugcaugugcuuagugccucugaacuguacacuuaaaagugcuuacggugguauauuuuacguguauuuuaccacacuuuaaaaaaggcaaagugauaguugugugggcuccccacccagcgcgauagagaacuagcguuacccuggccugccuccuccugcagcggagacccugugccccaagugcaccacagcacccuugcuguccuuauaguuggcuuucaguggcacgucccugagcucugccgccuuagaaugugugagaguuguaucccuggcucaggccacuggaacugauucaugucacuaauggaggaggugcgauucugcucuccccgcuccugucaucuuuugcucucaccgaacaguucugcucugaaccuucuugugcggcucuugccuuuuggggagacgccuccagacuguggcugcugggacaggcacaggcugcccacaucccagaggggccguggaguugcccugcugaguuuucacuguggccgccuuuuaacuggaaugcuaguguugccaggggauuccuuugcugacugcgagagcugauugaguugggcucaaaaguggagagaugagggccugaaggcugacucugguugaaggcugagggaggaaguucaagaugcccacuuuaugagugccugcaagcuauccugaggcggcagagagcggucccauucagugucugcagcagucccccugaggugcuggaacgggcugaccccugcucccagcacuaaaggcucagagaauccaaagcuuccucagugcuggcaugauguguuuaggaucaugacacugauccuuuuacuuuucuucuuccauauguuaagacccacuuccgacagugaucuuuaaguaccagagaucaugccagauucaaaaggaucaaaagucauuuacuagaaagagccucccuuccuuuucuuuccugagccccucaguucccucccuagugaccagucauaaaaaucaggucuuuguguauccuuucagaaguguucugugcauauaaaagcaaauagagacuuuuaaaaauacacuacguauagcauacuguaaacacucuucugaacccugccuuuuccccugaacuugcuuucaguuggagacuuugcuguuacugcugcuaccuuuuucucuuuuuuuuuuuuuuuuuuuuuuuuauugagacggaguuuuacuuguugcccacgcuggagugcaauggcaugaucucagcucacugcaaccuccgccuccugcguucaagcaauucuucugccucaggcucccaaguagcugggauuacaggcacgugccaccaaacccagcuaauuuuuguauuuguagcagagacaggguuucaccguguuagccaggcuggucucgaacuccugaucucaggugauccgccugccuuggccucccaaagugcugggauuacaggcaugagccacugcaccuggccacuuuuucuuucuuuuuuuuuuuuuuuuuaaacauagacucuauuaauugcucucuuacuggucauuucacaccugcaaugaaaagcaaaaauacagucccuuaggaagcccagggcucaaaagauuccaacuagcucuuacuuaaaaaaaaaaaaaaaaguccauauaauuuaaaaaaaaaaaaaaaaaggaaaaaaaaagaucucccaugcaccaggguucagaucacccaguuccuaaagcccauggccuuaccaguuagggggcagcuggugaugcucugcagugguuugagauaaccuucugacuggguucuuuccuucauuagguuuuguuugacccacaagcagaagcaagccauauacggguggcugcuggguggucaggagcuggcuggacguggcugucuccugggaguacuuggcaguuucuuuuuucuuuuuuuuucuuuuuuuucuuucugucauucaggcuggagugcaguggcacaaucuuggcucacugcaaccucugccucccagguucaagugauucuugugccucagccugcugaguagcuguaauuacaggugugcagcaccgcgccuggcuaauuuuugguaaagacgguuucaccuuguuggccaggcuggucucgaacuccugacaucaagugaucugcacaccuuugccucccaaagugcugggauuacaggcgugagccaccgcaccuggucauggccacgaauuucugaaguaagagaagugcagcagucccugucagcagugcagaccugaacccaagggcccagcaguggcagcuaaaaaaccugugucugcacugacagcaccccacucccaccaguguaccaggaaguuggagugcugacugccuggucguggccgggugagcuccaacggagggauccugcggcuuugggugcgucuguguguguuuugguuugaaccuuaccgucuccauauagggucuguugccuuauagaauccuagaaauccacuucccuagacuucacguguuguccuuucccaguggaaaccgagauucccuuugccuaacuggcuuuaaaagcagaauuggugagccucuggccucagcgccguugugcaggacccugccuuuguuugaaggcaguguggcuuauguccuuuguguuucugcuguggauaggugucuuagacagugggcagcaacagugcccagcccauaugaagacgccgaggcugcaggaggccggggccaugguuugacaggcaggugggggcagacccacgccaccaucucaggaugugugcuggcgagugcccccauguccacgugcuugcuuauggcugugucauucacaggacugcccacagccgagggcagaggaugcccagucuccucacucccugugcuggggggcgggccacaccuggcaacagcagugaggugggagggagccuggagggccuuggcuucucgcugcuuccaggcugguugggacucguggacgcacccacccauccgucccagcaagcgauggagccugcagaggggucuggguggaugugggugccagcugggcuugcaggggggccggagggggugagggggugggaucugcccacugcuguguuuccagauggggcagucgguuccaggaccgggguuuccacuggaauuuccucugugggaccaacagugguuuucacuacauucaggauggcgcuggccugcugggcagagaaagguaccgcacuaggguggauuuggguguuggcgagaacauuguguaaccccagcuugacaccucccuuuugcuuugaguguuccugagggaggaagcccgccucuggugcccgccccaaggugucccuggccuggcuuugacagucaguaggaugcacagcugacuuggaagcaacuccauuuccgucucaagauugggacacgauuugguccuccaccccuaccuuguuaucuggccucucugcuccuguugccugauggacuugagaccagaagggaguucucuuggccaggagugcucccaccugagaguggaggccccgccccuccccgcacacccagggccacagccagcccauugcgccaccgccacucauuucucaucugagcacgugggggcacugcucggccuucagcuuuccagcgccagugaagacccugcuuugggugugcuuguuugcuguagguagcuucuaaaaugcugcaucuggcuggaugcgguagcucaugccuguuaaucccaggacuuugggaggccaaggcggguggaacacuugagcccaggaguucgagaccagccugggcaacauggcauaaccccaucuguacaacaaaauuuuuuuaauuagccaggcagccaggcgugguggcacauaccuguagucccagcuacucgggaggcagaggugggaggaucucuugaacccgggaggucgaggcugccaucagcagagaucacaccacugcacuccugccugggugacagagcaggaaccugucucaaaaauaaaaacuguugaauccuaccuggaaguaacagcuggccucucccuuaccucuccucuaagaccaaauggaaaaacuccaccgagaacuuuagaaggaaaacccuccuuuccccauuucauaagcugcucgugcagucuuacaguaacagcucaucauuucaucccuggcgaggcagccgugacacuggcacagucacagguggcuuggcagcaacccauguuuaggaggcucuugucccacccucagggcacugauuucuccccagugcaugccguuuaauuagggccuaugauugaauuaggaggcuuugccuuagccuggcuuaguuacagugacuuuuucaggauaaagaguuccguuugcccaaguccaagccagugccuuuuaugaaagugguucccacccaggggcgggguuaggguccccaugcuugggggcacagucagcccauuaccaaugacuuucaucuuuaauguggccacaugagaucguuaacuaguuguuuauccaaccagaaugcaacccugccuguuagguuugcuuauuuguuugcugaaagcuuugagcugggaggagucucaguaguaggaagaacuacgauugccuguucuuuuuccuugaaguuucccgacaguccgauuuccaccauccuucacuuggaauugcucccaucuuugaaggaggcuggagggaguuaccuucaugcugggcugagguucugggguggcuuguuaugaaugucuucacucgucacucccauauuacggccaauggccagguggcucagcuccccaugacucuccucugcaccgcagccaggugugccugccaggacaggcugggcggacgggaccuucgcgucugugcacacugagggcugugcuucucguuagccaugaaaggaagcuaguuccugucaggcacauucggagcuucagguacaugggccacauugacccuuguguugccugguacaguguuccagagccucccaguuggaagggcauggacuccagcaggggagcagugaccagcaggucccuggagccuuguguccuuuagucagauggguccgaccauccuggggaccagggugugcugagggaaggggcagcuuuucccugaggcaugugacagaacauggcucugugcagccuugggagccaugaguuggaaaacuugauccagccucaagagcuaugucuagcaguguccccgucaaggcccagauaaagacuucuugcagaugagcagauaacggaaaacuaggauguggggugacggugcggagauucagagagaucugucucagcugaaaccagccaaggaaagaugacaaggcauggauagcccugucuucaggccugcccgccacaggugaagaagauucugcuuugggugggaaauuuguaccgcagaggccugaaaccaagaaaagcaagacugccugaaaugcagcuuggcccacggucacugcuggggcugcagccgggcugccgucuggccuugcugcagagcugagcguuccgugugguggauuacucuccugcugguuggggucaugacaugcauccccagucccgggggggaaagccccuuguguggucuccguggcaguguuucuuaugcaaaugaguggcauuugccgguggugcaggggccugggccuacagggccagaauugguggcauugcugggcuggauguuuugaagccccucaguugacccuccugcuuacuaaauuuggagcccacuacuguucuugaagcguugucuuuuccuaauucaaggaaagggucgcuuuuccuaugcagugggcuaguguccugggucuccucuucuccccuccgcagcggggaggagcugggggcugcugccggcccaggaagggcacccagggcuugugcagccuggccuccaggagagccaaaggaguuuggauuucauucgcccaaggcaaagcucuuccuuucugccucuguucugcaggcccaggaugacuacuuaggaaacgugcggagggcaagggcuuagcauuaucuguccugaggucugugguuuccagugaagaauccucuugcaguugcccugauuaacuaagaauggcuuucaggcuguuggcccucugcugccgugugugcuccugugauucugugccgaaucguucuuuccccuuuaggcuccuuugcugacucagaucaguugguccacagccuuaggcuaaccaccaggccuguguuugucauguuaaacgucgaggcacugcuuuuccugccuuuuuauaucuuuuuuuuuuuuuuuuuucugagacugagucucgcccugucacccaggcuggagugcaauggcacgaucucggcucacugcaagcuccgccucccagguucaagugauucuccugccucagccucccgaguagauuacagggauuauaggcaugcgccaccacaccuggcuaauuuuuuuuuguaucuuuaguagagacaggguuucaccauguuggccaggcuggucucuaacuccugaccucaugauccgcccccccggccucccaaagugcuaggauuacaggugugagccaccacacccagcuuuauuucacuauuuucaggaaaaauccuuuuuacugauuaucuuguguugggauuuaaaggagaugaggacccaagugagaugugcucuccgcagugcaggcucagaccucccccagcgcugaaacacaguuaagugcuccucagccuaaucauccugucucucucucucucucccuuuccugcccccuccaucaaaagggugagcuugucggccacagacugcuacauugugcaugagaucuacaauggggagaaugcccaagaccaguuugaguacgagcuggagcaggcccuggaagcccaguacaaguacauugugauugagcccacucgcauuggcgacgagacagcccgcuggaucaccgugggcaacugccugcacaagacggccgugcuggcgggcaccgccugccucuucaccccguuggcgcugcccuuagauuauucccacuacauuucccugcccgcuggugugcugagccuggccugcugcacccucuaugggaucuccuggcaguuugacccuugcugcaaguaccaaguggaguacgacgccuauaaacugucgcgccugccucugcacacacucaccuccuccaccccgguggugcugguccggaaggacgaccugcacagaaagagacugcacaacacgauagcacuggccgcccugguguacuguguaaagaagauuuacgaacucuaugccguaugauuucaguagaacagggagcgaagcaaaaccacccggcccacaagagacaacagaguauucagaucgccacacucugugaggcagcagagccugggcagguguuuggcuuaguauuuguuauuuuuaaaaaauaacagaucacggguguacccaggguuuuucagcucauuacacuaagauguggauuuccauaacccaagaggggggucugaggcuguggaaguccgacugggcaguggaaugcugauggaggcagacgcugccgaggggguguggacgugcuuugggggaggucuuuaagucuauuguuuaacuguaccauccagagcccaccagaagcuauugaucauuaaaauuaugagaauuucaacucc

SEQ ID NO: 192249 - RNA, 43447 nt, Homo sapiens
uucucagagaaaauguagcuuuauuaugacauaggagagacuacaaagcacugggggggaggaggagugacacagcuccucaaaauggaaggggaaaggaagaguaaacaucuugguaaauaaagucuccaaccacagcacagucauuggaauuuuuuucuucauuuuuauuuucaaacuuacaguaaacaaaacaaucacuuaaauugucaaaagaacagcaauuuuacacaaugaagagcauacacaccaagccaaaauacaauagcacucaggucuauauguugcaguggugcuggcgcuggagggaaugcccagggaggcugcagugcucaccacgaagcccagguccacggagggagccaagguccacagagggccccggggccagagggaggccgcccacacucccagcacaucaccugccucaaagcacucccuucaggcaucugaagagggaaaggccaugugucuuccugggaggcacugaaaggccagccagcaucuccaaaaugcaggccauuuuaacacugcugugaaugugcuggggucaccaagggggccccuuaguggucagaugcacuuugucacaauguacaccuacauggggugauuacuaggcaacgggagguuuccugaauuucacagccagauggggagcuaaaagaaauuccugaacccaacgcguaaauauuuuguucugacaaaguaaauucacaagaacacaucaaacacaagaccuaaugcaaggggcagugccagggccgccgccgccuccugugagcagcucuucagcagcaggcaucagguaacugcuuagaacggcaaugccacaguggaauaagggggacuaacuuggauacgaaaguuuagaauaaugcccaccaaaaauccaugugacuccaucucucuucccaguucuaauguucucagaacagcagccaccccugaaugcaaguggagacaggaaggggacuagggguuggccggcgggaggggaggcagggucuggccaaacccaggcagcugccagaaagccuucugcacuccgcaagacaccccaguaaacuggggcgucccaagguggcaagccuucaugaaggcacugcccagcucacaauccugugggccaacuucagucaacucuccuuuccauuagauuuguuccuaauuaaaagaccacucauaggccaggugcgguggcucacgccuauaaucccagcacuuugggacgcugagguggguggaucgccugaggucaggaguuugagacauggugaaaccccaucucuacuaaaaauacaaaaauuagccuggcgugguggugcaugccuguagucccagcuacuugggaggcugcggcacgagaacugcuugaacccaggagguggagguugcagugagccgagacugugccacucacuccagccugggcaacaaacuccaucucaaaaaaaaaaaaaaaaagacugcacauccucaaaggagaucuucaaagcacugucacccaaacagcagaacuuggucacaugggaccauuucugaaaaucucggcccaucucuguuucucugguaauucauuuuauaaaacaugcuuccaugugaauucuuuaagugcagaaaaacaacagaaaaugaacagagcacgugggcaagaaaccgcaucccucaggcuucugccacacaugaugguucugcgggcugugauugccaaguccuguguuuuccacacugagcagugaguagcagcugccacugucacuacccccuccccagcccagccagcuaaggagcugggucugguccccaccagcuucuccauggccugugagcuaagaauagguuucacguuuuuaaauaguuaaaaaaaaaaucuaaguuucuugacacagaacaauauaugucauucagauuucugugucuaaaaguuguacuagacacagccacaucucuguacuauuuauggcagagaccauacagcccacagagccaacaguguuuacucccuggcugucuaugaaaacaucugcccaccgcugagacagaugauccuguuccugcaggacugaagaagccucaguucagaugcugcuggggcuccugggacaagcacagcccgagacacacuugcuucauaaacuguauuucaguacuuuuccucccccuugucccuaguuucuaauuucucaguggacaaauggacaaaccaucucuguuugaauuugaauacacagauacaugcaagauaucuuacaagaaacaaugcacauccuucuacuuucucuuucagcucugcugacaagcucaaucacggugucauuuuacugccaccacgcccgaaaguacaccaaauguaaagcagaggcagacgagacaagaugcaggcuccaccagaggccacuccagcuucgcgaccaacacccuuggcugccaggcagcgguagccaggcaaugggauagaaggcaaagaaaauacgagggacagaacccaucagacaccggcagacacugcauuuacuccagacugagaugacagacacaccguaugagcugcagcacaacucuccuccgcugcgcccacugccagccaccagcagacaccaaggcacccagaggagccaggcacacagggcgggcagcaacauaaacggcacccauuaaaaagcaagacucgcucuugagacuaaaggagaaguuaccuaaauuucuguauaaacucaguaauucauucacuuuacuaguauuacauuuaugaaauucaccuuuguggaaaaaggagcgggagagggauaagaaaaugccuguuucuagaaaaccgcgagaugcuuccacgugcagcuugaugcuguuaccugcagaacagacacgcuugaaaacgcgacguaguguccguacuuccgaagcuaggaggcugcuucacagccgcugagaaaauggaggugaagaguuccauacucuccguauuuuaacacuaaaacaccaacagaaaggcaucugcaaggcccucugucccgcacacuacaccucuguguccagcuuacugcuuucauggacccauaaucuuacagcagguaggggccuuuccacaccgagugcuggggaacgccaggcagcggucacucugugcugugaggcccccguugcacccccaugucaugacacaagagauguucuggugacggguguacgcugcuccucccacccagagcacaccccucaucucauccaucuucaaagcagcuccaggagccuccccguccgugugguccaucccgacccgaugggucccaggugcagaggggccacaucugcaugggagguggugucaccaggccggggaggcggcgggagacuugggggaggggggggccagggaggaucacuuugugaggcuugccaaugcauugccuuuguuuuucugaccagcugcagauaaggcuacucguauuccaggaacuguuugugauagaacagcaaguaccuguggaggcagagagagggaggaggcucaccucuaacuccuaagacaggagccagaacaacccacccuacacaaaagccuacgugcucugcgcucugcacaggucggccaggcccgaguugaugguuuuggcuuuuuaguccgcaaggaggaaagagugcuucacuggcugguggcacuggcccugcccaucucugcagcccgaccaccacccccaccugccacgaggucacccauugccucacccaaccucccacagccucucccccacuugugacagccccacccuugugcagagcccacuguuuucaaguggcuccguccagauccaccucaucgcccugaaggcuguccuuuaucccagauucuuccaaauaaaaccucucaagagggcuuggcuuccguguugcucagaaugugaagugcaaagcccucagggaguucauggcagcuggggucccccugaccccuggagggucaacagguuucucuaugccaugaaggaaugaaacuggaaaggagaggagcugauaaagaacugaugugggccgggcccgguggcucaugccuguaauucuaacacuuugggaggccaaggcaggaggauugccugaagucaggaguuugaaaccagccuggucaacauggugaaaccccaucucuacuaaaauacaaaaguaggcaggcgugauggugcaugccuauaaucccagcuacuugggaggcugaggcaggagacugacuugaaccugggaggcagagggugcagugagcugagaucaugccauugcacuccagccugggcaacaagagcgaaacuccgucucaaaaaaaaaaaaaaaaaaaaaaagaacugauguguucaguucacgcaguuaaaaaacaacugcucugacguucucugugcuaagggaaugccuccagagagggccuuugcucaggcaccucuucucccaccugagcacccaucgaggcuggcauccuauccagaacaggcuucauuacuucggcaaaugaaggucaacaccuucgagugguucuaggcucagacaugggcuagucucagcuauaccggaggggaagcaccguagccaccguagggccuuccucccaccccacaggacgcacccuucgcuguccaggacguccuugaugcuggccuuggugaugauggcaucgucacacuugaaccacuggucuuugugcugccggauaaagcugguguaguggccacucuccaaggucccuugaugguuaacaacagcaaacagggaauaccuagugcaggagcaaaggagagggagggcgcaggugacuugaugccgucacuugaggucaucaccaucagaaaccaggcagcccaggcagggagcgggaggccugugggccugucaacccccagggccucaggcugaugcacaggaggcugcaggaacuaagggagccuggucaccccccuuggcucuagcccggguccaggcgcuuccuggaacuccaucuagugggaguggugacugcagucagcaguggggauccuggaacaccccagccuuucauacuuucuacaaccccaaggcaagaagaaugaacaccgagcuuuccagauggaaccucccuccugccagaggccaagaguggggcugggcuccuccaacaggagggagcauuuguggcaccacguggagcggccuuuccuaguggagcugcgggcagccaauaguggagcugcgggcagccaagcgggaagcaggucaguggcgggggauccgcugggcgcccuacaaggcagacaggagcccacccccagcucuuggccagaggcccuggacacccacaccgcuaagcaccacuuacuuguugucauuguugagacuguccgugggcugcugguacuguccauucauccugcucucuuugcuguaacagacaacggcaggauucagcaucauuaaaaucaucaggcccagagacacaaggcucucgugaaaccaacacuuauccaagcuugaccaugcagaugcugcaccgaggugcacuuuaugcuucaggcagaaaucuccccauguuucgugaggacacugacgcucaagcuguggaggccccugccucagagcacaccuggguccugaggccaccuggcguggccccugguucuuccaagguggguccugaauagggcugguaaugggagcuggaucuggaggaaugugaguuugguuugugacaaagcagauggugaaggugcucuuccucccacauguaaaggguuagcuugaaaggguacgcugaauccauucuacaaccuaggcaggugccuccucaaaagggacaaagauugcugcucauuauuucaugaccagcaccuccccuggugagaugggggagaggagugcugggaacaggaagccaugcacauuauuuacugcauuuuccuacagcuguguuuggcaggaaacaccaagaucuuugagacccugaccuuagaacaguacugucaccucccucaguacgugaccaucguggucagacugaugauauggagcucugacucuggucuuguuuuauucaggaggucaucugugugccacaggggugggacagccaugagaggacaccaggaagaggccgcuaacuaccaaaaagcaacaugcuuuccacggugcuggggcugggacuguggccaccaaaaaauaacacccugcaaauaacaacauccacgucucaacccucagaaccugagacugggaccucauuuguaaaaccagucuuugcagagacucaaaguaaagauguugagaugagauccuccuggaugaucugccuagguccuaaagccaaugaccacggucaugacagagaagcagagggaacuggacacagagucaggggagcuggccaugugacccggaagccaggggagugacagccacagaaggaacacguggaaccaccagcagcuggaggcggugaggaauggaauccccaagacccuuguaggacauggagcccugccaacaccuugauuucagauuuccaaccucuagaacugugaggaaauuaauuuuaagccgccagguuuuuggucauuugucacagaaccacaggaaacuccuaugugucucaugcauuaguaagcagcugaauuccaaguaccccagaauaggcagauuugaaaaggaaaaugcaaucuacaacugcaaaaccaacuaugucugccuguacuucaacaucuguuccacgaacuaaaauguugccuucucgcugugaucccaccuugaggacuuugccgguuugaaaguggauugauaauuguugagaaauucaaaacaaaaacaggguaucugaugaaaaacaacucauuaacaugugcuguaucuuaagaucaggauaaacagauuuggggaaggugggguuuauauuaguaucgacagucauuuuuuuuuuuuuuuuuagacguagucucguucugucaccaggcuggagugcaguggcgcgaucuuggcucacugcaaccuccaccuccuggguucaagcgauucuccugccucagccucccaaauagcugggacuacaggugccugccaccacacccagcuaauuuuuguauuuuuaguagagacgggguuucaccauguuggccaugauggucucaaucuguugaccucaugaucugcccgcuucgaccuccugaagugcugggauuacaggcgggagccacugcacccggccaacagucaucuuaauaggagcuccgagcuggauuccuguccugauaggaucacagccccucaggacacagaacgggccuacaaccccacauaccuggaggccaugaaaggggucauguccagcuccagggggaaggacacauacguggugaucuuccgccgcagcuuggcugaguguucaaaucgcugcagaaauaggaaggggacagagggaagaggaaagaagaucagaaaugucacuggaagcuucagggccuucuucugaugacaggugucuguguuaucucuuuuguauuuuauugaacugccuuguagcuacaucuagaauuacagauucaaaaacacaguggcaauccacccaaguccucauuuacaggguucaagucuucaaaugaugggacuguucagugguaacaccaaggguacaaaaaguaaucuuacagcaaacccagcaaagcacagaaaacaaaacaaagauccguggcccauggcagcaaaaaugaacaaauuguuccuuucaccagacagaagacaguccuuugccuagaucaggagucacccauuccagccagcaagcuaggaaugggcguuuuccauguuuaaaggguggugaaaugaaacaaagaacauguaacagagaaucguaugaucgcacgcagccuguggagcucgacaucuucaguuaucugggccuuuagagaaagagcuugccaacuccuggaccagaucugcaugcugagggccuuugucuuaaaauaaaacagaaaaccugaggaggggguagcuggaggaaugguagaaguaauaaaaacuucacaaccacucugcucccaagaaaacucacauucuacuuucacugcgaagccacugauuuuguuuaccgcagcacagacaaaaggacaauucacagaugggaggacaauucccucacacccucccuuccucgguguucuuccugcuugcugcaauuauaaaaaauguaacugcacagcaaaccaaaaggcugaggaccguacuguggacuaaaaacuaagucugccauuagaguuggcuuucuggaaaacuuacuuugagaugaaaacaggcuacgaugggcaguuucuucauagugagcugcuuuguggacuccugguagcuauggcaaccgcugcacuugaucuuggcgcugcugcccaagugcucuggucuggugaaucuacaggcguucaaaaaagacaggagcgguaagggagaugcaagagacagaaaaaugagaggaaagagguauuuuaucucuuucauuggguugauuucccuaccaaaaacauacacuuacaacuaaaaaugaaacaaugaaaaaaagagaaaauguuguccaccuuugcugccugucucuacagaauauuuaucuuaaauauuuuuuuuccaggaaaggccuggggaaaugguaauaauuuucuaaguaccauaugacccagcaguugaauuugagccagagaaaugaaaacuaauguucacacacaaacuguccacaaaugugcaccagaauguuacucacgagagucacaaaacuggaaacaccccguuucuucccauggcugaauaauuaaagaaacuguggaacacuguaccauggaguaugagacagcagcaaaaaaggaaggaacuacugaucccaagcuguacccuggaugcguccccagagaauuaggaugugcaagaaaagccaaucucaaaggguuccguuauaucauucaguugacaugacauucuggaauugucaggcguauggaaaugcaggaguccagggugacugcgguuacagaguggguggugagggaggaggcacuggagaugcuggguacuuuccgcaugaaugucugaauccuggccagggcgucgcaccacagugcugaggaggucaccaucgggggaccgggguaaaggguaccuaaaggcuucuuacaacugcaugugaaucuacaaugaucucaacauaagcaguuuaauguagagaggugagaggucggccaggugcggcagcucacaccuguaaucccaccacuuugggaggcugaggcagguggaucaccugagguuggaaguucaagaccaaccugaccaacauaagagaaauuccgucuguacuaaaaauacaaaauuagccgggcgagguggugcaugccuauaaucccagcuacucaggaggcugaggcaggagaaccgcuugaaccugggagauggagguugcagugagccgagauugugccacugcacuccagccugggcaacaagagcaagacuccauuucaaaaaaaaaaaaaaaaaaaaaaaaaggcaagaggacugggaaagguaauuuccugaccgugcagaggcaggagguaggagggcugcaucagaagcgugucuggcacaggugucagcugccacugacaaaaccugcagaacagaugauucaacaaagcacacgccaaauuuugaagcugaaacaccagcaaaaaauucacucuuuucacaagcagguauggaaagcccuuauuuaugcucuggaaauucugccaucuuaacuagggcaagacgagggggccucugggcaaagcugcaccuguuucguugcuagcuuugugaucugcucuccaaaggacucgaaaaggagccuuugcuugcaauacaaaguggggacccgggugcacucuaccucuccuccaccuucccgggagucagcaccacaucaugucucuccuaacaacacaggcuucccacacauuguaguuugugaagugugguuucuaccucauggccugcuguuuuggcaaagcuuucauuuuauuggaauuuaugauuaaauuuaauuuagcugcaaagacuuucuuuaaaaagguuuugguuggccgggcaugcuggcucacaccuguaaucccagcacuuugggaggccaaggcaggcggaucaccuaaggucaggaguuugggacuacccuggccaauguggcgaaaccuagucucuacuaaaaauacaaaaguuagccggauaugguagcaagcaccuguaaucccagccacucgggagguugaggccggagaaucacgugaaccugggagguggagguugcagugagccaagaucgcgccacugcacuccagccugcacucuagaaagagcgagacuccgucucaaaaaaaaaaaauuaaaaaaaaaaaaaucacaaaaucagcugggcaugguggcacacaccuauagucccaacuacucaggaggccgagacaggagaccaaggcugagcccuggacacugaggcugagcccaggagaucgagguugcagugagcuaugauggcaccacugcacuccagccugcaugaaagagcaagacccuaucucaaaaaacaaaauaaacaugcaacuuuggucgugcugacuaugcagccagacagaaaccaaaggcucguaccucuucuaagggauacuuccacucaacaaggacucuucugcauuaccuuuaauugaugcaaauaaaacaaaggcuauaaaauaauagacaaauuuuaggaagguuuucugcugucuuuacaauuguaugcuacagcuacuuaaauacauuuuuuuuuaaaaaucacucacaggugugguggcucaugccugugagcacuuugggaggccgaggugggugaaucaccugauaucacgaguucgagacuagccuggccaacaugguaaaacccccgcucuacuaaaaauacaaaaauuagccaggcgugguggugcacaccuguagucccagcuacucaggagaaucacuugaaccugaaaggcagaggcugcagugagcagaaaucgcaccacugcauuccagccuggucgacagagcacaacucugucucaaaaaaaaaaaaaaaaaucacuuuguaaauauuauuacuuaucccaaaugaagcaguacaugcacaauuucaaaaacagcccuaagaguacagaacaucacaacuaaguuuuaaucaugugcagagaaggccguggaccauggggagaggcccgggcgcaucucagcucacacuccgggguaggugauuagugcaagggcuaagggagcagccaguuuggcucuggguucauuuacaugcggagguuggaguagcagcugcugacacugacaccuggugcugugcgaagcugggggacagaaauauugagucaucuggccaaaacaaaggacaaacuagcacaagagacugcagccaauccaggcucaugcugcaccuuugcccaggcucuguccugggcaugugaaagagcccugcuuugguccugauggagcacagccuucuggccaggagacacgcccccgccgugugggugcaggccucucaccgucgcaggcaguccgugagcguggugguucccgacacguggcuuuccccguuuaccacguugcccucgcucccugggcucaggggccagaaugggguggaagagccggggagauccaagcugaugucccagaaggggucgauggugguggagacuccacuggaagcagagggaaaacaauggcugugaggacugacacccacccagcuccagaggcaacccgggguggaagccguucccacaucccuuccccgcugugcccuuugucacagugacacucaggugggauggggcaggagcaagagcagcagugcucacacccaacguguccuggcucccaagguggcccuggggaggggugugugugaacucggaaggcgaggggcgcuccucaagcaaggacuucccagucuggagaccaucacagucacugagggacuugggaggaggauaaacucaugggcccugucagaggcucugaauccacaggucuaucucagcugcaucuagaacuuggggccugugacccuaggcaacacuggagaccccugcacauuucacagagcgugcccaggccaggcccgguggccugcacuggacagucaaugcugcauuucacaaggccaguuccuugcuagaaauuuauuuaacaauauaaaaaaugaaaacuugcagacugggaaauuuacucucgauauuuauacaggauuuaaaucuugagacaaucuccuacuaauggaauucaguaguuaagggacagcgaggagguccaaauugcucagagcaaacucgguuucuaauacucagagacaaggccccaaacggucuaugcuccuuauagaaaauggcccccgugacacaggcagcacuggccuuucccgauauuugcucgucuuaugcaguuuagaagugacaguccauuucggguucugaaauaauuucgguggaucauguccaggguuuuuaaacuucaacugaaguaaagaacagagccaggcacgguggcccaugccuguagucccagcuacuugggaggcuaaggagggaggaucgcuugagcccauggguucaaggccagccugggcaacauacacaagaccccaugccugaaaaaaacaaaaacaaaaacaaaaaaccuguagcaugcacugagguugggugagaggguccccugaccuaacaaagcaauggauucucccugcacucaacacuugaggcucuaagcagagaccacaucugagaagaauuagggccacuacaucagaaaauggaaccagaaaccauaaaauaaugaaaacuaacacacuucgaagcacguagaaaaacaauccaccaugcaugauccacgccuucuugaagagggcucuuucacuuggucccuggucaaggacuguaagaugcaaaaugguaggggaagcuuccaagaacacacugcuggcuguagacaacagccaagaccucaacacgaagggcucgcaucccgaggggacaccugcccuacgaccuccccaagaggaagcacccccaccccacaaccuucgcucucauggcgucuauuaaucauuuaucucauagccuccuuaaagaccucucagagcacacacagcucuggagacugggaggaugucaguacggccccagaggguuugauauugccgagcacgcagccucucacuuacuggcagacuuggcaggugacgucugacugcaacccgccugugaagaucuggucuaugaugcaguugcagugguugggguuguuggccuucuucccauugucaucaccuggagacagaccacggcucugggauuagugucuccccaaauauggggagucucuaagggaagagcaguucacccugcagaagccugggggagccagggccaacgcuuuaaaaggccaugugaggacacuccucauuuuagcagaggguguccuuguuauuuuaauaugacgagaaaucacagcacuuggauuuucaaugcuccuuuuucucauucccuaacaagagccccacagcuucagucuugccaagaaaacccaccuaaugcccagugacugagcagaauaaucgauucccauuaucauauaaagaaugacugaaucaauauuguuccagugagacagcugaacauauggugggccagguacacccggggaagccccagcaaccucccucccugaguagguaucauggugccccaaguucagaaagugacaccgcaggacacaggcuguccucaucagcuagagcccccaggggacagcgugucuuccagucaguugcaucuggaagugccacucccacccucucuauucaauacacacuucauucauauccaugugugcagaucugugaaaaagaaacuuaaguagcagaacuuaauucguguguggaauacauauucuacauaacuucacuagacaguggggacagggcacgaggacaccuguauauacaucacaguucaaagacguugaaucaugacagaggaauagagaagggccacuaagucuucugagagcagaagguuuaagauuagagagaaaaaugcuucccagagggaucucaaauucaugggacaaaauucagaggacaagaauauccauacaggaaggcgcaaagaaugaugaacagaauggccaggcgcgguggcucacgccuguaaucccagcacuuugggaggccaaggcgggcggaucacgagguuaggagaccgagaccauccuggcuaacacggugaaaccccgucucuacuaaaaauacaaaaaauuagcugggcaugguggcgggcgccuguagucccagcuacucaggaggcugaggcagaagaaucacuugaaccugggaggcggagguugcagugagcugagaucgcaccacugcacuccagccuggcgacagagcgagacucugacucaaaaacaaaacaaaacaaaacaaaagaugaacagaaagaugccgugaaggccacaaggacaaaaugcacguaaccaaggccauguggccaggccaccucgcugaacagcucuggcaaccagguuucuaaacagaagaaccuuacauuucuuuucagacauuuccaagggaauucugucagaagcacgucagaggucacauuuugucaugugaacauuuaacagcaaugcauuuuugaacaagugauuuuuagaacaucuuucugcugcuuacagaaggcucuucguuauucucacuaggugcuugggguaacagcauagucacuuccacaguggcucuuuccucucuuauaaaucauacuaggacaugaaauucuaccuaagcuacuaaguaacuuuccuuugauuucuagguaagaauuaaaaggaucacguaguuuuucagaggaaaaaaaguaaguaccaaaagaaaacagaacccaaagucacauuugaccaaaaccagccauuuuagcucaacuguggguuguuucugggcugugaucucagaacccauagguuguacguaagcgccuagggcccgggugcacagccuugagacggaugagaagcgaugggaaggccagcccaccaagcuguucaacucggugaaccgucagaacaggacucuguucucuaaaagacuccaaguuaaaauuaacugauaggauaucggcuacaacuagcugugccagcccagagaccacaggaaacucacaagcagccaggugcccugugaccugagcgcauggguucucagaguauggcaucugaaccagcggcaucaacaucagcugggaacugauuaagagugaagaagccccugccccccacagaucugcugaaucagaaacgccagcacgggcuuuaggaagaccugcaagugaccagcccacacucaucugagaaucaccucucagucucucugccuguauggauagacuucagcugcaggucccucacacugggaucuccaccaugaggaguggggaggagccgaucuuggcucaagucauucauucccagccucccaccuccagcgcuaagagcugccccugccaacuaccaacaccacacaacucugaaaaaucaucaggguaccacccuggggccaggcugugggacuauguugggggagauggcccagguccaaugagaccccaagagaagcuuugcucguccugugucccagcucucuggcuauuucagagcaaccaucaguccuuuuggagaguccccaaugggaaggagacaguugggugauuaaguuguguuugggggauguccagaagccucaggccugauaacccacagggucccagaaaugccagggcaggcaggggccucaaagcacaggcccaagagggcuccaagaguuugcuguucacugugaucggucacugaggaccugucauacugcuggaacuacuuccucgccucuuaaaaauaaacuaggaggagccucucugaggucauuaguuauggugacuucagaaacaaaugacgacaagggcuaugaugacaaaacaauggaaugugucaccugugccccuuuuugcacgagugcauacacucgcuuugcuuccuuccccuucaaggaaaacauccugcccugguggagggugcagagcccagggcccaccuuugcagugucgguggagcacguccagggccgcgaugaggaacucgugggcguccugcugcucguagccugcuaggugccucgcguggguccacaccaggugcagcaacuuauacgggaugugaggggaccgguguccagaguaaaacugccagagggcggggaaggaaaccuugucaggaauaaauguagacucugaacacagaguacacacaaucaaaaccuuuaucagaugccuaccauuggcuguggcucauuugacacaaauguuuggauuuuacuuuucuacuuuuugcaaagucuauuuuuaucugggcucacuggacuuuucgaguccucauaugaauuuuuuccuuucuaccaucuaguuuuccacauauaagccuaaaaaaugaauuaugacuugcuacuaugagaucacaugcaaauaaaagugacucgauuugcccaauacuaguuuccucaaagcacuagccaaaccacucaggcccauggacaccagcaccuccgcaaagggaagcacaucacugugauuaugcagaauucaccagcaucagccacaggauucucugccucugaggcuaauggcaauuagcugagggcuugccagccaguccucuccaacagcucaacuccagccgcagacccagcagcacaccuuccaucccacggcuuccuccccaggucagaacccacagaggggucuugccugugcaaauacagaauucagggcaguuuuauuucucaucaaaaaacccaaaaccacagaccacccaaaugugucugaacugggaaacagacaacuaaaccauaacccaucuacauaauggaacccaacucagacaucgaaagcacacaucauggaugcacgcaagacacgggugaauccacccaguauuacauuaaguagggacagccagauucagaaaggcuacuuccugcaugcauccauccguaugaugcgcugguaaaggacacucaagggaccgaagacagaucggcagcuaccagggucuggggacuggggguugacuucggaggggcacgagggaguucggagagguaacaguucuucaucuugaguagcagcaguuacacaacuaugcauucgucgaaacucaucuaucuauaggcuagaaggugggugugacuguaauuuacaccuuaacaagccggagucuaaaaacaaucuaacacaagugagcuuaucacuaaagucagugauacaaccacccaccaacuucccagcugcacccuccuuucuccuauuugggccguguccccagcaguuauggcacauugcagguacuuugaggaaaucgguuaggcucgaccagaggcuggcaaucuguuuuugaaaggcuuggacaguaaauaauuucagcuuugcagguuggauagccucuguccaacugcucaacucuguggcugucccacaaaagcgaccagugaccagacagacaugagugagcuggcguggcugcaucucucgcagagguuacgaaugggaacaggccagggcuguuggcuggcuccugugcaaggcaccugaagaacaggcaccagccugcuuauuaguugagguaacugagcugcuucagcucugagaagcaugucuaggucacggagccggugagggcugaggcggcagccgugaacgccuugcucugaacgcugccaugcucugaugccggggacagaaguggacaggaacgccacacgugcagcccacaggaacagccaacgugcagcgcguagcucaugaggacagaggcucugauggggcaugcuuagagagaccuggcgguggaggagacucgcauaccaggaggacacaggagggugacacaugcgugccuuucugagccaggaagguagaccauggaggaagaggaagggggagaaucacccgucuuuagagacaaaugucacccaccagggaagucucugccacaagccucucaaagggcuucuccuuguucugagucagcagugcguccccaaaaaucacgccaggucuucccuuuuuggaaaacuguguuuuccauaauagacauguauauuaaacauuaacuuacuacaaaagguucuaaauguaucuuccuuuaucaugguccaccuuaaauuuuuuuuuugaaggugaaaacaaaguaacagaaauguuccccugcagaagucaauggcgcucaccuccugaaacagugaggacaucucacagaccagacaggagcuggggcucugcaucucacagcggugccugucagacaggaagaagucccgcagaaguggcgugugggucagggccugcacgaugcaguucaugaagcauguguucccaagguugaucagcccacgcagaccuggacacaaaucaccagagagcaggaguuaccugugugcugaaccacaggugucgcuggaucccagcggcuuccucuaccucuacauacucauuuucuuuuauucauucauucaagccagaacacgaugagauaucgcauucugcuaguuuuuaugccacuuuuacaugaacgguauugaagaauguccaccaccauggaccccucccacuucagccauuguaugcuuugacagaauuacacaaauauaguuucuacgacaacaggccaggucagagugaagccuaaugaacaaacaaaacagguuuuuaaaaauguucuagggccagggcaggggcucauacuuguaacccagcacucugggaagccaaggcaugaggaucacuggagcccaggaguucgagaccagccugggcaacauggugagaugucucuacgcaaaacacaaaaauuauccaaacaugguggugugcaccugcaaucccagcuacuugggaggcugagguggaaggaucgcuugggcccaggagacagagggugcagugaacugugcuccagccugggcaacagagcaagacucugucucaaaaaagaaaaagaaaaaguuuuaaaggguauucccucaauuuguagaaaauucagcgaacacuuacacucacacacaucauuucucucccugaagauuacugugcccagccucacccuggccaaaaucaacuugagucccuuuacccacacagacgcugaaggcugugagggcagggcuguugcuacgcaucacucugcgccccaagcccacugcaggucccugcagagaacaggugcucaagagcugguugcugagcacauugaugagugacaguuaugcagggcuucaacagaaucauguggacuuaagaaacccacaauucuguauuuacuuuuaaacccuggaaagaagccuagcugagagugacgacacgcuccacccaccuauggugcaguucgaggugaucuuucuccuuuucggguugugcuucagcaguucaagcucccguuugguugguucccaaguugaaaacuucucuccaacgccuaagcagaugaaggacaguuccaagcgcuauuagcuagauuuucacaucaaguguguuuacacauaaaagcuguggcgcuaugcugucugucagggugcauuucagugagcaacauccacagcaccagggcuuucucaaacucuacugugcugagaggggcuacacacaacacuuaaaggagcuucucacagaggguaugaggaugugagcuacguuuccugcaagaaaagcagcaccuccagucaaaacuaccccaacgccaaugccaaaacaguuguuuuucaaaugucuuccauccuucagcacagagauggcagcaucagcaccaaugggaacuuacaugaaggauucucccgcaaacaagugaaauugaaggagagagcuugcacuuuucagcaaacugaaauagcauaaacucagcgucgaguuaccaaacuaagauagauccaacaguuaaaaacgugugugccacaaaauauucagagaguggugguaaaugcuaauuggcauaguauuccauucaacgcacacccuaugcgcucagaaguacuuguuccaugccaaccaacauuucugaauacuucaaaauacuuuaaaagacacagcauguuggauagacagaauuauaaaaugauucuagaagaauuccauuuuaauccuggacauacauuucuuaggcccgugcuuuaagugcucugcacagaauaauacacccacacuuagucacaauguuauuaaauuucugagagggaaaagaacagcgaacacaagucagagauugcucuccagagaagacuuguuaaacacaaauaauucugcucacugaaagagccccuguugcuauucuucccuucucaaaacacugggguguuuucaauggagaguaaucaaggcaagaauguaaaacaggugucagguucauauguuuccuuugcaaacagugauggcuuugcuaccagggagaucagaugcucaccugucaacugggguaaaccacaccugucacuaugucacuaucacugucaaccacuaugagcaucugucagaaucaaaaaccaaaaaaaaaaaaaaaaaaaaaaaaaggaaaaaaaacucagggaagccaagaagaaauaaaaaauaaagaaaaugacugcauguuugcuccucucacucuguguagccaauaaccaguguguguggccacacgguggcgacggcaagugcaaaacccacacuggugcgagagccgugagggcagcucacaagauggcaaggaucugacugugcaguggggcugcugggagacucuccuaguuuccuucuggugggucuaguuuccaucuggugggucuaguuuccaucuggugggugcacgcuguugacauggauuuaacaucacccaaacaguccagaguuuuaaaagagauucuaccacaacuugauccgaaaauagucugcucuccugggaggaaggagguauguuuacauauaacauuacugcaaagagaucgcuugcuagaauucggcagagcugagggcaaaccacucagggauguccagauacggagucaccuguccccgagaggugugaccucgccacacucguucagccccacaucugcaggugcgcccugggagagcuuaaguaaugcugggguuguucccuuggcccagcugcaggcccaugggggaccugcaagggaagcacccuggaaguggucccaagcacacgggcagcuaugcaugccucgacacuagccaccuccccugucaugcagagcuucagcugacuccacugugggccuuaggggaagguggggacggccucuucccaccagccugccacuucccaccuagguacuucucuuucuccuacugggucugcccuugauggacaugagggaacugcaggaucaagcagguaaacugagguggaaccaaaccuugcauuuuccaagcuuuucgcugcuccuccuuggcgauuauuuccaugucuuugucauagauguaguccuggcacagaaaacaguagaugccuccguacaucagaucaauggcugaggagagaaaggagggaggagaaaccaaguugaauuaaaaaccacaauggaaggcuggagggcagaguuaaacacagugagguucuguagauacugacuguucacagcaccuuccuauucacaagcagggaagccaguccagcggagucuccuauccugagcaggugaggggcaugcacuguguuuggcagcucaugcccagggcugaggugucuuaaaaaacagaggcgacccauacauacuuuucaaagcagccaauacuccaggaucaggaccucugccaccuucucugaaugcgugguauuuaaaacugguacaacugcauuggauauuuucaguccuggccaccugacacggagugacuaugcuucccuccaucuagaauuccugacaccaucaccauaaagaauguggcagcaacuugcugugacuuuugugguuggcggcauuugcuacucuuaccuuaaguacagggggaaaauaguuucucaucggaugacuuugauugacaucuugacccagagcugccugaaggugggucuucuaccacaauuucucaacugcaucuucuaaaaaaugggacuaauaggccaggagcugugacuuaugccuguuaccccagcacuuugggaagccgauguaggcagaucauuugaggccaggaguucaagaccagccuggucaacauggugaaaccccaucucuacuaaaguacaaaaaauuagccaggcaugguggcacacgccuguaaccccagcuauucggggagcugaggcgugagaacagcugaaaccugggaaggggagguugcagugugccaagaucuugccacugcacuccagccugggcaacagagugagacucugucucaaaaaauaaaaauaaaaauaaaaaaauuauaguaauacuaguauauucuuuucacaaauaagaagagauacauauguauguauaaauuucaauuuucuaaaacagucacaagaaacuguucacagucguuuccuuuggggagaaguauacauuuucgugucguuugaacuuucuaaucgugugcauguccaguuuuuaauugucaacauaaaccuuuauuuuauggaaauaagauccacuuuugcuuucuuuguuaaaaguaauaauuuguaaaaagucaaaaaaauaaaauaaaauaaaauaggacuaauaguuugggcucuuaauuauuuuaucauaaaaguaaguaagauaaaguccucugagugccugaaaaaagguacucucuccauucaacaauuuauaaacaacugggguuaaccggguguggugguucacgccuguaaucccagcacuuugggaggccgaggcaggcagaucacgaggucaggagauugagaccauccuggcuaacauggugaaaccccgucucuacuaaaaguacaaaaaauuagccaggcaugguggcaggcaccuauagucccagcuacucaggaggcugaggcaggagaauggcgugaaccugggaggcggagcuugcuaugagcugagaucucaccacugcacuccagccugggcaacagagcgagacuccgucucaaaaaaaaaaaaaaaccaaaugaaccaggauuaccuacccaaaggaagguaaauggcucuaccauaaagacacaugcaugcguguguucaucgcagcacuauucacaauagcaaagacaugagaucaaccuaaaugcucaccaaugguggacuggauaaagaaaauguacauauauaccaugggauaccauguauacauaaaaugaaaugagaucaugucguuugcaggaacauggauggagcuggaggucauuauccuuagaaaacuaacauaggaacagaaaaaccaaauaccacauguucucacuuauaagugggagcuaaaccauuagaacacauggacacaagaggagaacaacagacacugcggccuacuugaggguggagagugggagaagggagaggaucaggaaaaacaaacaaaaaaaauugucagguacuacaguacauacccaggugagggaauaaacuguacaccaaaccacugaauaauacguuuauauaacaaaccugcacauguaccguugaaacuaaaauaaaaguuaaaauauuuuuuaaaaaacugggagagaaacccggcgugguggcucacaccuguaaucccagcacuuugggaggcugaggugaguggaucacuugagcucaggaguuccaggaccagccuaggcaacauggugaacccccaucucuacaaaaauuagccgggugugguggugugugucuaaggucccagcuacucaagaggcuuagguggaaggauggcuugagcccggaaggcagaggcugcagugagccaagacugcaccacugcacuccagccugggcgagagugccagacuaugucucaaaaaaaaaaaaaaaaaaaaaauugggagaguggggcuuaaauccacgugaugucagacacccgggaggcagcgaagcacagaggaaagaccauggauugagaguaacuggcaccagcccucacuaugccaccugccagcugugcaccuuucaucaauuacuccacaccucugagccucaguuuccccugcgguaagaugcugauagcaacgguacuagugcuucccagagcugugugaugauuagguuaguauauaacuuaagugcauccccggauaaacagggaagucuuggaacaccacaguuuuauucuauuucaggucuuaagcuacuacgacuuauauugugguaaaucuuugaagucuuccaaagcagaucuguugaaacucaaaacagcaguuuaagauucccagggcuaccuucugcccuacucaaaaaauucacaaaaugccaacaacgauguuaaaauccuggugggagcugucgcagagcucagccaucaaccuuugccacuuccuguucaucagcaguacagccccagcacauggacgucacagagaaauccugacagagacaaguuuacaauaagggugaugagaauuuacaguaaggccaagauaucccgugaaaaacagcccacacauguagcugacaacaaaaacucuagccugggaagacggaucaccauuccagugccuauguaaauccuucuagauuuaggccuucuuuaagacgccuucacacugcaacgcucccacugcauaaaaccaaccgacauccacaaggcaucaggaccauuugaggggauaggguaucucuguaacaaaugcugcugggacaacugaauauucaccuacaaauccuuaccucauacuguauacaaaaaauuaacucgaauggaucagagaccuaaauaugagaaccagaaauauaaaacucguagaagaaaacuuaagggcaagucuucaugaccucggauuugguaagggauucuuagaucugacacaaaaccaucagcaacaaaagaaaaaauaaaaccaggcugggcagcagcagcucacaccuggaaucccagcacuuugggaggcagagaugggaggaucacuugagcccagaguucaagauaagccuuggaaacaugguaaaaccccaucucuacacaaaguacaaaaaaucagccaagcgugguggcgcguaccuguggucccagccacucaggaggcugagguugggaggaucacuucagcuugggagguugaggcugcagugagcugugauugugccacugcacuccagccugggugacagagggagauagugucuugaaaagaaaaaagaaacuggacuucaucagaauuaaaaacgucugauccugugcuucaaaggacacuaucaagaaacuaaaaagaaccuacaaaaugggagaaaacauuugcaaaucauacaucugcucagaguccaguauccagaauauacacacacaccccaacacacgcacacacuguauacugugcauguguauauauaaagaacaacaacaaaaaccaaacaacccaauuuaaaaaaagcaauggacaugaacugauauuucuccaaacauauacaaauggcccaacaagcacaugaacaaauauucaacaucacuggucauuaagaaaaugaaaaucaaagccacaaugagauaccauuucacacuauuauggguauuaaaaaauaaaaguguuggcaaggaugugaacaaacuggaaagcuuguccaucacuggugagaauuaaaauggugcagccacaaaaaaaagaugguguuucacauaaguuaagcagugaccugaugacccugccagcucacuucuagguauacauccaagagaaaugaaaacaugucccccuagaauuacacacaauguccacaguggcacuauuccuaagcaccaagacgaugggaacaacccacacguccaucagcagaugaacggaugaagaauguggucuacauaaacaauggaacaugacugagccauacaaaggaaugaaauacuaauccauaauacaacucagaugaaucacaaaugcaugcuugcggaaagaagccagacacgaagggccacauguuauaugauuccacacauaugaaauauccaggaaaggagaacccacagagacagaagguagauucaagucaccaagggacaggagagagagcaacaggcagugaucuguuaacgacgcauuccucuguggugcaaaaaaguuuugaacuagagagguggaggacacacaacauuguaaaugugcuaaaugucaccgacuuguagacuuaaaaaugguuaauagggccaggcgcgguggcucaugccuguaaucccagcacuuugggaggccgaggcaggcgaucaccagaggucaggaguucaagaccagccuggccaacauggugaaaccccaucucuacaaaaauacaaaaauuagcugggcauguuggugugcgucuguaagcccagcuacucggguggcugaggcaggagaauuguuugaaccugagaggcggagguugcagugagcugagaccgugccauugcacagcaugauauugaggugacagcuuccagauguccauaagaaaacagcuggaucauaaacacaucauagaagauacagguauguuuugccuuaaaucgucucacuucuuuuuuacuuuauuuuuuugagucuugcucuaucacccagguuggagugcaauggcuugaugacagcucaccacagccuugaccuccuaggcucaagagauccucccaccuccugagugaguagcugggaccacaggcacacaccaccacgcccugcuaauuuuuaaauuuuuuguagagacaggauuucaccauguuguccagacuagucuugagcuccugcgcucagguaaucugccaaccucagccucccgaagugcugggauuacaggugcaagccacaccgcuccucccucaucucacuucuuuaaaaaaaaaaauuaguaggaaaaaaaaaaaucagacacacuguguccaggcaugguggcucacuccuauaaucccagcacuuugggaggccacagccgaaggaucgcuugagcccaggaguucaagacuagccuacgcaacauagugagacccugucuccacaauuuuuuuuuuuuuuuugagacagauucucgcuguguuguccaggcuggagugcaguggugcgaucucggcucacugcaaccuccgccuccuggguucaagcgauucuccugccucagcuucccgaguagcugggacugcaggcgugcgccacagcacccagcuaacuuuuuuguuauuuuuaguagagacgggguuucaccauguuggccgggauggucucgaucuccagucugcccaccuuggucucccacagugcugggauuacagacaugagccaccacgcccagccuacaaaaaauuuuucaacacaggaagucacucggccucccaaagugcugggauuccaggugucguggugugugccuguggucccaacgagaggcugaggcagaaggaucuccugagcccaggaggucaaggccgcagcgagccaugaccgcgccacugcacuccagccuggacuccagacaaagcgagacccugucuccaaaaaaaaaaaaaaaaaaucagacacacuaucugugucgucagccucaguuaaagccgugggucuuauccuuuacuacgaguacuccuuguagagagcuguaagggacgugggugcagugacuuuauggacucgcauguuguuuccaauaggucuuucuaggcuaauguuuuuaaaagagcaucaaauuacagaacuucagggcgggaaagccuaaaaauaucuuuaccuggaauugcuaggcucacaugaacuauucccuaaaacagguaucuagcuuggaccgcuugaaaaugcuguucugaaggauauccugccaacuccaugagcauuccaaggaaaacacuacuguguagaagaaacaguuaaugcacgaagucagaaaacaaagccaaggccgggcacaaugguucaugccuguaaucccugcacuuugggaggccaaggcaggaggaucacaugaggucaggaguuuugagaccaaccuggccaacauagugaaaccccaucucuacuaaaaauacaaaaauuagccaggcgugguagcaggcaccuguaaucuguuacaugggaggcugaggcaggagaacugcuugaauccaggaagcagagguugcagugagccaagaucacaccaccgcacuccacccugggugacagcgcgagacuccaucucaaaaaaaagaaaaagccaagagcaaaacugaguuuuauguaacuucuagaauguagaaugaguuugauuuuguaaggcugugaaagguaaauuaaucuugaggccacacacagugcuaagggagccuuuucaagaacugugugacuggaaacaaugaaacccauugcugaaggccauaaaaucaccuaugcccacccaaccccacgccagccucagcgaccucauauugcauggagcucuuucuuuauaaauguuugccuaaggugauuccuauguguuucaaagggucugacguuucauuagcagggacagugcaacuuuucacaggaagucagcuggacauaagacagcaggccauucacucagaaccaucggaugcgaaggcaaacugaggacgcgauucagcugagcucggcuugucccuuucacuuccaagugucaccagugaggggcacgcauuacuugagacaaacgacaaaguggacuuuuggaagaguggaacugcaaaucaaaaaaucaaagaguagcaauuugggggccacaacuauccccccaucccagaagcucgccucacccagguugugccgcuucgccuucgcaugcucgugaauaugcuucuuugugaaacagccgaagaagacacaguagaggcaggaaugcagccuguugagguggacgccacagacauggcagauacaggacuuggccugaaauucagagaagaggaggagugaacgcugugugauaagacaggggugcucagaggaaacagucaagcaaagcauccccccgagacagcuacuggaagaaaggacagggaauuccaucuucaaggcuuacuacucuagaggaucaguuuaauccuuucaguucccccaaacaggacuucauucagaugaaaacuagcuccccauaggaaaacuccguccacaacuucaacugccaaaacccuguaagcuacggggauguucccccaccuccugcuccugauccugaugggcaccccaagcccagcucccauccccacugcaggccagcaacucacaccuagucacccuuaaccuggacaucauuucagauuugcaaauccagguuccaggaccacagcaaauuuagaagccaacaagaaaaagggagggagacaugaaucaaagcaauguacagaagaaagaaaaaggagcagggcauuaccaagaaacagaccucacaaaccugaaauguuaaucacggcaaugaugagcacagugguaaacaaccguuacacccccaaccacccaggagugccacugacucacaauacuaacgggacgugugaacagggacagccgccacuggcaauaguugcacaauucgagcacagaaaugaguaagaggaauuauuuauacugaguuuuaaaagaauccguaaguccagauugauaaacauauacaccuacuauguacccaucagauuuuuuaaaaaagaaauuaauacuauacaaacacaaagucuucuucgcaggagaauuccaucuaauaaauaucguaaaaagacaaaaauacaagaucuucauuuuaugcuuaucauaguaguaacuaauucaggcaagaaucaucaguagaugcuagaaccacuggguaaaaaaauacugugucauucacaacugugaaaauaguagaaaagguccauauagucaucaacagaugaguggaugaacaaacuguagcauauacacaauggaauauuaauuacuccaccacagaaaggagugaaguacugacacaugcuacagugcagacuagccuugaaaauaucaugcuaagugaaggaagccagaaacaaagggucacguauucuaugagucuauuuacaugaaauacucaggauagauaaauccaccaacacaacucaggacguugccaggggcuggggacagggagaacaaggaacaaauaaaaacauuuucaaauuugauacagguaaggcagugacugcacagcaguguaaaccacgaaauguugcugaaugauuccucuaaaacagucaacuguauuaugugaauuucaccuggauuaaaaaaauauauuaaguuacauaaacaauugucccucgguaucuaggaauugauuccaggauccccucagguaccaaacuccauggauacucaagucccugauacaaaauguacuugcaaauaaccuaugcacauccucccauaaacuuucaaucaucucuagauuacuuacaauaccuaauacaaaguagaugcuaugcaaacagugguuauaauauauuguuucaggaauaaugacaugagaaaaagucuguacauguucaguacugaugcaccuaucccuuuuuucccccaaauaucuuugauuugugguugguugaacccacagagguggaacucaggccgcuuguguguguguguguguguauguauguauguauguauguaugcaugcacacguguacuuguguauugaggcaauagauauauacaguuucagaguaucacuccagagacuacuucagucaauuaaacgggaaaagauuaccucuacaacaaagaacucuggccaacgccacccuaaccaaacuuauccccaccacagagcaggcaagugcagagaacaacauggcggcgccuguggcgugcucagaccaacacgacccaucuggaaccugcuccugagaaguagggagguauguccaaauugaaggacuucugcaaaaugacugaccugagcucuucaaaaacauuaauguaaugaaagaaaaauaggcuaggaauuucuagaugaaccaaaucuaaagacacaugaaaucaaaugcaauccaugaucuuggauugaauccuauacgccaauuuuuaaaggcauaaaggauauuauuggaacaauucagguauuuaaaguuggacaauguauguuagauaguacuauuugaaaaauuaaacugagugugauaacuguauugcgcuuauguaggagacugucccaguucuuaggagguaaacuaccaugaugucuacagucagcccucagaugauucagaaaaagguacagacauaaaaccaguuagcaagaagcuaacaauugaugaauccauauaaauguauacaauauucauuuuagcauucuugcuauuuguuguagguuucuuauuuuccaaauaaauggauagaagacaacuauuaaauugaacacauguacccuacagccuaacgcuucaauucauagguuuauacgcaaccaaagacacguacaaggacuuuuguagcauuauuacuugcaacaccgcagagcugaaaauacaaauguucaugacuuguaaaaagaauaaacuauacuacaguuaauugaguaaaguacacagcaaugaaaaggaacuuaugauauacucagcagcguggaugaaucucagaaaccuaacacugaacaaaacaacuaaacacaacaagcuccugcugugcuacacacuccauuauagucuaucucuacuacacaaccuaggacugugcuacacacuccauuauagucucucucuacuacacaaccuaggacuaugcuacacacuccauuauagucuaucucuacuacacaaccuaggacugugcuacacacuccauuauagucucucucuacuacacaaccuaggacugugcuacacacuccauuauagucucucucuacuacacaaccuaggacugugcuacacacuccauuauagucucucucuacuacacaaccuaggacugugcuacacacuccauuauagucuaucucuacuacacaaccuaggacugugcuacacacuccauuauggucuaucucuacuacacaaccuaggaugcuccccugcacggguuuaccaaucaccagggaagacacauuuuacaggccuuauggagccaacacagcuaagagacagcuucuccaacauuauucaagcagccaaccaacaagacaacuggcgcuaaauacagaaaacagcugucucugacauacugauaaaaccucaaucuuaugucugguauagucacacaccacauagcaauguuucagugaaugacaggcugcauguacaauggcggucccagaagauuauaguaucauauuuuuacuguaaccuucucuauguuuagcuauagaaacacaaaugcuuacaaccgucuuucaacugccuacaguguucaguacgguacgugcuguacagguuugcugccuaggagcaacaggcuccaucucacacagccugggugugcagcaggcuguaccaucuagcuuuguguuaagucacuccaugauguucacacaaagacaaaaucgccuaacaaugcauuucucagaauguauccuguuguuaaacaaugccaacacugcauuauuauuuuuccccaaucuacacuguggaacagcacguccauugauaauacuguaucagauuuaaauguaacagaggcagacacaggaguaagguagcacaugucuuccagugucuggaggaggccaggaauagccucuggaguggcuacccugcaaacacuuuauuuuggacguccagucucauaauuugagaugaaauuucuguuguucuaaguuaaucgguuuguggugguuuguuacagcaggcccggucacucacaugggguucacauucauuuuuauucuaucuccuuucacagcacuguaaaguagaaaacacagccaggcguguuggcucacgccaggaaugcagcacuuugggaggccgaggugggaggacagcuugaggccaggaguucaagaccagccugggccaaauggugaaaccucaucucuacaaaaaaugcaaaaauuagcugggcaugguggcacacaccuguagucccaguuacucaggaugguuugagcccaggaggucaaggcugcagugagccaagaucgcaccacugcccucuagccugagcaacagaaccagacccugucucaaaaaaaaaaaaaaaaaaaaaaaaaaaaaaaguugaaaaugcauuccccaggcacccuugcagcucauguuccaaacauaucuugagacacauuugcagacgaugcgguuggugaguaagcuaaggagagaggcccagugggggcauccacaggcugacauggaccguggagggguggcacuguuuaagcagcccagcacaccacuuucuggugugguggcuccugcagaggcaggauuccccaggcuggcggguuuuccuagaaauucaaccuagaaucuacuacuccauagcccuugcaaugauuucugaauuaaauccuuuucuccuauaaauuaauucaaguagauucaguagacugcaagcaaauccugaaacauaacuaggauuuguaugugacaggaauuagaagaggaucaauuauuuaauuguuguugaucuuaugcaguacagaaacacccugccaaauucauuaauuuggucccgauauuaagaauauuccucugaauauccuguccucuuaucuccccacucacacuaccucccaccccaagaaggaugcggaggagcaagaggggcagagcccuuguagucaaccagacuuacccuaugggaugacucaacaguacacugaauuuugaguccagcuuuuaaaagugugcaaacaugacacaccaccuuaagagcuagugcacuuuucacacauuacccaugacuuccuacuggucuaaaaccugagcaucuuaggaagguaaguuuaauucuugugcauucucuucagugacuuuuucaaggacucaaacacugacauaagugaagggacagguauaauuuuuuuuuuuuuugagaaggagucuugcucugucaccaggcuggagugcaguggcguaaucuccgcuaacugcaaccuccgccucccggguucaagugauuccccugccucagccucccgaguaucugggacuacgggcgcgugccaccaugcucggcuaacuuuuuguauuuuaguacagaugagguuucaccauguuggccaggauggucuugaacuacugaccucaagugauccacccaccucagccucccaaagugcugggauuacaggcaugagccaccgugcccggccuaaauauucuauccuuuauaugaaaaaaaaaauacggcacuaaaaagcuaaagacuuugccaaaauuagauaaucuucucaaauuaaguuccccaaccucaaaaaccucagcuuccagacucaggccccucaaucucggagccaaaaucaaucuaaggguacagcgacuccagaccuuucaauuuacagaagggguaauuucauucagcaaaggcaagaccucagacugaccucauuucaaggcugggacccagcaguugccggugauguccuuggacaggucaggagacuuacuugccaggccuaccuaaaaaguguaucccaacuaccaaaaccagaaggaaauuacguaugaaauauaaaauaucacagcaguccucccuuaccuacaguuccgcuugcugugguuucaguuacccacagucaaccucagucugaaaauaguaacauggaaaugccagaaauaaacaauucauaagcuuuaaacugcccgccguucugagaaacaugaugaaacugagugacaucccgcucugucccaugaccaucccuuuguccagcuucuccgugccaucuaggccaccugcccguuaagucacuugguagcugucuugcugaucacaucaacuguugcggaugugaucacggauaaaagugaacacaagccacuuuuauuuggcuuaauauggccccaaagcucaagaguacugaugcugcaauuuggauaugccaaagaaaagccauaaagggcuucuuuuacgugaaaagguaaaaauucuuaauaagaaaacaauaucaaauaacaagguugcuaagaucuacaguaagaacaaaucuauccaugaaauuaugaaggaaaaaaguuugcacguaauacaaaugggguucaguauuaucugugguuucagacaacuaccggaggucuuggaauguaucccucaaggaugggggugaguacucuauuaucauaaacaggaaaugaggaagcccaagagaugcugugcugagggacacacacuuggacggaagcaaacuggggcaaaauccuccugguacugaccagcuuaggcuagucuuccuuuaaauugagcucaccucacacaacugucaauuacacauguauggggagcaaucacauuauccuaaagccucauuuuaaucuaccauucucacuuaauucucugaguuucuuaccagagcugcuaacauauaauaauaaaacucacacucaauucuaucucaauuucuacucuucagcacccucugcuacagguacuggccaacauaaaacaagaggcaagaaaaagacucacauauccauuaggcgggucauuuuaauccuugaaaacugaguuuacuuccuaccuaagcuuccauccgcuuaauaccaaggugaucaagucugugugcuaaauacaggaaaagccuuaauaggagacccugcuaccaauuuguaggaaauaggacaaaaaaaaaacaaaccacaacacuuugaacuuccacuguugaguaugcaaacagcaaaauccagacuauagggaagucaacaagucacaaggcccaaguuuuucaacagauaaaguagaagcaaaaaacuguaagaaaggaaugaagagagaaccuacagauuaagaaacuuaaacgacuuaccaguauagccacaugauaaauaccauuaaaagaaaaaggaaugaacuuucggcugggcgcgguggcucacgccuguaaucccagcacuucgggaggcugaggcagacagaucacaaggucaggagaucgagaccauccuggcuaacacagugaaacccagucucuacuaaaaauacaaaaaaauuagcugggcgugguggcaggcgccuguagucccaguuacucgggaggcugaggcaagagaauggcgugaacccaggaggcggagcuugcagugagccgagaucgcaccacugcacuccagccugggcgacagagcaagacuccgucucaaaaaaaaaaaaaaaaaaaaaaaaaggaaugaacuuucaauccacucaauggauacaauggauauugcuagacaaaagaagccaguaugaaaaggcuacagacuguaugaacccaaugauaugacauucuggaaagggaaaaaccuccgagauggagacgagaccagugguuguggagaguuagaaggugaagcacagggauuucuuggggcagugcaacuguucuguacaguacuguaguuguggaugccucugucaaaauccacugagcuuuaaagcacaaagagcaaaccuuaauauaugcgauuuuaaaaauaacugaugaggcccuauggaaugcaggcugaggcagaagaaaccaauuguauuacacauauaggacacaacuccgccaagagggguggggagggaaguaccuaaguaauguggaaaugaggagggaguguaagacuaaaagcaaaaggaacuguaacugagcacuguacuguaaggggggggggggucaagucauuucccaagggaguacaggacaauucugaaaccucucuucauguauaccaaagcacaacagguaaguaaguagauugucgacagugggagccagcauuuucucugcuggacagagaaguuacagauaaacuggaggggaaggcuagaauaaucccuauagaaauggauuagaguuggagauauaaacaugaacucauguagagcuuaauagggaugcugaugaauauauaucaaauuacagacguguauaugcacgcauuuguauauacacaccuguuucccagcucugucccuugagggggccaagaagccaggauaucccaguaaugaugaacacaccagugcccagaucuugagaucuaauuccauucucccaaaaaagaaacuagggauccuuggaaaaugcuggagucuaaggcuggggcagaaaacacauaagaugaucccagaacaucguguaguuccagaaaguaaggaagugcucaaaaacaacgaacaaaaaauaauguggcuaugugaaagggacaccggagccagcugaaagagcucccaguggauacagccagaugaugggagcaacacaacaaaccacacagcacuggaugauaacccaaagcauacauucaauauccacaaguccauguugauauacacaaaugaauaaacacacgagugaggaucagcaaaucuuccauacauaaacguuccaaauaauuuaaguagcuacuccauccucaaggaggaggaacagaacuccccaccccgguagaguaccuaugcagagugacucccuucuauuauaaacaguacauaaaggagggaaagagucacuccacaguggagaaaccuggcaaacaugacuucggccauucagucaagcccagcaacccaagacaucuugacagcaucauccuuaauuuacgggaaugagaagggcacuucaucucccuggucuuccuucccaaaacucauaaccacagcugaaucaugagaaaaacaucagaaaaccaaaacugagggacauucuacaaacuacaugaccgggacuccucaaaacucucaaggucaccaaacaggacagccugagaaacugucacugucuagaagagcccaagaggacgugaagacucaaaguaaugugggauucugagacagaauaaggacauuacauaaaaaccaaugaguucugaauaaaguaugcaguguaguuaaugaacuaaauacacaaacacaaaugaguagaaguaaaagcggggaaaucugaaugagaugguggauuauauugaagauagacuguaucaaugucaauauucuggugguaauuguacuccauuucugcaagaaguuacccuuagaggacuggggaaagauacacaggauuacucuauuuucuuacaccaguaugucaaucuacaaugaccucaaaauuaaaaccuuaaacagaaaaauguuuacauuuuagaucuuuuacuuagaccccacuuaguaugaaugguguaauguuuuguugugaugauuugaaagauccaguucacuauaaaauaaaaaguaaauuccucaaagaaacaaaguuuuaaaguauacuuuuaaaauagcacauaucaucccagcacugugggaggccgaagugaaucuccuaaggccaggaguucaagaccagccugggcaacauagggagacucagucuuuuauuuuuuuuuaauaaauaaauaaauacaauagcacguaucaggaaaaugagcuagacuaugaaaauaaaaacaaguaaugagagcucucuacaaugugcucaccaccaucccagcaccuggcugagccaguaaagacagacugaggcauuguuggauggcugggagagguggcucaugccuguaaugccagcacuuugggaggccaaggagagaggaucacuuagcucagaaguucaagaccagccugggcaacauggcaaaacucauggcuaccaaaaauacaaaaauuagccaggugcgguggcgcaugccuguagucccagcuacuugggaggcugaggcaggaggaucacuggaccccaggaacucgaggcugcagugagccaugaucauaccacugcacuccagccugagugagagacagacccugucucaaaaaaaaaaaaaauacauaaaaaauaaaaaauuuaaaaaaguguuuugaggacacagugccauaaaauuuuagauucaaagagagaaaugguuuuaaaaacauuaccuguucuccaaagugucuauauucaaaauauaauguagaauguuaaaucauaaucacuuccugccaguuccuaucuuuacagacaaacccugaaaugguaagaaauuuguuauauuuaacacacaccaaaaacacaaaggagacgccacuguggucgugccaguccuaaaucauggaaauaguuuuuuucuuuuuuuuugagacggucucgcucugucgcccaggcuggagugcaguggugcgaucucggcucacugcaaccuccgccucccugguucaagcgauucuccugccccagccucacgaguagcugggauuacaggcgcgugccaccaugcccagcuaauuuuguguauuuuuaguaaagacaugguuucaccguguuagccaggauggucucgaucuccugaccucgugauccgcccgccucggccucccaacgugcugggauuacaggcgugagccaccaugcccggcagaaauauuuuuauagucugcaauacaagaguuuuauggcaauucgggccaggcgcgguggcucaugccuguaaucccagcacuuugggaggccaagaugggcggaucaccugagguugggaguucgagaccagucugaccaacaugaagaaaccccaucucuacgaaaaauacaaaauuagccaggcaugguggcgcaugccuguaaucccagcuacuugggagaaucacuuaaacccuggagggggaggcuguggugagccgagaucacgccauugcccuccagccugggcaaaaagagugaaaaccccaucucaaaaaacagaguuuuacugcaauucaagcuucuuuuggacagaaauuuaucaagccuggucauguuuuugucauguucugccuguuaaaagaagaaucaaaguuuggguacaaaaugcauaauccaucuguccuuagauaacaaaacucguaauuccuauucauucagggauucauuucuuuaaacuguaccugagauguccaucucaaaaaguaccuuuguuuguuuacaaagauuauaauucaaguugaaguuuguuuugagauagguuuuguuguccaggcuggaguacaguggcacaaucaucagcuuaaaguacuuuuacagucaaguucauaucauuaaaaccaaaaauauggcugggcucaguggcucuggccuguaaucccagcacucugggagacaggaggauggcuugaguccaggaguucaagaccagccugugcaauauagugagacacugucucuacaaauauuagccggucguggugacacacgcccguagucccagcuacucaggagaggcuggaguccaggaaucugaggcugcagugaucacugaccagaccauugcacuccauccuggguaacagagcaagacucugucucuacaaaaaauaauuuuuaauaaaauaaaauuuaaaaaacaaaauguccuaagcuuacagaucugauggaaauccuaugcagauuguccaacuguuaaucaucagguuuguuaaacuauuucccaaaccaacucuuccuuaacugggccacuagagagugcuagaaaugcaggacaccgcacaugaagugauacagguaaauaaguccccccagucagaggaaaaagcauggagggcuuaagggcuccuugcuggcacacugccaacuggcacugcagcagcccccaccuaaauuuugaaagaaauauuuuucacuacccgacuacaguucaacuucuaauuggugaauaacauacauguggcucaacaguuuugaaacuaagcaacugacaucugaaauuaaaagauuaaucagagccauaaguagcgcaaaaaaaaaaaguaauucuuaacuuuaggaaauuaggcaaaguuaguuaaugaugguuuaaacuugacuccuucuauuugguuaaaaaauaccagaggggggaagaaagggagagggagggagggaacggaaaaagaaaaggagggagaggaagaguggggcgguccccacuucauccaaaguaguaacaaaucuugggcgcgucacgucccaauccggacacuacugacccagaguagcaacagcacauucccuguagaagacuggcuucaaccaggccacccuuuuuuuuuuuuuuccggagggggucuugcucugucacccagucuggaguacaguggcgcgaucacugcucacugcaaccuccgccucccggguugaagugauucuccugccucaaccucuggaguagcugggauuacaggcgcccgccaucacacccggcuacuuuucguauuuuuaguagagaugagguuucaccauguuggccaggcuggucucgaacuccugaccucgugaucugccccccucggccuccccacgugcugggauuacaggcgucagccaccgcgccaagccaggccaucuuuucuuaaagacacacaauucuacuagcaagacucuaacuccgauccugaaacguuuuaugucugauuuuaguucauccagacauaacgcuaccugauaccauuacagauaaaaaaaauuuugaggccgggcacgguggcucaugccuguaaucccaacacuuugggaggcagaggcggguggaucaccugagaucaggaguuccagaccagccuggccaacauggugaaaccccgucucuacuaaaaauacaaaaauuagccgggcgugguagcaggagccuguaaucccagcuacucaggaggcugaggcaggagaaucggcugaacccgggaggcggagauuguagugagccgaaaucgcgccacugcacuccagccugggguacaaagcgagacuucgucucaaaaaaauaauuuuuuuuuugaauuacugcuuaacauacccuacaaucucagcgagccuguugguauucccauaaauaaaaaaaugccacucaagguggaaacugcccucacaacucccaaucucggauuguaaucuacaaaagcgcgugaaacuguaaaaauaaacuuuauucacauagaagaaucacguuacguuuugauuuccaaacccuuaccaagccuaacugcgggacgcaagacugggcuccccgaggggacucacuccugguuaaggccucccacagcccacggcgcgcuuccaagucuacuccucagccgcaacgcaaacccgggcuguggcuccgcacccacaggcucgccccggccccagccccugccgcccuccaccuccagcuccucgcgggccccgaggcagccgcgaagcuccggccccgcgccccccagcccgccuccugccccagcucccguccaaggucgcuccuggcggcgggugaccgcugcagaccaacgcccagaacucgacagccccccauccuuuacucauuuuuuugaaauauuucuuucucugcacccgcauccagccccgaacccuccagaaccaggagaguuccccgcaaggaccucgcgcaggaacgcccgggaccgcccaccgaagucccaggcuccccaggcagcagggcaggagaacaccacccccggcccggaagcacucgccccucccgggccaagaaggauaagggagggggagggcggagagaaaggagggggaggggacagagaggagggggaggggacagagaggagggggagggaaaggaagaaugggggaaggggggagaggggaaggauaggaagaugaggagauaagggaagggagagaguugaggggggaaggaaaggagggggaagggguaaagagaagagagggcagaaggagagaggaagaggaaggacagggaaaggcaacgggggaagggaagagggcaggaaaagggccccuccgccggccggccucaggagcggcagaaggccccgagcccgccgcgcggugggcugccgggcgcaccuugcgcuugcgggccucagccgugccgcuccacacgaagcacugguagauggcccgcagguucugcuuccaguuguccaccuugaagcugcccaggugcgagcagcccggcggcgcuaccgccagcucggcguccauggccucgcccucgggcucuggccgggacaccauggggggcaaggcccggccgcgcgcggggggcggcggcgagggaggcgaggacgacgccagcgcggcgugggggcugcucggcggcuggccaggcuggccaaggcccgggcgccgagaacaaagcgcggaggccggacaaagauggggcugcgcgaucgccgaggggaggcugcaaggcaggcaccgcccccgagcugcggcugc

SEQ ID NO: 192250 - RNA, 74988 nt, Homo sapiens
acaugccaacaugugacgcguggaaucuacgccagccacagcagagagguggggguugugaccggaguuagaugccagcgcagaagggacgugagcccagccgagguaccgcugaagaggaaucaauuuugguaugcagauaaucacugggcucaugggucuugcucuuuacaaagagguaugucccuguaaaguugucaggcaaaggaaauguuucaaacgacuccauuucacgaagucucaccuaauuuacaauucguuaguugagaugcuuguauucuucguuucuaaaauaagacguugaaccauaaagacucuagcuagcucugcaaccucugaugaauauuucaugccucauuauugugaaaaauccaaagcagaauuggagagaagaugugguauagggauuagguaagugaagacuggugcaaagccuccugggucgaaauucuguccacugcuuugucauuggaaaaguuauuuaacgucgucgucucaguucccacaacuauuaaaauggagaggauaacaacaccuaccuuaugcucuugugaggauuaaauaaguuaccguuaauauauguaaagcacuuaaaagaggaccauguguuugcuauuauuauguuauacauacaauaaagaguaaacauuaccuaaguuauaaagaacuuaggcaauggauaccaaaaguacuaauuccuuuauaauaaaagaaaaaaaggcgacaaggcaaauaacgauaauaacugauaauggcugggcgcgauggcucacgccuguaaccccaggacuuuaggaggcggaggcgggcggaucacuugaggucaggaguuugagaacagccuggccaacauggugaaacccugucucuacuaaaaauacaaaaaauuagucgggcgugguggcgcacaccuguaaucccagcuacucgggaggcugagacaggagaaucgcuugaacccgggagacgaaguuugcagugagcugagaucgcgccgaugcacucuagccuggacaacagagcgaaacuccgucucaaaacaaaaaacuaacaaacgaacaaaaaacugaucauuuauuauacacccagaacugugcuuuuagcacaguuuuguuuuguuuuguuuuguuuuugagauggacucuugcucugucacccaggcuggagagcaguggcgcgaucucggcucacugcaaccucugccucccggguucaagcgauucuccugccucagccuccugaguagcugggauuacaggcgcgcaccaccacgccuggcuaauuuuuuuuuuuuguauuuuuaguagagauggggguuucaccauguuggucaggcuggucucgaacuccugaccucgugauccgcccgccucagccucgcaaagugcuggaauuacaggcgugaaccaccgcgucuggccguauugucucauuuaauccucacaacagucuuauggaaugggugcugcuaucuuuguuuuucagaugaggaaacaagcucagaggguugaaaugacuuguccaagguuacaggccaguggaggcuugaacccagguauuuguaauuccaaaugucauacucuguccacauucauuccuuguaaccugccugggcugucacaguugguguggggcuagcagcuccccagggaccaaaacaggcgcauccccgcccaccgccccgcccaucgugccagcccgacuccaccccuguggcuacacccacugccccgcgccuuacccacuggugggccacgcccacagcccccagcuaggugccuccgcuguccgggcucuagucccgcccucgccccuccccgcccaccggccucgcagucaccgcggacgccaaucuugugcauggagucgccauuuugcuccuagagaggccgccaggagacccggcgcuuucuuccuucugcagcugaggcugcggcggggccggggcuggggucggggccagguaggcgggcgggagccaguggcgagcggcagcgagggcuggcuggcuccggcauugcggggcgcaggugcaaggggcggggagcccgcggcgccggcaggcggacgggucggggucccugggugguggcugcuugggggcucacuggggcgaucucgcgcccgcggcccuuccauuuuucccucccuucuuccucucccgccaggggucggcgggggcgggggacgggcguccggugccugggcucucuccucucccugaggcgccgcuggggagucgaacccugaugaugggaccuguggugagcagcccugaaagcaagcccagacccagccauucuccgucccuaagcugacacggagccccugauuuuaauuuaccuggcuuugcuaguuacgaauauaucucucaccuccuaaaggaugauuuuauccaacucagaacucaccccagcagagauugagggggaaccgugaugaaauuuuuaaguauucugcuugaugauaauaauuuuucucuuauguuaauguuggcuccguuuggguguuuagcuuuugaaaggaguaugaaaaugcggaauggggcuuuggggcuugaggugugaucucuaguguuuaaaaaauuuaauugcacaaauagaaauaauucacccacauuauugaaccccacuaaagcauauccuuuuuguccauauuccuuuccugcugcccucguguguaccauuauuacucaguugugauuugagcucguuccacuuaaagucauucauagauacuuuugcgucguguugaauauuuauugaauuucuauucuguguuuuacuuaauuacuuuauuauggaaccuuuacacaggucugguguacuuguucuuugaaaagucuuauguugaccaccaucacugagcauauagcuuuuuccuuauuuccuugggauaauuacccgaaguggaaauaccgaaucaaacuucuguuuucuuucuuuggcacuauuauauaaauuguuuuccaaacaaggcauguuuacaauagacauuuuucaaaaucuggguauuuguccuauuuugcucucuguaugcagaauucagcggggugccaagucguuuucuguguggguugagagacaggcugugcagcccacuguugcauaggacuaacuacuacaaaucaugcugagaccgagcuauuuuugcugcuuagaggcuuugcagccuugaguaaguuucuucaucuggaaaccuagcuucccugucuaaaaugggucucauucuagugcuugcuucacuggguugucauaagcauugugaacacucagauguuaggcaugaguuaacauuguguuggagagauaagcagagccugggaucauacaggaguggaagaguaauucgguuuagaauuugcccuucaaauucucaucaauauugauauuaaaaacagauuuccuuggagugaggcacaucacuaauaaacauacauaauaaguuuuuuuauuuuuauuuuuuuugcagagucuugcucugucucccgggcuggagagcaguggcgcgaucucagcucacugcaaccucugccucccggguucaagcgauucuccugccucagccuccugaguagcugggauuacaggcaugcgccaccacgcccggcuaauuuuuuguauuuuuaguagagacagggugucaccacguuugucagguuggucucaaacuccugaccuugugaucugccugccuuggccucccaaagugcugggauuacaagcgugagccaccaugcccauccaauaaacauaaauuuuuauacuuuuuaauuuuuugacacagagucuugcucuguugcccagguuggaguguaguggcgcgaucucagcucacugcaaccucugccucccaaguucaagcgauucuccugccucagcugcgcaaguagcugggguuacaggugcaugccaccacaccuggcucauuuuuguauuuuuuaguagggguuucgccuuguugaccaggcuggucucgaacuccugaccucaggugauccguccaccuuggccucccaaagugcugggauuacaggccugaggcacugcgccuggccgguuuuuauacuuuaugaugccuuuuaguucaucuuucaauuucauuuguuaaucauugugacucauugaagucaggcauuauucagcaaucauuuguuuagccucuaccguguggcagcugcacaggguauacagcagagaauaucaugguaaaaaauagucucugcugccuggaccuuaaauucugauggggaaaucuuuuuaccaagguuauaucucuugucuggaagguaaaggcugaggcccagcaaggacaagugauguccacauggccuaguagcuggaaggcaaacccaacucuucacacuccuacuucagccaucuuuaaguagaagguauuuacacaguagaugcuuuagagggaagacaacacacuucaaugugagucuuccccaucugaaaugugggugagugguuuugaaaugacugcuagucuguccaaaggaaaugaucucucagugugguuucuucauucaugagacuuaacauucuaaaaucuuauucaaaagaggaguaugauuugcucuuuaaaaggugcuaagauucucugaaaacgguguguuuucauacauguuauaaauaauucucacacauucuagaguaaauuuagaauaaacauaaagcaguuauagcucauggggaaaauaagggaguguucucauuucacacuaaaaccuugugcuaacaagccuccugccagccccaucucgaugauuauuauguuuuugaggauagucuuuauaacucuuuucuugaagcuugguaaagaacacagccuuaauuaccaacaggagaaaggagaacuaaaacuacaagcaggcauuauggccgggcgcaguggcucaugccuguaaucccagcacuuuaggaggcugaggcggguggauuaccugagcuugggaguuugagaccagccugaccaacauggagaaacccugucucuacuaaaaauacaaaauuagacgggugugguggcgcaugccuguaaucccagcuacucaggaggcugaggcaggagaaucgcuugaaccggggaggcggagguuauagugagccgcaaucgcgccauugcucuccagccugggcaacaagagugaaacuccaucuuaaaaaaaaaaaaaagaaaaaaaagaaaaauaaacagcccuuauguuugaauaacuugugaagugaauagucacaaaacaugacuauguugauagucauuuccaaguggaugcuccccaguccacuccaccaugucauuuugaggguggucuuagguuaggauucuauauagaagccuauaucugaagucuagaacgucagagaccacaugcaggguguugcaggccauuuuaaaccaugagagauaaggaaagacuucaggaaauauccuggaaaaaauauacaaaggcaggagagcuaucuugaaauaguuuggaggccauccuguggaaaaggaauuugauguuucccauaaaucucuaaggagaguacaagaaccagugggcagaagcugcaggaagaggaaucucagcauguucuuuuguuuguuuguuuguuuguuuugagacagucuugcucugucacccaggcuggcgugcaguggugcagucucuacucacugcaaccuccgccucccagguucaagcgauucaccugccucagccucgugaguagcugggacuacaggugugugccaccaggccuagcuaauuuuugcauuuuuaguagaaaugagguuucaccauguuggccagacuggucuugaacuucugaccucagguaauccgccugccucgcucucccaauuugcugggauuauaggcaugagccacggcgccuggccacagcauguucuaaggaagaauuuggaaugaugggcccucagcggaugugggcaucagacccuggggcuguucaagcuucuguugagugguuccuuggcaggauuccuacagaugggcuuugaacaaaagauuuaggagggaugggcugaacuaccucuaagaucucuuccuaccucuaaaauacuuucauucuaaguguuccaacuccuaucaggaauccugcuguacuuuaaggagcuucuuauuugaagguuaggggguguaaaaaaaaugccccuccccccauggcuguuacuguacuuauaugguagauaaucaagauguuagaagucaguucauagguagcauguccgauaugcagggcacuguguuaagugccuugcagaaauuuuacagucaccuguggggucaguuuucacaguuguauggauggcagaacugaggcuaagagauuuugaguauuagauaacuuaugcaaguccucacugugaguuuaggggaaguauuucaagaugcaaacaugaguuugacuccaaauccuguauuuacaacuacaggaaaauuaguuuguuuuuauuuauuuuccuggaccuguaacacccuuuuauuuauuuauuuauuuauuuauuuauuuauuuauuuauuuuucugagacagagucucgcucugucucccaggcuggagugcaguggcaugaucucagcucacugcccacuucgccucccagguucacgccauuuuccugccucagccucccgaguagcugggacuguaggcgcccaccaccacgcccaccuaauuuuuuguauuuuuaguagagacggggcuucacuguguuagccaggauggucuugaucuccugaccucgugauccaccugccucggccucccaaagugcugggauuacaggcaugagccaccgugcccggcaauuuuuuauuuauuuauuuuuuuauuuuuuugagacgaggucgcauucccaucguccaggcaggagugcagugaaguggugcaaucauggcucauugcagcccugaccaucugggcucaagugauccucccaccucauuuuuugauuuuuuuguagagacuaggucucacuauguagccgaggcuggucucaaacucuugggcucaagcagucagcccaccuuggccucacaaggugcugggauuagcggugugaguugcugugccuggccauaccuuuuguucuuaaacacacauguuuauugguugagagauggcuuuagaaguauuuaagaucccuuccagaauguugaugauuaaacguauucuuucuuucuuuucuuucuuucuucccuuucuuucuucuucucuuuucuuuucuuuucuuuauuugaaacggagucucgcucugucgcccaggcuggagugcaguggcgcgaucuuggcucacugcaagcucugccuccuggguucaugccauucuucugccucagccucccgauuagcugggacuacaggcaccugccaccacgcccggcuaaucuuuuguauuuuuaguggagacagcguuucgccauguuguccaggcuggucucgaaccccugaccucaggugauccacccaccucggccucccaaagugcugggauuacaggcguaagccacugcguggccuuuuuuuuuuuuuuuuuuuuuuaauuuuuuagauggaguuuuguucucauugcccagguuggagugcaguggaucucagcucacugcaacuucugccuccuggguuuaagcgauucuccugccucagccucaugaguagcugggauuacaggcauguaccaccaugccuggcuuauuuuuauuuuuauuuuuuuguauuuuuaguagagaugggguuucaccauguuggucaggcuggucucgaacuccuggccucaagugaucugcccaccucagccucccaaagugcuaggauuacaggcgugagccacugugccuggccguauauaauuuuuauggaggucacauguauaaaugcauagaaaaagucuuauguugucccuaccaaacugauaagaacccucacuucuggggaggaccugggaucgaggcuggugacuuuauccuuaacuaucauguuucagguuuuuuuuuuuuucugagacggagucucgcucuguugcccaggcuggaguacaguggugcaaucuuggcucacugcaaccucugccuccugaguucaagcgauucucaagccucagccucuagaguagcugggacuauaggcagccaccaccacgcccagcucauuuuuguauuuuuaguagagacagauuucacccuuuuggccaggcuggucuugaacuccugaccuugugauccgccugccuuggccucccaaagugcugggauuacaggucugagccaccgcgcccagccauguuucagguuuuuauagggaggauguguuuguguuuuacuuguauaauuaaaauuugagaauaaugaaaaagauuagcuuaguuucagcucauugaugaucuacaccagccuucccagaggucccaggugaacauacaacuguggaaaugcagugggcuugcugagaaagggccccccugcccacagccugcuggauuguugcuguuccucccaucuagcaucuccauuaugugaugaggacacucagcaaugaugacgacuuuuuuuuuuugagauggagucuugcugugucgccaggcuggaagugcaguggcacgaucucagcucacugcaaccucugccucccagguucacgucauucuccuaccucagccucccgaguaggugggacuacaggcacgcgccaccaugcccagcuauuuuuuguauuuuuaguagagacaggguuucaccauguuggccaggguggucuugaucucuugaucucgugaucugccugccuuggcuucccaaagugcuaggauuacaggcgugagccaccacaucugaccagcacugaugauuuauaagccagggaccuuuuuauuuuuggcccacugccaaaauuugggugugaccaaaacugucauuuggguggucgcuuaaguguccuucaaggugauuaucuagucagcccguguuccacuugaggaaaaugaagaugagaggucaguuuuagacaugacacagggcagcugaaaggccgggaaagguuuuaugguaaacaaggauuacaggaaaagcuggguguagaugggucauuuauucuuugucuaaggauuaaucaguccuuguucucgcuaauggcucugccauuuuucuguguguuaauccaggaggaauuuuguugucagagaauaaaaggagguuguccauaauugacuuuaagcagcaaucaguaaaacauugagcucuucagcuccgccuuucuuguaaguuuaucauuucuucuuagugguugugaacaucaugugauaauguauuuccauaaauuuaggacccugaaauccaacugaacuuucuguuuguccauauauaucuaauauuuaaaaaauacuauuaggauggaaacuaauuuccuucagcugaagucauuuccuuuaaaaaaaauucauucagguauauuucauaucauauggcaguuuuuaauaaguauuauauccuucuaggcucugaaaauuggaaaaccaagaagguuuugauguuuugugugacgccaccugaauuagaaaccaagaugaacauaaccaaagguggucugguguuguuuucagcaaacucgaauucaucauguauggagcuaucaaagaaaauugcagagugaguuauaauuguaccauuaaaaucuauauucauuaugugaugcuuuaaauuugauaaucagauuagcaguuauuguuaaauuugaaagcagauauuuuauaauuauaaaauaauuauaucuuuuuuucaucauguaucuuuuuuuucaucaugcaagauguucauguaguaugucucaucuguauauauuaagggcuauucuuuuuguaaacuaucccaucucccuacauauucuuucagcagacauuuauugagugccuuauaagugccagggauuguguuagaugcuauauauauauauaauuauuugaguauaaagcacacuggggccaggcgcgguggcucacgccuguaaucccagcacuuugggaggccaaggcggguguaucacgaggucaggagauugagaccauccuaguuaacaaggugaaaccccgcgucuacuaaaaauacaaaaaauuaguugggcgugguggcgggcaccuguagucccagcuacuugggaggcugaggcaggagaaucgcuugaacgcaggaggguugcagugagcugagauugcaccacugcacuccagccugggcaacagaacgagacucugucucaaaaaaagaacauuaacauguauauuauaugaaauaacuuauagcuuauaguuuaguauaauuuuagauauuuauuaaacaaauauuguaccccuacuacuguguacuagaccuugaucuagauguuggggauuaucagugagucaagauccauccuuuuuaugaaauuuacauuuuaguaugggagccaaacagaaaucaagucaacaaaacaaacaagguaauuucagaugaugucaaugcuaugaagaaaacugugugaaaguaaugauggggcagguuguucugcuuuagcaugugugcugaagugcuuuuaaacugaagggauggugugugaguugagaaaccugaaugagccaccaagugaaggucuggaggcagaacccccccaagcagaggggacagcagauuccaagccucugcagcaugcaggaggaguucuuggugugucucaggaacgugggcuggaguacagaguguccaaggaagauggcuagugaggcaggcagagcgggacugcauaguccuuccuggggagacaugggguuggggugaggggcuagguaauggauugauguaacaauuuaauguugacuuuaaauuuuauaagaagaauaacuuuauuuuauuuuacucuuaucgauuuacgagucuccuuaaauaguaaagauacuggguuucuucuauuacuuuuucagcuuuuucccccuuucucuucucuaggcggcuagggguggagaugggcaaagugcagguuuaccaggaaccuaacagaggugagcuaucuugggcauguggaacauugaccuuuuugugaaauguggcauauuggcuccguccuucauccuuuacuauugaaacgauuugauucaguuguacauuuccauuagcaagaagucaggcaggcaagguagaacagagugguuuuuuagcucucacuaauaccagcuagauaucuaacccuggugcaagucauuucuggggcuugaacugcaguucugagacuucauucaguaaaagcugcagacauauuugaaccagcuggucaacugaaugaacaugagcucaacuguugcuuaaauuuaugucaccuuaggaaggaugaguaaauccugucaccuuagacaggaugacuaaauccugugugaccgcaguuuuaguuagucuuuauuugcaccuaagcugccuuggguuagacuucauaaaauauuguuaagaaauacuuuuugcuaauugauacaugucauuacauaauucucccaaguuguaaaaagaaguguuauuuaaccuuuguagguccaggugugcuggcucaugcaucuaaugccagcacuuugggaggcugaggcaggcagauuccuugagcucaggaguugagaccagccugggcaacacggcaaaacccugucucuacuaaaaauacaaaaauuagccaggaguggugguuugcacuuguagucccagcuacuagggaggcugagguggaaggaucgcuugagcccaggagguggaggcugcagugaagugugaucauaccacagagugagacccugucucaaaaauaaauaaauaaauaaauagaaagugaucuuuguaauuucuuuagcaaugguggauauuugaaauuauuuuaggccaggcgugguggcucacgccuguaaucccagcacuuugggaggccgaggugggcggaucaccugaggucaggaguucguagaccagccuggccaacaugaugaaacccugucucuacuaaaaauacaaaaauuugcugggcuugguggcaggcgccuauaaucccagcuccugggaaggcugaggcaggagaaucgcuugaacccgggcgguggagguugcagugagccaagauugugccauugcacuccagccugggggggaacaagagcgagacuuugucucaggggaaaaaaaaaaaaaaagaaauuauuuuagcaggagcgauggacagcuugcaugggcuugagaguuacacaccuuauccuugacaaguuauuuaaccuuucuaaacuauaaauaaacuguaaauuagggcuguuuugaggauuaagugggauaacuugugugccuaccaguuuuuggcacacaguaggugcucaauauauacuuauuccuguuccuuuuccacuagaagauuuaaaaaaacauuuuuuuuuuuuuugguagaacaagggucucauuauguugcccaggcuuaucucaaacucugggcaaaagcaguucuccuauuucagccccccaaagugcuaggauuacaggugugagccaccaggccuggccccucuacaggauuuuaucaaauauuuacauauuauaaagccuacaggaggcuuugauaaaaaggcacaaguuuugcuguucccauguuuaucuccguuccugccucuuuucugucucccaagaucccuauguggcgucaguagggaaaaaguauaauuaaacucugcaaggagaguuuggagaagauucuuccucuagaggggauugaaugauguucuuugucuggagucuaggagggaaggugaaagggagaagcaguggcauaagacuccaggagacugguccacucuccaaguuucugaauaaagggagagaaaauacuugguguuuauugggaaggaaggaaguaauauuugugaauuucuuacuguuaccagauacugaaaaacugaguucaggaguucagggauugauguuagguacgagguccaguuugaauccagaucucccugacucuaaagcucauuuucuuuucuuuucuuuucuuuuuuuuuuuuuugagacagggucuuucugugucacucaggcugggguguaguggcaugaucagggcucacugcagccucugccuccugggcucaugugcuucucccaccuuagccuccccaguagcugguacuacaggugggcaccaugcugccaggcuauuuuuuuuuuuuuuuuaaauauggagucuugcucugucacccaggcuggagugcaguggggcaaccucggcucacugccaccuccgccucccagguucgagugauucucgugccucagccucccaaagugcugggauuacaggugugagcuacacacacacacccagccauaauuuuuuuuuuuuuuugauacggggcuuugccaucuugcucaggcugguaaagcucauuuucuuaacaucauaccacauuucuuuuguaaacuuguauucuguuuuuuccaacauuuuuuuuuuucucuuauccucacaaucuguucccauuuugcuacuuuuuuuuugugugugugugugugugugugugagacagagucuugcuccauugcccaggcuggaguacaguggcgcaaucuuggcucacugcaacauccgccucucagguucaagcgauacuccugccucagccucccaaauaggugggcuuacaggugugugccagcacgcccggcuaauuuuuuguguuguugguggagacgggcuuucaccauguuggccagguuggucucaaacuucugaccucaaaugaucauccaccucagccucccaaacuauuuuccuacauuuuuaaugaaaauguucaaacauauaaaaaaguugaaagaauaguacagugaacuaccgccuagcuugaacaguuaacauuuugccauaugaauauguauguggcgaaccauuugaaauuaagugcaggccgggugcgguggcucacuccuguaaucccagcacguugggaugcugagcugggugaaucucuucagccugggaggucaagacugcagugagccauauuugcaccacuguaccacagccuaggcaacagggcgagaugugucccaaaaaaagaaaaaaaauguaaguugcagacaguuaauccuugaauacuugaccaugcauccucuaggaauaauuacuuucaccuaaauaaauaugauaccauuaucacauuuaaagaaauuaacuacaggcagggcaugguggcucacaccuguaaucccagcacuuugugggggucaagguggguggaucacuugagaccagaaguuugagaccaaccugggcaacauggcaaaaccccaucuuuaccaaagauaaagaaauuagccaggguugguggcacacagcuguaauccuagcuacuugggaggcugaggcaggaagaucacuugaguccgggagguggagguugcagugagcugggaucacgccgcugcacuccagcccgggcaacagagcaagaccuugucucaaaaaaaaaaaaaaaagaaaaggaaaagaaaauuaacuuaacaauuaaggacaauucuuuuuuuuucuguggccucaagugaucugcccgccuuggccucccaaagugcugggauuacaggugugagacaccgcacccagcccaacaacaauucuuuaaucaucuaauauauggccuauauucacauuucccuaauuguccuaaagggucuuuuauuuuuuauuuuuuugagauggaaucuggcuuugucacccaggcuggagugcaguggugcgaucuuggcuuacugcaaccucugccucccagguucaagcaguucuccugccucagccuccugaguagcugggauuauaggugugugccaccaagcccagcuaauguuuguauuuuuaguagagacgagguuucaccauguuggccaggcuagccuuaaacaccuaaccucagauuauccgccugccugggccucccaaaguucugguauuacaugugugagccaccgugcccagccuaaagggucuuuuauaguuguuuuuuccaacaccuccaccccaaaccaggauucuuaguucaagggauuuuuuuuaaaaaauaucucuuuagucucuucuauuuuagaacaauccccucaccucuuccguuuucuuccugugacagugaagagguugucuuguagaaugucccauuauggauuugucuaauuguuucuuuaugacugaucacacauauuuugagaguagggauauuaggucuuauuuaucuuuguuucucacaacauacaauguuuuguaccuaauacauucugaauugauaauugaugcugauugaaugaguauauaauuuucuuuuuuuuuuuuuuuuuuuuuuuugagacggaguuucgcucuuguugcccaggcuggagugcaauggcacaaucucggcucaccgcaaccuccgccuccuggguucaagcgauucuccugccucagccucccgaguagcuaggauuauaggcaugcaccaccacgccuggcuaauuuuguauuuuuaguagagacgggguuucucuauguuggucaggcuggucucgaacuccuaaccucaggugauuugcccgccuuggccucccaaagugcugggauuacaggcaugagccacugugccuggccuaugauugucuauaaagauacugugcucaggcugggcacgguagcucacaccuguaaucccaguacuuugggaggcugaggcaggcagaucgcgaggucaggagaucgagaccauccuggcuaacauggugaaacccugucucuacuaaaaaaauacaaaacaguuagcuggaugugguggcgggcgccuguaguuccagccacucgggaggcugaggcaggagaauggcaugaacccaggaggcagagcuugcagugagccaagaucgcaccacugcauuccagcgugggcgacagagcaagacuccgucucaaaaaaaaaaaaaaaaaaguuaccaugcucggagugguacagcacucaacuguuuguauauauaaggggugagaauuauacauuuacuuauuucaagucagaaauguaauucucucuuaaagcuguguuuuaaaaagugauuaauggcaguauguguauuaucccuuguaacaucuaaagccuacugagucuuauaacaguuugaguugccauauucuauuacauuagggaauaauacagauuuuuuuguguauuuugaaaaauuugaacuauaugccuuucccucucuucuuuuuccuuuuccugccagaaacaagaguacaaauucaagagucugugaggggaaaagauguuuucaucauccaaacuguuucgaagugaguauccagcaaaaguguugcuuucuggguuucaguuuaggcaugaguguuuaaaauaaugauagauggcuagccaggaagaguuauaauagucuuaaaauuaguauaucuuaccaauuuagaauuuagaaaacuaaguuuucugacauaacugcugacuuuuacauguucuuucaguguuuuuccuucuuucuuucuuuuuuuuuuugagacaaagucccacuccuucacccaggcuggagugcaguggugcaaucucagcucacuguaaccaccuccucccagguucuagugauucucuugccucagccucccgaguagcugguacuacaguuggcgccaccacgccuggcuaauuuuuguauuuuuaguagagacgggguuucaccauguuggccagacuggucuugaacuccugaccucacgcaaucugcccgccucggccuaccaaaguggugggauuacagguaugagccaccguguccagccacucaguguucuuaacggguggaaauaaccaaguauuggaguagaggcucuuuuuuuuuuuuuuuuuuugagacagaauuucacucuuguugcccaggcuggagugcaaugacgcgaucucggcuuaccgcaaccucagcuuaccgcaaccucugcuucccagguucaagcaauucugccucagccuccugagcagcugggauuauaggcaugugucaccacgcccgguuaauuuuguguuucuaguagagacaggguuucuccauguuggucaggcuggucuugaacucccgaccucaggugauccaccugccucagccucccaaagugcugggauuacaggcgugagccacugcgcccagccuggaguagaggcuguuaaugauaauaguauacauuaaguuuccuaacaauuaacagccagaauuuuguaaaacuugcaaggaagcauuucuaguucccuccucuccccaaaagaaacagaggcuaggggaggagaccuuucuuaguugggguucuuuaagcuuuuauugcauauaaaagugaucauuauuuacuguuuuauuacauaaauuagcugagaggauaaaaaacuguacugaaggaauguguauuccugucuggugugaccuuugacacaccuguguucuggaaauuguuuggucacauauguuuaagcuagguauagaagauucaaugcagcaaggcugucucuggcacucuggaagggagggugaucaccuggagcccuacuuuuuuuuuuucuuuuucuuuuuucuaagagguagagucuugcucuguuguccagucuggagugcaguggugagaucauaacucacuacaacuucaaacuccugggcucaaacuauccuccucccucagccucccaaguagcugggacuacaggcaugcaccagcaugcucaccucguuuuuucauuuuuuguagagauggaggucucacuguauugcccagcuggucucaaacuuuuggccucaagugauccuccugccuugaccuccuauauugcugagauuccagcaauauagaaggugagccuaucacaccuggccuuaaagccccacuuuccauuguguguuuguccacaaaugucccuaaaugcuucuguguaugaaguucuucgcucagaacaauuuuuaaugucuagaaaucaguuugucuagugcauuauuuuuuagcuuagagagucugaaaguugcugcaugcuuaauuuguguauauacauauauaaaaccaacgaaagggaaaaagaaggccauuucgggagacuuuagucuuggaacacacauuuuuuucaccuaaauuuugaacauuuucucuccuggucuuugguuuauugggaugaagucacaaaacccccaucucuccugggaagaggaguggcaggggagaccuguccuugcauccuauagcccuggcaaacgggugugcucugaaggaggaaggguguggagggccuuugccacggugcccuagcuucaccuucugcugugacacccaggauucucagcagagcuggaggugggggcacggagcgccaacugccccugcugcugcuguccucuuuccccuuucccacgucugccaccaaaccaggguggaaguggaggacucaccugugcccacaucuuaacccuuuaccuccagcaucgggguagggaaggggcgggcacagaacaacuuaaacggcuucuggcuccuugguuucugugucugugguacuuuuauguccuuacagacaagugugauuccauuggauaaaugcacagagguuguguggauuacccaaggggauggguaggcauugagggcaccccuggacuuagaauuuaggacuucagaagggugacugcugauccuucucauuuucaaguccuucugguuguuuauuuuuguacauuucaauacuuauccugugccccugucuuuugucaguuucauauuccucuaaucagaaucacucagcaccccuuucauuuucucuccgugucucauuuugcauuguuccauaccugacauaagcuuguguuaacucggguucucagucuuguccauguugcagagucuggacgucauggucuucuuugugaaauaccaugaaauaacauuuaguguugagggccagaugugguggcucaugccuguaauccuagcacuuugggaggucgaggugggcauaucaguugaggccaggaguuugagaccagccaggccaacacggugaaacccugucuuuacuaaaaauacaaaaaauuagcugggcauggucaugagcgccuguagucccagcuacucagguggcugaggcacgagaauugcuugaacgcaggaggcagagguuguagugagcugagaucacgccacuggauuccagccuggguaaaagaacaaggcuccaucucgaaguaaaaaaaaaaaaggcugggcgagguggcuuacaccuauaaucccagagcuuugggaggccgaggcgggcagaucaggaguucaagaccagccuggccaacauggugaaacccugucucuacugaaaauacaaaaauuagcugggcguggugauaugcgcuucuaauuccagcuacuugggaggcugaggcaugagaaucgcuugaacccaggagacagagggugcagugagccaagauggcgccacuauacuccaggcugggugauagagugagacucugucucaaaaaaaaaaaaaaaaagccuguaaucccaccacuuugggaggccccaggcgugcagaucaccugaggucgggaguucaagaccagccugaccaacauggagaaacgcucucucugcuaaaaaugcaaaauuagccgggcaugguggcgcaugccugugaucucagcuacucgggaggcugagacaggagaauugcuugauccugggaggcggagguugcggugagccgagaucaugccauugcacuccagccugggcaacaagagcagaacuccgucucaaaaacaaacaaacaaaaaaaugauuuaguguugucagauacaucuuauacuucauuuuacuacagauuagugcuagcacuaaaaauaaaagagaaauuuaaaauuaagaaaauuccauccauuaacugaaguuuuccuguauuucaaacaagacuguccuuaucugaguucaguaauggaaagccuuguuccuccacucuuauccuucccauagaauacuuuucugaaaaucuuuuuuuuuccuaaguuaauuaacagggugaaagucucuuuuaacucaucagaugucagacuuguuguauagugacagagaaccuacucaccugaauguucuguguuuccauucacuccuucuuucauuaacaaauacuuauuuugaaugucuacaauaugugaauuacaguuaguuacacguaugcaggaugccuccaugauuaaaacagagaaaguccuuguccuuguggaguuuauauuccaguggaggaagacauaaagugagcauaauaaagacauagauuaucuagaaggugaugaaugguuuggaaaaaaauaagacagcauggugagaugauaguggugagagggcagagagaggcagacaggguaggccucauuguggaggugacauuugaacagagacuagagaaggugagggagagucaggugacuagguggggagaaaagcauugcaggcagugggaacgccuagagcaagccccuuagcggugugagcugcugugggaggacugaacagggucagguguggccaggcaggaggggaggggcagauccucaaguuuggacuggaguuguaaauuugagaguugccaccaucuaugaagcugugaaauuagaugagaagcccaaaggacgagagggaacagaaagagaggacacaugagcaaguccugggacgugaggcuggggagaagaggaaccagcaaaagaaaccaaggguggaaggaggacaccagagaggggcauucuggaagccaagugaccguggacauggccgcauggaggccacugaugaccuuuaugaaaacaaagcuucacuggacuauuugggagagacugagaguagauaaauuggagauaguguaagauguacagcaaaggggagcagaggggagagugguuaugagucguguuaauggaaguaacagaauguuuguggccgauggguuaucagugguggaggcaggagaggagagagaauuccuuacauaggugugccauuuggagggauuaauuuuagggccacuggcauggaaauuuccucugacugaugacugagggcaggccgacuccuggggcacagaugcacauagugggagcuuguggacacgcuccucugagaguacuuaaguaggguggucaguugagagcagaugaugggggaucuuauggaggccugagaaaagaggaauuuauugguugguuuuuuucugccuugcaccuuagguuguauaaaggcaugaguaacacacugcugacacuuuuuggaacagggaauacuguguuguagaucccuugaugagauuugcugugucuuuguuacagggacgugaacaccaccaucauggagcuccugaucaugguguaugcauguaagaccucuugugccaagagcaucauuggcgugauacccuacuuuccuuacagcaagcagugcaagaugagaaaaagaggcuccauugucucuaaauugcuggcuuccaugaugugcaaagcugguaagaauggcagauguuucacaauuaauugggggccugggaguuuuauuuauuuauucucucuuuuuuaagacagggucuugcccugucaccuaggcuggaguguaguggcgugaucauagcucacugcaacuugaacuccuacagucaagcaguccaccagagccucccaaguagcuaggacuauaggcacauaccacccugccugcuaauuuuuaaauuuuuuguagauacugggucuuacuauguuguucaggcugguuuugaacugcuggccucaagggauguuucugcuccagccucccagggugcugagauuauagucaugaaccaccauacccugcuggaguuuuauuuuuaccuuagaaauaucaaaguaauggcugggcacagcagcucacgccugcaaucccaaugcuuugggaagcuaugugggaugaucuuugaacuccugggcucaagugaucccccugaguaguuggaacuauggacauauaccaccgugccugccuagauaggcauauauuggaaaagauacauauuauucugugucaggcauuuucagguaacaaccuaaguauuuuuccuguguuucuaaauaaccuucauaguuguuauuggguauuugugucaauauauuuguguuugugugugugcgcgcuuguauaaguguauaugauuuuauuuauuuauuuauuuauuuugagauggaguuucgcuccuguugcccaggcuggagugcaauggcaugaucuucgcucaccacaaccuccaccuccccgguucaagcgauucuccugccucagccucccaaguagcugggauuacaggcaugcgccaccacgcccggcuaauuuuguauuuuuaguagagacaggguuucuccauguuggucaggcuggucucaaacucccgaccccgccucagacucccaaagugcugggauuacaggcguaagccacugcacccggccuaugauuuuuuuauuuuaauuuuuauucuguuuauuuauuuuuugagacggagucuugcuccguugcccaggcuggagugcagugguggcaccucggcucacugcaaccacugucuccuggguucaagcgauuuuuguaccuuagcuucucuaguagcugggacuacaggugccugccaccacacucagcuaauuuuuguauuuuuaguagagaugggguuuugccauguuggccaggcuggucucgaacuccugaccucaagugauccaccugcuuugggcuccuaaaauucugggauuacagacacaagccaccauagccagccugaauguauaugauuuuagaagguauguaucacggagcauuugcacagagugaauagaauaaaaguccccauaucacugcauuuuaagacagguacuuacuguagaauaaaccuuuuuuuuuguuuguuuuuugagacggagucuugcucuguugcccagucuggagugcaaugacgugaucuuggcucacugcaaccuccaccacccggguucaagcaauucuccugccucagcccccagaguagcugggauugcaggcacacaccaacaugcccaacuaauuauuauuauuuuuauuuuuuauuuuugagucucaccugucauccaggcuggagugcaguagcgugaucucggcucaccgcaaccuccacuuccuggguuuaagcgauucaccugccucagccuccugaguagcugggauuacuggcgcccaccaccacgccuggcuaauuuuuguauuuuuaguagagacgagguuucaccauguuggccaugcuugucucgaacucuugaccucaggugauccaccuuccucagccucccaaaguguugggauuacaggcgugagccaccacgcccagcccagaauaaacuuucuaagauaguuuuucaguaaaggcaaacguaaaacaaacauuuaaaaacuaggcagggugugguggcucacgccuguaaucccagcacuuugggagaaccagggggcgaucaccugagguugggaguucagagcagccuaaccaacauggaaaaaccccgucucuacuaacaauacaaaauuagccggguguggugacacaugccuguaaucccagcuacucgggagucugaggcaggagaauugcuugaacccgggagguggagguuguggugaaccaagaucaugccguugcacuccagccugggcaacaagagcaaaacuccgucucaaaaaaauaaaaauaaaauuaaaaacucaacccgaagcaaccucaggagccuaccccauuguaaacacuaugacaggcagcuggugaggagagcaggcuugccugcugaaucuucaggaaagggcccaucuucucuaccagccuugcuugaugggccuccagacuuacuuuccuguucuuuugggcaaguaaugcuuuaaacaauuuuucauacugaauuuuccuuacacuuuucuggugaucguuacaaagguggugaagguuuucuguuuucuccaauuuccaggcuggugcaguuugucuugauaucuuuuuuuuuccccaugggucucaguccucuugcccgggcuggggugcaguggugugaucacugcucacuaccaggagguagccuugaccuccuggguucaagugauccuccgaccuuagcuuccagaguaacuagggacuacaggcaugcaucaccauaccugacuaguuuuuuguauuuuuaguagaaauggagucucaccauguggcccaggccauuuucaaacaccugggcucaagugauacuccugccucggccucccaaagugcuggguuuacaggcaugagccaccacacccggcugacuuguuaucuuaagacuggacuuugccaugccuguuaaacuucaagaagauuugaucugcucuaauauaauuuuuaaagacucuucuguauuacuguuaucuuugcuauauuaugacuauuuuuuauuuauuuauuuuuucgagauggagucucgcucugucgcccaggcuggagugcaguggcaugaucucagcucacugcaaccuccaccuccuggauucaagugauucuccugccucagccucccuagaagcugagauuacaggcacaugccaccacacuuggcuaauuuuuguauuuuuaguagagacgggguuucaccguguuggccaggcuggucuugaacuccugaccucaggugauccgccugccucagccuuccaaagugcugggauuacagcugugagccaucgcaccugaccaagacuuuaaauugaugugaaaaucaggcaucucacaguacuaaaaaaaaaaaaauuuuuuuugaaaaauacaagugcugaguuuuuuugaugguagaacaauuuugucuuuuuuuuuuugagaccaagucucccccuuucacccaggucggagugaaguggugcgaucucggcucacugcaaccuccgcccccccagguucaagcgaauucuccugccucagccucccgaguagcugggauuaugggcacgugccaccaugccuggcuaauuuuuguguuuuuaguagagaugagguuucgccauguuggccaggcuggucuccaacuccugaccucaggugauccacccgccucggccucccaaagugcugggauuacaggcgugagccaccguguccggccuuauuuuuuauuuuuuugaggcaagaucucacucugucacccagacuggaaugcaguggcucaaucucagcucacuugcagccuugaccuucugcacugaagcgauucucccaccuuagccuccugaguaucugggacuacagaugugcgccaccaugccuggcuaauuuuuguuuuguagaggcgggguuuugccauguuccccaggcugaucucaaacuccugagcucaagcaguuugucagccuuggccuucaaagugcuaggauuacaggcgugagccacugugcccggccaugagagcaauuuuuuuuuuuuuuuugagacggagucuugcucugucacccaggcuggagugcaguggcaugaucuuggcucacugcaaccucugccucccggauucaagcuauucuucugccucagccucccaaguagcugggacuacaggcacacgccaccacgcccagcuaauuuuuguauuuuuaguaaagaugggguuucaucauauuggucaggcuggcguugaacuccugaccuugugauccacccaccucgcccucccaaagugcugggauuacaggcgugagccacagugcccggcuggagagcaauuuuuuaauaguaacuuauuguauauaguauuuuauguaguaccuauuuuauacagugcaacuuguuuuuaaacuguuuauaggcugggugcaguggcucaugccuguauucccagcacuuugggaggcugaggcaggaggauuacuugaggucaggaguucgagaccaaccuggccaauaugaugaaaccccuucucuacuaaaaauacagaauuaucugggcgugguggcaugcaccuguauucccagcuacuuucaaggcugaggugagaggauugcuucagccuaggaguucaaggcugcaguuagcuauggucaugccacugcacuccagccugggugacagaaugggaucccaucuuaaaaaaaaaaaacaaaaacaaaacuauuuauugcuugugucugcuuuauuuucaaaggucuaacucaucuuauuacuauggauuuacaccagaaggaaauucagggcuucuucaauauuccuguugacaauuuaagagcaucucccuucuuauuacaguauauucaagaagaggugagcuagcucaaacuuuuuuauuuuaacauucugauuaagguugaaagauguauuuccauuuccuuaggauaccccuaaaggauuaaaacuugauguauuguacuuaaaguaccauuauacuuuauagcuauaauccaacgcauuuuagaauucugaaucugcaguuuguuucuuuagauaagcucuuaaaauugcuuuuucuuuuggaccucaaguaccuagaauuggacuagauaugauuguaaugaguaauuuacucucauuacuagucuaugcuugauccugguucuguuuuauguauccaucuauccauccugucucucuguccauccaguuauaauagccagcauccaugaucccaccucccagcaagaaaacuagagucaucaucauaacuuagagcugcucaugggcuccuucucuguccuaucccccugccuccuuccacccuagggaaccacuguccugaagcggugcugaaucugucagaugcuuuuucuguaucaguggagaugaucauuuuuuuuccuucauucuguuaaugugguuuauuaccacccuugaauccugggauaaaucagauguuuaauuuuaauauagcuacauuuguuuuucuuugauaugaguuagcauuuuugugacuuacuauuuaagaaagcuuuuaaaauguuaauuuauacuguacuuagcuauuuugcuuuuagcuguuuuucuuucuuuuuuuuuuuuuuugguggggggugugauggagucacucccaggcuggaguguaauggcgcaaucucagcccacugaaaccuccaccucccggguucaagcaauucucgaguagcugggauuacaggcaugcgccaacacagcuggcuaauuuuuuguaucuuuaguagagaugggguuucaccauguuggccaggcugaucucgaacgcugaccucgugaucugccugccucggccucccaaagugcugggauuacaggcaugagccaccgcaccuggccuuagcgguuuuucuuauauaaauuauuucucucuuuaauaacuuuucuagauaacuucuuuuuacaguacuguauuuaaaagaagauaacuucuuuuuacaguacuguauuuaaaagauggcaguuuauagguuucugaggaacuucuuucugguaagaauacagggcuuccccauucuccagcaauuguuauaaguccuuauagagaaaaugaauuuaaguauuuuugaaagagaaaaauguaaaauauucugcuuuuuuuuuuucuuuaaaguuacacacaagaaacauaaaaacucuacgccaggcgcaguggcucacgccuauaaucccagcacuuugggagucugaggcggguggaucacuugaggucaggaguucagaccagccuagccaacauggugaaaccccaucucuacuaaaaauacauaauuagcuggaugugguggcgcgugccuguaaucccaguuacuugggaggcugaggcaggagaauugcuugaaccugggagguggagguuacagugagccaggauugugccacggcacuccugccugggugacagagcgagacuaucucaaaaaaacaaaaaagaaaacaaaaauacucuaacaaauuaaaaaaauaauagagacuuuaauuuuaccugaaaaauuuuauguuuuuuuuuugagacagggucuuucucugucacccagguuggagugcuguagugccaugauagcucacugcaaccuugaacuccugggcucaagagauuucucccaccucagccuucugaguagcugagacuagaggugugccaccacaccuagcuaauuuuuaaaaaauauuuccagagucagaaucuugcuguguuacccaggcuggucucaaacuccuggccucaagcgauccuccugccucagccucccaaaacagugugauuacaggugugagccacugugccuggccuaauuuuaccugaauauuauucuuaguugagagagaaggugagauaaaauuggcaaaugucuugauagggaaggaugaagagguuuaggcagagagagagugagagggugagcauugaacgugguucaguuagcaaccagccgcauggagaaaccugucauuuuggaagaaauagagcagucgcuauagacuuauguggguugcugucgacaucuuguuguuuuaggggauguuuccauucaggacacaggcauguugugugccaaugucucaaggcacaaauggcaauugcaccucuuaagggaugcccggugggugagccuaaagaacgaaggcuggggcacccuugugcugguugcaaggucaggcuggaagccuaacgcuagucauugccuguagugcaggcuucuaccugaggaugacacugccuucuacuugaaaaaauccccauuuuaguuucauuguugagaagaagucagggcugagugugguggcccacaccuauaaucccagcacuuugagaggcugaggagguuggaucaguugaguccaggaguuuaagaccauccucggcaauauggcaaaacccugucucuacaaaaaauauaaaaauuaaccaggugugguggugcauuccugugguccccccuacucaagaggaugagaagugggaggauugcuugagccugggagguugaaguugcccagguggucgaggcugcaucaagccgugaucugggcgacagagugagauuccuucucacaaaaaaaaaaaaaaaaaaaaaaaaaauuaauaugugggaacucaguguuaaaaaggaauuuuuguguauugcuuuuuucuuuuuuuuggagacagucucucucugucacucaggcuggagugcgauuuuggcuuacugcagccuccgccuccuggguucaagcaagcauaucuggcuaauuuuuguuuuuuguuuuuuuuugagauggaguuucgcucuuguugcccaggcuggagugcaauggcaugaucucggcucacagcaaccucccccucccagguucaagugauuguccugccucagccucccgaguagcugggguuacaggcaugugccaccacacccggcuaauuuuguauuuuuaguagagacaggguuucuccuuguuggucaggcuggucucgaacuccugaccucaggugaucugcccaccuuggccucccaaagugcugggauuacaggugugaaccaccgcacuuggccuaauuuuuguguuuuuaguagagauaggguuucaccguguuggccaggcuggucuugaacuucugaacuccagugaucugccugccucagcuucccaaaguccugguauuacaggcaugagcuacuacaccuggccuguauugccuuuuuauaguauacguaucuugucucuuuuguuuucguguguuagagccucuuaaagcaggggauagauauucauguuucacugaaucuaaggugcugucaguccaggcuuacauuauuuuacgucaccaagaaagaagaaaacacugcuaauuauacuguggcacugugccuucuugucacuuagugauccuauucugcagguuuugaugcugacgcuuucuccaucucuuguguuugucacuggaauuuaagcaccuucugccagagucagaaggaacauucugguacuaggaugcucguugccuugaaauuuuugccaucuauacuuuuuuuuuuuuuugagacggagucucacucugucgcccaggcuggagugcaguggcgcaaucucagcuuacugcaagcuccgccucccggguucacgccauucuccuaggccucagccuccccaguagcugggacuacaggcaccuaccaccacgccuggcuaauuuuuuuguaguuuuaguagagaugggguuucaccguguuaaccaggauggucucaaucuccugaccuaaugaucugcccgccucagccucccaaagugcugggauuacaggugugagccaccgcgcccagccaacuuuugccaucucuucugagggcgucugacagugucuguugccuuccgcugcacugcuggggaugugucaggcaguccuuuucacaguuugaccuacugguagggaucuuccuuucuuaaguuucauaaagcauuugauuguugccuugcaagaaaauguggaauuguaucauuuuuccagugaugaauauuugauucaugaauaucaaauuauacucugauggucucuuccugugucuuucugcauacaugauaauuuuucuuuucuucuuuuuuuuuuuuuuuuuuuuuuuugagacggaguuuugcucuuguugcccaggcuggagugcaguggcgcaaucucagcucaucacaaccuccgccucccagguucaagcgauucuccugccucagccucccgaguagcugggauuacaggcaugggcccccauaccuggcuaauuuuguauuuuuaguagaaaggggguuuuccauguuggucaggcuggucuugaacucccaaacucagguuauccacccgccucaaccucccagaguacugggauuacaagcgugaagccaccgugcccggcuugauaauuuuucauuuuaaugaaaaauuuuaaugaaaagaaucauaguaauucuuucuggagacauuuuaaauggguucaaacaauucuccuggguucaaacaauucuccggccucaaccuccugaguaacuggauuacaggugugcaccaccacgccuggcuaauuuuguuuugcauuuuuagcagcgaggggguuucaccaugcuggccaggcuggucuuggcucagauguucugcccaccuuggccucccaaagugcugggauuaugggcaugagccaccgugccuggccaucuuugggaauuuuuuuuaaucuguuaaguauuucaucccuucuauuucuuuuauuauuuuccuuugggaacuauuagguccugaaaauuuuggaucuagucucuauaacuuuuaaaaacuuauuuuacuuuuugcauacuuauauauagcauucuggggaaauuccuugucuugaucuucccugguuuguucuuaaaguuguguuuauucugcuguuaagccagccagcuacuggguuucuuuagaccauaauaacuucuucccccuagauuuauuuuugguucuuuuucauaauaacuuguucuuucuuuuuuuuuuuuuuaauuuauuuuuuuauugauaauucuuggguguuucucacagagggggauuuggcagggucaugggacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaaguaucuguuuaacaaagcacaucuugcaccgcccuuaauccauuuaacccugaguggacacagcacauguuucagagagcacaggguuggggguaaggucacagaucaacaggaucccaaggcagaggaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggcccguucucaaugagcuguugggcacaccucccagacggggugguggccgggcagaggggcuccucacuucccaguaggggcggccgggcagaggcgccccucaccuccugggcggggcggcuggccgggcggggggcugacccccccaccucccucccggacggggcggcuggccggucggggggcugaccccccaccucccucccggacggggcggcuggccaggcagaggggcuccucacuucccaguaggggcggccgggcagaggcgccccucaccucccggacggggcggcuggccgggcaggggggcugaccccccccaccucccucccggacggggcggcuggccgggcaggggggcugaccccccccaccucccucccggacggggcggcuggccgggcggggggcugacccccccaccucccucgcggacggggcggcuggccgggcagaggggcuccucacuucccaguagggguggccgggcagaggcgccccucaccucaacuuguucuuucuuguuguauauaauuucccauuuuaaccuccguagagacaauagacuuguuuuuguuagaguccuuucuuuuagguccuuuaauuguuauuaacuguuuucuugguucugucuuuucuuggcuggguuugguaauguuugaugauguuugaugagacaaggaaauacaugaaaaaguuuagaaagacugccagcaaaaauaaugaaagugcccaaauggaaauauauuuuacugccuuacuuccugagaguguuggauaaauuaggcuuuccuguagauacagcugagccaugugauuaugccggaggcaacuguacuaaauuauucaaauuaaucauuuuuuguucauuugcuaaguaguuauuauuuagugcuuguuguaugguaggcauuguuuuauacauguugcuagguguuauuaacugcucauauuaaaauucauugguguaauugugagaaaaaagcaaugagaauauaguuaauauauuuuuuuaaaauagugcugggccgauuauccuuuaacaaauugguugcuucaacauguuaugacugcgauauguuaaauagccauuuguuuggacugcaguaauuuggaauuugacagucagcuuguauucagauugaauuggauauccuuguacuuugaaauuacauguaauuaggauucuuguugacgagauauauagaaacaucuuuacacugcaucauuaguauuugcuggcagagauaagagcuaaucaccaauuaucccuacuuuuuuccuaaaagaagucuguguggcucacaaguuaguaauauuuuuucauaggcagguuccuuucuucauuuuccaaaggagaauuuuacuuugaacuuuuucuuuuuuuggaaaacuuucaacuagccaagcauuuuugggucuguuggaauuuuccuuuuuguugacaugcaguaauaccugacuucuugucugucacagaucccagauuacaggaaugcaguaaucguggccaagucuccagccucggcgaagagguaggugggaaucucacaaccucuuucuggaucuacuucuaaggauuguauccgugaugaguuccaggcauucuaauuugaacuucagugguucccagcgauaucucuuauuuuucuuccauggacugguauuuuaagauuguucugucaacuccauuuauuaaguaaacauuuuaauuuccucucuuuuuuuuccaaucccacucuaugauugccagacauacuuccuuuuuuaaguuaucuuccacuuacacuuucuuuuauuuuuauuauuauuauuauuuauuuuauuuuauuucuuuauuuuuugagauggaguuucgcucuuguugcccaagcuggagugcaguggcgcgaucucggcucaccacaaccuccaccuccuggguucaagcgauucuccugccucagccucccaaguagcugggauuacaggcgugcaccaccaugccuggcuaauuuuuguauuuuuaguagagaugaaguuucaccauguuggucaggcuggucucaaacuccugacuucaggugauccaccugccuuggccucccaaggugcugggauuacaggcgugagccaccacacugggccuuauuuuuauuuuuaauaguagaaacagaguuuugccauguuguccaggcaggucuugaacuacugaggcucaaacgauccacccacccgccuuacccucccaaagugcugggauuacaggcaugagccacugcgccugaccucaaucauauuucuugaccaaagcaauccaguucuggggaauacgaucuaguguuuuccccagacccagauugacaaucacaugucagucuuugagucuggcguuuacaguacuggcgaauauuuacaguacuagcagacaacuucauaguuguuuacugccccuuauuugaggaacucagaaauugauuaacagaauuuuauccagcugagaggccaguuauuuguauauguuaaaggugacauuuuacaaaauugacacaaccugagguguaccaaagggggagccuugagagucaguagagugaguuacauguaaccuggaguaacugaugugucacuauugcauacuuaaaauuauaugucgguugagaggauuucuuauacuaccaguguuuuguggagaagccacuccacuggagagggaaagaacaaaaucacuuguaggaauaaagccuuuuuccuaaaaaagcccuuuuaaaguuauuuuccaguugaauaccuuugaucacuggauuguuguugaguccuguggaaugaaagaaaguguagggugccuccacccugggcucgugggcuggcaguauugaaggauggaggagaacuugcacacaguaagccauugauuucaaaaguauuucacauaagucauugacguuaugaauuaagaauagcacuuuaauauguagacuuaguauauuaaauaaaauaaauuggcauuugagauaaaaccauuacauggcuguguucuuguggcugacuuucccaacccagccgggccuguguucacccauguguccuucaagaaguuguaucaccugaucuccucuuguccauuugauuaaauuguaagaaacagacugaauuuuagaauguaaacauuucaaauagcuuuuccaaacauuucuucaaaggcugaauuaauuuuacuuaauaauuuuucucugauauacaugcuuuaaaaaaauguaggugaaaaaucacauaauauacaauaauuuuaaaguauagaauucacuggcauuuagugcauucacaauguuguguaaccaccaccugucucuguuuucagaacauuuucgucuucccagaagaacaucuaguacccauucagcaaucauuccuuaucccuucaccuucugucccucggcagccacacaguauguggcccucugugucugguuucuuucacuuagcaguuuucaagguucaucuaugguguagcauguaguaucucaguguuuuguugucgcuguuauuguucgagacaaaaucuuacucuguugccgaggcuggagugcaguggcacgaucucagcucacugcaaccuccgccuccuggguucaagcaauucuccugccucauccucccagguagcuggaauuacaggugcaugcuaccacaccuggguaauuuuuguauuucugguagagaugagguuucaccauguuggucaggcuggucuuaaacuccugaccuugugaucugccugccucggccucccaaagugcugggauuacaggcgugagccaccgcacuuggccaguaccucaguccuuuugauggcugaguaauauugcauuguauguguauacuaguuuguuuauccauucaucuguugauggacacuuuuuuuuuuuaccguuuggcuauuaugaauaggacuccuauggucagucauggauuaguuuuuguguuggcauaaguuuucauuuuuccuuucuuguggauauauauuaggauuggaauugcugggucauauggcaguuucguuuauguuuugaggaacuaucagucucuuuuccacugcagcugcccauuuuacauucccaccagcagaguaugaggguuccaacuucuccacaucuucaccaacacuuaauucucugaguuuuuucauuauaaucauccuagugggugugaaauucuaccuuaucgugguuuucauuugcauuucccuaaugauugaugauguugaguaucuuuuuuuuuuuuuuaaugagacagggucucaguauguugcucaggcugggcucaaacucuugggcucaaucaauccuucugccucagccuguugaguguguguguguguguguguguguguguguguguguguguauuuauuuauuuauuuauuuuuuugagacagagucucgcucugucacccaggcuggagugcaguggcgcgaucucggcucacugcaaccuccgccucccagguuuaagcgauucuccugccucagccuccugaguagcugggauuacaggcaugcgccaccaugccuagcuguugaguauauuuuuaugugcuuuuuggccauuuguauauauuuggagaaaugccuguucacacccuuugcccauuuaauaauuggguugucuuuuuguugaguuauaagcacucuuuauauauucuacauacuaaaccuuguuagauacaugauuugcagauauuuucucucuuucugcagauugucuuuucacugucuugaugguguucuuucacacaaaaagguuucaaugcugauaaaguucaauuuaucuuuuuuuuuuuuuuuuuuugagacggagucucagucuguugcccaggcuugagugcagugucucagcucacugcaaccucugccucccggguacaagcgagucuccugccucagccuccugaguagcugggauuacaggugcccgccaccacacccggcuaauuuuuuguauuuuuuaguagagauggaguuucaccauguuggccaggcuggucucgaacucuugaccucgugauccgccugccuuggccuccccaaucaauuuaucuuuuuuguuuguuauugccucugcuucugaugucaugucuaagaauccauuggccaggugcaguggcucacuucuguaaucucagcacuucgggaggcugaggcagaaggaucacuugagcccaggaauuugagaccagccagggcaauauagugagaccucguuuuuaagaaaaaaaaaaacauuaacuggaugugguggcauuugucugugguucuagcuacuuggguggcugaggugggaggauugcuugagcccaagaggucaaggcuacagugagccgugauugcaccacugccuggcuaauuuuuguguuuuuaguagagacgggguuucgccauguuggccagacuggucuccaacuccugaccucaagugaucuugaccucaaaugaucaucccaaaguauugggauuacaggcaugagccaccgcacccagccaccauagcuuuuuaauuuuuuugagauggaguuucacucuuguugcccgggcugcacaaucuuggcucacugcaaccucugccucccaggcucaagcaauucuauugccucagccucccaaguagcugggauuacaggugugcaccacuucaccuggcuaauuaguagagaugggguuucacuauguuggucaggcuggugaccaaccugaucuccugaccucaggugauccacccaccucugacucccaaagugcugggauuacagacgugagccaccaugcaggccucuauagcuuuuuuuuuucuuuugagacggaguuucgcucuuguugcccaggcugggguacaauggcacgaucucagcucacccugcaaccuccaccucucggguucaagugauucuccugccucagucuucugacuagcugggauuacaggcaugcgccaccacgccuaucuaauuuuguauuuuuaguagagaugggguuucuccauguuggucaggcuggucuugaacuccagaccucaggugaucugccugccucggcaucccaaaguguugggauuauuggcaugauccaccaugcccggcccucuguagcuuuucaauagucuuuuuuuuuuuuuuuuuugagacagagucuugcucuguugcccaggcuggagugcaguggugcaaucuuggcucacugcacccuccgccuccuggguuuaagcaauucucugccucaccuccugaguagcugggauugcaggcaccugccaccaugcccagcuaauuuuuaauuuuuguauuuuuaguagagaugggguuucaccaucuuggccaggccagucuugaacuccugaccucgugauccacccaccucagucucccaaagugcugggauuacaggcgugagucaccacgcccagccuuaauagucuucaaguuggguauugucacaccuccaacuuuguucuucaauauuguguuggcuauuuugggucuuuugccucuccauauaaacuucagaaucaguuuuuugaaauacacaaaauaacuuguugggauuuagauugggauuugcauuaaaucuguagaucagauuggggagaacuggcaucuugacaauauugagucuuccuauccaugaacaugggauaucauuuuuuaaaaauucaucuuugauuucugucaucagaguuuuguaguuuuccccauauagauguguacuuuuuuuuuuuuuuuuuuuaaagagaaagucuugcucuguuuacccagacuggagugcacuggugccaucacagcucacuacagccuugaauuuuugggcucauggcaauccuuucauuucagccuccuaaguagcuaggacuauaggugugcaccaccaugccuggcuaauuaaaaaaauauauauauauuuuuuguuagagacgggggucugacuguguugccuaggcuggucucuaacuccuaggcucagccucccaguguugggauugcaggcaugagccaucacuuccagcccauauuuuguuauauuuaugccuaaauaaauauuucauuucuuuggguaucccuuaauuuuuuagacauuguuuucuuuaguucugugaacauauuuaugauagcuaauuuauugugucuaguuauucugacauugggcuuuuucagagaucguuucuguugacugcuuuuuuacuguguaugggccauguuuuucuuuuuuuuaauguuuaaaaaaacuuauuacuuuauuauuuuaauuuaauuuaauuuuuauuuuuauuuuaugacagagucuugcucuguugcccaggcuggagugcaguggcaugaucucagcucacugugaccucugccuccuggguuccagcgauucuccugccuuagccuccugagcagcugggauuacaggugugugccaccaaacccagcuaauuuuuguauuuuuaguagagacgggauuucaccauguuggcugggcuggucucaaaacuccugaccucaggugauccacccaucuuggccucccaaaaugcugggauuacaggugugagccaccaugccuggccaaaacuucuuacuuuaaaaaagaauacagaaacaagaucuugcuguguuucuggacuggucucaaacuccuggccucaagcaaucuuccugccuugggccuccugaaguucuagaauuaaaagugugagccaccaugcccggcccauauuuuccuuuuuguuugcaugccuuguacauuuuaguuaaaaacaacauuuuaaauuauguaaugugaaaaaucugagcaucagauucuaccuccaccaauucccaguguuuguuguugcuguuguuucugugauauguuuguuuaguggccacccugugccaauucuguaaagucuguauucuuuguagcauucagccacugaagucucugguugguuagcuuacuggccagcuaaugauuggacagagauuuccugaaaugccuugaagcaauaaaucucccacucucuucaaggucuguguguguguguuugugcaugucuucaauucucccagcagcuuacaacucugccuuagccuuuacuucuugguugcacagagccuuaaggucagccaagguucaagguuaggggcuuuucagguccuuccuggguaagcgcauguucuuuacaugcaggaauaagcuuuucaaggcccauguggccaucucauuccccagauuuuccuuuuuuuuuuuuuuuuuuuugucuagccccuuguuuuacucaacugguauugucacuucaggcggcugcaguguuaaacaguugcuguugauugcucaucuacucuggggaugggacuauucacacagagugacucuaaguuugaucauauucuccagcccugagucucagcaagcugccagauaggcauaauagugaugguuaccugagaaugggcuucuugagaagcuccaaaccuguucuuuucccaccagugguugcuagucuucuguuucucauggccaccaugauuaugagguuuccaauuuuugucuuuugcagaacuggagagagaggcaugggaauaauggaauaaugggaauggggcaaguuaaaacacacacaguuucuuuuuuuugagacagggucucacucugaugcccaggcuggagugcaguggcaucauuaugguuuacugcagccuggacuuccugggcucaggugauccaccucagccucccaaguagcugagaccacaggcaugcagcaccaugccuggcuaauucucauguuuuuuuuguagagauggggucucacuauauugcccaggcuggucuccaacucguggccucaagugaucugcccaucucagccucccaaaguguugggaugauagucgugaaccagcaugcccagcccaaaguuugcucuuuaacaagauucagcuguuuuucuuaaacacuccucagauuguugcaagcuguugguuaacuuccacaguuauguaaaaguuaauuuuugcaaaauuuuuuagaguuuuucuuucuuucauggaggagcagauuuuuuaggguccuuauucugccauucuagaguggugcuucucuauagugguguuguuguuguuguuguuguuguuuagacggauuuuuauacuugucacuuaggcuggagugcaauggugccaucuuggcucacugcagccuccaccucccagguucaagcgauucuccugucucagccuccugaguagcugggauuacaggcucccaucuucacacccagcuaauuuuuguauucuuaguagagauggaguuuucacuauguuggccaggcuggucuggaauuccugaccucagguaaucugccugccuuggccucccaaaaugcugggauuacaggcgugagccaccacgcccggcccucuauaguguuuugaauaucaccuuauauagcuguuuuaauaguuguucuaaguauuuuauuacauauacaaaacauauuacaauauacugaugucauuuuaucagccugagugaaauauagaagucauaccucucugugucucuuuacucccccuguuuuuaauauauuugucuuaaauauuucuauacauacauuuauagcaguaucaggcuguuagaauuuuugcuuuuuuuuuuuuuuuuuuuuuuuuuugaggcagugucucgcucugucaccagguuggagugcaguggugcaaucuuagcucuugguaaccuccgccucccggguucaagugauucuccugucucagccucccaaguagcugggacuauaggcgagcgccaccacgcccagcuaauuuuuguauuuuuaguagagaugggguuucacuguguuggccaggguggucuccaucucuugaccucgcaaucugcccaccgcggccucccaaagugcugggauuacaggcuugagccaccacacccagccagaauuuuugcuuuuaaacaucaaacauaauuuagaaaagucagaaaugaagaaaagcuuauuauauuuacagguauuuuuguuuccuucuuccuugcugauauuccaaaguuuaguuuauuguuuccuuucuguuuagaguaccuccuuuugccgcuuuuaaauaauaguucuguugguaacacauuuugcugguuuuccuucauuugagaaugucuagaguuccuuuucauucuugaaggacaucguugcuggguauaggauucuggaguaacgguucuuuucucucagcaccugaaaaguuuuugugucacuuucuuuuggucacugugguuucugaugagaaguugguuaucaugaauuauuuuucaagauuauuucuuugucuuuaguuuucaaaaguuuaauuaugauauaucuugagauugcuuuggguuuauccuguuugguguuugcuggacuucuugaagcuguggguuuaugucucugaccaauuugggaagcuuucagccauugucuuuuugaguacuuuuuuaguccuaccgucuuucuccucuuuuucugggacucuuaugacauaaaugucagguguuuguuuguuuguuuguuuguuuguuuguuugagauggaguuucauucuuguugcccaggcuggagugcaauggcgugaucuuggcucaccguugcaaccucugccucuuggguucaagcgauucuccugccucagccucccaaguagcugggauuacaggcaugcaccaccacgcccagcuacuuuuguauauuuaguagagacgggguuucuccauguuggucaggcuggucuugaacuuccgaccucaggugauccacccaccuuggccucccaaagugcugggauuacaggugugagccaccgugcccagcugaucuuuuguuacagguccaugggauucuguuuauuuuuauuuucuagucuuuuauauuuuuauuuuuuagugggucucacuauguuacucaggcuggucuugaaccccugggcucaagugauucucccaucuuagccuccagaguagcugaaacuacaagcacaugccaccaugcccugccacagccauuguucucucuguuguccaaauuggcuaauuucuguugucugucuuccaguucacugauucuuuccuugaccuccauuauuauuuucacuguaacuuccauucugcuguugaguauauccaacugaguuuuuuuuuuuuuuuuuuuuuuuuuugagacagggucucaccucuguugcccaggcuggaguguagugguaugaucacagcucacugcaaccucugccuccuaggcucaagcaauccucccacauccgccucccaagaagcugggacuacaggugcaugccaccgugucuugcgaauuuauuuuugguauuuuugguagagacggggauuuuaccauauugcccaggcuggucuugaacuccugagcucaagugaucugcccaccucagcuucucuaaagugcugggauuacaggugugagccaccacccccagcccaacugagcuuuuuaauuugguuauuguauuuuuuaaguucuaaaauaaguuuuugguucucuuuuuuugagacugagucucgcucuguugcccaggcuggaguacagugguguuaucacagcucacugcaaccuccgcucccuggguucaagugauccuuaugccucagccuccugaggagcugggauuacaggcaucugccaccacgcccggcuaauuuuuguauuuuuaguagagaugggguuucaccauguuggucaggcuggucuugaacuucugaccucgugaucugcccgccucagccucccagacugcugggauuacaggcgugagccaccgugccuggcugcuaauuuuguauuuuuaguagagacgggguuuugccauguuggccaggcugguuucaaacuccuggccucaagugaucugccugccucggccucccaaaguacuggaauuacagucaugagacacuacgccuggccuugggucuuuuuuuauaccuucuauuuuuuugucaauacuuucuuuguuuagacuucuuguuuuuuauuucacacaugcucauaauugcugcuuguagcacuuuucugauggcugcucuaaaaucuuuguuauacaguuucagcaugucugucaucuugguguuggcaucuguuaauugucuuuuuucauucauauugagauuucacuggccuuuaguguggcgaguggcuucugauuggaaucuggacuuuuagauauugugugugagacucugggucucauuuaggccuucugauuuugcuggcuucucaggacucuggcagggaaaguggugguguuggggcucguuucugcuagguaaggguagaagucgagauucaccaccaggccuuguguggaccaccuaaggugguccuuguuacucauggguggaaaugcucccuccauguccuccgcugacgccaaggaaaaguagcaucauucucauuggguggugguggaauuccugacuccaccaggcugccucugauaccacugcaauggagaggggaggggcaccucuuuacugcugaguuggggguagaaguccagauuucacucuccacugacucuggcaguugcuccuuacugcugagugagggugaaagucccagcucccuguuuggccuucugugaaaccaccccauuggguuuggggugccucauuauagccugacaagccaggaaguacaggcucaccccucaaccuuuacucaugcggcggaaauguggcggaaacgugggcuguggcuuuccugccuguguggcuagaguaaggcaguuauugucuaaauauuuucucacucacuagguugcccuuuucuuaguccuuugacuagggagagccgaccuuuguuggagcuuuucuugucuuugcccacuggcauuuuugggucgcuucuucuccagcuacaaaucugggauaauaaggcaaaaggaaugcccaaggaagccaccaccgugacguugcucagguccugaggucccuugcuagucugccuucucucuaccuuuuagugucuucucauuuuuuuuugagacggaaucucgcucugucacccaggcuggagugcaguggcacgaucuuggcucacugcaaacuccgccucccggguucaugccauucuccugccucagccucccgaguagcugggacuacaggcgucugccacuaugccuggcuaauuuuuguauuuuuaguggagacaguuucaccauguuagcaaggauggucucuaucuccugaccucgugaucugccugccucagccucccagagugcuaggauuacaggcaugagccacugcgccuggccagagucuucucauuuuuguuuguauguaacauccagggguuuuaguuguggguggcagaaggaguauuaauaauccuuccuaguggaagcagaagugacaauguuuugauacuuuuuuuuccuugagacagguucuugcucugucauccaggcuggagugcagugguacaaccacggcucacuguagccuccaucuccugggcucaagagauccuccugccuuagucuccugaguagcugggacugcaggcaugugccaccaugcccagcugguuuuuuccuuauuuuuguagcaacgggaucucccuauguugccaggucuggucucuaacucuaggguacaaguaauccuccugccuuggccuccuaaaguuccgggauuacaggcaugagccacugcaucuggccuugauacauuuuuuuuucuuucccacuaaauaccagaagaacaugaugaauuuucuguugacuuucccaucuggguggacuuuuaguaaccucuagaguccucaguuuacuucugucacccaccuguucacagagggauggauguaguagccuuuugcucaguuucuuuggcuuuugucagugauguuugucauucaucuguucaaauguuuauugagaaccuauuuugcuggggcugaugaggccuaggaagaugcccuguaggaaugcauguguagcgucagauguuuuuuaucuauguuauguuauuugaucuuugcaacuuuggaagucagcaguuauaaucucucauagaugaggaaacagacccacagagaugaaggaaccaagguaguuccaccaaauguuguuuccuugaagguaguggggcaacuauuuacuuccaagaauguuuucuauaccagugauuaggggacuugaguguuggccaaauaugauugaaauugggccaggugcggugucacaccuguaaucccagcacuuugggaggccgagggggguggaucacuugaggucaggaguuugagaccacccugaccaacuuagugaagcccugucucuacuaaaaauacaaaauuagcggggcaugguggcgcacgccuguaaucccagcuacuugggaggcugaggcaggagaauugcuugaaccugggaggcagagguugcaguuagucaggauugcgccauuguacuccagccugggugacaagagcaaaacuccaucucaaaaaaaaaaaaaaaaaaaaaaaagaaauugacuugccccccuccacucagucuuuaccgaguacauauuugagugcugcugugccagccaucguggaugugguggugaccagugcaggcagggcuguguucccauggcacuugcagacugcccucaugugcucuuugacugguaggucaguuggguagauuggaacgaaagacccagucucuuuuucucccaguuucaguaauugaauccacauagaucauacuacauuaaaugaauguuuuagaggcugggcgcauuggcucaccccuguaaucccagcacuuugggaggccgagauggguggaucuccugaggucaggagaauugcuugaacccgggaggcggagguugcggugagcccagaucgugccauugcacuccagccuaggcaacaagagcaaaacuccaucaaauaaauaaaugaaugaaugaacguguguuuuaguauggagaugagugcuacaaaagguucaguuuuauauggaacagguaguaaaauaacacagucaaggcuuaggaguuuggucugugaguuuaagguauugugagugggcuaggcucgauggcucacaccuguaaucccagcacuuugggaggcugagguuggaagaucauuugaguccaggaguucaagaacagccugggcaacauguugaaaccccaucucuaccaaaaauacaaaaauuagccgggugugguggcgugugccucuagucccagcuacucaggaggcugaggugggaggaucacuucagcccaguagguggagguugcagugaggugagaucacaccacugcacuccagccugggugacagccagacccugucucaaaaaaacaaaguaaaauaaaaagguauugugagcaagagcucugucgacauggcaucaacacaguaaagucaguucugguugucuuauaucccguagcuaugugguggugauuuucuuguguucuaauguccugauaaacacauucacccagacuucgagcaggagauggcacuuucuggcucagccacaugcaaauucugauccuauuauuucuaguucccuccuccaaguuuuucauuuggcagccaaccuuagaaaauagcuguaaucaauguagaagucagacuggggcugacuuuuaucagucaggaagguauuaaauuagcaguccaagacuugggcuuccacuugugccuuagccagucuuugugagaaccuuggucaaggcugucucuccaagccucaguuuccuggggauaacaccugcuuggcuuaucuuacagaguuaauaagcaucaaagaacuuacugaaggacuuuauaaauuaaauaccauuauguagaaugguggugguuagugccuuuauuuauuuauuuuuugagacagggucucccucugucgcccagucuggagugcaguggugugaucucggcucacuacaaccuccaccuccuggauucaagcgauucucuugccucagccuccuaaguagcugggauuacagacgugcgccaccaugcccagcuaauuuuuguauuuuugguagacaugggguuucaccaugcugguaaggcucuucucgaacuccugaccucaagugaucugccugccucggccucccaaaguguugggauaacagacgugagccacuguugggauaacaggcgugagccacuguguuuagugguuagugccuuuagaauccugaaguuauugaugaauaggucgaaguccagagcuauuguuuuggaguuguuugacaaugagcaguuguuuugacuaaaagggaucaucagagaaaguguugcuuuuguaaggaacagaacuugcuugaaugaguuguuugaaauuguuuucucugaauaacugagugaauaggaaacaaaaggauagcugaggcccugugucuuguucuuucucacccaugauguaaauuaacucauuaucguacaaucaggaucaaguugcuuuagaauuccucucugucagugcaugaaacaaaaugacacagagaaaccauccugauugauuuuggaauuagaugggaaugcaaaguaucugauuaaguuauauggaguauccagaaacucccauugcugugcagguaauaauuuuauuuauuuauuauuuuacuuauuuauuuuuuugagacagagucuugcuguugucgccugggcuggcaugcaauggcacgaucucggcucacugcaaccuucgccucccggauuuuagcaauucuccugccuuagccucccgauuagcugagauuacaggugccugccaccaugccuggguaauuuuuuuguauuuuuaguagagacgggguuucaccacguuggccaggcuggucucaaacuccugaccucaggugauccaccugccuuggccucccaaagugcugggauuacaagugugagccaccgcacccggccaugauuuuauuuaucuuaagagcauugugcuuuguagagguugguauaauugaaauauuauucuaggaauuggcaaaccuccacagaucccagauggaaaagacuuccuuagaggauaacuaacaggucagucauuuggccaauuuuguuugcaaagccaaucuugaauuucaaggaggaacuaauaaucuaugugaugccaacucuuuugaagacucugccccauuguucugucugaaauuuuuuucucuugagaauuuuuuuuuuuuuugagacggaguuucgcucuuguugcccaggcuagagugcaauggugcgaucucggcucaccgcaaucuccgccucccggguucaagugauucucccaccucagccucccaaguagcuggggauuacaggcaugugccaccacacccggcuaauuuguuuguguuuuuaguaaagacaggguuucuccauguuggucaggcuggccccaaacucccagccucaggugaucugcccgccucggccucccaaagugcugggauuacaggcgugagccacugcuccuggccacucucuugauaauuuuuuaaaaacuauuuugauuuuuuuuguaaggaugaauucaaaguuauaugaauacuaaaucuuacaucuugggauauuuaucaaauguuauuaaaauauucuguguuuaugaugcucccucuuuucccuuaggacaaauauucugucuuacacacacauagauaaauauauuuuacugacuucacuguuuuugaccugaacagucuugcuccugugaagguuuaucaucuuuuccuuggaaauauaaauuacauuccucauagauaggaccagaccaauaaauguuuacuuacgugugucugagauuguuuguuuguuuguuuguuuguuuauuugagacagggucuuucucuguugcccaggcaggagugcaguggugcaauuauagcucagugcagccuugaccuucugggcucaagugauucucccaccucagccucccaaguagcugggacuacaggcgcgugcuaccacgcccagcuaauuuuuguauuuuuaguagagacaggguuucaccauguuggccaggauaguuucgaucucuugaccuugcgauccacccgccucagccucccaaagugcugggauuacaggcgugagucacugugccugggccagcuaauuuuuuuuuauuuuuguagagacgaggucucccuguguugcccaggcuggucucaaaccccugggcucaagccauucuccugccuucgucucaaagugcugggauuacaggugugagccaucacccagcuuuaaaaaguauauugaaaauaggaugauuuaagcaugaguuuuuuguguguuuguuuguuuguuuguucguuuuucaguagagauggaguuucaccauguuggccaggcuggucuugaacuccuugucccaagugaucugcccgccuuagccucccaaagugcugggauuacaggcgugagcugccgugcccagccaaauuuaaauuucuugaaauaauugcuaacacuguagcaaagcuuuccuuuguuguguagugcauauaggaaaccagguugaugugaaauuucuaacagcucauaagagucuacauacuaauaguauuuaguacuuucuagugcccugcucuucauaugucauguaaaugccuuggcuguaucuaguauagauaguacuagugggauucaguauaauccuuaauuuuuuguuuguuuuuaguaauucuuguaagcaguuaguuaagaacuuguuuugaauuuuuggugcugguaagccaagacugcgagaacuuguuggauucuuaaacacuugaacauuuaccaugcauuaggugcugaggauggaaaaaagaguaagacucagcauggcccccaggaaucaggaguggcuguauuaauaucagacaaaucaaggcaaauaauuuugccaugguugaagaaggucuuuuccuaaugauaaaggggucaguucuucaagaggacaaaacaguucuaaacauuuauaaacuaaaugacaguguuucaaaguauaugaagcaaacacugauaacugcaaggagaaauagauauauccauaaugauagugauuccauuauucuucucuuaguaauugauagaauaaggagacugaaaaucauuaaggaugcgggagacuugaacaaccccuucagccugcuggaucugacugacagucauagcacaccauccagagagagcagaauguaguucuuuuuuaguauaaacacaaagauagaucauauucuugugagccauaaaauaagccccaaauugauaauuaugcaagccauacaaaauauauucucugaccacaguggaauuaagaauaauucuaauaacagaaguaucuuuggaaauguccugaauauuuaguaacuaaauaacauacuuuuagauaacccauaggucaaagaagaagucaaaagugaaauuaaaaaguauuuagaaccaaaugaaaaugaagacacaggccaggcgcgguggcucaugccuguauucccaacacuuugggaugccaaggccggcagauuaccuaaggucaggaguucaagaccagccuggccaauaugaugaugaaaccccaucucuacaaaaaauacaaaauuagccgagcgugguggcacacccuguaaucccagcuacucgggaggcugagacaggagaaucacuugauccagagguggaggcugcagugagccgagaucaugugaccgcacuagccaagaucacgccacugcacuccagccugggcgacagagcaagacuccaucucaacaacaaaaaaaagccagaugcggugggaagaagcuccugcaagaggccacggagccagcgacgggaggccuugaagccagugacgacccacucagccgagcugccgcuuucgcagcacgccaaggacacucaugaggaccaugauacuuccacugagaaugcagaugaguccaaccaugacccucaguuugagccaauaguuucucuuccugagcaagaaauuaaaacacuggaggaagaugaagaacuuuuaaaaaugcagacgaaacuguucugauuugccucagagaaggaucucccagaauggaaggagugaggcaccggcaacgucaagcuccugaaacacaaggagaaagggaccaucugccuccucaugcggagggacaagacccugaagaucugugcuaaccacucuucacgcugauaauggagcugaagcccaacauggguagugaccaugccugggucuggaacacccacgccgacuucgccaacgagugccccaagccagagcugcuggccauccacuuccugaauauugagaaugcacagaaauucaaaacaaaguuugaagaaugcaagaaagagaucggagagaaaagaaaggaucgggcaaaaacgaucaugccaaaaaaaguggcggaaaagcuagaagcucuuuugguggaggaggaaaccaaggaggaugcugaggagaagcaauaaaucaucuuauuuuauuuccuuuuccucccuuuccuuuccuuuucaaauuuuacccugccccuccuuuucgguuuguuuuuauucuguuuuguuuuuacaagggauguuauauaaagaacugaauucaacauucaaaaaaaaagauuaaagcauaaaucaaugaaauagaaaacaaaaaccagaaaaaagcuaaaaagcugauucuuugagaaaaucaaugcaauugauaaaccuuuauccagacugguuaggagaaaacaagacacaaauuaccuaccguaccaaguguuggugaagauguggaggaacuggaucucucauguucugcucaugggacuguaauaugguauaaccacuuuggaaaacaguguggccuuuuuuuuuuuuuuuuuuugagauggagucucgcucugucgcccaggcuggagugcauuggcacuaucuccacucacugcgagcuccgccuuccagguucacgccauucuccugccucagccuccugaguagcugggauuacaggugccugccacccaguccggcuaauuuuuuuguauuuuuuuaguagagacgggguuucaccguguuagccaggauggucuugaucuccugaccucaugauccgcccaccuuggccucccaaagugcugggauuacaggcgugagccacugcgcccggccuauguggccuuuuuauaaagaguuaaauauacaccuacuauaugauccagccauuccacucuuaggaauuuaucaggagauaagaaagcauguggcuggacacguaauuccagcacuuugggaggccacggugggcagaucaucugaggucaggaguugaagaccagccuggccaacaugacaaaaccccgucucuacaaaaaauacaaaaauuagccaggcgugguggcacgugccuauaaucccagcuacuugggagguugaggcaggagaauagcuugaaucugggagguggagguucacaccacugcacuccagccugagcaacagagugagacucugucucaaaagaaaaagaaagaaagaaggaaagaaagcaugugcccauacagagaucuguguaugaauguucacagcagcuuugugacagccaaaaacuagaaacaaccggaaagcucagcaauacauaaauggauacacugugauauauucacccagcagaauauuacucagcaaugaaagggaaugaacuauugauauguuauuccauggaugaaucuccaaaacaugugcugcguaaaauaagacaaaauggccaggcgcaaguggcucacaccuguaaucccagcacuuugggaggucgagguggguggaucauuucaggucaggaguucgagaccagucuggcuaacaugguaaaaccccaucuguacuaaaaauacaaaaaaguuagccagaugugguggugcaugacuguaguucuggcuauuugagaggcugaggcaggagaaucgcuugaacccgggaggcagagguugcagugaacugagaaauccugccaccacacuucagucugggcgacagagcaagacuccaucucaaaaaaaaaucagacaaaaaaaggcaacuuuaugauuucacuuacgugaaauucuagauaggugaaacuauagugacagaaagcagaucagcuguugccuggggcaacacuuagugaaaaaucacuaaggggcauaaggagaugcuuguggugaugacguuccuuaucuugauugugcuaaugcuuauaugggcacauacagccuucagagcucaugaaauuauauacuuuagauaugcacaguuucucauaucucaguuuuaccucccuaaaacuauuaagaaauuugugcuuaauacuuuggugagcauuuuaugcccuuugccccauguaguugguucucacugguagguaggcaggcagguagaauuagcagcuuuaggugagacagagcugagcggagguuccuucacucagucaggcucucccggccaguggcuugcagaccaggccaggcugcugcccuucuuuggugcugcugcagagggaaguguuuggcauguggggucucuacaguuaguccugguuucuaagagucuaaggcuguuuuauucucucuuuucuuuaguccuuugggagacaacauucuacuuauguucucuuaauguuuuguccccuaggcauuagcagaaccaagggcugcaugaguuuugagcuugugucugguguuuucccucagggcacagucuuuugcugagcgccugcgccugggaauugcagugauucauggagaggcgcaggaugccgagucggacuugguggauggacggcauuccccacccauggucagaaguguggcugccauccaccccagccuggagauccccaguaagugugcugcugccucuuucccacuuuccucugauuuuaaggcugacuacacuguugucugugugguuuuuuuccucauucuucguuuuuuuuuaguuggcaaaaacucauuaacaccuuucuuggccagauaguagcgaaugcauuucugauuaccuuguaaauuguaaggccguuuagaagcagucuguccuucuuugcaagaccugugaaaauguuuggacuauugagacaguugcaaugcuucagggaaguccauucauucauucagcaguauauacuagaguguaguuuaacauaagcaaaaagcuuuuuauauacaaaguuauugacugugauguuguuuuuaaugcaaaauauuagaaagguuuaaaugguuuaccagaguguagggcuugguaaauuauacugugucaguacagcuaauuaugcagcccuuugaaauaaucaagacuaucuggaaacgagaaaaauauauggaauauauaugaacaaggcagaauauaagauuguauaccuauuugucuuaguucaggcugcugugaugaaauaccuuagacuggguaauauaaacaacaaauuuauugcucacaguucuagaggcugugaaggucaagauaaaggcgccagcacugaccccgugaugggccgggcacgguggcucacgccuguaaucccaacacuuugggaggccgaggcgggugaaucaccugaggucaggaguucgagaccagccugauccacauggagaaacccccucucuacuaaaaauacaaaauuagccaagugugguggcguaugccuguaaucccagcuccuugggaggcugaggcaggagaaucgcuugaacccgggagacagagguuguggugagccgagaucgcgccauugcacuccagccugggcaacaagagugaaacuccuucucagaaaaaaaaaaagauaaaggcgccagcagauuuggugucugucgagggccuguuccucguagaugguaccuucuugcugcauccucaugugguggagaaagguggaagacucccucaagccucucugacaagggcacugacccccuucguagagcagaguccuaacaaacuagucaccuaaaagcccuaccucuuaauaccaccacaguggguuccagcaugaauuuggaaggacacaaaaauucagaccauagcauuuugccccggccccucaaaauucauguucaucuuacgugcaaaauacauucauucuauccuaauagcccccaaaauguuaacuccggguaagucuuaacuuaauuucagcaucaccucaaaagucugaaguccaaagucccaucuaaauaucaucuaaaucaaauauggguaagacuccagcucugggauucacucugacgcacguuucucuccggcugugagccugugaaaucaaacagguuguaugcuuccaaaaugcaauggugggacagacauuggauagacauucccauuccaaaaaggagaagugaggcccaguguggugguucacgcuuguagucccagcguuuuggguagccaaggugggaggguugcuugaggccaggaguucgagaccaaaagggagaaguaggaagaaagaaaggagugacagguccugaccaagucuaaaacccaaccagacaaacaacauuaaaucuuaaggcuuaaguugacucaaagccccgccuuccacaaaaacuggggcagggguuggucuugcaaagcucuggauggccccacucccacagcuuugcugggagcagcccaugcagcagcucucagucacuggauucucaugccugcaucucucaggcuggaguugcacucuagugguucuaccagucuugggucuugggguggucuugccccacaacuccacugggcauugcccuaguggggucucucugguggcccugcccuugugacaguucucugcuugggcccuggcacucuuuggggcauccuuugaagucuggguagagguagaugugcccccacagcucauucacucugugcacuguggagauggcccugcacggacaccacugugguuuguugccugugccuuccagagggguggcccgagcuauaguuggaccugcuugagcuauagcuggaguggguaaggaguauucuggaaugugggaaguggagccuugaaaucguucugcccccaagacccuggcauucuaggcuuaugaugagaugggcagucacaaagaucucagaaaugccuuuggggucauugagucacugucuugaugaauagcgucugguucuuuuuuuuuuuuuuuuuuuuuuuuugagacaaggucucacucugucacccaggcuggagugcaguugugcgaucauggcucauugcagucucaccuccugggcccaagcaguccucccacuucagccucaugaguagauggaacuacaagcacuugccaccgcaccuggcuaauuuuuguauuuuuuguagagacaaaguuuuaccauguugcccaggcuggucuugaacuccugagcucaagugauccacccgccuuaaccucccaaagugcuuacaggugugagccaccacuccuggccgucuggcuucuuucuauccauacuaaucuccuuaucaaauguuugcuugguggcugggcgcggcggcucacaccuauaaucccagcacuuugggaggccgaggcagguggaucacgaggucaggagaucaagaccagccuggccaacaugaugaaaccccgucucuacaaaaaauacaaaaauuagcugggcaugguggugcgugccuuaaaucccaacuacucgggaggcuaaggcaggagaaucacuugaaccagggaguuggagguugcagugagcugagauccaagacugugccaccguacuccagcauggcaacagagugagacaccaucucaaaaaaaaaaagaaaaaagaaaaguuugcuuggcuacacacuuggaguucuguccugaacauguuuuugcuuuuuuuuuuuuuuuuuuuuuuuuuugagacagagucuugaucugucuuccaggcuggaguacaguggugcgaucagaucucacugcagccuccaccucccgggcccaagccauucuccuaccucagccucccaaguagcugggacuauagaugugugcaccaggccuggcuaauuuuuuuuuuuuuuuugguagagacggggucuugcuuuguugccuagguuggucacaaacucuugggcucaagcaauccucccuccuuggccucccaaacucuugggcuuauaggccugagccauugcauccagccuugcuuuuacauucuuuacaagauggccaggcugauaauuuuccaaauauuuaaguucuaccuccccuuugaugauaaaucucaucuuuaauucaucuucuuggauuuuaguauaagcagucaagagcagccaugcacccucuuuugccaaagauucuauuucacugcccuuuuuuuuuuuuugagauggagucucacucugucacccaggcuggaaugcaguggugcaaucucggcucacugcaaccuccagcucccggguucaagcaauucucaugccucggccuccugaguagcuagcacuacaggugcacaccaccacaccuggcucauuuuuguauuuuuaauagagauggcauuccaccauguuggccagguuggucucaaaacuccugaacucaagugguccgccugccucagccucccaaagugcugggguuacagacaugaaccacugcacccgaccuuuuuuuuuuuuuuuuugagacaguguuuuacucucuugcucaggcuggagugcaguggugugaucacagcucacagcagccuugaccuccugggcucaaucgauccucccaccucagccucccaaauagcugggacugcaggcaugugccaccaugucuggcuaauuuuuguauuuuauguagagauggaguuuugccauguugcccagguugguuuugaacucuugggcucaaagcgauccuuccaccucagccucccaaagugcugaaauuacaggugugagccaccaugaccagccuacugucuguuuuucuacuagcauugugaucaugaccacuuagaucauuucuaagaagauugaggcuuucuuuacagcuguuuucuucugagccugucuuagucuguuuuguguugcuauaacagacuauauaagacuggguauucuauaaagaagacacuuuauuuagcucacaguucuucgggcugguaaguuaaagagcauagcaucacaucuggcaguuucuggugagggccacacacuagguugaaacaugguggagaagaaaagugagcaggcgggugcagagaaaucacauggcaagagaggaaacgagagagccugggaagccaaacucauuuuuauaacaaccuguucucaugggaacuaagugcccugagagcaagaacucacucacccccauaggaaggcauuaauccauucaugaaggaucugccucugugacccaaacaucucccacuaggccccaccucucaauagcgcacacuggggaucaauuuuuuuuuuuuuuugagacggagucuugcucugucgcccaggcuggagugcagugguacgauuuuggcucacugcaagcuccaccuccuggguucaagcaguucuccugccucagccucccgaguagcugggacuacaggugcaugccaccacacccggcuaauuuuuuguauuuuaguagagaugggguuucaccuuguugcccaggcugguugaacuccugagcucaggcaaucugccuaccucggccucccaaagugcugggauuacaggcgugagccacugcgccuggcccaaauuuuuaacauaaguuuuaguggagacaaacuacauccaaaccaaagcagaacucucaccagagcuccccuuuacggucuguacauagcaauacagucuuuuucuagccuuuuccucuuccagccucugcccauuacccaguuccaaagccacuccugcauugguggguauuuaauacagcagcaacucacuucucaguaccaauuucugucuuaguuuguuaaggcuacuauaacaaaauaccuuagacuugguauuuuuuuuuuuuuuuugagacggaauuucgcucuuguugcccaggcuggagugcaaugacacgaucuuggcucaccgcaacuuccaccuccaccucccggguucaagcgauucuccugccucagccuccugaguagcugggauuacaggcgcgcaccaccacgacuggcuaauuuuuguauuuuuaguagagacagaguuucuccaugauggucaggcuggucgcgaaccccugacuucaggugauccguccaccucagccucccaaaguacuggaauuacaggcaugagccacugcacccggccagacuggguaauuuauaaacaacagaaauucauugcucacaguucuggagacugggaaguccuggaucaaggcaccagcagauuggugucugaugagggcucacucugcuccugagguggcaccuuguuacuguguccucagaugguggaaggagcaaggcagcucucuguaagggcacuaauccuguucaugaaggcagaggccuugagccuuaaucauuucccaaaggccccacuguuaauacuaucacauuggguauuaaguuccaacauagcauuuugagaggacaccaucuucagaccacagcacucucuuugucuaugcaaagaccaggaggaaauaggaagaaugaauguaguuggguuggggugguagaguuaugcaugaauuuguuuuuguguuuaagaaacuuccccaugccuuaauaacaucuucuuaauuaaaaaaaaaaaugccaccuucgaguuguuggggaagaacccuaacccccugcccucauagauucaguguuugguggcauauggacuaaacuggcaaaagacagaugaggaagaggaaaggcaguuuaaucacauacauacagaugugugugauuaaacucuuuugugagucacaaaaaugugacucgaagugguuacaauuuggggcuuauauagcaucuuaauaggggaacaggaggggcagaaaaggccccugugggaaaacagaugacuucuuuuuuuuuuuuuuugaaacgcucuuuugcccagccuggagugcaguggugcaaucauggcacacugcaaccucggccucccagguucaggcgauucuccuggguagcugggacuaccgguacaugccaccaugcccagguaauuuugguauuauuauuauuauuauuauuauuauuauuauuauuauuuuuuuuuuuuuuuuuuuuuuuuuuuuuuuuuuuaguagagacaggguuucgccauguuggccaggcuggccucgaacugacugcaagugauucgcccgccucggccucccaaugugcugggauuacaggcgcccggccaagaugacuccuuaauaggggaagaggaggagggaggggacugaugggaagugggcgcugaggagaaaagaugggagagaggcuaguuuuugacagcgucuguuuagguguggucuggacuucuucuggucuuaagcgauaagagucagucuucccugguguucccagggaggagauuuaucacaguugaguucuuuggaguuauuuugugaggcucugcuuuucagcauauaagggacuucaggaacucaaaugcuuucagcucaaaauaauuuuuaggucacagagguauauucuggacuguuagguuuuugccuugcccaggaguuugcucauuuauaaauagagggaaaaaaaaaccagagaaggaacuagugugguugggauagccaugcacgcagcugggauuccagcuauacuuuguagaucccaacugagguggaaagggaaggccaucugggcagggguuaaaucuccuaaggggugggggacugagcuugaguuugcaucuggcuccaucacuuaucagcuguguguucuugggccuguuguuuuucugaaaaagagcgacagcaagaggccauccucagaguggacccaugauaggccaagaugguggaaagcccaggacgagcccucaggacccagcacugccugccuuaugugagugagauaggacugcaguggugagacguucagugaugggccaugguguggccaggaagacacuagccugacuaccaggaggccccuggagggaagagauggacuaagauagcaguaucugcggggagccaaccaaggaggacuuugaauaccaguaaauacacucguguccuagaaggcagcccacaaaggcucucgauccgggccauuuaguguucagcaggccaggccugcaucuguguuugggauagggcugcaagugcagaggccagauccgggaggcugaugaaguugagcaggcacaugggaggagagcuugaucucuugggcuaugcuguccagucggguggccacuggcuacauguggcuccugcacacugggaacgggguggggagcagugggagugugaaggacacaccccuaaucugaaaacuuuaauguaaguaucucauuagugaaguuuuauugacucuguguuaaaaugguaauauuuugauauguugaaucaaaucaaacauguuauuaaaauuaauuuuaccuuuuuuugugcuuuuguaauguggcuacuagaaaaucugaaauugcauauguggcuuucauuucuguugugcguuauugcucuagggguugguaacaaugggaaugaaagugacagagcacauugagaaauguuaaaaagacgaugggagggaggccagguacuuuggcgcacuccuuuaaucccagcacuguggaaggcuaagguggaagguuugcuugagcccaggaguuugagaccagccugggcaacauagcacaaccccguuucuacaaaaaguuuaaaaauuagccaggcggcugggcgcaguggcucacaccuguaaucccagcacuuugggaggccgagguggguggaucaugaggucaggaguucaagaucaaacugaccaagauggcgaaacgcugucucuacuaaaaaauauaaaaauuagccagguguggugguucgugccuguaaucgcagcuacucaggaggcugaggcaggagaaucacuugaacccaggaggcagagguugcagugagcugagauugugccacugcacuccagccugggcaacacagugagacuaccucucaaaaaaaaaaaaauuagccaggcaugguggugugccuguaaucccagcuacuugagagugaggugaaaggaucacuugaacccaggaagucgaggcugcagugagccaugauggugccacugcacuccagccugugugacagagugagacccugucucuaaaaaagauagcaggagggaaugaacauuuuuaguguauuagucuccaguacagcccuuuuaauugagugaugauuuuccacuuuauagauaaacaggaucagaaagagaaagcgacuucccugcagucacauagugacaagcuggacaugucugacuaaaaccugugcuuuuuccacuguguucuugggucucuuggacuuaguaauggggauuuaaggaggaggaaggcagugagauagagccaggguucaggauuuggggcugggaggguguuaauaaagcguuuggcucaggaccucaaagccuuuugcuugugugugcauuucucacagccucacgugcccaggcuguuggugcugggggguaggccuggggcugccgcucccuuucagaauccuugccuggccucagaggggcuugugucuaggaaccucagcagaacccugcaagggcuggcugggaccauuggugagaugagccaugcccgggagcauggaagaauauauguuccucuucaguccuguaagcacaugggcugugaugaggaacgcguuggcagucuuuagaugaacgcugcuucuuuggaacuugcuggguguuagcuuuugguguggccuuugggaguggacucuggacugcagacacugaacuacagguuucccaucuggaaaugaguucauaggacuggaugaucucuauguucuuucuaauauuucuuuacucgugggaucuuuauguuucauucauaauuuuaauuauaauguuucuauguuuauguuuugacucaaguagugaucacuacaggccgucuuugggaaugcaguagaauuuuaguuucauagauccuaaauauuugauuguuuuuauacauuugaugauuggacacccuacauagaauacuuuuuuaagguacuagcaaauaauauaugaagggaaaagaaagcauucuuccuguagcaucucgaauauaaagauuuuguuauuuaguauuagauuuuaaaaauuauuuuguauccucugauuucuuauagaugaaaauaugccuacuaaaaaacaaugaaaauacuuuuucagaauauaagcacuauauauaauauuugaaaauauuauccauaaaaguuagaagaaaauaauaauuagugcuugaugccacuauucaaagacacaccacuuuaauuuggugagccucuuuuugguuuuucacccuuauuuucauaaagcugcgaugcaugcuucauacauaauugugcauguugcugccuccuucucccagcugcccgacgugucaucucaggucaccagaaacuuugacaggaaacagcaauuucuuuuuuuuuucuuugagacugggucucacuuugucacccaggcuggagugcagugacaaucacggcucacugcaaccuugaccucccaggcucaagcgauuuguccaccucagccucuuguaaacagcauuuuuauggcuaauaacccaucguaugaauguggcuuagacugcccaaccacagccuaauuugggguuuuuauguuuucuucuguucuuugcccuuauaauguggcaggaaauauauguggauaaaacacuuuucccauacuuuggcuuauuucauuucaagcuucuaaaagugagauuaaugagucagaagguaugaauauaaggcuuuuugucaaauugauuuccuagagggugauucauuauacuuuuucaccggcauugaggucaaguguccugggaguaggacuguugaaaauguaaaaagucacuucaguucuggaauuuaucuugcuuugcuuuguuuuguuacacuuuuuugcccucuccugaugcucaccuggggucacacauugccucugguugucauaugucuuucaucucuuucaaucuagagcagugguucucaauuagggaguggauauugucuccuagaggucauuuggaaaugucuggagauaguuuugauugucagaaucaaggggguggcuacuggcaucuagugaguagaggccaaacaugcugcuaaacuucucacaguacguaggguggucccuugcagcauaaacgugucuggcccaagaucucagcaguugaaaagucccaaucuagaacaguauuuuaacuuuuucuuuuugugacauugccuuaaaagaaaauugaagucaaagucacauaacauagaauuaaccauuuuaaaguauaaaauuuacuggcuuucaguauauucacaguuuugugcaguuaccauuucuuucuaguuucaaaacuucucauuaccccggaagaacacccugcacccauuaaguaguuucaccaugcccccaucccccagccccuggcaaccacuuaccucuuuucuguuucuguggauguuugccuaaucuggacacuucauauaaacggaaucauauaauaugugggcuuuuguaucuggcuucuuucuuugagcauguuuuugagguucauccaugugauagcacuugucaguacuucauugcuuuugguggcuggauaauauuucauugucagcauuugaaaggaauuuggguuguuuccacuuuuggcuaugcugcucuguauauucauguaugaguuuucuguguggauagaugauucauuucucauggucuauaccugguaucggaauugcugcgucacuugguguauguuuaacuuuuugaggaacugccagacucuuuuuucacagcagcugcaccauuuuauauuccuaccaguaauguacaaagauuucaguuucuccacauccucaucaacacuuauuuucuacuuuuuauuguagccagcccagugggcauaaaguggcaucucauugugauuuugauaaacauuucccuaauggcuaaugacuucauuuguauaucuucuuuggagaaauaucuguugaaauccuuugcccauuuuugaacuagguuugucuuuuuuuguugaauuauaaaaguucuuuauauauuuuggcauauggcgcauauauauauauauaauuuuuuuuuuuuuuuuuuuuuuugcgacagggccucacucucucacccaggcuggagugcaguggugcaaucguggcucacuggagccuugaccucccgggcccaagugauccucucaccucagcccccuaaguagcugugacuacugucaugcaccaccacgcccugcuaauuuuuguauuuuuuuauagagacaggguuucgccauguugcucaggcuggucucaaacuccugaacucaggcaggcaaucuguccaccucggccucccaaaguacugggauuacaggcaugagccaccaugcccagccuacuuuauauauuuuggauacuagacucuuaccagauacaugauaugcaaauauuuucugccauucuguagggguuuuuuuuacuuuuuuauuuuuaucuauuuauuuauuuuuauuuauuuauuuuuugagacagagucucgcucugucacccaggcuagagugcaguggcaugaucucggcucacugcaagcuccacaucucagguucacgccauucuccugccucagccucccaaguagcugggacuacaggcgcccacuagcacacuuggcuaauuuuuuuuuuuuuuuuuuuuuuuguauuuuuaguagagacaggguuucaccauguuagccaggaaggucccgaucuccugaccucgugauccgcccgccucagccucccaaagggcugggauuacaggcgugagccaccacgccuggcguggaauugcuuucucaauucccucuuuugauuguucagugcugcuguguagcagcugauuuuguguguugauuuuguacuuggcaacuuggcugaauucauauauuauuagcuuugguagguggauuuguggauucuuggguauuuucaauauguaggaacaugucaucugcuaauagagauaguuuuacuuuuccuuucugaucuggaugccuuucauuucguuuucuugucuaauuacccuugcuagaguauccaguaugauggugaauggcaguggugcagugggcauccuugucuuguugcugaucuuaggggaaagcuuuuggccuucggccauaaaguaucaaguuagcuguggguuuuuguaguugcccuuaaucagauugaggaaauucccuuguauuccuaguugguugaauguuuuuaucuugagauauuaacuucuuuaaaguuuuguuuuacuuuuuaauauaaaaauuuugguguguguguuuuauuccaaccagugcugauuccuaaagaaaagcccccaaucacgguugugggugauguuggaggaaggauugccaucaucgugguauguagaccucuuuuauuauuaauucuaguauuugccauuguuauucuguugauugauugauugauugauuuuauuacagagacucacugucgcccaggcuggagugcaguggcacaaucucggcucacugcaacuucugccucccagguucaaacgauucuccugccucagccucccaaguagcuggaauuacaggugccugcuaccacgccuggcuaauuuuuguauuuuuaguagagaugggguuucaccauguuggccaggcuggucucaagcuccugaacuuaagugauccaccugccucggccucccaaaguguugggauuacaggcgugagccacugcaccuggccaauuuauuuguuaauucugggcauauaaaggccuaaggauaguaguauggccagauaauucuuauuaaauuugugccuugugcuaaauguuugcuuuggcccagaaauuggaaaaugcuauuguuuauuuuaaaauugcucacuacuggcugggcgcguuggcucaugccuguaaucccagcacuuugggacgccaaggcaggccaaucgcuugggcucaggaguucaagaccagcuuggacaacauggugaaacccugucucuacaaaaaauacaaaaauuagcugaacuugguggcacauaccugcagucccagcuacuugagaggcugaggcgggaggaucacuugagccuggggcucagagguugcagugagccgagaucaugccacugcacuccagccugggugacagggugaggcugugucucaaaaaaaaaaaaaaaaaaagucauccugucauaacaugagauauuguucugugaucaaaguaaaguacaagcugggcacaguggcucaugccuauaaucccagcacuuugggaggccaaggcaggcagaucaccugaggucaggaguugaagaccagccuggccaacauggugaaaccccaucucuacugaaaauacaaaaauuagcuggacauguuggcgcacaccuguaaucccagcuacuugggaggcugaucuuggagaaucgcuugaaucugggaggcggagguugcagugagccaagauugugccacugcacucuagccugggcgaaagagugagauuccaucucaaaagaaaaaaaaaaaguaaacuacaaaguugauuauaacuguuugaaacaugcauccuuucacacaucauaagaccagugcacaaaaagagugcacuucaugccuguauauuuuaaagaauagaaugaacacuggguacccgcuagcucacuugaggcauagaucaucaccagguaccuagaggccuccucugggcuuacccuggucucuuugccucagagguugucacugaugugaaagcugcccaucuugauccuguagucagccaugagggcuuguggccuuaaaugcugccuuuuuuucuugucuuugauguuuauguaaaugaugucuuuguguacuuugggacuuucuugcucaacacuguuauugaaauuuaccuguguaguggcaggaaguuguacuucauucuuuuucacugcuauguguugugucuuugguauaacugcuacacaacugauugaggcaaugguacugcuuugaacauccucgugccuauuuucuggugcaaaagugugagaguuucaaggugccugggagugggguuguugggucugaagguaugcacauuuuuaacuuuacaaggugcugccaaauuguuuccaaaguggucacacccauuucccaaguuccauagugggugccccacauuauccccagugcuugauaauuuuguacgcacccuuuucagguuagaaaaucucucuggggccgggcacgguggcucacuucuguaaucccagcacuuugggaggccgagacggguguaggucaggagaucgagaccauccuggcuaacacggugaaaccuugucucuacuaaaaauacaaaaaauuagccgggcguaguggugggcuccuguagucccagcuacucgggaggcugaggcaggagauggcaugagaggcggagcuugcagugagccgagaucgugccacugcacuccagcccaggcgacugagcaagacucugucucaaaaaaaaaauaagaaaaucucucacgucacccuccaggguaauagcuguccauuacuuauuccuuaguuggcaaagucuauaguaacaaggugcuguggauucaguagcaccuuuccccccguucuagugccacugcauuauuuauuuauuuauuuauuuauuuauuuauuucuauuuuuuuuuuugagacaaagucucgcucugucacccaggcuggagugcaguggcgugaucucagcucacugcaaccuccaccuccuggguuccagcaauucuccugccucagccucccaaguagcugggacuacaggugcacgccaccacguccggcuaauuuuuguauuuuuuuuguagagacgggguuucaccauauucaccaggcugguuucgaacuccugaccucgugaucugcccgccuuggccucccaaagugcugggauuacaggcgcaagccacugcacccagccgccagugcauuuuuuaaaaaaacguuuuuauuuugaaguaauuauagauccacaggaaguagggggcaauacacagggacauccuguguauucauuacccagcauccuccaucuugcuuaacuauaguacaauaacacagacugaaaauucucggugccacagccacagagguccuucagacagcaccaguugugcauguagugagugugaguguguguguguguguguguguguguuuguguuugugaaugcagucuuaccauggguagcuuuguggaaccaccaccacagucaggacacagaauugcuccuucacugcaaggcacccucaugcuuccuuucauagcuacacugacauccuucccacccaaucugcaaccccuugugucuuuguccacuuugugcugcuguaacaccugagacuagguuguuuauaaagaauagaagaaauuuauucucuaacagcucuagaggcuguaaguccaaaucauggcaccagcauuuggucuggugagggccuucuugcuguguccucacauggcauaaggcagaaggacaaaaaggaaugaacuuuccuucagaaggccaggaaagagguuaacccacucccacaagccuuuuuauagcgacaugaauucauuccugaugguggaucccucacaaccuaaacacuuucccaaagaccccaccacccaacacuguugcacuggggaauaaguuuccaacacaugaauuuuggagggacaaaaacauucaagccacagcacuggcaaccacugaucuguccccugucuuucuaauuauuauuucaagaaugucauauaaauggaaucuaugguauauaaccuuuugaguuuuguuuaaccuaccaugauuccccugagauccauccagguuguuuuguauauuaauauguuauuccuuuuuauugcugggcaguaucccaugguauagagguaccagaguuuauuuguugaaggacauuuggaugauuuccagguuggggcuauuauacauaaaacucgcuauguacauucauguauagguuuuugugugaacagaguuuuaauuucucugggauaauugcacuuacaaaugcaguuguugguuugcaugguaguugcagauauacucuuauaagagacugucaaacuguuuuccaaaguggcuguaccauuuuacuaguaggacuuuuaaaguagcguguguguguguguauguauuuuuuuugagguauggucugggucugcugcccagguuggagugcaguggcuugaucacagaucacugcaacuucuaccuccuggcuaaagcaauccuccugccucagccucccaaguagcuaggacuacaggugcguaccuccaugcauggcuaauuuuugcuuuucuguuuuuguagagacuggguuucgucauguugcucaggcuggucuugaaccccugagcucaagcaauccucccaccucagccucccaaagugcugggacuacaggcaugagccaccacgccuggccuuuauauguauauuuuugaucauaguaacaucaguaugcaauuaaagaguaauaauauguauguaaaauaaagacacgaauauuuauucaacucuagacaacguuugaugccauaauggguuuaaaauaacucugggagccugggaaucuagucucuagauuggaaaccacugaacuggguauuuuauuauuaaaaacaauaaucauuauuauuuuuuccauuguaauaacauguaaaaaaacauauuucccauaugcucaguggagaaaauuuggaaauaaggaaaguagcaagaagaaguggggggaaagaggcacccauaauucuauuacccagagucaaaaacaucuuuuaacacuuuuucugugcauuaaaaacaaaaaaagaaaauuauaccuccaucauuucuggugugaccugcauugugacagcacaauguuggccaguuauggugcagaaaacagugcuaccccugggagccuggaguguggugggagauagcuccaauaguggcaggugcugugcaggaagaggcucgugugaaaguacuggagggcugccauggggcacggugauggggacauggggccaugccgucugcacaaggccaaguggaagagcagauuuuucacgguaaauguaggcagacccuuuuuuuuuccugguugucuaaccuauuauuguagaagugcucauauacauucuuuuccaucugugcuuuggcaggaugacaucauugaugauguugacagcuuucuugcugcagcagagacccugaaggaaagaggugcauauaagaucuuugugauggcaacucauggcuuguugucuucugacgccccccggcggauugaagagucugccauugaugagguaacagggucuggguguguguggguacagcugccugggcuuuuggcacaucuugaucuuuaguuacagagagucaggacaagacugagaucuuuuguggcugagaaacgauucaagggcugggugcagugguucacgccuguaaucccagcacuuugggaggccgaggcagguggauuaccugaggucaggaguuggagaccagccuggccaacagggugaaaccccgucucuacuaaaaauacaaaaauuagccgggcgugguggcacacaccuguaaucccagcuacuugggaggcugaggcaagagaaucacuggaacccagagggcaguggcugcagugagccgagauugugccacugcauuccagccugggugacagaaugagacucuugucucaaauaauaauaauaauaauaauaauaauaauaauguguacaacucauugguuuuuagaauguucagaguugugcagucauuaccauaguugguuuuagaacauuuucuucuuccuagaaaggaaccccauacccauuagcugucacuucacauuuucucucacugccauuagucccugggaaccacuaaucugcuuucugucucucuagauuugccuguucuggacauuucauauaaaugagauuauacaauguguggucuuuugugucuggcugucuucacucaacauaauauuuucaagguucauccauguuggagcaugaaucaauacuucauuuuaugaucaaauaaugcuguguuacauggauaguccacauuuugucucucucuucguauuucauguugauagaaaaaauuuuuuuucuacuuuuuaacuuaugaauggugcugcaguaaacauuuguguacaaguuuuuguguggacauguguuuucucuucucuuggauacguaccuagguuuagaacugccaggucauacaguaacuucauguuuaaacuuucaaggagcugccagacuguuuuucaaagcagcugcgccauuuuacauucccacagccgugaguugggggggggcuccaguuucucugcaucccuccaguacuuguuauuaucuuuuuugccauaccuauccuagugggugugagguuaucaaaucuuaaccuaagaaacacaggcugggcgcgguggcucacgccuguaaucccagcacuuugggaggccgaggccgguggaucaugaggucaggaggucgagaccauccuggcuaacgcggugaaaccccgucucuacuaaaaauacaaaaaaauuacuugagcgugguggcgggcgccugucgucccagcuuacuugggaggcugaagcaggagaauggcaugaacccaggaggcagagcuugcagugagcugagauggcaucacugcacuccaggcugagcgacagagcaagacuccgucuaaaaauaaauaaauaaauaaauaauugaaacauugacuugagacauagauccacuguguuuuccugucguggcaagccucagauuugagaagcugucacauuuccagaucaaaccaugaagcuacuuggcuuucugaugcugugguuuuuuuucuuuugcuucacaggugguggucaccaauacaauuccacaugaaguccagaagcuccagugccccaagauuaaaacuguggauaucagcaugauccuuucagaggcgauccgucggauccacaauggggaguccauguccuaccuuuucagaaacauaggcuuagaugacugaguuuuccuuuaggaaaacucccgagggccaaacuggaaacauaagagugacugcucggugggauggauuucacaggaaccgucaugcuuguuccucccucuccccuguaaccucacuucuuauugauuccuaagaagauagaccaacuuuuuaugucgguuuggguguuugugaguuuggggagcaauuuuuauaaaagaaaaacuuuauucuccucuuuugaaaagguaagaccucguuuuaguuguaacuguuuaaaaaauaacacuuggaauaagauuuguaagcucacaaagccuucuuccaaaguugcuugagccaagugcuuaaaaaguuaauaaaauaaaaugaucuguaugauaccugcaauugaaaagccgaaaagauuauacugucaaguccaguaaaugacauuuuuagagaugcuuuuguagacaagcauauggaauaugugauuguauuuauuuucugcaacuaaaaaaggaauaaaaacuuguguuuguguguuuuucuaaaacuuuguguuuuggcaaucguuuuauaacuaaaauaaaaugaaagcuaaaucuacacgcugugaauguugaa

SEQ ID NO: 192251 - RNA, 30030 nt, Homo sapiens
cgaacaagagguuuagagaaccacauggaaaaaaggcagggccaggcccggacaccccgccuccugccucccggcccggcggugcccggaugccccgcccgcgcccauggcgcagccacacacgaccucggucccguacuucgcgcgcucuccugcaccgccgccgccaucucgcucaggagcuccuccacaaccgccggcaacacuacggccaucgcgccgcaggacacgcccuccacgaccggcggaccgccgcgacgcuccagcugacugcgccuaccuguggaggauccugaccccccgccggggcagggcgagacggagugacgucggggcgcgucaucgcgcgugcggacgcagggauguccugcucagucgucagggcccggccaauccggagggcgcucggcgcguggucgggggccaggagcgcgucuggccugcagugcgcagaggacgcggcgggagcauguuccggcuccugagcuggagccugggccgaggcuuccugcgggccgcggggcggcggugccggggcugcuccgcgcgccugcucccggggcuggcaggagguccggggcccgaggugcaggugccgccaucccgagucgcgccgcacggccggggcccaggccugcugccgcugcuggcaggugaggggcgcgggccgggcggggccggccgggcggggacaggggcgcgggccgggcccgaugaccucagagccccuucccgcagcgcucgccugguucucgaggcccgcugcggcagaggaggaggagcagcagggagccgacggggccgcugccgaggacggggcggacgaggccgaggcagagaucauccagcugcugaagcgagccaaggugaggcggcuccgggcccugcgcccggccgagcgcgguagccuuugugagcggggucuuggcguugcugcgcauuacucucuccgccucgccgaagaguggauggaggcuccgcggguaaaauugccgagaaugaggugggucauccgagaggggauuggaauccauccaggcuuuuccgacucuaaggccugcaguaaaaccucugcagugucaagugcaaauggagauggcgcccuaggcaucacgcuuuaugcaaacgaaauaucgggaacguuuuguagugguuuuaucaauuaaccagccuaucugaaaugacauaauuucgcacguauauagcggccugaaaauggcaacuuaguguugguuaugcgguucgguucuccuccugaauucuuccuuuucuccacauccuuuucuauuuuuuuuuccuccucuuuucccaaguuaucucaucucuuccauugagcuaaauaccuacucgaugccaacaacguccaaauuuguauuuccauucuguagugugcuacugacaugccauuugcacuuuaggaccauaccuaccucucagauuuaacaugcccaaaacuaaacgaucuuuaaugccuccucaacauacgcuuucgccaucucuuuacuaccaucaguuuuucagccuaaaaaccucauagucauucuuaaaacuugugguaccuuaccauugccuuccaauacacuuacaguccagcaacaaguccuguugccaacaaaugcaaaauauuucucaaaucuuuccccuuuugucuaucucccuugcugucacccuagugcaaaccaucauugccaccaacuaugcuccaguagucuuuccuggccuccuggccucuugcaaucuauucuccaugcagaaaccaaagcgaccaaaaaaaaaaagaguaaauuggauuaugucaucuccuugucagaaagcucugaauggcuacccacugcauuuaugauaaaauacaaacuccuugccuuggcuugcaacaccccacaugaucuaaaccagcauauaccuugcccacccauuuggcaguaauccucuggcucaccauccucccuucacaucuauuucuuugcauuucuuccucaaaaccauucucuucagcuuguagggacuucacucauucucuacccucuguuugagucauuguucuccccagguccuuauuugguugacucauucucauccuuacuaccucaguuuagcugucacuuccuuggaaggcuucccuaaguccuauuuagaggagaccccuuaucauuccuuucugucaucuuuauagcucuuaucauuaguuguaauuaagcuuacuuguccuauauggucaccuccagccugcaagaaauuagaaagaggauggaggacaagcagcuuccuuauaaaauauguuguaagaucacauuccuucugccugugucucuuggccaaaacuucaucagauggccacaccuagcugcaagggaggcugaccucccugucaucucuguagacaaugcuuuguacauaguaggaauucaguaaaugucugaugaaugaguuagcuuccuucuaucaguugggauguacaguugcauacacuucugucucuuagcauaugcaucuacuauauguuucauuuucuauuauuuugucuucccuuuucaguugagcauuaugaaagaugagccagaagaggcugaguuaauuuugcaugacgcucuucgucucgccuaucagacugauaacaagaaggccaucacuuacacuuaugauuugguaacucuuauaaccagucugaaccacugaugaggaagguuggaugggagggaaggguaguuaguucuucugauuuauauuccugacuuucacgauguucuaaaacuccuuuucuuuuuacugaguuuucuuuuggcuucaguuucauuuuuuguuuuguuuuguuuuuuugagauggagccucacucuguugcccaggcugcagugcaguggcacaaucuuggcucacugcagccuccgccucaugaguucagacgauucuuuugccucacccucccgaguagcuggauuacaggcaugcaucacuaugccuggcuaaauuuuguauuguaguagagacgagguuucaccauauuggccaggcuggucucgaacuccugaucucaggugauccaccugccuuggccucccaaagugcugagauuucaggcaugagccaccacgcccggccacagcuucaguuuuuuuacccuuggggugacauaagaccucucaauuccagaccaaaaaaaaccaguaucauuagcauguuuuuuuaaugaugaguggaccuagauuugguuuguuaacaacaaaguaugugcaaguauuuaauucucacaugauugcuguccugugcuucuucuugcagauuaauuggugaugugcuuuucauuuucaacuauuuuuuaaauuuugagggugaaagcaaaagggaauuuuaaaguuuugaaauaaguaggaacacaguauucuaaacugaaaaacaauuuguaauuugcuuucagauggccaacuuagcauuuauacggggucagcuugaaaauguaaguaaauugcuuuguaauaucuugaauuuaugaaggaguagcuucaagggaacuguaauaguaagaguacaggcuaagcugcuauaacaaagagacccuagaauauagugacucaaacaagauaaaaguguauuucucuuuauuguguuaguccagagauaggcuaaagacugaaggcagacagacauaggcaccuuugcucucugauccagaaguccagguuucuucuaagauaagcccuccucugccuaggugagcugacucaccuccagucugcaggaagggggagaagauggacugugagcagcuuccuuauaaaacaugauuagaaguucacguucuuucugccugcaucccuuggccuaaauuuuaucauaugaccauaucuaacuuaaggguguccaaucugcuaaaauugacugaauuuuuuuuuuaagauaaggucuugcucuguugcccagguuggagugcgguggcuuaaucauggcugacugcaaccucgaccugccaggcucaguugauccucucaccucagccuccugaguagcugggauuccaggcgugugccacaacacuuggcuaauuuucuuauuuauuuauuuauuuauuuauuuauuuauuguagagacgggauuucaccauauuucccaggcuaaaucgaggggacucuguaaucaaaaagauggagaagagaaugacuauuaggagacaguuuguagucucugccacaguggguuuggauaagaacuuaaucucugagguuguuuucuacucaucagagaguaguuuaagguacacagaggauguugaggguccugauauuuugaucuguuuucgcuucaaaaggguacuuuucugugugugagugugcguguguguggguauauggguuuuacaaggaauguugcaucagacuggcacuuagaauccagggucauauauauauauauaaaauggggcccaauuaaaagaaaaaucuuuuccuuaugcuuuuaggcugaacaacuuuuuaaagcaacaaugaguuaccuccuuggagggggcaugaagcagguaaggacauugccuaguauuggccccucacugaagcaguuuucaaaacagucuugucuccugaaaacuccuccuagccccaccacaugcuuuggucaggaaagguggaguuucccuucugagaucucuauacaaauugccauucuuucacuaaaugcaacagcaugcuugccaaggaauucacaguuggcucaucacucuaaaagaauaaagacuguggcuuugaggccaccgucagucuggaaguugaucugaaauaugccaugaaaaaauuuacuuguuaugaguucccuucauucucuuucucucacaggaggacaaugcaauaauugaaauuucccuaaagcuggccaguaucuaugcugcgcagaacagguaaguacagcagccagggaguaggacugugggcaggaaacuuugacucugggauguuacauaauauucauugucuacuggucaucugggucucccagaaauugggugucacacucaaaguguuccaucccucaucuuugaaauugucagucuuuuuccaguuugccccuacuguuuccaucagccugccuaguggggcacacaacaucucuggcugcccugugacaaaacuaacuaaguuuucuguugcugcuugaagugggaagggaaguuagaguuagaacuuuaguuuaacuuuuccuagaagaggaaagagcagugugaaagcugcuggggauaauauauuaauacucugaagaagccauuuugcugguauaaauagaguucaaagaugaagcaucuagguuguaagcagagaacuccucuagagaguuguauuugggaugaauuuagggagagaccuaagacuagcuucccuucagguuuuaguggugcagaaguuggugcgagagguuuggagugacauggagccugaugcuguagaaagggugcucacugaggccaggcccuggcacuguucccuacuguccuacucaccagcuccuuuguucucaucaggaccugcauagucuccuugcauuuugauuggacacuagauaggcuagagcuuccuggagccuuugacuucaagucuuuugaggagcuuugagcuuggcccaugccagggaacacugcagcuuggucaaucuuucuuggaguuguaacaaacaugccuaguucuugauuggguaugaaucccuaggguaagaagaagcccagagccuaauaaacauuguugaguaagacaaauucauagucuucuagaggugaaagcuaguaacaauuagccucugaguuacaugguacucuguacuuuucauuuuguuuuauuaagagaagcaugagacuagaaaagacauggccagaucugaggcuucgaaaggcugauauagguuaugaggggaauuguuuguagaccucuugcuccgacugggagcgucuucugggcaguguccacuugcccuguguuauggcuagagagggcccucuugccaaguuuugagcguagggaaggaaggggaugcuucuguucuucugagaacagagcagaacaguagggucauaaguucuccccuggcaaagcacuagagaacaggugagcuuuuuagugccacuucuguaagaaacuagagccaaaacugaagaaaagaaccaaagcugagcuccuaaauggagaagggauuucugucacauuuccucugcaucucuguaaaaagcagcagucagucggccugcuuggguugacucaacccucuccaguugauugaggguccagggcuacagaguuggguuaaaugacuucuauugccauagcuaggagucccauuucugcaaaagaaacuuuuaucagagacuuauagcuugaaagaaauauaaaaugacuaaagcuccucagaagcuguaugaggucaacaguuggaauccucacuguagggcggccugaacuguuuaggguaguauuacuuugaacagggguaaggcuuucacacauggagaaguugauucacuggaggccaucuguuagugggagaugaugaauacugcuggcuaugucaguuauuaaaauuagggcagcauuccuagcuuuuuguguccuaaguuauauuaaauggaugacuuaaaaaaacugcuuugagaaauggcagauuugacacuacuuagacuuuaagcaaaguucccucuucccauuuuacacuuccuuuacugauaauguuuaaacugagcuggaaaaaugaagauaaaaagaauuugugaaaagguaaaugggccgggcgcaguggcucacgccuguaaucccaccacuuugggaggccgagguggguggaucacuuaaggucaggaguuccagaccagccuggccaacauggugaaacucugucuuuaccaaaaauacaaaaauuagcugggcauaguggcgggcaccuguaaucccagcuauucgagaggcuaaggcaggagaaucgcuugaaccccggagguggagguugcucugagccgaggucacgccauugcacuccagccugggcaacaagagcgaaacuccaucucaacagaaggaagaaaaaaaaaagaagaaaagguaaauggcugauuauugauuuugcuuuacagacaggaauuugcuguugcuggcuaugaauucugcauuucaacucuagaggaaaaaauugaaagagaaaaggaauuagcagaagacauuaugucagguaggaaacccauuaucugggcauugccuuuucuccacaaaaggcuuuacuuuacacuuuugagaaauggaaagagaucuaaauugggaagagggaaaguuaccuauuuugcaaaauaagugucugucuuuaagguaucagcagaaguuuuggaauaagauguuuuauuuaaaauauuugacugcuguuuugguggugguuuuuuuuuuaacccccuugguaacauggucauaauuuauuuguuaacuuuuaguuacauauaacuuaaggaaaauuggggagcagaaggagaagguguuucucguaucucuuaguucagcuaccaaucaaaaugcuuauuacguuuuagcccuagauauacagcaaauuaagaaagaagagaaaaaaagcucauguuuuuacaauccauccucacucauucuggaggcuaggaauagaacuggaugagcaggaagcucucuagcucuccaccauuuuggguuucuuaauuuggguugaaguauugagaauuuucagauuugacauuuauucaauaccuacucuauaccaagagcuaccgagaugguagggauacagcagucaacucuucuguaccuaguggucuucuaacucucucuugaacauagaguagucccccguuauccauggggaauauguuccaagacccccagcagaugccugaaacgacuucuaauacacuguguuuuuuucuuauauauauguaccuaugauaaaguuuaauuuauaaguuaggcacaguaagagauuaacaacaauaacuuuuaauagaacaauuauaacuauauacuguuaacagugucacagacaggagauucauucuuauuguagaucuuaucaaccucagcauacaguuuuuuguuuuuuguuuuuuguuuucuuacuaaguugagaacuuucaccuuuucauuaaaaggaagcacuuuaugacuucucuuugucauauucaaauugccaguaucaccacucucacacuuuggggccauuauguaaaauauggauugcuugagcacaaguacugcaacauuguggguugaucugauaacugagacugcugcuaagugacugaggccagcugccguauacaacuuggguacacuggacaaagaugauucauguccugggcaggauggagugugacaguguaagauuucuucaugccacccagaauggcaugcaauuuaaaaacuuacggauuauuucuugaauuuuucauuuaauauuuuucggacucugguugacugcagauaacugaaaccccagaaaaugaaacuguggaguaggagggaucacuguacaccaauuuuuuuguuuucaucacuccacugaagcuaccuuuaucaaagucaccaaauccaaugguuacuucucaauccuuaacuuacucaucagcagcuuuaacuuaggggaucacugucuccuacugaaaauacuuucacuuggcuucugggaugccucacuggucucucuagugaggugaauagacuucccuaccucuuaauguuggcacgccuuagggcuguuuucagcccuauucucuuuucucucugccccaacaccuaggagauaucuuuuaguuccauaguuuuaaauauuagauuuauaccuucagccccaacuugcccccaaauggcagacuuauaauuaugauugcccacccgacaucuugacuugaagucuaauggucaucucauacuuaacauguccaaaauaggucucaguuuugccgcucacaacuuguuucgucaccagucagccccagauuuguaaauggcacacuacucauuuaguugcuuuggccaagaaccuaagaauuguccaugauuucuuccucauuccucauaucuaauccaucagcaaguuauacuggaucagccaucaaaauauauccauacugaccaugucucaucccauuacccuacugcuuugguccaggccaucacuguuucaagaccucaguaccuuuguaucaccuuuagaauaaauuuagaaucccugcauggaccuguaaggcgcuuaugaccugggcccacccaccucuuccaugccaucugcugcucuccccuugcucguuccagucucaccacacuggucuuauucuggcacauuccaagcuuagugccaccucaaggccucuuugcuugauauucccccuaccuagacuguucucucuuaccuuucucuggccaacucccguacuucacucaggucucugcucaaauagcacuuccucagagugcucccuucacuaaaacuaucaucucuucccaccuuacuauugcucuacuccucuuuccuuuacuuuucuucaucacacuuaaaaguagagguguguguguugugugcuuguguuucuccacuaaaaguauguuuuuguuuaaaaauuuuuagucuuugucuuccauaucaaagaaggauagagacuucauccauuauacucagugcuaaauccucggugccuagaacagugccuggcacauaauagaggcucaauaauuacugaaugaaagaacaaaagacccaagaaagaccagcaaauaaauccaguuucagugcaguguggaagugcuuugaggaaauccacaagagguguaaaaacaagucuagcugucaaguaagucacuucugaacuauuuacaccuuugcugucuuucauuuauaguguugacuaugguuucuuaggaguguaaagcuauauuuucugauucaaaaaauaauaccaguaaacacugaagaaaguuuagaaaagcacuaaguaaaaaucaucuguaaucauacuauuaagaaagagcuacuguuuuauuuauuacuacggcuuuucggguuacauuuuaagaaauaaauuugggaugauacuguauauccuacuuuguaaccugaguuuuaacaauuuaguaacauauuaugaaaacacuuuuuuuuuccaggcaaaggaauucuuguuagauagagcaagcuaauuucuauuauaaauauuauuuuuacauuuuacuaguugcacaguauagaaaauguguuacaugauucuucaucuuauuuuuucuagaaaaggaauuccuaccuauucaguuuugcacaaagcaaauccauuaucaaauuuacgugcuuuuuauugacacaacuaucucuauucuaggauaacauuacuuaauuacauaaaauuacauuacuuaauuacauaaaaccuugcucuaggauaauuauuuuguuaccuauguuguagacauauauguacuuacugaggaaaugcccauaaaaaauuaagugaaaacuuugguuacaaaacaguauaguuaguauguagacuaaaaauaggaauggaacaaaggcugaaugauagauaucaaaauacaggcagugauucucuuugguugguagguuuauagggaauuuauauuuuauuuguguuucucugaguauucuauaauuuuguacaaauuuauauuuuucuuuuuaauuuccaauguuaucuguuaguauaaaaagucaaauaauauuaauaguacaaagcuuaauuuaagagagcauuuucuuggcuaucucacccaccccaucuauuuuuuuuauuuuuuaauuuuuaauuuuuuuuuuuuuuuuuuuuuuuugagacagagucucacucuugucaccaggcuggagugcaguggugcaaucucggcucacugcaaccuccgccucccggguuuaagcgguucuccugccucagccucccgaguagccgggacuacaggcacgugccaccaugcccagcuaauuuuuguguuuuuaguagagacaggguuucaccauguuagccaggauggucucaaucucuugaccucauaaucugccugccucagccucccaaagugcugggauuacaggugugagccaccgcacuuggcccuauuuucaacuuuuguuuuugagacagagucccgcucugucgcccaggcuggagugcaguggcgugaucucggcucacugcaaccucugccuccccgguucaagcgauucuccugccucagccucccgaguagcugggacuacaggcacccgccaccacaccuggcuauuuuuguauuuuuaguagagacuggguuuuaccauguuagccaggauggucucgaucuccugaccucaugauccgccugccuuugccucccaaagugcugggauuacaggcaugagccacugugcccggccccuauuuucaacucuuaaccaguuuccucugguauuuaccuucacauuucucaauaauauaaaauugcuauuuccuaguucauuauuuucagaauauguugauuuauggaaaagugaagauuuagugcaguuucugguugugucuacauuaugaguguaugaauaguguuagcugcugagccaaguaacaugauuacacaguuacauuuccuuuuguguacguuuugcuuccucugaaguuaacuagguuuuuuuguggcuccguuuguuauguauaugccagauucuucacuuuuacauauuacuugcuuucuucaauucauaagcuuucccaguauucuagaguucauguuggcucacuuuucauuggcauggcuggccauaggcauucagucuucaucuucuuuuuuuuguuuuuguuuuuguugagacggagucucacucugucacccaggcuggagugcaguggcucaauuuuggcucacagcaagcuccaccuccuggguucaagcaauucucaugccucugcuuccugaguagcugggauuacaggcgugagcuaccacacccggcuaauuuuguauuuuuaguagagacgggauuucaccauguuggccggccuggucuccugacuuaggugauccacccgccccagccuccccaaguguugggauuacaggcgugagccaccgcgcccggccgcguuauaucuuuuucauccuguaaguuucauuuuagugguauuuggggaaggaguggagaggaaugccuguguucaguucagaauaguaaaucuguuauugggcaucaagauaguguccaaaccuguuuuuuuaaaguggauucuuagcacugagauuuccaagucaagaguagcacauuuuaagguuguugaugacuauugccaaauugccauugaaaggacuguguuaauuuacauuuccugguuuggcuauuuauguacuuugugacuuuggccaaauuacauaaucccugugugcuuuuucuucagugugggauuaagaguaacacucauaggaccuuuaggaagguggaaugaguuaauacauaaaacguacuuagaauaauacauuguagcugcucaaaaaggguuuguuagugguuuuuauuauugugauaagccuauguccuccuccccaaaacucauuaacuuuuauaaucuuuguuagcuugaugauauggccuugaugcauuaucuagcauuucuuugauaaacagugagguuuaucuuuuuuuuuuucucaccaugucuuagggugcuaagagguuuauuuuuuauuggagcuuuauuguaaaaauauuaauccuuugucucuuggguuuuccuccugauuuguguuuauagagugggguuuuuuuuucuaauaaaaagggaaugugaaauuaacauuuguauaaagaauuuaugagaauuggcgagggacaguggcucacgccuguaaucccagcacuuugggaggccaaggcggguggaucacuugaggucagucguuaaagaccagcccuggaaacguggcaaaaccccauguuuacaaaaauuaucugggcaugguguugcgcacuuguagucccagcuacucgggaggcugaggugagaaucucuugagccugggagguggagguugcagugagcugagaucgcaccaccugugguccagccugggugacagagcaagacccugucuuggggcugggggguggaagaggauugugagaauagacaagugauccagcauugccaguaccuuuggagcucuuccuaccugggauacuauucuccuuaaucuugucacuaucauucaauggcaugaucucggcucacugcaaccuccgccuccuggguucaagugauucuccugucucagccucccgaguagcugggauuacaggcauaugccaccacgccuggcuaauuuuguauuuuuaguagagacgggguuucuccauguuggucaggcuggucucgaacugccgaccucaggugaucugcccgccucaaccucccaaagugcugggauuacaggcaugagccaccacgcuaggccuauuugcuuuucuuucauuuuacucugugucccuuaagaagaugucauuuaguuuuugcauauugcuuuuaaaaauuuaaauaggcuggguggagugacucaagccuguaaccccaacacuuugggaggccaaggugggaggaucgcuugagccuaggaguuuugagaccagacugggcaacauggugagauccugucucuucaaaaaauaaaaaaauuaccugggcacgguggcacaugccuguggucccagcuacuuaggagacugaggcaggaggauaacuugagcccaagaggucgaggcugcagugagcuaucauagugccacuguccuucagcacaggcaauagagacccugucucaaaaaaaauuaaaauuauacaaaugaaucauaauauguauucauuuuagggcauuuuuaugacuugcaugaguaaucuuuucagaauuagaucagaauucauuucuaauuuccuuugcuuuuauucaucuuuaauaaauacugaguagcuguucugugccagguauucuaggauuugaauagcagcaaguaaggcaaaaguccuugcucuucuggagcuuaaugcuuagagagauauuuuucaagcuuugaaauuguaugcauucucacucaucuuuccuuauaauuuucuauuuuuuuccuuuuauuucuaaacaguuuuaacuuuuuaguauaucugguauuuuggugugaagcuggugacuguuuucuugcagauaguaaucaaucuauauguacuaauuaguacauacuuggguuucuuuugggguuuuccauucugauguauuuaccugaugaguuuuauaacaguauacauucuuugaauuauauauuugaguuauaugguaggacaguugacacaugcuuccuuuguaaaauuccuucccacauuucacuguuuucacaugaauuuuagaauuauuuugucaaguucguaaagugccuucagacugaauuaucagauaugcauuauauuuauaaauuaguuuggggagauugccaucugaauaaguuagcauaucuuugacugcaaagagcagaaauuucagcuaaauuagguuuaacaguaaggacauuuaugucaaguaacuggcaguucagcaauagggagcaggcuguugaguuaguugacagugugauucacugaaaucauaaaggaacaggcucuuuccauccuuccucacucauguauuggcuuuuuccccaugcuccccuggugguugaaacgugaaacuauaacaauucccaggaaucucauccagaaaugacaguguccagaggaaaaggagacuucuuugauguuucucauaggaucaagguaaucuuuccuagaagucuccaaguagauuuguccuuacuucucauugguuagaauuggguuacaugccauuucuaacccaguccuuggcaagaaaaauggauuaucaugauuggcuaaaauacaucagucuccuuuccugaggaugugagucaugugagaaaagaacggauacugggacaaagcagcugcucugcuagcaaaggaagaucuuuguaauagugagccgucucacugaggaacauucuauagcuccugcuuauaguuuucuucauauagaugacagcuauuuauuaaauuugauucuaacugacuccuugacugaacucuuugcuuuucaguugauauucacacuaauuccagauuuauaaucauacauuccggaaaucaugauacagguugagcaucccccagaaccgaagcuuucugagugccaacaugaugcauaaagaaaguacgcauuggagcauuuggauuuggguuuuugguuuugggaugcuggcaguauccaaaggaaauauuccaaacucaaaaaaucugaaaucugaaacacuuuugguccuaaacauuucagauaaggaauacuuaaccuguaauuguuuccuuccagagaguuauacuacugucucccuuccccacccuuuauaaaauuaguucauuggcuguaccuucagaacaucaagcaauaguaguaauaggaaacuuagucuuauauccaauuugguaccaagauauaugaauagauuuauuacuauuauauaucuagagcggaccaggcuugcuuguagguuaauugcuuaguaccuguguagugcuggauaauauuuaaugcugauauguaacuugcguuucuuaugagauccacaguaaauuucuuauuguauuguuuguacuauuauguuuguauuauuuguuaucgcaggauuguuauuaaugugauaaaaugaauugggaugcuuucuguauuuucuauucugaaauaagugugggauauugcauuggaauggucuguuccuugaaaguugcagagucugugaugccagauggaccagaacuccugaguuaauucuccggcagcuuuuuuuuuccuucuugauuacucauguauuucuuccauuuucuuaauuucaauauaggacagugcuaaaaacauaaacauuaauaaauaucuauugaauaaaugaacguaugggugaacaaauuuuauaacuauuaauuuccuagaagaaacuuuaaggaauuauauuuuuaaagcauauuuuacacuacucuuacguaucugagauccucuuccuuuucuagauccuaauuuuauggauuuccuuuuaaauuaguaaaaagauguuucccauugauuccuuccuccuccuuuccuugaaaguuuuuauuuucauauauuaaauaaaacauuucuagaaaguuauuuuugaugacauaauauuugguuccaugagugcuuaaagucuggagccugaguucagauucugguucugccacuuacuagcaguggacaaguuauuuaacuucucuguucucagcuuccuuaucaauaaaaugaaaauaauaauagaacuuaccucauagaguuacaagaauuaaauacuccaggacuaugaccaguacucauuaggcacuauuauauaagaguuuguggaaugugauauauuuacuaaucuuauuuauuauaugauuuggcaccuauauuuuacuauuaucaauuuaugaaggaccuuccuggccauuuuauuuauaguuucuccuugguuuuuguuaauuuuguuuauucauucaaagagccaacuucugguuucauuaauuuucuuuauugucuuucuauuuuccauuucacuuauuucuacuuugucuuuauuaccucucuccuguuugcuuuggguuuauuuuguucccuuuuuucuggucccuuaggugggagaugagguuauugauuuaagguuuuucuucuaacauaauugccauuuauaacuauaagcuuuagcugcaucucauuaauuuugguaaguuauauuuucauguaucucaaguauuuuccaauuuugggggggauuucuucuuugacccuuuggauauuuaggaguauauugauuaauuuccacauacagugaauuucucaaauuuucuucuguugaauccaguuucauuccauuguguucagagaacaacugugcuugauuuuauuuauugagauuuguuguauggccucacauauggcuuauccuggagaauguuguaugugcauuugagaaguauguguauucuguugaauggaguuuucuaugaaugucuguuaggucuaguugguuuauaguguuauucaagucuucuggguccuuacuaauuuugucuaguuguucuaauuuuuuuuuuuuuuuuuuuuuuugggauggagucuugcuuugucgcccaggcuggagugcaguggcgugaucucggcucacugcaaccuccaccucccggguucaagugauucuugcacuucagccucccgaguagcugggaguacaggugugcaccacugcaucuggcuaauuuuuguauuuuuaguugagaucggguuucaccauguuguccaggcuggucucgaacuccugaccucaggugauccgccugccucagccucccagagugcugggauuacaggcaugagcuacugugcccagccaguuuuugguauuuuuaguagagacgagguuucaccauguuggccaagcuguucuugaacuccugaccucaggugauccaccugccugagccucccaaagugcugggauuacaggcaugagccaccaugcccggccgauaaauuuuuuaaaaucuucuuucuuuauacauguuucugugcucuguuuagacagucucauagauauauuuauuuguuacgaauugucccuucaucaggaaaaugauuccuuuuucccuauuuaagguauuuguuacgaauucuaguuuuauauuaucuacuauaucuuacccuuaacuuuucugagucauuuucaguguaucuuuuauagaaggcuaugguuggaauuuuuuuaaaaccugaguaucauugucuucugauacagaaucugaaaaccuuuuaaaaauuagugaggcgaaaaaaauuagccaggcauggugacgggugccuauagucccagcuacucgggaggcugaggcaggagaauggcacgaacccagaagccagagcuugcagugagccgagaucgcgccacugcacuccagccugggcgacagagugagacuccggcucaaaaaaaaaaaaaaaaaaaaaaguauucaggcugggugcaguggcucacgccuguaaucccagcacuuugggaggcugaggcagguggaucgccugaggucaggaguucaagaccagccuggccaacauagugaaaccccgucucuacuaaaaauacaaaaaaugagcuaggugugguggcgggugccuguaaccucagcuacucgggaggcugaagcaggagaaucgcaugaaccugggaggcggagguugcagugagccgagaucacgccauugcacuccagccugguuaagaagagcgaaacuccaucucaaacaacaaaacaaaacaaauuaguauugaaagggauaauuggucuaauuauugcauuuuaaaaagugcuuuccauuuuuguuaauuccuuuguuuucaguuccucuuacaggaacuuuucccucucugaucuguauuuguauuuuguagggaagguauauguauauaugauuuucaguuguauaaggaguaaccuaaacauuucuuaaagacaguugacucagaggaaaaaaaauuuuuuucaguuucuucucuaaaaugagaugaguacauuuuaacauuauccuucuuucccuuuuccucacuuguuuuuucucugugaucuggaauuuuagacuuaguggaauuuauugcagaggagaauucuaaagccugcauauuugccuuguuuuuuaaauagucuauuuucuccugcucagaugcuuugcuggacucagaaguuaaaugagcauaagguuagggaguugucuguuuaugaagcuugcuuagucccuggugaaccuucauuuuuagcauccaguucucuggagcuucuguagucuauucuggcucaaugcuucugucccacaugcucuggccucuuacccuggaaugucauuuaccuguauguugaccucucuucucuauccuucacauuauccccucuuccaucaguuuucucauguauauuuugggaguuucuucaguugauauuccacauuaccaauuuauuauuaagaaaagucaguucugugcuuuucuuuugauuuguuuuuuguuuuuugagauagggucucacugugucgcccaggcuggagugcaguggugcagucauggcucacugcagccucaaccucccaggcucaacugauccuccuaccucagccucccaaguagcugagacugcaugcucaugucaccaugccuggcuaauuuccggauuuuuucauagaggcggaguuucaccaucuugcccaggcuggucuugaacuucugagcuaaagcaaucuaccugccuugaccucccaaaaugcuggcauuacaggcaugaggcaucacgccuggcuucccucugauguaauuuuuuaaaauuagauuucaaacaaaaguaaaguuuugaggacuuaccaaauaucuguguacuuucagccuuggccagauuucaauauuuuaccauauuugcuuuagaauuuuuuuuggauauuuaaaucccuguauacccuucccucccugccuagggguagcuacuauccugaguuugguuuuguuugccuacuuauugcacuuguauauaucaauaaacaauauauugcuggguacaguggcucacaccuguaaucccagcacuuugagaagccgggacagguggaucaccugagguuaggaguucaagaccagccuggccaacauggcgaaaccuugucucuacuaaaaauacaaaaauuagcccaacaugguggcgggcgccuguaauccccacuacucgggaggcugaggcaggagaaucgcuucaaccugagaggcagagauugcagugagccgagaucgugccacugcacuccagccugggugacagagugaagacuccgucuccaaaacaaaaaaacaauauacaauagggcuaauauguuuuuaaacuuaauaugaaugguaucauacuguacaauugguuuuguaguuugcuuuugucacucaauauuauguugaugagauuuauugggcugcuauuuaaagcaguuuucuuagcacagaggcccuguuugcuugccaaacugcaugucugcuggguugcgucugucuuuaaagggugacuuccucuaauuaauccacuggggugagggguaaguugaaccuguuuuuucuguucacaaguguggauacaagcuaaagguggcccugugugguucccucacuacaaccaugguauaguaguccauuguagaaauauaccacaguucuauugauggaccuguuggguuauucuauauguuuugcuguuaaaagucauacuucacugaacauucuuggacuugcaucuuugugcacaccuggaauauuacauaaaaguggaguugccagggugcauauaccaaauugcuuaacaggcuggguguaguggcucacaccuguaaucccagcauuuugggaggcugaggcaggcagaucauuugaggucaggaguuggagaccagccuggccaauauggugaaaccccaucucuacuuaaaaaaaaaaaaaaaaaagccaggcaugcugguggguaccuguaaucccaacuacuugggaggcugaggcaugcgaaucgcuuaaacccaggaaggcagagguuguaaugagcugagaucaagccacugcaagacuuugucucaaaaacaacaacaaaaaccaaauugcugaucaaagugguuuuaccaguuuacauuuugacuagcaguauauuaguguucaugauguucucuguauaucuuuguuaucagauuuuuuugauaaucugcuggguuugaaaaggaauuucauuguggcuucacuauguguuucugauuacuguauuuaucgguuauucagauuaccugcucugaaaauuauuucuucauaucuuuugcuuauauuuuugagggguugucuuuuucuuaacgauucguaagaguuccuuacguauucgaucauuuuguauuuuuguggguuacguaucucuuuguagcuugucuuuucacauuagggcauuugauguagauuaaaaauuuguauauuaacagaaucuugauauuuaucuucauaguuugugcuucuuaugucuugauuuguaaugacaucucuauauuggguuuucauagauucauggggugcuaauguuuaaaucuguaauuauaacuauuuuuaguuucauuauaauuuuucccuauuuaauucaguacuuuauuucccccacuaccccccaccccccaagagacaaggucuuccuuuguuggccaggcugaagugagugcagugacacgaucacagcucacugcaaccuuaaacuccugauaucaagugauccucccaccucagccuccagaagaauuaggaguacaggcacgugccaccaugucuggcuuauauauauuuuugggggguggugggggagaguagagaugagguuucgcuauguuguccaggcuggucucgaccucuugggcugaagugguccuccugccucagccucccaaaguacaggauugcaggugugagccaccacgccuagcccuuuuauaauuccuucuauuuguucauucauucaacaauucagucagaaauacugagugcccauuacacacuagauaugcugcuaggugcugagauacagauauaaauaaaagaaaguuggcugggcgcaguggcucacgccuguaaucccagcacuuugggaggccaaggcgggcggaucaugaggucaggaguucaagaccagccuggcaaauauugugaaaccccgucucuaauaaaaauacaaaaaaaauuuagcugggcgugguggcgcaccuguagucccagcuacucgggaggcugaggcagaagaaucacuugaacucaggaggcggagguugcagugagcugagauuuugcaacugcacugcagccugggcgacagagugagacuucgucucaaaaaagaaaaaacaaaaaaacaaagucaccgccucauggagcuacauuucuggugggggaaagacgcauaguaagcacuacccaguaaguugguguguccaaagugcuauguagauauuuaugaaggaauauguauaccaggaauauguuggggcaguauggugucuuauagaggggguagggaaggccuuguuaguaugaaaccuggugaaugggagagaauaggccaaguggcuauuugugagggaaaaaaauuacagacaaagggcaauuacagguacaagacucugaggugguguaugcugcuugacuuacuggaaguaaggaguuagaauuacuggaguugucugauuuucuaaaauuuugggggaugaggccugcuuuuuuacugucugcugauucucauuuaugaugaauugucauguuuacuaaucuuggauuauacauucaucuucagcaagguuuuagcuauaagugagauuccagaauaguuuugugucuuccaggcacucagcuccuggccgaaguggaugcuacaaauuuagacaucaaauuuacaggguagucauuuuucuccucuuuagauuccagacuuggccauucaaggcuccuuguugucucccugugccuguggucgggggguuaaggggaguguaggcuggaguggugcaauuuuuuucacauacaugcuuuuccugggguugugguccuaaugguaaucauccugguuuaugcauuggcuucagaucucauuuuguuuaguacacaucaacagcuuuaauuccuggauuacagagacaacucaagcuacaacaaaaaccgggcuucugcugugucaacucacagacucuccacuuuggguuuuagcuuacuccuaauuuguggcucuugggagcucagcugugcagggaaaggauguguguuauaguuuaucuaagguuuccagguguuugaagcagauggguuucaucuauaguguuacguuagauucugcuuuauucccuccacuaaaaccauuaacacucaucagaaagugcuaaucaguugauuaacaagagauuuaguuuagcagaaauuucaggauauucuuggaauuugggcaacaaauaucucuaguuucaaagacccuuguagacuuuccuauauugcuauugauggugaggggguaggggaguguuagaggccuaugcucaaguuuuccuaaauuagagaugcucuuuugcuauuguuacaaaugcauauaauugcuccaguacuuuaucaaauucccuuuagucuauauuuauguaaaccuaguuugauauacugaaccauucuuuuauuccuggaauaaaugcuguuuggucaucuuaauacaucugauuauuccauuugguaauauuuugaguaaaaaauucuauagugaauccuguuugcuucauggacugaguauaguagcguaucuuuuucugugacuagaaguuauuuaugaaagagaaucauuuauguuugaagaaguaaauaugccucaguuucaaaugguccuuuaagggcucuguauaaacgauuccaauauauuucucaguuguuauuaaaguacuugauuuuuuucuugucuaacuuuuagcaauuuuuauauuaauauuucaaagaaccauguuuaaguaaauuacuagcaaaggaacucuuugggggaacuuuaugaaauuuucucuuggcaguugcuaaaaguuuucuuacguuuucuaaaaguucaguaauaguacauuuaucuuuagaaaaguuugcuuuucagaaaguguuuccauuuuucuuguggucagaaugugcugugaauuuuaaauguauuuuuaagauauuauagcuaaauuguaccucacuguuuucucuaaaaaguuuuacugcuuuugcuuccacuccacuauucagugauaacaaggguaacaaguuuccacuagaauugcuugucacuuuauucuuguacuuuuguuuuacuacugaacaucuuuuuaaaucguugccacaaaauaucucgcuuuuaucauuuucacauugcucuaguauaucaacuuuggaaacaagacaucauucuauuuauagcauucuguuuuuaguagugguauuuccauuuacaaaauacaguaauucuugaucgcugaagacgucaaauccuagaaaacauagcaugccuacgcgugauguuaacaucauucucgaauaguuguugguugaagauucauuugaugaauccgauuuuucagaaauagacgagucugaugauacagacgauucugguguuaguucucuguagaaauaacuccaagaacacuuuuaauaguuuauuuucacauugaaaaucagauuugcuccagccucaaagaguauauuuauguaaaauuagguaagcgauauagaagcaagcugcacuuuuuuucuaaaugggaagguauuaaaaaagaaaagucucauuuuaguaacauagucuuccuuaaacucuaugccacuuguaagauuucugaaaacugaagacauagaagggaacgggcuugauaugaacgacagcuuugcugguaaauaaacccaacugaaccuaagauuaucuaagguaaccucuuuuucuagucuuuuauugugugaacaguuaccuccugcugaguuguuggcagaauuuccauauaaucuugcuuaugaccauuucuacauuauuuguaucaucuuuuagaagucuuacccagguugauauagguuaccguucucuagaucugugucuccaauucuucuuacauggcauuagguauuuuaagcuuguuuuuuuucagacaucguauagucaauucuugaauguguugagaggugcuaugucauuguaagcuuuauucuucuucucugaaugauuagcuuguuuaaauuuuaccuuaaauucuuuuuuuucuuuuuuuuucuuuugagacugagucuugcucugucgcccaggcuggagugcaguggugugaucucggcucacugcaagcuccaccuccuggguucacgccauuccccugccucagccuccugaguagcugggacuacagguacccgccaccacgccuggcuaauuuuuuuuuuuuuuuuguauuuuuaguagagacgggguuucaccauguuagccaggauggucucaaucuccugaccuugugauccacccgccucggccucccaaagugcugugauuacaggugugagccaccgcgcccggccuuuacguugaauucuuuaaauucagcuugugacuuugcacuucaggauucugaguguucucugucuucuuccugcauuguuuuucuuauaccauacagguuuuucauuggccuugacuuuuuguuguuaacucauucuucuuuggguuuauuuucauuuguuucugcugaauauuauuuguuucaaacuaaaaauaacauuccacauuuuaauugaugugcggacucuuaaucuacuuaaaaugugggcugaaguuccaugauuccagcuagucuggaauaggucauuuaacuggauguuaauucaccuacauuguucccuaagugacaugugggucccauucugcugacauauuuguggguccugguaacaaccauuuggguagauuugcugauuccucuuuucuccuuaguggaagagaaagccaauacccaccuccucuugggcaugugcuuagacgccugugcucgcuaccuucuguucuccaagcagccgucacaggcacaaaggauguaugaaaaagcucugcagauuucugaagaaauacaaggagaaagacacccacagguaagggaggaaaacacagaagggggaauauaaaacaaaggcuucaaaauugaagggugugaaaugucacacucauugguaacaggaucagcagaugguccuagauccuccuugguccccagucuacucauuuucuuaucaccagcacccucaccccaacuacuuguuucagaaaggauuugagacuaguuaucaguuacuaggucugcccagaacuuuuugcaugauccaugguuugcacaacagagcaaccuuucuacagagcaggacuggucaggcuucaauggacacagcacaguauuucagaguggggucucuagauaccccuauuagaagcuuaugaggaacgguuuaauacacaaauauccuugccucccuugccccacaguuaaaauggcaagaggugagggaagggcaagggaccacauuaaaaacacuuaaaccauuggcauauuauagaauuuaaguauaacguguaaagcucuguguuagaacauuaaacacauugaauugaaaucaucucuuugggucuccccuccauccgaguaaguucuuagauguaaggagugcauugcuuugucuaugaaugcuugcuacugccaauauaagacauaacaauuuuaacugaaugugucccaaggcugggguacauggguagggugaguaauauguuuuggaagaaaagggagguugagcuaugaauuaucuccaugaaagggauuuauaacuuauuaugaagagucccuuaauggagugaggaauaauaaacaagcaaguacagaauucagaucuccaaguacuagagucagggggcuuaaagcauggcaucaguggggaaguagguauggaagucuaccucuuccauacugaaauuccauuucaguagccaaauuaaaaaaacuccuacugggcaucuuccuaaaauagaugguguauuucuuguuuuugaugagccucaggguuaucagcaggaacaacauaauacaguggggcuccagaggcaaucaaaccauaggaggcuggcuucucaaaguugcucagccuuaaaggagauaauauguguagcuucuugcuguuguuuuucauuuggugcuucuaacuggguaauuaguuggauuaauaagcacugucuguuaccuaauuuccagauuuguauuauuucccaaaaggucgaacuaacauuguccacuguacaaugugauuaugauuaacaaaugcccacaaauuuguuaaagaaugguaucccucaucuuuuguggaaugcuaggaaagaugaaaucuuauguauucagaguuggaugcacuccacauuaaaguucugugaaggcauguuuuuaaagaaaaaauuguuuuuucuuuuacauacagaccauugugcugaugagugaccuggcuacuacccuggaugcacagggccgcuuugaugaggccuauauuuauaugcaaagggcaucagaucuggcaagacagauaaaucauccugagcuacacaugguacucaguaaucuagcugcaguuuugaugcacagagguagguagcaauguaaacuuaacugacuugcuuuaagggagggaugucacuggauugauagauuugugaagugguauguagggagggcaagggccaacgaauaaacauguaaauuaaaagacugguugaauggcagaaaaaggagguauugauuagguugaaguacuauuguguucaauucacguaacuucuacagaccugcacuagccugucgaaccccaucaagcuggagaaaaccuugcaaugauaguaccuuacgucaguagugcuuuacagauuucuaaauguguucaguuacaauguguuucucacagugugcuggugaagcuuuaugacaggaaguaucauuuugucagacauuucuuagugucagcacacuauaccgaucauuuucagaaaccugggaugacagguguauuacacauaccaccauucaugaaaucuugggcucaucaaaguccucaggauauacuggaaagggccguuaggaaucccacagcauucaguggaguuccagccugucagauggggaugaaaugaggcagcaccagcuugucgcuucauaagcacacaguaaauuagcccuauaucugcauucaugcucucucuucagaaucaccuugaaaacauacacuuucuucuuacugucccuucucucuggguuauuuuagaacgauauacacaagcaaaagagaucuaccaggaagcacugaagcaagcaaagcugaaaaaagaugaaauuucuguacaacacaucagggaagaguuggcugagcugucaaagaaaaguagaccuuugacaaauucugucaagcucuaaauccauuuuuguguagggagaauaaugucuaguaauguggaagaauagcuaucauuccugucucuguggcacccgaucaauggcuuaaaucugucguuuuugauauucagguuuccucaauuuagccuuagugaaggagggguuguacacacugccauuuuuguauuuuaaaggaaaaaugacuuucauucccaacugauuaugaccuuucaggaugucgucaagugaugcuuucaguuguaacacgugacuuggugcugucccugcuggucuaaguagaacuguagauucauaugggcugguguuccugugcgcuguggguguggugauucagccuggcauuucuaccauaaguuuuuggucugcugauuugcugcccugucuucucuuacuuuacuuuaucaauaccuggcaaacugaccagaauuaccuuccucauggcaaagggggauuauggugaauuguuguucuuauagucuguuucaugaagcacaaguggaauuuaauacauaaaagagaaaaauaucuuaguuugcuaccagcauccagcaugaaguuguaaaguggggauuaggcacgugacaguauagcacccauuugaauuuaaauaaaagugaaccauauuuaucugguuauauaaaacuaaaaauggggguguuuauauaaaacuaaaaacuaagaaugauguaaccuuuugucuguguuaucugaacacucuacuuccuuugcagccuuagucacacaacugagucaucucaaguacucuuuaaggacacacagcccaggcuguucugagucagaauaggccccuacagguauauuuuaaaacucuucguaauucuaauguguacugcugguauagcugaacuacugaccuggaucuuaguccuagccuuuuugcuuuugcaauuucaguaucuucaucucuaaacuagggaaacacugggauucuuucuuagcugugggggaagguauuugguuagaugacuuugaaugaauagacugcugugcugaaagagcuuuaucacacugucucaaaguauguaaagauacauagguggaugcucuuacugcagcagucaugaauacauuuuuagccauuuaccuaaggaaaaagacaguuuuucuagguaccaugaaggaagauugacccuguugguaugccugugggggugggaugugagugggacugauaaacugauacuuuugguucguauguacauacuggaagaaucuucauaauaaaugagacuacacaacaauauuguauguaucccaguaaucuuugcauuucucaaaaaaaaaaaaaaaaaaaaaaaaaaaacuuucugaagaaaauaaaaacaccagaaaccuugagguccaaauccucagggauuagacuaaaacuagaguuuuguauguugcagauguaaauuucuuccuauuuucugucuaaucucauauuauuuaccaugcagcuaaugccguuuaccaagucuagcucagagagauaagauacaauauaaaucagacuguuucaguagaaaccaguauuaacguauggugauuucuuaaaaaaauuaaugucaaccacucaccuuuugcauugagaauguuuuuaccuuuucacaacugcagggguuacugaaagguuuuucauuccaaguuuuauuuauuuauuaauuuuaaaucauccacagugacucagcucauggucucguuguuggaaacacuaggaguuuucaggacagucucuucauguggguguuuucauuacaguucauuuacacuguuguaaaauaagguacugaagcaaaaggaggacugaucuccuuuacugauuggucuaaauucaaaagugaauugguuaaaaucgugucauuaaaauuuuuuaacuguccaaug

SEQ ID NO: 192252 - RNA, 109065 nt, Homo sapiens
cuacugcgcaggcucagugcugcuuacccaucauggaagcaauguggcuccuguguguggcguuggcggucuuggcauggggcuuccucuggguuugggacuccucagaacgaaugaagagucgggagcagggaggacggcugggagccgaaagccggacccugcuggucauagcgcacccugacgaugaagccauguuuuuugcucccacagugcuaggcuuggcccgccuaaggcacuggguguaccugcuuugcuucucugcagguaggaggccauaggaggggcgaugggagccggggcuuugaaagggauuuaagugcuaaccgaucucagucgccuucuucucgaaguuuuccguagggagcuaagugaauacaccgaaggucuuaccucugaaccccucacagccuagggacaggagcggccggcuuaccugguggguugggggacgucggcagcucgcguacuacgccagcaggauugaggagcagagaaacaguugcaguugguuguauucaguaccugcauuuccguugggaacuccaccuguacuuguuauucuguggaacuuuuuuuuauuuguagaaggagcaagaauauugaccuuacuauauagcacacgaaacaaucuaugcuguaucgugccugcucaauccuuaaaguuaacuucuaaugauaguaaaagaccuuccugcugccuuuaaaaugcagcuugugcuaguaacaugcaugugucaaauugaagaauuagacauagaugacuagauagaaaguaauuuuguagguaauuuuagaguucaacuccacccagcuuucagugaaggaaccuuucaaauaauagauuuuugcuuaccauagagaaaagaucaaaugacaaagcaaauauugaccauuaagcuggaauauggugauaauugaacaguuguauaaaugaaguaauugaauuguacacauacaaugggugaauuuuauggcaugucaaaguauaccucaauaaagcuauuuuuuuaaauugcccaugaccucuuuucccauuuguuugugugucuuuccaauucuuuuucuauacagcuucuucacagaaaucacauuuuauaaaauuuuauaucguuuuuacucgacauuacuuuuucauuuauuuaccaaauacuuauuaaacauuuaugugcuaggccuuauucuaugcccuagggauacaaaaguggaaagcuagauaagagcaguguccucaugaaacuuuaaacaucuaccuauauuaauuagaucuaaauguauagccuguuaaauggcuucaucgggauaaaccuuaaucaucccuuauuguuuguacauucagaggguuuuuuccuaguuuauugcaaagagcagagaacaucuuuauguauuuuauauuauuucaugaguauuaauuuuuaaaauuggcuguuuuuaggcuuugcauugcaaaacacauucccaaaaacaaaaugccaacuuacucuuuuuuuuuuuuuuuuuuucugagauagucucgcucuguugcccaggcuggagugccguggcgugaucucggcucacugcaaccuccaccacccggguucaagugauucuccugcgucagccugccaaguagcuggguuuacaagcgcaugccaccacaccuggcuaauuuuuguauuuuuaguagagaugagguuucaccauguuagccaggcuggucucaaacuccugaccucuagugauccaccugccuuggccucccaaagugcuugggauuacaagugugagccaccaugccuggccuaccuauuuacauucuuacuggcacuaaugagaguaucugucuuaauauacuacuuucuguagcauugacugacauuuuuuauaaauuuuuuuuuuuuuuuuuuugagacggagucuugcucuaucgccuaggcuggagugcaguggcgcaaucucggcucacuguaaguucugccuccuggguucacgcccuucuuucugggacuacaggcgcccgcccgccaccaugcccagcuaauuuuuuuauuuguuuuuaguuuuuaguagagacgggguuucacuguguuagccaggauggucuugaucuccugaacuuuugaucugcccgccucagccucccaaagugcugggauuacaggcguaagccaccacaccuggccauuuuuuauaaauuucuuaauuuguuuaguaucuucucccccaaaaaccuuuguuaccaguaaaaguaaaccauuuuacauauuuauuaagaauuggagcccaagcacuuuucuucuaaaauuuaugcucuguuaagaauauuaauugcaaauaguuacaaguaaugccaccauuuuuucuuagcuucuagguuuggugggggguuuuuuguuuaguuuucuuuuugagauggagucucacucugucacccaggcuggagugcaggggcgcaaucucaguucacugcaaccuacgccuccugaguuuaagcaauucucuuaccucagccucucgaguagcugggacuacagugugcaccacauguugggcuaauuuuuguauuuuugguagagcugagguuuugcugggauagccaggcuagucucgaacuccugacaagugauccacccaccucggccucccaaagugcugggauuacaggugugagccaccacacccggcuggccagcuuuuaguuguauuuguauuuuauauuacaacuauaggagucaaauuauaagcaaauuuguuacaaggucuucaaaagaagccuggauuuuauuugcaaaacauuauagguauagcuguuuaauaaacuuacccuuauuuucaauagguucauaaaaauuugggaccagaauugaaaauuuuuucaaauaaaaaauauaggccgggcaugguggcucaugccuguaauccgagcacuuugggaggccgaggcgggcagaucaugaggucaagagaucaaaaccaucuuggccaacauguugaaaccccgucucuccuacaaauacaaaaauuagcuggcuguggugguccacgccuguagucccagcuacucgggaggcugaggcaggagaaucacuugaacccaggaggcggagguuacagugagcugagaucgcgccacugcacuccagccuggcaacagagggagacuccgucucaaaaaauauauauagagagagagagcaugcacuuggcacucaauguuuuuauuguauuucauuauuuccucugaauccauuuuguuuuuuauuguauguuauuuauucuuuauuuguguuuuuuuaaauuguuauuuuuuuuuuuuuuuuuuuuuuuuuugaggcagagucucacccugucucucaggcuagagugcagugguucgaucuuggcucacugcaacaucugccucccagguucaagcgauuuuccugccucagccucuggaguagcgggauuacaggcauucaccgccacgcccagccaauuuuguauuuuuaguagagacgggcuuucuccauguuggucaggcuggucucaaaacucccgaccucaggugauccgcccaccuuggccucccaaagugcugggauuacaggcgugagccaccgcgcccagccacgccaggcuaauguuuguauuuucaguagagacaggguuucaccauggcggccaaacuggucucgaacuccugaccucaggugauccaccuggcccggccucccaaagugcugggauuacaugcaugagccacugagcauggccuguuuguuuauuuuauaaaaauggggucuuguucugucuagagccuuuccccucuagacugcacugucagcucucauaucaggugacagagcaagacccugucuuuauaaaauaaaccaaacaugaauaacauacaagaaaaaacaaaaugauaaguuggauucagaggaaauaaugaaagacaauaaaaacauugagugccaagugcaugcucuguauuuuuuauuugaaaaaauuuucaauucuggucccaaauuuuuaugaaccuauugaaaauaaggaugaauuuauuaaagagcuguaccuguaauauuuugcaaauaaaauccaggcuucucuugaaaaucuugaaacaaacuugcuuaauuugacuccuauaguugcaauauaaaauauaaauaaaacuaaaagcugacuggaucacagcucccuacagccuccaagucuugggcucaagugauccucccgccucagccuaccaauaguugagacuauaggcgugugccagcacacccaacuuuuuuuuuuuuuuuuuuugagacggagucucacugucgcccgggcuggagugcaauggcgcaaucuugggucacugcaaccucugccuccuggauucaagcaauucuccugccucagccucccaaguagcugggacuacaggcaugcaucaccauaccuggcuaauuuuuguuuuuguuuuuguuuuguuuugagucuagcucugucucccaggcuggagugcaguggcacaaucucggcucacugcaaccuccgccuccuggguucaagugauucuccugccucagccucccaaguagcugggauuacaggugcccgccacuaugcccagcuaauuuuuuguguuuuuaguagagacaggguuucaccauguuggcugggcugcucuugaacuccugaccucgugauucgcccaccucggccucccagaaugcugggauuacagacgugagccaccacgccuggccaauuuuugcauuuuuaauggagauaggguuucaccuuguuggccaggcuggucuugaacuccucaagugauccaccugccuuggccucccaaaauaauaggauuacagcaugagccacugcuccuggucuaauuuuuaaaaucccuucuuaaauucacaagucauucaaacguguggauuaaacauuaucuauucugcugauuuaacauuuuaauauaaaaaacaggaagcuauuaauuuguaauguaaugaaagcuaugauguuuugauggagaaaguacuauggacacaaaauggaaaaaagcauuaaaucucuuuucagggguuuagauuaaggaaaucuccaaauugguuuucuuuugagcuggacuuuaaaaauaggaguagauauauauauaggaagcaagcaguaguaaaggcaucaguaacucuuggauuugcaugaauaauucauucuaacaagaucuucaguuuaagggaaagggagaagcagggaaaaaauaauaauugcuuuguuauugguggcucauuucauccugucagcaacucugugagguagguacuauuguuuuuuccauuauacaaguaugggaacugaaucacaaaguuuaaguaacaacugaagugaccagcuacaguguaaagaagccaggacccugugguuuuucucuguucuaaaaccguuacacccaaucugccucucacauugccuuguaugccuugucaguugaugaaauaucuaaauugauucccaguguauguuccaaggaacauuaguucaucaagcugcuauuaaaaaaaaaaaaaaagaggccaggcacaguagcuuacaccaguaaucccagcacuuugggaggccgagacaggugcaucacgugaggucaggaguuccagaccagccuggccagcuuggugaaaccccauuucuacuaaaaauacaaaaauuagccaggugugguggugcaugccuguaaucccagcuacucuggaggcugagacaggagaaucgcuugaacccaguagguggagauugcagugagcagagauugugccauugcaauccagccugggcaauagagcaagacucugacucagaaaaaauaaauaaauaaaaugaaaagaaugccucggucaaguuuggagaauagccagaugugcuauccucuauguagacguuuacagucuuuaugagaauaucaacaucuuugagaagcauugcuguaaaaaauuuugacuugguuuaauccaguauuccuccaauuuaugugaccacuaaaauaccuacuaauagaugcaucucuuauauaguaggaugucauugaauauauaugguagagaaguaacauaaucaguuuuguguuuuagaaagcucauucuuggccaggcgcaguggcucgugccuguaaccccagaacuuugggaggccaaggugggcagaucacaaggucaggaguucgagaccagccuggcaaacacggcgaaaccccaucucuacuaaaaauacaaaaauuagccggguguggugguggaugccuguaaucccagcuacucaggaggcugaggcagaagaauugcuugaacccaggagguggagguugcagugagccaagaucgcuccacugcacuucagccugagcgacagagcuagacucuaucucaaaaauaaaagcucagucuuggaccgggugugguggcucaugccuguaaucccaguacuuugggaggccaaagugggaggauugcuugaggccaggaguucaagaccaaccuggucaacauagugagaccccaucuauuuaaaaaagaaaaaaaaaaaagaaagcucauucugguggcaauggggagaaugguuuggaaggaaagauuggagucaggaaaaucaauucagcccagccuuucuucucuagacugcacugccagcucucauauaucagauuuccauguaauucuggucuauacacuuuagucaucucaacaacccugucuuaauuacuguagcuuauaaaagcuacacuaggccagaaguguugguucacgccuguaaucccagcacuuugggagacagagacggguggaucacuaguucaagagagcaggaccaucuuggccaacguggugaaacccugucucuacuaaaaauacaaaaauuagcugggcauggugaugugcgccuguagucccagcuacucaggaggcugaggcaggagaaucacuugaaccugggaggcggagguugcagugagccaagauugcgccacugcacuccagccucuugcucuugcgacagagcaagacuccgucucagggggaaaagaaagcuacacuauauuauagaagcgcuauuaucugauaugaauagucuucugauuguucuucaggguauguuugcuguuuuugacccuuuuuccaaauaccuuuuuuaugggggaagacagagccucacuguugcacaaucuuggcucacuguagccuccgccuccuggauucaagugaucccccugcuucagccucccgaguagcugggacuacaggcaugcaccaccacgcccagcuaauuuuuguauuuuuaguagagacgggauuuugccauguuggccaggcuggucuccaacucuugaccucaggugauccaauccuucuuggccucccaaagugcugggauuacaggaugagccaccaugcccagcccccaaauacauuuuagaauuagcuuggugauguucaaggaaaaaucuugcugacauuuuuucccccuugugacagagucucacucugacguccaggcuggagugcaguggcgcagucucggcucacugcaaccuccaccucccagguucaagcgauucuccugccucagccucccaaauagcugggacuacgggcaugugccaccaugcccggcuaauuuuuuguauuuuuagcagaaauaggguuucaccguguuagccaggauggucucgaucuccugaccucgugauccgcccaccucagccucccaaagugcugggauuacaggcgugagccacagugcguggcccuugcuggcauuuuuauuggaauuucacugacucuacugauuaauauaaggagaacugacauuuccaauauaaagccuuucugucucugauacuaugguaugcuuccauuuauuauauguuggccuucuuuacuaucuguuaauaguuuuauaauuaaggucuuaaauguguauugagaugauuaugucauuguguccauuaaucuguucuuauguguagacauuccuuuugcaaauauagucuguuacuuucucauacuucaguauccucuuuaauuucuuuaaauauauuaaacauuuauaucugcuucuaauaauuccaguuucugcagucuguauaucugauucuguucuuuguucuaguaauucauucggggugacucgguuccauguguauuuugugauuuuuuuaaauguaagcacguuucuuuuuuuuuuuuuuuuuuuuuuugauacggagucuagcucuguugcccaggcugaagugcaguggcacaaucucagcucacugcaagcuccgccuccuggguucacgccauucuccugccucagccuccugaguagcugggacuacagucaccugccaccaugcccggcuaauuuuuuuuuuuuuuuucaguagagaugggguuucacaccugggauuacaggcgugagccaccgugccuggccuuuuguuuucuuuuguuguuguuguuguuuuguuuuuugcacguguuucuuagaaccauauuugugguaauauuuuggugauuuacuuuagcuucagccagguagcuaagggcacuaccuaccucucaucacucuaaaauuuuagauugagauuuuucaggccauagaggucauauaaauucagggaucaaacccaagagcauucacuguggaaugcugugaaacaaauugucucaagaccuuguagcuuaaaaccauaauuaaaucuuuccagccugugugcuggcacacaccuauaauccuggcacuuucugaggccgaagcaggaggaucacuuaacccaagaguucagccugggcaacauagccagaccaggaaaaaaaaaaaaaaaaaguuagccaggcuugguggcagcugcauguagucucagcuacuugggaggcugagguggaagaacacuugagcccaggaguuugcgacuagaguaagcuaugaugaucaugccuuauagacuaagcccaugucucaaaaacaaacaacaacaagaaaaaccaaucaccuuuuuuuucaugguuucagacaaaguauacuugucucugccucacaauguuuaguaccucauuuggaggacccaaagacuaggggcuggaaucaccugaauacucaugcacuuacguaucuggcugucagcuggggacuuugcuacagaugucagccagaacauccacauaugguauauccaugugaccugggcuuccucacaaccugguggcuggguucuugggcaaguguccuaagaaagagccugugcuagggauaaccauauuuccuuuuaugaccuauccuuaaaaaucuugcaguaucauaagccacauccagguuuaaggagagaauuagauuccaccuccuaaaggggaauguagacauucuacaagugcauaugggacuagaaauauugcuguagcuacuuuuggaaaauacagucuaucacaccaaguaaaggagaguaugugauuagcaauucuuagggggugacauuuuuucuuauuuucccuucugcuagaaccaagccuacagauaggauguagccccaccauaucugucuagggcaaguuuuuuucugguucauccagugaagguauugccuuuugaagguccugucuuuauguggaggucuccuuaucuguguccaagcuuuaucugcugcucccuugacuuuaggccaccaaggauauguagauguucucaaagugcucugggucagccgcauaauaccucucaggauuuaugucuaccuauuguuuuaguccuucaaguauaucccuuacuuuccugcuaguuaaaccaugcauucuagaacauguuugccuuuuaucucacauguucagguauucauccugaggguuucucugcauaucugauuuaccauauugccuaaauagaacuuauuagggguuauuuuuaauacugcuuuuuuggguuuuuucuuuuuuuuuuuugagacggagucucccucugucacccaggcuggagugcaguggcacgaucucggcucacugcaaccuccaccucucggguucaagugacucuccugccucagcuucccaaguagcugggauuacaggcgcgugccaccaucaugaccagcuaauuuugguauuuuuguagagccaggguuucaccauguuggccaggcuagucucaaacuccugaccucaaguaauccgccugccuuggccucccaaagugcugggauuacaggcgugagccaccucacccagugaaagguagcaauuucauuaguaagagucgauaugaaugcaauccuuuugggaauaaugagaaaugacacuacucgcaaguauggcuauauuggcugauaauauagcaugugacaauguuucuugaucugcagagauaugagcucauuuuucuuuuuaauuuucuuuucuuuuuuuuuuuuuuuuuuugagauggaguuucacucuuguugcccaggcuggaguacaauggcaugaucucggcucacugcaaccucugccucccagguucaagcgauuuuccugccucagccucccaaguagcugugauuacaggcaugugccaccaugcccggcuaauuuuguauuuuuaguaaagacuggguuucuccauguuggucaggcuggucucgaacucccgaccucaggugauccacccaccuuggccccccaaaguuugggauuacaggcaugagccacugcacccagccuuuuuaauuuuuuucucuuagugaucuuuuaaagacaacuucuguuuuauagggauaacgccuauaaucccagcaauuucauaauugaaagauuuuauucauugaaaauccaguuuuuaauauuauuuaaauugugguaagacauacauaacaagaacuuaccauuuuaaacuuuuuuuuuuuuuuuuuugagauggaguuucacucuuguugcccacacuagagugcaauggcaugaucucggcucacugcaaccuccgccucccagguucaagcaauucuccuaccucagcccccugaauagcugggauuacaggcacccaccaccaccaugcccggcuaauuuuuuuauauuuuuauuagagaauggaguuucaccauguuggccaggcuugucuugaacuccugaccugaggugauccaccuuccucggccucccaaagugcuaggauuacaggcgugagccacugcgcccagcgauuuuauuuuauuuuauuucuuuauuuauuuuauuuuauuuuuuugagacggagucuugcucugucgcccaggcuggagugcaguggcgcgauguacgcucacugcaagcuccgccucccggguuuacuuacaccauucuccugccucagccucccgaguagcugggacuacaggcucccgccaccacgcccggcuaauuuuuuguauuuuuaguagagacgggguuucaccguguuagccaggauggucucgaucuccugaccucgugauccgcccgccuuggccucccaaagugaugggauuacaggcguaagccaccacgcccggcgauuuuaaacauuuuuaaguguucaauuccauggcaguaagcacuuucauaguauuauguaaccaucaccacuauuucaucaucccaaauagaaacucuauaccuguuuagcauuccuuuuccccuccucucccaagccucugguaaccaccauucuuucuaucucuaugaauuugucuauucuagguaacucgaauaaguggaaucauacaauaauuguuauuuuaugccuggcuuaugcuaauuagcauacuguuuucaaaguucauccauauuguggcauguaucagaacuucauuucugguugagcucaguggcucacaccuguaaucccagcacuuugggaggcugaaguggaaggaucccuugagaccaggaguucaagaccagucuggacaacauagugagauuucgucuuuacaaaaaauaaaaauaaaaaaauuagccagucuggguggcgagugccuauagucccagcuacuugggaggcugaagugggagaaucccuugaauccaggaggucaaggcugcaguaagcucugaucagucugcugcauuccggccugggugacagagcaagucccugucucaaaaaaaaacuucauuucuuuuuauggcuuuauuaauauuccauuguguauauauacauacauauauauauguauguauauauaccacauuuuguuuaucauucaucuaaugauaggcacuuggguuauuuccaauuuggggcuauuaugaauaaugcuucuaugaacauugguguacaaguauuuauuugaguaccgguuuuccuuuuuuuuuuuuuuuuuuuugaguauaauugcugagacauaugguaauucuguauuuaaauuuuuugagaauugacaaacuguuuucugcagcaacuguacaguuuuacguugccaccagcaaugaacuaugguuccaguuucuccacaucuuugucagcauuuguaauuuuccauuuuuuggacuauagccauccuaguaagugugcagugaugaugucacauugugguuuugauuuucauuucccugaugacuaaggaugaugagcaucuugcaucuuuucacaugcuuauuggccaucuauauaucuucuuuagagaauaccuauucaaguccuuugcccauuuucugauucuaguuucauuuuaaagucaugauuuuuuuuuuuuuuuuuuuuuugagacggagucucgcucugucaccaggcuggagugcaguggcacgaucucagcucacugcaaccuccaccuccuagguucaagagauucuccugccuuaaccucccgaguagcugggacuacaggcgugugcccaccaugcccagcuaauuauuguauuuuuaguagagaugggguuucacuauguuggccaggauggucucaaucucuugaccucgugauccaccugccucggccucucaaagugcugggauuacaggcaugaggcacugugccuggccaagucaugauuucuuagacuggguucuguggacacauccuaauagaagaggaucuagcucucuuaguuucagcuuccuuugggaacccaggccucugggcuccaguaacacugccuccuuccuuuaccuugccaaccgaggguugguagucacuucuugcuaucucuaaacucuggguuacuucacuguuccuuuugucccuuagauccucccucaguuaugcgucaaaaucuuugcauuaaauucuugcuguuguaacuauuugaugugguuucuguuaccccgaauagaucuugacauagcaucuaaauucccucauuuuauaggggaagaaacuuguaccauuuugucuuccaaauacauuuuagaauuacuuggucauguuaaaggaaaaacauugcagcuauuccuucccauaacauacuucucagucguaacuagcaaucuagcagucauaaucacuuuuuuuuuuuuuugagauggagucucacucuguuaccaggcuggagugcaguggcacagucucagcucacugcaacuucuacuuccuggguucaagcuuuucuccugccucagccucccaaguaauuacaggcuaggauuacaggccugagccaccguggccagccucauaaucacauuuaauacaaaauaaagucacguuguaaagacucaaauuuauacaucacaauguauaaagguaaaaauuuuauuuuuaaagaauaaaauuacaaaaauuaaagaauuucuccaaauucauauaguuaguaaaaagacagauaguguugggaccaugaugccuucaugcccaguccauuucuuguucuaacaaauuaaaacuucccggguuggagugggagaggagcuuuuuuccuuuauaugguuuuuuuuuugguuuugguuuuucuuuuuuuuuuuuuuuuuuuuuugguagagagaggucuugcuauauuccccagccuggucuugaauuccuggccuuaaacagugugcccgccuuccaaagugcuaggagcugggauuacaggcaugagccaccacacccagcuucuuacugauuuauuuucuuuucuuuuuuuuuuuuuuuuuugagacacagggucucacauugucacccaggcuguagugcagugguguggucaugguucacuauagccucaaaaucccaggcucaagcguuccucccacuucagccucccgagucagugggacuacaggcgugagccaccaugcccagcuaauuuuuaaaauuuuucuuuugugaaaacagggucucacuauguugaccaggcugguuuugaacuccuggccucaagugauccucuugccacagccuuccaaagugcugggaauacagacaugagccacuaugcccagcuuugauuuuuuuuuaaccauauaaaucuauuaccuauuuagaauaaacuaauuuuaaauuuuuuaaguaaaauaaaauguuuacccuuauaaauuaugauguauaaauuugagucuuuacaaaaugucuuuacuuuguauuaaaugugauuaugauugcuaguuaugacugagaaguauguuaugggaagacuacuaagcauacaauugugcaugagcuuauacacaaacacacacauaauguaguucuacaucuagaaauuacauuaauuuuauuauuuucuguuuccuagaauaauggucucaaacucuuuggucacauuuuccuaucaguaaaaaauguugaguuuuuuuauuuauuuacaauauaucauaaguauauggacuaauguguacauuaaaaacauuaacaaaaacuuacauuuauaaaaaacaagguaaacaaauuagggggagauggcugagcacuguggcucacuccuguaaucccuucacuuugggaggcagagguggguggaucaccugaggucaggaguucaagaccagccuggccaacauaaugaaaucccgucucuacuaaaaauacaaaaauuagccaggcgugguggugggcaccuguaaacccagcuacuuaggaggcugaggcaagagaaucgcuugcaccugagaggcggagguugcagugaacugagaucacaccacugcacuccagccugggcaacaagagcaaaacucugucucagaaaaaaggaaagaaaagaaaauuagggggagacauccuaaugcuuuuucuccaccaccccaaaagauuauuuugugcauccuagggugcaccugucuuaguuggacauuguucuagaauguaucaguuaaaagcugcugaaagaucucagacauguguucuguuaagugccuacagguucaccaaacuuauugaaaauaguuaaaaugguccuugacuucagcuuccagaacuguuguaaguuccuuaguucaaacacaaagcaauaaaacuggccccaauaaaacacauuagccucaauucuaagcaguuucugauaaccauaaucauagacuaaugugcacagccuuugaacuuagcaauugcaacacuaauguacaugagacuauuuaucaccaaaaaucaaguaaucuagggagaaaaaaugggagaggguauguguagagauuugagggaaacccaaaauauacacaaaauaguuuaugacuuaaaaaaaaaaaacgcaaaaaaagguaugaugaggacaauacaaaacuaaaccuguaaacuaaaccuguuugcugggcgcaguggcucacacuuguaaucccagcacuuugggaggcugaggcggauggaucacaaggucaggaguucaagaccagccuguccaacauggugaaaccccaucucaaauaaaaauacaaaaauuagcccggugugguggcgggugccuguaauccuaacuacugagcugaggcaggagaaucgcuugaacucuggaggcagagguugcagugagccaagaucgcgcugcuguacuccagccagggcgacagagcaagacucuuaaaaaaaaaaaaaauggccauuaucuccacuuaacuggugaagaaacuguggcucaagaaaguuaaguaacuugcacaaaucagaccugcaauuauuuauuggagaguugaaguaacaggugcauuagcuggacaguugcucaaaaugaguccaacuuaagugauaccaaaaugucacuguauuauuauuuguaagguuacagaggaguuuuauuuaccagaacuauuuuuagggaauauaguauauguuuugggaaaauaaagaauauauaaguuguuuggggugccaaugggaucaagauccccuugggguaugcuggauagcuggcuaugaaacucuucaaaagaggaagcuuuccuaaaugguaucuacacauuuuccuguaauacucaggaguagcaaccucuauuuucuuuuucuauaccaacaagaaugagcuuggaaagcuucauccuuaaaucaauguuaaacaggauuugaggacugucaaugaagagggggccccaguuguucugaguggucguacauggugugauccuaaaucugcuuaacuucaaaguuaguacccuuggcuguguaccaugcugccucuagcaugugacugaaaugcagacagacagauagguauauagauacaaagaugggaaagaauugugaauggugauucuaaagauugugcuacugguagucuucucacaggaguaucuuggugucguguuuucuuaaacuuuguaucauaaucacacauuuucaggcagcuuaaauccuuuaaggaacaaaaacaggauaagaaugagugaauagauaggucuccacuguuaaaaaaaaaaaaucuaccacuguauauuuguuacccucaggaaauuacuacaaucaaggagagacucguaagaaagaacuuuugcagagcugugauguuuuggggauuccacucuccaguguaaugauuauugacaacagguaauauaucuuuuaacaauguagaaauuuauuggcaauaaauaugcagugauauacucaaaagacacacaaaaaacuaaugugaguggcugagaacaucuuguaugaaaagucuagggcucggugccaugguucacgcuuguaaucccaguacuuugggaggccgaggugggcggucucaggaguuugagaccagccuggccaacaugguaaaaccgcaucucuacuaaaaauacaaaaauuagcugggcauugugguccagcuacuaaagaggcugaggcaggagaaucacuugaacccaggaguuggagguugcagugagcugagaucaagccauugcacuccauccugggcgacagugagacuucaucucaaaaaagaaaagaaaagucuacauaaaauaacuucacagcggggcacaguggcuuacgccuguaaucccagcacuuugggaggccgaggugggcagaucaccucaggucaggaguucaagaccaaccuggccaaacaugguaaaaccccgcaucuacuaaaacuacaaaaauuagccgggcguauuggccuacgccuguaaucucagcuacuugggaagcugaggcaggagaaucgcuugaaccugggaggcagagguugcagugagccaagaucacaccauugcacuucagccuggaugagagagcaagacuccgucucaaaaauaauaauaauaauaacuucacauuuguuuuuaaaugacagcgugauugaaauaaauuuuuuaacuucuguucggauuuuuuuuccugacauggguacuucucuuuacaucuauagcuuuaaaaaguuuuauuauaaauuucaaaaacauacaaaaguauaaagaauaguaucauaaacccccauuugccuauuaccuaaacccacugauuaucgagacuuuacuauacagugcuuguuucuucaccuaucccuaacuuaacaucuuuuguguauaugaaacauuuuaaagaaaacuccaaccaccagguuuuuuaccccaagguacuuaggucugcaucucuuaagaagaugggacacuuuucaucuagcuacagacagccauuaucauuacaucuaacaauauuaacaauaacaguaauucuuugguguccaccaacacccaguccauaucagaauuucuucagguagcucaaagauuuccuuuuacaauugguuuacucaaaucaggauuucgacaaggaccacacauuauaguugguugauauucugcauuuaauuacccuuuucuccaaaucaguggauuuguugaagaaacugaauuauguugucauacagaauguccugcauucuggauuuaucuguuuguuuccuguaugucuacguucuuuuuuuuuuuuuuuuuuuuuuuuuugagacggagucucacucuguucccgcccagccuggagugcaguggugccaucucggcucacugcaaccuccaccuccuggauucaagcgguucuccccccucagucucccaaguaguugagauuacaggcauccaccaccacaccuggcuaauuuuuuguauuuuuaguagagaugggguuucaccauauuggccaggccaggcugaucuugaacucccgaccucaggugauccaccugccucggccucccaaagugcugugauuauagccaugaaccacuguguccggucuuuuuuuuuuuuuuuuuuugcacacggcaaaucagauuugggucuaacuuuuuggggggcaagaauauuucauaggcuguacuauguacuuugcaucauaucaggagacacguacuaucuguuagaccuauagugaaucuacaguugaucagugaguucagauggcaaugacucccuuuauuuuaaagacccccgucaaacuuucauauguucucaugccuauugccugaaucauuaauuaccuagaaguugcaaaaugcuuaguuuccaauagucucacauauucuauguguacuaucuauaauucuuuuguaaaacagaaucuucacuauuaauuaaggcuacuuaguuacccugcuauguauaauaauuugaaacaaaaaaacaggauaggugcuuaauuuuuuccccuuaauugacauuuuucagaauaaagaguugauacgccguacaccuacagucgugaucuauuguuuguuucuugaaugggaggacaccuaacuuucauuaggaaauuacgcguuuuuauguauucgguguuucagguucagucauauguucuuuaauacuaaauugucuuauguuuggccagagagucucuccauguuggcuuauauguccuuuucauaugaccucugucuuuuaugauuuccuuccuuucuuucaaguacaaugagauuuuccaguacuaucuuguauacuuuccugcuccaauucugaaaucagccauuucuccaaagagccuuuguuugucuuaguagggaaugguauuuagaguccauaaccagcauaguaggaguguucauugcaauaguguuauuuauuuauuuuuuuagacagagucuugcucuguugcccaggcuggagugcaguggugcgaucuuggcucacuguagccucugccucccugguuccagcgagucuccugccucagccuccuggguagcugggauuacagguacacgccaccaugcccagcuaauuuuuauauuuuuaguagagacagggguuucaccauguuggucaggcuggucucgaacuccugaccucaggugaccugccugccucagccucccaaaguguugggauuacaggcaugagccaccacgccuggccgcuauaguguuauuauuucucauugcuacuugaccuuuauaguggacagagcuaagauguauguuuuuuaugugcuuuuguauuuuuuagagacaggaucucacuguuacccaggguggagugaacuggcgugaucacacuucacuguagccuugaacuccuggguucaggcaauccuccugugucagccucccgaguaacugggacuacaggcacucaccaccacaccuggcuuuuuuuuuuuuuuuuuuuuuuuugagauggagucuugcugugucgcccaggcuggagugcaguggugccaucucagcucacugcaacguccgccaccugagcuaaagugauucuccugccucagccuccugaguagcugggauuacaggcacacaccacuacaccuggcuaauuuuuguaucuuuaguagagaagggguuucgccauguuggccaggcuggucuugaacuuuugaccucaagugauccgcccuccucggccucccaaagugcugggauuacagacgugagccacugcgccuggccuauuuuuuuuuuuaaaggaaaaaaaucagaaauauauacagaugauuacaauucaaaguuaauauuucagggguuuuguuuaacgucauugauauuuacaauggaaucucugguugggugugguggcuccuaccuguaauccaagcacuuugggaggccgagguggacagaucgcuugagccuaggaauuugagaccagccugggcaacguggugaaaccccgucucuacuaaaaauacaaaaauuagcugggcaugguggcaugcccgaaaucccaacuacuugggugacugaggugagaggaucaccugaacccagaagguggaggcugcagugagccaagaucaugcccacugaacuccagcccggauaacagagugagauccugucucaaaagcaaaaaaaaaaaaaaaaaaaauugaaucucuuuucugucacacugaaaguccuuuccaagaacaugaacauaauuacuuauuuucuucuuuaaucuuuucaagaauuucagggccgggcgcauuggcucacgccuguaaucccagcacuuggggaggccgagguggguggaucacgaggucaggaguucgagaccagccuggccaacauggugaaacuccaucucuacuaaaaauacaaaaauuagugggguguggaggcacgcgccuguaaucccagauacucgggaggcugaggcaggagaauugcuugaacccaggagauggagguugcagugagccgagaucgcgccauugcacuccagccugggugacaggaugagacuccgucucaaaaaaaaaaaaaaaaaagaauuuaauaaaacaugaaagaaggggcugguauuaugguauuauguauacucaaaacaguaaauacucaaaacuaauacuaaauacaauaugacugauuaugaugccugcaauuuacuuuaagauaauucagaaaaaaauaaauaccuauauagauuaaccccaaaugacaaaauauaacaauuuaaaccuuaguggaagguacuggaguguuucuuuuuuucuuuuuuuuuuuuuuuugagacggggucuugcucugucacccaggcugcagugcaguggugugaucucagcucacugcaaccuccuccuccuguguucaagccauucuccugccucagccucccgaguagcugggauuacaggcgcccaccaccaugcccagcuaauuuuuguauuuuuaguaagacaggguugccaggcgccgugacucacaccuguaaucccagcacuuugggaggccgaggcaggaggaucaugaggucaggaguucgagaccauccugaccaaaauggugaaaccccgucucuacuaaaaauaaaaaaauuagccagauguggugguacgugccuguaaucccagcuacucaugaggcugaggcaggagaacugcuugaacacaggaggugaagguugcagugagcugagaucacgccgcugcacuccagccuggugcgacagagugagaccccgucucaaaaaaaaaaaaaaaaaaagacgggguuucgccauguuggccagguuggucuugaacuccugaccucagaugauccauccgccuuggccucccgaagugcugggauuacaggccggagccaccuugcccgaccugaaaauuuagcuaggugugguggcacgcacccuguaguccuggauacucaggaggcugagguaggaggauugcuugaggccagaaguucaaagccagccuaggcaacauggcagaacccugucucuaaaaauuaaaaugaaaaauaaaaaugaauuuugggccagccggguggcucacgccuguaaucccagcacuuugggaggccgaggcaggcggaucaggaggucaaggguucaagaccagccuggccaacauggugaaaccccgucucuacuaaagauacaaaaaauuagccaggcgugguggcauacaccuguaaucccagcuacacaggaagcuaaggcaggagaaucgcuugaacccaggaggcggagguugcagugagcugagaucgcaccacugcacuccagccugggugacagagugagacucugucucaaaaaaauaaaaaagaaaaaaaaaagaaaaagaaaaggcaguaaaguuuaggugagcugugaacaaauuagcuuuggcaaaacauauaucucuuucuguugaaccuucaugauaucauacagaaauguaaacugugaauaguggagagagaugaugaguuuugugcuucagaaugauuacucuaaugaaaguauggauugaagagaucaagauuguagaugagucuauugucuuugucccaguggagggaggauaucucaaauuaggguagcagcaacugagauggagaugaugggaugaauucaacucuuuuuuuuuuuagagacaaggugucacgcugacacccaggcuguuuaggcaguggugcaaucuuagcucacugcagccuugaacuccugaguagcugggacuacaggugugggccaccaugccuggcuuauuuuuuaacuuuucguagagauggguucucccugaauuacucagugauaugauuucgaucuguguccccaccaaaaucucauguggaacuguaauccuaacauuggagguggggcguuggaucaguaggaggugauuggaucauggaggcagauuucucaugaauaguuuagcacuauccuccuugguacuguccuugucagugaguucuggcaagaucugcuuguuuagaaguguauaguacuuccucccucucucucuugcuccugccucugccauguaggaugcuugcucccccuuugccuucugccaugauuggaagcuuccugaggccuccucaaaaguggaaacugcuaugcuuccuuuauagccugcagagccaugagccaauuaaaccucuuuuccuuauaaauuacccagucucagguauuucuuuauagcaaugugagaaggaacuaaugaacccaggcugguuuggaacuccuaggcucaagcaauccucccaccucagccccucaaagugcugagauuauggaugugagccaccacgcgcagccccagccccaagguuuuguuuucuuuuguuuuuuucauuuuauuugagacagaguuuugcucugucacccaggaugaaugcagugacacaaucacggcucacugcagccuaacucccgggugcaagggauccuuccaccucagccucccgaguaacugggaccacaggcaugcaccaccuugccagcuaccuuuuuuuuuuuucgguagagauggagucuugcuagcuugcccaagcaggucuugaacuccuggacucaagcagucucccacuuuggccucccaaaaugcugagauuagaggcgugagccagcgcaccuggccuccaguauuauuuaagagguagaaauaggccgggcaugguggcucacgccucuaaucccagcacuuugggaggccgaggggguggggggcagaucaccugaggucgggaguucgagaccagccugaccaacauggagaaacccggucucuacuaaaaauacaaaauuagccgggugugguggcacaucccuguaaucccagcuacuugggaggcugaggcaggagaauggcuugaacccaggaggcagagguugcagugagccgaaaucacgccauugcacuucagccugggcaacaaaaacgaaacucccucucaaaaaaaaaaaaaaaaaaaaaagaaguggcaggaauucaacgaacaaaagaaauuugggauaauggaaacccaccuagauaucuagguggauaaagauuagcgaggguaguuugcaaaggaggagaauuggguaugaagagauaauaaauuaggcaucuuuagcauaugggaggaugaaagucuuuggggugggcugggugcaguggcucaggccuguaauuccagcacuuugggaggcugaggugggcggaucaccugaggucaggaguuugagaccagccugaccaacguggagaaaccccaucucuacuaaaaauacaaaauuagccgugugugguggugcauggaggcugaggcaggagaaucacuugaaccugggaggaggacggugcagugagccgagaucacaccacugcacuccagaaugggcaacaagagugaaacucugucuuaaaaaaaaaaaagaaaaucuuuggggugaaugaaauugcccauggauuaacuggagugauaagaacuggggaucaguuagaggaaaauaaaaccacaaacuauaaugaggagaauuggaagcauugagauguaaggugggaauacuugagaaaauuauaaggaaaaugagaauuaucugcucaguauuaaacaaaauuagcaucaaaugguauaagaaauuugguacccugcuuuuuuuacuagagaguauuuuuagcauuuuucuaugucauuaaauaaucauuaaaagucuuuaaugauuguaaagauuuaaucgugaagauguaccauaacauuuaacauucuccuacuauugaauauuuaaaucuuucuaauauuuaagcacuuacaauuuuuuuagcaaaucucuuugaaguucugacucuuuccauaaaugaauuucuagauauugaauuacugggucagaguauaggacuuuuucuuugggguuuuuuuuuguuuguuuuuggagacaaggucucugccaucaggcuaaagugcaaugacaugauccugucucacugcaaacucuaacuucugggcucaagcaaucuucccaccucagccuccuaaguagcuaggacuacaggugugcaccaccaugcccagcuaauuuuaaaaauuauuuuagauccagagucuugccaugucacccaggcuggucuccaacccuugggcucaagugaucugccucagcuucccaaagugcugauauuacagcaugagccaccauucccagucuauauagaacuuuuuauaguuuucuucaucuagguacuaaacaauucuuguuaaaguuauuuugauucuuuuuuauuauuauugcugugaaaaagauuuuuugguuaagaauuuacugcuaguauguagcuuuauugauuuuuuaauguauuuauuuuauauucaucacuuugaaacuucuguaaaaagccuaccaguuuuaacuugauucccuaaaguuuuguagguaaaucaucugcaaauaaugcuaauacaaucuuucauguuuucaacauaugccucuuauuucugauuccuuuuuuuuuuuuuuuuuuuuuuuuuuugagacagagucucgcuuguaacacaaucucugccuccuggguucaagugauucuucugucucagccuccugaguagcugagauuacaggcauacaccaccauacccggcuaauuuuuuguuuuuuuaguaaagaugggguuucaccauguuggucaggcuggucuugaacuccugaccacaaaugguccacuucccaaagugcugggauuacaggcaugagccacugcgcucagcccugauccauuucuuauuucuuugaguggauuuccuuaaucuauguuaaacaaaaaagggaaagcaggcaacuuuauccguauuuaugauuugauugacaacauauccaguguuuaaccauuaacuguguuguuacugguguguguuuguuuguuuguuuaugagacggagucuugcucuguuacccaggcuggaaugcaguggugcaaucuuggcucacagcaaccuccaccucucggguucaagcaauucuccugccucagccucccaaguagcuaggaucacaggcgugugccacccacccagcuaauuuuuauauuuuuaguagagauaggguuucaccauguuggccaggcuggucucgaacugcugaccucaggggauccaccugccucgaacucccaaaguguugggauuacaggcgugagccaccguuucuggccugcugauuauucuuuauaauauuaggcauuggugggaauugauguucacuguauuugauuugggguggggaucccauucauuucaguaugcuacaaagagaugaaggaaaaaguuuagauuuauucuugaucuuacuugcuucaugguaaacuacuggggucaccacgggagaauuucuucuguuuauaccaguggauuuauagagccagacugcccagacugaaacccaaguuuaaaguuuuuaauugcguaaccuaggcaaguuacugaauucuguuccuaaauuucuuccuccguaaaccucgaaagauacaugguuuugaguuaauuugugaaaggaguuauggguuccuuuguuuucaaagaugauaucccacccucuuacucugugaguguugugauuuguuuuuucacauuaauauuguaaccgcccaagggguucaccuugcccacugccuagacagagccaauuuauccagauggagagcugcaauggugaaagaguaauucacgcagagcugcgggagaccagaguuuuacuguuacucaaaucugucucccugagcauucaggcagcagaguuuuuaagcauaaugugguggguggggcgaagccagugagcugauuggucagagacgaaaucauggggagucgaaggucucuucuugggcugagucaguuccugggugggggacuacaagaucagaugagccaguuuauugaucugggugauccaucaagugcagggucugcaaaauaucucaagcacugaucuuagcaguuuagggaggguuagaaucuuguguccuccagcugcaugacuccuaaaccauaauuuauaaucuugggccuaacucguuaguccuacaaaggcaaucuaguccccaggcaaggaggucugcuuugggaaagggcuguuaccgucuuuguuuaaacuaugaucuauaaauuaaguuucucccaaaguuaguucauccuaugcccaggaaugaacaaggacagcuuggagguuagaagcaagauggagucaguuaaguuagaucucuuucacugucucagucauaauuuugcaaaggcaauuucaauauuaguaaucguguuuuuucucaggcacuccauuugcacaauguccugccugugcagugucugcuuuggcccaguaaugcaaauguuuucggggacaaaucuguuuuggagaucuugguuauuaagaucuuuacucugauagaaagcaaugugcauucaguacacuccucaacuugggaugggguuacauuuggauaaacaccuccuaaguugaagguauaaagcggggaguuuuugguuuuuguuuuuugcuuuugagacagggucucacucugucacccagguuagagugcaguggcaggaucauggcuuacugcagccuccaccucccgggcucaagugacccuccugccucagucucccgaguagcugggacuacaggcacacgucaccacaucuagcuaauuuuuuugguaauuauuuuagagacaggguuuugccacguugcauaggcugguuuugagcuccugagcucaagcaacccacccaccucagccuuccaaagugcugggauuacaggugugagccaucacacccagacuagaguguguuuuuuguuguucuuguuuuuuugagacggaguuucgcucuuguugcccaggcuggaguguaauggugcaaucucggcucacugcaaccuccaccuccuggauucaagcaauuuuccugccucagccucccaggaagcuaggauuacaggugcccaccaccacgcccagcuaauuuuuguauuuuuaguagagacgagguuucaccacauuggccaggauggucucaaucucuugaccucgugauccacccgccucggccucucaagaagcugggauuacaggcgccugccacuaugcccagcuaaauuuuuguauuuuuaguagagacgggauuuugccguguuggccaggcuggucuugaaguccugaacucagaugauccaccugccucggccuuccaaagugcugggauuacaagcaugagccacuacacccggccuagaguguguuuuuuacuuaugauauuuucaguuuaggauggguuuauugggacguagccagauuguaagccagggaguauauauauauauauauauuugagacggagucuugcucuaucgccaggcuggagugcaguggcuaauuuuuuguauuuuuaguagagacgggguuucaccauguugggcaggauggucucgaucucuugaccucaugaucugcccgccucagcccuccaaaaugcugagauuacaggugugagccacuaugccuggccuauauauauauacacacauauauauauacacacacacauauauauacacacacauauauauauacauacacacacacauauauauauauauacacacacacacauauauauauauauauuuuuuuuugagacggagucucggagucucccucugucacccaggcuggagugcaguggcacaaucucagcucgcuucaagcucugccuccuggguucacaccauucucccaccucagccucccaaguagcugggacuacaggcacccgccaccuugaccagcuauuuuuauuuuuguguuuuuaguagagacgggguuucaccauguuagccaggauggucuugaucuacugaccuugugauccacccgccucggccucccaaagugcugggauuacaggcgugagccacugcgcccggucauggcaccuauauuuuuuauauaucacaugaagaccauguagcuucagcaucacuccccuacucgugaaaugcuauaguagagggauaguaagccuauuaaaaguaaguacuucaggccgggugcgguggcucacaccuguaaucccagcacuuugggaggcagguggaucacgaggucaagagaucgagaccauccuggccaacacggugaaaccccgucucuacuaaaaauacaaaaauuagcugggcaugguggugcacaccuguagucccagcuacuugggaggcugacgcaggagaaucgcuugaacccgggaagcggagguugcacugagccgagauugcaccacugcacucuagccuggcaacagagugagacuccgucucaaaaaaaaaaaguaaauacuuaaagaagccaguuugaagauucaagaaaaaugcaucuuagucugcuugggcucccuuaacaaaauaccguagacaguguggcuuaaacaauagaaauuuauuuucccacauuucugcaggcuagaaguccagaucaaggucuuuuuuuuuuuuuuuuuuuuuuuugagacggagucucgcucugucgcccaggccggacugcggacugcaguggcgcaaucucggcucacugcaagcucugcuucccggguucacgccauucuccugccucagccucccgaguagcugggacuacaggcgcccgccaccgcgcccggcuaauuuuuuuuguauuuuuuuaguagagacgggguuucaccuuguuagccaggauggucucgaucuccugaccucaugauccacccgccucggccucccaaagugcugggauuacaggcgugagccaccgcgcccggcccagaucaaggucuugcagggucacuuucuuaugaggacucucuuccuggcuugcagaugaccuucucgcuauguucucacaugcuggaaagagauucucucacucucuccuucuucccucccucuucuuaaaaggcuacaaguuuuauuggauuaaagccccacucguaugaccucaugugaucuuaguuaccuccuaaaacccuaucucaaaauaguuacaauuagugguuagggcuucagcacaugaauuuguugaggacacuauucaguucauaguauuccaucccagacucccacauucauguccuuauuucaugcaaaauacauucaucccauccuaacagccuccaaagucuuaacucauuccagcauuaacucgaaaguccaaagucucaucuaaauagccucaccagcugugaaccugugaaaacagacaaguuauauauuuacaaaauauaaggaauggagaggcauaggauagauauuuucauuccaaaagggagaaaugggugacaggccccaggcaaggccaaaaccuaggaagguaaacuccauuagaucuugaggcuugagaacaauccucuuugggcggauauucggcccuccaagcccucuggagccuguggugggaaugguaguccuucugaucucuggauaacuuuugaggucauucuucccuuuucuugaaggacgacgcauguuugcagccagauagcucuguugucugguccuguagacucuuaaguccagcaggcuucuuucgucccacccgauuuuuucuuucuccuggcuguuauugaggugguugauuacaugugugguucacacccaugcuaaucaccucaucaaaugguuguucagucacaccagagugcucucuucagaacaagcuuucucucuuuuuuuuuucuuuuggagauggagucucacucugucgcccaggcuggaguacaguggcacgaucucagcucacugcaaccucugccuccuggguucaagcgauucuccugccucagccucccaaguagccgggauuacaggcgcgcaccaccacaccuggcuaauuuuuguguuuuuaguagagacgggguuucagcauguuggucaggcugguccugaacuccugaccucgugauccaccagccuuggccucccaaagugcugggauuacaggcuugagccacugcgcccagccucaagcuuucucauuuuuuuacaauauggacaggcugaaaauuuuccaaaaccuuuacguucugguuccuuuuaaacguagcaauuucuucuuuaucucucaacucuuacauuuuacuauaaacagucaagaggacccaggccacaccuucaaaauuuuacuuagaauucgccucagcuaaauaucuaauuucauccuucagaaguucuaucuuccacaaaacacuagaacacaauacaggcagguucuuugcuucuuuauaauagugaucaccuuuucuccauuuuccaaugucuuaucucauuuuucucugagaccccaucagaauggccuuaaagaccauauuuccacugacauucuguucaugauuguuuauguauucucugagaagauggagguuuucucuccagucuccuuuuccuuuccugaguccucaccagaaucaccuuuaauguccauauuucuaccaaccauuccuuccuggcagucuaggauuuuucuagcauucaccucaaaacuccuccaaccucuacccauuaucuaguuccaaagccacuugcacauuuuuauguaucuguuacuucacaguacuaaaaucugucuuagucagcuugggcugccaaaacaaaauaccauagacuggguggcuuaaacaacacaaauuuauuuucucagaguccugcagacuagaagucccagaucaaggucuggcaggguugguuucugguaaggguccucagccugacuugcacauggcugccuucucacugugccucaugugguggagggacagagggagacagaucucuuccuuuucuuauagcaccaccaguucuaucagauuagggccccacauuuauggauuuauauaaccucaauugcaguaguccucccuuauccacaguuuugcuuucugugguuucgguuaccugcagucaacuguggucuaaaaauauuaaauggaaauuccagaaauaaacaauuuauacauuuaaaauguacaccauucuggcugggcacagugcacucacgccuguaaucccagcaauuugggaggccgaggcagguggaucaccugaggucaggaguucaagaccagccuggucaacauggugaaacccugucucuacuaaaaauacaaaaauuagcugggcaugguggcgcacgccuguagucccagcuacucgggaggcugagacacaagaaucgcuugaaucugguaggaaacaaguugcagugagccaagaucaugccgucacacuccagccugggcaacagagcgacacaaagacaagaacaaaaacaaaacaaaacaaaacaaauaggauuauagauauaugagaggggauuuauuaggggaguuggcccgugauuauggaggcugagaagucccacaacaggccaucugcaagcuggaugccagaaguauggcucaguccaaggccgagggccugagaaacaagcaggccacugguauaagcccuagaaucuaaaagccaaagagucuggaguucugauguccaaagacaggagaagaagaauguaucccagcuucaggagagaggaaaucaccuuuuugcuccaugugggucccccacugauuguauugugccuaccuacauugauggcaugucuuccccugucaguucccugaaucacaggccaguauccucuggaaacccccucauaaaaaugcccagaaauaauccuuuaccaguucucuagauaauccuuaauccagucaaguugauaccuaaauuauuauuauuuuugugugugugauggaguuucacucuuguugcccaggcuggagugcagugacaugauuuuggcucacugcaaccuccaccucuuggauucaaaugauucugcugccucagccucccaagucgcugggauuaccgacauaugccaccauguccggcuaauuuuuguauuuuuaguagagucaggguuuccccauguuggucaggcuggucucgaacuccugaccucaggugauccaccugccuccuuugucuugcgaagugcugggauuacaggcaugagccaccaugccuggcugauacuuaaaauuaaccagcacacuuacugugucuaauuuauaaauuaaacuucaucauaguuaacauguguauaagaaaaaacauaguauauauaggguucaguaccaucugcuauuucagguauccacuggggaucuuggaacauaucauccacagguaaaaggaggcugcuguaccuccuaaaaaccugccuccaaauacagucacauuuuggguuuagggcuucaaccuaacaugaauuuggagggaucacaguuuaauccauagcaacacgcaacagucagucuuucagccucucaucuccuaacccagaaaaagcagagcuuuggaaucuuacuuuagauuauuuagauaagucaaagagaagaaugaagaggaagaagagaaagagaaguuuuauagaggaccuguacucguaacaauaacaguaaauauaaaacuacuacugucagugccaaaaaaauaaauauaugaucuuucuuaauccucaaaauagucuaauuauuuuucccaucuuacagagacacagugggagguugaguaauuugcucaaggucauccagcuaauaacugguagagcuggcauuugagcugaugcaaucuggguguacaguauaugcuucaaccacuauuuuccaccuacuccaugccugacacaugcuuucacaaaggcagucucauuuaauucuuagacuaacugcacaagauagguuuuauuuucuuuuuuuguuucacaggaagaaacuaaagcucagagagauuaagagaaucuuuguggucacacguuuaauaaaugacaaugugaggauucaaaaacagaaagggagauggaauagauucugacuuucuucagggaagcagaucaccacuuuguuacuguauuugaaagacgagcugggcacgguggcuugugcauguaauccuagcacuuugggaggccgaggugggaggaucacuugagcccaggauuucaagaccagccugggcaacauagugagaccccaucucuacaaaaaauaaaacuaaccugguaugguggcgugugccuguggucccagcuccuugggagguugagaugggagaaucgcuuggggucaagaggucaagguugcagugagccuugaucacgccauugcaccccagccugggcaauggaacaagacucugucucaaaaaaaaaaaaaaaagaccaacguggguuuaugaguacauuuaauugacaucguauagaaucagcucuauuuuccccuuguucugaacuucacugcaaaacauuuagccagaggagcucacccaaguaaaucccucaacuaaucaguuaaagaggggggaaaaaaucuaguucucaagaaaagaaggcauaaucucaguuguaagaccacuauauggggacuuuuggcaacuuuacccaguaccuuaacaucuaguaugauguuaaaaugcaugcugcacagauguuaacagauaccuauucaguaccuagaaugacacugugcuagaugcugaagaaagagaaaagcagugaaagguauaggaaaugaauaauagguuuugccaugacagucauugcuguugcauuuguggacagcuauuucauuaugcauguauugaaggucaggccuagagaggagauuagagacccuuuccagaauacuugggaacgguaugugauugagaaaugcagccaacagauuugguauucauuuguugcuuuugugcuucuuaacauauuaugaagaaucuauagaauuauuuuauuuauauuuagaaaaacaaaaacacgaauuucucuaugcgcagauaauuuuuuuuuccuuuuuuuuuuuuucuuuuuuuuuguugagacagagucucgcucugucgccaggcuggagugcaguggugcaaucucggcucacugcgaccuccaccucccagguucaagcgaugcuccugccucagccucccgaguaggugggauuacaggcacaugccaacacgccuagcuaauuuuuguauuuuuauuagagacgguguuucaccauguuggccaggauggucucgaucucuugaccucgugguccacccgccuuggccucccaaacuguugggauuacaggugugagccaccccacccggccucuuuuccuuuuuuaaauagaacuaagacaagacuuagguaguaugcacagauaauuucuaaaaggauagauaccaaacucuuuaacaguagcugcuacuuaguuggagccagggaagagagauaaucacuuucuaauuccacaugaaucuguguagguuuuuuuuaguaagccuuuauuacuuuaaaaguuauauacauauaauuauauaauuauauguauauaauuuuuaaaacauauauauaauuuaaaagacuauccuacacaacuaauaaaacuuuccucccucucuacucaacuucuagccauccaagugaaugcuagauuacaaauaauucuguguacauuuugauaauauuuuauuugauaaguucaaagcauagaacagaguuccuuuaaaagauaacaaugcauuuaaaccuuuuuauaaacacuguagucuucucaugggcuucuuucuggaggaugaauggggaguaacccagggacaccacuccuaagugcuuagacuagaaaugguggggagucagaaaagaacuguuuauggugaaauaaaacaaagaaggcugggcgugguggcuuauuccuguaaucccagcacuuugggaggccgaggugggcggaugaccugaagucaggaguucaaggccagccugaccaacauagagaaaccgcauuucuacuaaaaauacaaaauuagcuuggggugauggcgcaugccuggcugaggcggguggaucacaaggucaggaugcgccaucacgcccaguuacccgggaggcugaggcaagagaauagcuugaacccgggaggcggagguugcagugagccgagaucacaccauugcacuccagccuggacaacacgagggaaacuccgucucaaaaaaacaaacaaacaacaacaacaacaaaaacguaaaacaaacaagaucccuccaauuaaaacccaugccuauuaaagugcaugggggcccaaugaccuacuguuuggcaaaacuugaaggucuaaaagcuguucauggucaaagaaacaauuuauaguugaggugauggauaugauaaauagccugauuugaucaaccuacaauguauacuuacaucaaaauaucacauuguaccccauaaauauauacaauuauuacuuuuuuaaaagauuuuuuaaaacuuuuuaaaaauacacacaaaaagcaguuuguggucuaauuucuuuuuccuugcucagccucaucuuuuagcaccuguuuauacacauaucaccucuauucuuguaacaaaaauagguagaacuggccagacacaguggcucaugccuguaaucccagcacuuugggagaccaagaugggaggcucaauaguuugagcccaggaauucaagaccagccagggcaacacaccagacccuaucccuacuaaaaauuaaaaauuagccaggcaugcugcacaccaguaguucuaggaacuuaggaggcugaggcaggaggaucauuugagcccaggaguucaaggcugcaauuagugaugaucaugccacuguacucccacuuaggugacaaaacgagacuuugucuaaguaaaaaaaaaaaaauaggacgucccaguaccccaaucuaugucucuccucuccaucucccaguccauauuuaagcugugccucaaauauaccaugcugucuaaugcauccacaccuuugcaugugcuagucccuccucuaacacacuuccacauuuuccaacgcccuucaucuugucccucuagcaaccuucuguuuauucuucaaaagaauuaucuuagaucccauggcaucaucccuaauuugccccagguuuucuuggacacuuuuguuacauucccauuguuccacuguauucuagcauauacaccaauuuuuuuuucuuuuuuucuuuucuuuuuugagauagaguuucguucuuauugccuaggcuagagugcaauggcgugaucucagcucaaugcaaccucugccucccggguucaagcgauucuccuaccucagccucccgaguagcugggauuacaggcaugcgccaccacaccuggcuaauuuuguauuuuuaguagagaugagguuucuccauguuguuaaggcuggucucgaacucgcgaccucagguaauccgcccaccucggccucccaaaguacugggauuacaggcgugagccaccgcaccuggcauauacaugaauuuuuuuguuuguuugguugguuguuuuuuuguuuuguuuuuuuugagauagagucuugcucugucacccaggcuggaaugcaguggcgcuaucucgacucacugcaagcuucgccucccagguucacgccauucuccugccucagccuccugaguagcugggacuacaggcgcccaccaccacguccggcuaauuuuuuguauuuuuaguagaaacgguuucacuguguuagccaggauggucucaaucuccugaccucaugauccacccgccucggccucucaaagugcugggauuacaggcuugagccaccaugccuggcccauauacacuaguuuuuuacuguaggccguaaggcccuuugaacccucgauauauaauacuugcucaauuauguuuguuuaguaaaggaaugauuccauuugcaccauaaacucucuuccugugaccagcauaugaauguguguguggucucuaagaacucgaaugaugccuaagcuauccaacccacuuuccucaguuuuuauuuacgcagaaauugaaauuaacaaacuaauuucugagucuuaagugaaauuguuuucguuuuauuuaaaguuacccuugacuuacauaguuuuaaccuucuggaaaguucuucuuuuuucucucucucuuccuguuccugauugccacacuggauagaaaguucuaaaugaauacuuagguuugaaaguauuuuucuacaucuauuuauuuugccauucuacagauuuggcuccauuguccuaagguuucagcacaauaaaaaucucguuucucccagugcuugucuugacaucaauguagcauuaaaaaguccaagacuuuuacagacuaauuuaagcugaacaaggaaauauaaucugguaccuacuaagaaacauaaaugggccuggguugcuagcaguuccuggaagucacuguguuuuccaauaaauccaugcaaaucguaacagggaaagagaagccacaaagcagaggcugggacuguugggaucauguuaguaauuaaacucucucuccucuugagacucagugagagccuuccccuuacaaaaaaacaaaaaagaccauagcuugcugccaaagcggaucugaccacgcguccucucacucuaagagauuaaaauaaagccuccugcaguccuuuucuccaaauacacaaagaaguggcugggcugaggcucaagggcacaguuccagucccuguuggcaagagaagggcagggcucugguucucccaaagggugcaaaggacaagaauguuuccuagaaaagaaaccagggaaggagaccaaaguagaccuagcugauauggagcuguuaugugaaaacugaaagcugcuucgauacuacuucaaagccagauuauucugggaacugaagggagacugagccuucaaguaauaugacuagggaagucaaguacaaaaaaaaaagugagaccaggaaggaacaaagcaugcauuuggagcuaauaccacucauuggaagagguuguuuggaaaagguuugcaaauaccacaaaaaugggauucaaagugucuuuauguauugugauauucauugcagcacuauuuauaauagcaaaaaacugguagcaacugaaacaucuagcaguaggugaacuguuuuauagccauggucuagaacauuaaaccacaauuuaaaguuuucugugcauauuuaauaacccaagaagauguucauaauauaauauugaggguuuuuuuguuguuuguuuguuuguuuguuugagacggagucucacacugucaccugggcuagagugcaauggcaugaucucggcucacugcaaccuccaccucccgauuccucugccucagcuucaagcgauuccucugccucagccucccgaguagcugggacuacaguugcaugccaccacgcccggcuaauuguguauuuuuuaguagagaugcgguuucacuauguuggccaggcuggucucaaacuccugaucucgugaucugccugccucagccucccaaagugcuaggauuacaggcgugagccaccgcgcccagccguuuuucacccuuuauaguuguuuuuuguuuguuuuguuuuuuguguguuuguuuguuuguuuguuuuugagacaggguaucacucugucacuggagugcaguggugcagccuugacucacugcagccucugccuccugggcucaagugauccucagccucccaaguagcugggacuauaggcaugcucuaccacacuaggguaauuuuuguguuuuuaguagagaugaguuuugccauguugccuaggcuggucuugaacucuuugggcucaaaugaucugcccacuucagccuccuaaagugcuaggauugcaggcgugagccaccaugccagccagucucuuuuuaagacccucuuccugaucauuugagcccaggaagucgaggccgcaaugagccaugcacuccacugccacugcacucuagccuggacaacagagauccugucucaaaaaaaauuaauguccuuaaaaaacaaacaacagaccaggcacgguggcucaugccuguaaucccagcacuuugggagacugaggcagguugaucaccugaggucaggaguucgagacuagccuggccaacauggugaaaccccgucucuacuaaaaauacaaaaauuagccaggccuggcggcgggcgccuguaaucccagcuacucaggaggcugaggcaggagaaucgcuugaacccaggaggcggagguugcagugaguugagaucacaccauugcacuccagcuugggcgacaagaguaaaacuccaucuaaaaaaaaagaaaaacccaaacaaaaagaacacuaguugccucugaagauggugagccucugaagaugccucugaggcucaauuuugagggaauucuauauccuguuaaaaguccaaggugcagcauguaccagauggcuguaugcccuccucuuucuggggcaggguugacaguaauaggcaggaauguaucauauauauguaucauauauuuugugguuuucagcaguggguuuuuuuuuuccuuucuuaauagaaauugaugcuauuuaauuuuuauaccuuuuguuguuguuuuuaaugggguuugagagaagagaguaaagugaaaaugucacuaguccuuuaauuagaaguccauauuuccaccgggcacgguggcuuaugccuguaaucccagcacuuugggaggccaaggcgggcggaucacuugaggucaggaauuugagagcagccuggccaacauggugaaaccccaucucuacuaaaaauacaaauuaacuggguguuguggcgggcaccuguaaucccagcuacuugggagguugaggugggagaaucgcuugaaccugggaggcugagguugcagugaguugagauagcgccacugcacuccagccugggccacaggagcaaaacuuugucagaaagaaagagagagagagagagagagagagagagagagaaagagagagagagagagagagaaagagagagagagaaagagagagagagagagagaaaacucggaaguagacuuuuuuuuucuuuuuuuuuuuuuuagauggagucuugcucugucgcccaggcuggagugcaguggcgugaucuuggcucacugcaaccucugccucccagguucaagcaauucuucugccucugccucccaaguagcugggacuacaggugccugccaccacaccuggcuaauuuuuguauuuuuaguagagacggcauuuugcgauaucggccaggcuggucucgaacuccugaccuccugaucugcccgccucggccucccaaagugcugggauuacaggugugagccaccucaccuggccucuuuuauuuuuauuuuuauuuauuuauuuauuuauuuauuuugagacaaaguuuugcugcuguugcccaggcuggagugcaauggugcaaucucagcucacugcaaccuccgccucccgggcccaagcgauucuccugccucagccuccggaguagcuaggauuacaggcaugcaccaccaugcccagcuaauuuuauuuuuaguagagaugggauuucuccauguuggucaggcuggucucguacuccugaccucaggugauugaccugccuuggcuucccaaagugcuaggauuaaaggugugagccaccacguccagccuggaaguagacauuuuuuuauuaaccaaaaugaauuuaguuagcucaccauugccucuacaaaaauuguacugggaccaaaaacuuuguauaugagacaacaaauuuucuaaaaugcaaaucuuaaagacaaauaauguuaguguccagaagaaagguuauugggucagucuuucagauuauuuccccauaacaccaaguuccaaaaaacaauuucuagucauuugugggaugcuccagagagcccuugggacaaguaaaguugcagcuguuuguguguguuguaauucaagaugauguguugcuacaucuacuaguuugguacaacuguuaugaucagauagaccuaguuccuuaaggcugagacacaacagucugguuucuguaauggaaggaugaguaggcuuuauucuguuuuguugcuuuuuuucuuucuuucuuuuaaauaauacauucuaagccucgauccuggacuuugcaggaaaaaaaaaaaaaagaauaauacauucuacccucacauauagucaauugauuuucaacaauggugccaagacaauucauggggaaagaauacucuuuucaacaaauggugauggaacauccacaugcaaaauaaugaaguugacuuugggaggccgaggcaggaggaucauuugaaccuagggaguuugagaacagccaaggcaacagagugagacccugucucuauucaaaaaaacaaaaagaaagaaagaaaaaagaaugaagcuggacuccucccucacaccacacacaaaaauuaucucaaaaaaaaaucuaaauauaaagacuaaaacuauaaaauucuuaaaagaaaauauaggaaucuucuugagcuuggauuugcugaugauuuugauggcagcagcggccuguuuggagugguggcuacugccaugacaccagcauugaggggacuggugggggagugggcauggcuggggcugcacacuccauggagccaacggaagccaagaacaggcgggagcccuacucccuucugaguuggcagggccagugcagcugcagccaaccagcuguagcuguggacccaggcaucccugcacucuugacucaggaagcccccugcccccacaggcucaaaaaugccugcucccacugccuggccucuuccuguuccuggugcccgcuccaauuuuggagcaaaguugaggcugagcccaggcacugucgcaaccugccacagugcacgcaugcucagggcagcacugauacaccagcccccugccaacuuggcccucucugggcuuugggcagagaugagcacaagugggaggccgagggggugcugagggcagcucaccaugggccugcaggcaccccuuggcacaaacagccuuggugccauggacacuuggauggcagauugauggcagcaggaggcagacaggcucguggacugaaaggggcaggugcccgaugaagccccaccuucaagccagugacagccugaagccugugggcugggcugccaguuccauggacuggagugagaacuuauggugcuuuuucuggaccugcccauggcaaaccauggaccaauucagcacucauuuccuccccucugaagcccauaaaaaccucagucucagccagauucaggcagacaacaggaagaccugccugcuguuaggagcuacucacuccaugucucuucuccacuaagggcugcagagaugaugggaugauuugccugcgaauaggagcuacccacuccaggucuccugucugcugagggcugcacagacauugggaugaccugccuguggaagggagcuacucacugcaggucucuucuccucugacagcuggauacucguugggaugaccugcuugcagaaaggagcuacccacuuugggucuccugagaaugguucugccucucagugaagcuccucucuaucuugcucacccucuaguuguccguguacuucauucuuccuggacagggaacaaaaacucaggaccugccaaauagcggcuaaaagagcuguaauacagccggucacaguggcucacaccuguaaucccagcacuuugggaggcugaggugggcagaucaggaggucaggaguuugagaccagccugaccaacauggugaaacccccgucucuacuaaaaauacaaaaauuagcugggcaugguggcacaugccuguaaucucagcugcucaggagucugaggcaggagaauugcuugaacccaggaggcagagguugcagugagccaagaucaugcuacugcacuucagccugggcaacagagugggacucuaucucaaaaaaaaaaaaaaaaaagagcuguaauacaaauagggcugaaacauaucccucugcuugccacauucccagcaacaagaagaaaagaacugcagcccuuuggagagcccggcccaggcuguugcguugccugcugggcugagugggcagaacaaacccagugggugcaagcaauacucaggcagaaggcaucacuggccacagagguuucuagcuggcgaagcaacaccccaaggauccugugacaauuuauugaauaugacaccaaaacaguaaucaacaaaagaaaaaauagauaaauuggacuuugucaaaauuaaaaacuuuuaugcaucaaaggacacuaucaagagugaaaagacaaucuaaagaaugggagaaaauguuuacaagccacauagcucaucagggauugauauucagaauauauaaagaagucuuacaacaaaaagacaaaaaauagggugggcacagugguucacaccuguaaucccaauacucuggaggcagagagaauaauaauacauuauuauuauugcuugaagccaggaguuugagacccgccuggaauuugagacagggaugaucccuccaccucagugccucccaaguagcugagacuacaagugcgcaccaccaugccuggcuaauuuuuuuguauuuuuuguagauaugagguuucaccauguugcccaggcuggucucgaccucugaggcucaagugaucugccugccucagccucccaaaaugcuaggauuauaggugucagcuaccaaguauggcucaaaaaguaauuuaaaaauuauuaaaauugccacuguggccaggcaugguggcucaugccuguaaucccagcacuuugggaggccaaggccggcagaucacuugaagccaggaguucaagaccagccuggucgacauggugaaauuccaucucuacuaaaaauacaaaaauuagccgggugugguggugcgcaccuguaaucccaucuacucaagaggcugaggcgggagaaucacuugaacccgggaagcagagguugcagugaggcaagaucacaccacugcacugcagucugggcaacagagugacacccugucucaagagaaaaaagacaauccaauugaaaaacaggcgaaggacuugaguaggcauuucuccaaagaagguaucaaaugggccaaauggccccaaaucacaugaaaacauguucaacaucauaagucauuaguggaaugcaaauccaaaccacagugagaugccacucacaccuacauaaauuuuuuaaaggaaaaauaaaaguguucgugugaaugcugagauauuggaacccuaauacauugcugguaggcaagaaaaaugaugcagccaccacagaaaacaguucggcgguuccucaaaaacuuaaaaauaaacaccaaauacaaaugguuugugucuguaaccccagcuacuugggagacugaggcaggaggauuauuugaggcuaguucaagaccagccucagcaacauagugaaaccccaucucuaaaaaaaauaaaaauuaaaaauaaacauagaauuaccacaugacuagcaauucucuuucuagguaaaugccuaaaagaauugaaaauaauaauucaaacaaaaacuuguauaugaauguucauagcaacacuauucacacuagccaacagguagaaacaaccaaaauguuugucacugaugaguggauaaacaaaauguaguauguuaauacaauuagaauauuauuuagccauaaaaaggaagaaaauacugauugaugcuguagcauggaugaaccuggaaaacauuaugcuaagugaaauaaauuagacacaaaaagcuacauaggauuccauuuauauuaaaugcccagaagaagcaaauccauagaaacagaguauauaaguguuugccagggguugggaggagggaaaaaugggguuuauuauaauaugguuuauuugggggggggggaugaaaauguucuagauuugauaauugauugugguaauggcugcacagcucugugaacuuacuaaaaaauugaauuguacaguuucuuuuauuucauugagauaggaucucgcucccaggcuggagugcaguggcuuagucacagcucauggcagccucaaacuccugggcuaaagugauccuccugccucagccuacagaguagcugggacuacaggcacacacuaccaugccuggcuaauuauuuuuauuuuuaguagauaugaggucucacuauguuguccagucuggucucaaacucaugacugcaagcgauccuuaugccuuggccucccaaauuacaguugugagccaccacaacuggccaaauuauacacuuuguuuuauugguuuuuuuuuguuuguuuuguuuagguuuuuuuuuguuuuuuguuuucuuaaacgaagucucgcucuguugcccaggcuggagugcaguggcgugaucucggcucaaugcaaccucugcuuuccggauucaagcaauucuccugcucagccucccaaguagcugggacuacagugugcaccaccacgcccagcuaauuuuuguauuuuuaguagaggcaggguuucaccauauuggccaggauggucuugaucuccugaccucaugaucugcccaucucggccucccagagugcugggauuacaggugugagccaccacacccagccuguaaauguugacuuuuuuuuuuuuuuuuuuuuuuuuugagacagaguuucacucuuguugcccaggcuggagugcaauggcaagguaucagcucacugcaaccucugccuccugaguucaagcgauucuccugccucagccucccgaguagcugggauuacaggugcccccaccaccacuccuggcugauuuuuuuuuuuuuuuuuuuuuugagacagucucauucuguugcccaggcuggagugcaauggcgugaucuuggcucacugcaaccucugcuuccuggguuuaagcaauuauucugccucagccucccaaguagcugggauuacaggugccugcuaucacacccagcuaauuuuuauauuuuuaguagagauggggucauguuggccaggcuggucuugaacuccugaccucaagugauccauccgccucagccucccaaagugcugggauuacaggcaugagucucuggguauggccuuaaucuuuuguauuuuuaguagagacgagguuucaccauguuggccaggcuggucucgaacuccugaccucaggugauccacccaccucggccucccaaaguucugagauuacaggugugaaccaccacacauggccuauauaaauugacucuuaauaccagaaacagauuagcugcucuagaaaauaacugccuagcucuuugaaaugccucaccuagaauguccucacaaggaguuuuguguaugccauguaaccuuuaagucaaacuagucuucccaaacacaucgucauuauuauuauuauuauuauuauuauuauuauuauuauuauuauuauuauuuugagacagagucucacucuugcccaggcuggagugcaguggcgugaucucagcucacugcagguuacucacugcaaccucugccucccugguucaagugauucuccugccucagccucccaaguagcugggauuacaggugcccaccaccacgucuggcuaauggggguuucaccguguuggccaggcuggucuggaacuccugaccucaggugacccgcccuccucugccucccaaagugcugggauuacaggcgugagccaccgcgccuggcuacuuuccauauuauugaaaugugauguagucauuuucacaugacaaugugaauaaagagacaaacuuaguuuuauaauguuucacaucaauuuauauaaugcuuauaguccuucuaagaggguaaaggccuuugugaggaaucagccaacuggcugcagaguagugguauuauuuuuuucuguaugagaagggaagugacacugugucauugugagguaacagaaagggauuuggagaagaacaccuaggaauaaagggaauaguguuaccuuaagacuaacacuuagggauauaugguaagguaacuaacggugaccuuaagggugcugauuaggucacauucauaaauggguggggagugaugccaaagggcacauagugagcaaguuguggucacgaggugauuaggacagaugauuuagggcuggagacuccuguggguguuaacaugaugacugcauaggugcucaagacugcccaugguggaguauuaguccccacaaccuaacuggcaucaagaaucagggaaaccagaccaggcgcgguggcucaugccuguaaucccagcacuuugggaggcugaggugggcagaucaugaggugaggaguucgagaccaaccuggccaacauagugaaaccccucucuacuaaaaauacaaaaauuagcugggaaucguggcacgugccuguagucccagcuacuugggaggcugaggcaggagaaucgcuugaacccaggaggcagagguugcaaugagccaagaucgcaccacugcacucguagcaugggcaacagagcgagacuccguauuaaaaaaaaaaaaaucaaggaaacuuucuuagaaacagcugggucuuaauagucucaacaaguuaaggagaguuucugggcuucagaccccgcauuuccccccaugcccugaagagcauuauagacccuguacuuuaagaagaguaaaaguccugaguauccuguuaggaaucaucccaucccugggcagcuucuccucaguacuaaccaugaggaaggggaacugagggcccuuucacccagagaggacucuucauccugaagagaagugagaggacaugucugaaaaacacaccaagauaaaguaucuggcugucaugacucuuucuagaaaaaucucagugcuguuuuacauaaccucauucaucuccagaauuagaaugaguaucuucuggccuggugugguggcucacaccuguaaucccggcacuuugggaggcugaggcaggcggaucaccugaagucagugguucaagagcagccuggccaacauggugaaaacccaucucuacaaaaauacaaaaauuagcccugcaugaugggggaggcuaaggcggaagaaucgcuugaaccugagagagggagcuugcagugagccgagaucgcgccauugcacuccagacugggcaacagagcgagacuccaucucaaaaaaaaaaaaaaaaaaaagaaugaauaucuucuauuacuucauuuauugugccagguacucuuacucuugggcaacugaaaucauggcuucauaucuaugaauugagugaggugguacucacaucaccagccucuuauguugaccgaaucaagaccuuuaacugccuaguagacugacuuacaaguggagcugcucaacagauaauaguuucuuuuuuuuucuagacgggagucucgcucuguugcccaagguggagugcaguggcgcuaucucggcucacugcaagcuccgcgucccagguucaugccauucuccugccucagccuccugaguagcugggaauacaggcgcccgccaccaugcccagcuaauuuuuuuuguauuuuuaguagagacgggguuucaccguguuagccaggauggucucgaucuccugaccucgugauuugccugccucagccucccaaagugcugggauuacaggcgugagccaccacgccuugcucuuuuuuuuuggggggggggggguugucguggaaauuaaguuuaugaaucuccuugaucucugaauuauuccaaacagcaccaucccagcaauuccuuuuaauuguuuuuagaacuacaguugaccuuugaacaaugagaggguuagggugccaacucccaccaaugcagcugaaaaucuacauaaaagauuagauuccccaaaccacuaguagccuauugaccagaagccuucuugauaaccuaaacaauuaacacauauuuuguaucuuuaucauauacuguauuuuuacaauaaaguaagcuagagaaaagaaauguuauuaagaaaaucauaaggaagaguaaguguauuuacuauucaugaaguggaaauggaucaucaugaaggucuucaucccugucuucacauugaguaggcuaucuugcugucucagggguggcagaggcggaagagguggaggaaguggauggggaggcggaagagguggaggaaguggaugggaaggcgggagaggcaggcacacuugguguaacuuuuguugaaaaaauaucuuuguauaaguggacccacgcaguucaaacguguuguucaagggucaacuguggucauauugucgggguucuuuagccauuaggucucagaaauuagccugaauuuagccagacauaguagcacacgccuauaguuccagcugcuugagaggcugaggcgggaagaucacuugaacccagacugcagugggcuaugauggugucacugcacuccagccuggguaacacagugagacuccauaucaaaaaaaagaaaaaaagaaaaaaaaaagaaaaggaaagaaauuaacccgaauuugugguuucuaacuuggcaauuagucuuucuuugaccccaaguuuagacucaauaucuucacuaagagccagcccagggggugcaacuuggagcaccagaauguuuguguaauacuagccaugguaaagaaggugucccaggcucuccugguggaggcaggcucugcucuacuuaacucuacuccaggcaagagcagacaaagagcagacucuuuagacugguaagcagaacagacucgucccucaaggagcucccagaccagggaggggaggagacuguaaauauucaccaugccgugguaacagcagagauggagcacaaggggaaguucagagaaagaucucagaagagagguacuuugucuaaccugagauuuagggaaaguucuccugaagaugaugacuggucuacaugaccugagccgagaugggaaugaguugaaagguaggcuugugaagaagcaggagaagagcauuauagauagaaaacucaaaggcaucagaggccccaagcugcaugcuaugauauugggauaauaguaguacaaacauagugcaagacagugguguaaagugagauauuugcuucugagccauuucccuucuguugccacuuccucuuccucuuuuaagugaaacauuacuagcagccuaauaauuaucauagcugacauauauuagguguuuuuuguuuuguuuuguuuguuuuguuuuucuugagaugaagucucgcucuuguugcccagacuggacugcaauggugccaucuugguucacugcaaccucugcccccuggguucaagcgauucuccuaccuuagccuccugaguagcugggauuacaggcgccugccaccaugccugacuaguuuuuuguauuuuuaguagagaugggguuucaccauguuggccaggcuggucucgaacuccugaccucaagugauccacccaccucagccucccaaagugcugaaauuacaggcaugagccacugcgccuggcguuuuuuuguuguucuuguuauuuguuuuuuuagaugggagucuuguucugucgcccaggcuggagugcaguggcgcaauuucggcucacuguagccucugccuccaggauucaagcaauucuccugccucagccuccugaguagcugggacuacaggcgcgugccaccacgccuggcuauuuuuuuguauuuuuaguagagacaggguuuuaccauguuggccaagauggucuugaucuccugaccuaaugaucugcccgccucagccucccaaagugcugggauuacaugcguaagcaaccaugcccagccagguuuuuacucuguccaacucuauucuacaucccuuaaauuuauuaacuuguuaaauucucuaggaguaaaugcugucauuacucccauuuuacagaugaggaaacugagucgggggagauuaaguaacuucucaaagguacacauagggccauguggucugucaucucugcuuuagcugacacauauggccucuauagccuaggcuuuacauggccagucuccauccagacugacuagagugguguuuuguaaaauauagagguugaucugcagccuaggugcaauagaauuaccuggggcaggccaggcacuguggcucaugccugcaaucccagcacuuugggaggcugaggcagguggaucaucugcagucaggaguucgagaccagccuggccaacauggugaaaccccgucucuacuaaaaauacaaaaaaaauuagcuggguguguuggcaugugccgguaaucccagcuacucgggaggcugagguaggagaauugcuuaaauccaggaggcuaggguugcagugagccuagaucacccacugcacuccagccugguaacacagcgagacuccgucucaaaaaaaaaaaaaaaaaauuagaauuaccuggggcauuugauaaaacacagauaccuaggcuccacuguacucugcaugaaucuaauggggugggugauuaagaaccugaauuuuuuuuuuugaacuccccagaugauccuaaggcacaguaauguuugggaaccucugggcuggagucucuggguugaaauccaaguuuuguucuguuuuuuuuaagaaugagucauugcaucuuucaaguauucaaccaagauugucuucauaaucuuacacuucauucaucugucuuuacaaaguuacagagcugaagccauauccuguuucuucagcacucaucuauacuuuaaaaauucuaggccaggcauggugggucacgccuguaaucucagcacuuugggaggccgaggcgggcagaucaccugaggucaggaguucgagaccagccugcccaacaucugcgaaaugcugucucuacuaaaaauacaaaaaauuagcugggcaugguggugggcaccuguaaucccagcuacucaggaggcugaggcaggagaauugcuugaacccaggaggcggagguugcagugagccgagcuugcaccacugcacuccagccugggugacaagagcgaaacuccaugucaaaaaaaaaaaaaauucuaaucagaugccagucucacugucauucuccaaucuucccacuauaacauauuuaguucauuguccugcccguguucuaauuuugcaguuuuccuagacugauccucugugauccaacaauuaauuauaaauuauuaauuauaaauuaauuaauuauaaauuaauaaaaauugugaucccacaauuaauuucaaauuuauuaaauagaaccugagaaaaaauuaugcaguauuuuuuucauuagaugauugucagccuccuaccaacaagcauaugcuagauguuacccaugaaaacuuaaguagucaggccaggcacaguggcucacgccuguaaucccagcacuuuaggagauugagguaggcggaucaccugaggcuaggaguuugagaccagccuggccgacauggugaaaccccaucucuacuaaaaauacaaaaauuagccgggugugguggcgggcaccuguaaucccagcuacucgggaggcugaggagaaucacuugaacccgggaggcagagguugcagugagccgagaucgcgcaacugcauuccagccugugcgacagagcgagacugucucaaaaaaaaaaaaagagaaaaggaaaaguagucaugaucccucccuuggacucauuuccaguguaaagguuauuaaccuuuuuguaauugggauguauuaugaaugacugcucaauucaacaauguaccuuuuuccucaguaauuccuaaagaagucauagaauguauguauuucuuuauugaauaaagucuauuaaaauuauugugauucuaaggcaucuuagggaauuucauuaugucuccuaaagcuagacucaaaaauagaauuaggaauuauucuucuuuagcaaccuucauuaugucucuuaaagcuagacucaaaaauauaauuaggaauuauucuucuguagcaaccucaagcaguccaggaucaguccucagcuccaccuuuugugacagugggcaggcacauucaugcucugacccucaggcuucucuucaucaaauaggagccuuguguuagauuaucucugagguuuuuucacaacuagcauuuugugguucaauaaacagaauaauuguccugcaaauagguacguacccuaaauaggguuacagauaaaauacaaagugccuaacuaaauuuuaguuucagauaaacaauaauuuuuuaauguuaagugugucccaaauuucacauagaacacuuuuuuuuuuuuugagauggaguuuugcucugucgcccaugcuggagugcaguggugcaaucuuggcuuaccgcaaccuccaccuccuggguucaagcaauucuucugccucagccuccugaguagcugggacuacaggcgcacaccaccacacccagcuaauuuuuguauuuuuaguagagaugggguuucaccauauuggccaggcuggucucaaacuccugaccucauggucugcccgccucagccucccaaagugcugggauuacaggcgugaaccacugugcccggccagaacauaauuauacuaaaaaauuauucacuuguuuaucugaaauucaaauuuuauuuuauuuuauuuucauuauuuuuugagacauaguuuccucugucucccaggcugguuucaaacuccuggccucaagcaaucuucccaccuuggcccccgcaaagcacugugauuauaaguaugagccuccauccaugcccagcuuaaaaucaaauuuuaacuggcaucugcuauuggcaacccuaaccccaaagccauugcuuuuuaucccauuuugugaaagucagugucacuauuucccuacugugagcuugcuuauuucugccuuuuauccuuagccugaaacaaguugugaauaucaaauuuccacucacuccauugcuuuaccuaugaaauaaauucccagaacuuagaauaguuaacagcaaucuguuuccuagaacuagcugccaggacuacaccuggacaucuguuauuuacagccucauuauugacauuuugucaauaguucugaccuaugccauguaaucuguuauagucauagcaugccuuccuggaaauuuucauuugccucuauuccuauuguauuauuuggguucuuuccauauuuguuuguucaagauucucucaucauuaaaaacaaauaaacaaaaaccucuacuuaacccuccucaucccauuacugcucuacuucucuuccuucauaaccaaguauuaucuacaugcauugucuucacauccuguuauuaauuccccaaugcauuaaauucuggcucaucguccuacuacuucucgcugccauugaagcuccucuuuccagagucacugguuacuuccuauuugugaaaucaguaggaagcuuuucagucccaguccuacuggaccucucagcagcucuggccaaugcugaccacucccccaauccagaaaccacucuuggcuucuguaacagucccuggcuccagcuguccuccuaccuccuuacuucccuggccacuugggucggucaccuucagccauucuugucaucugccugguccucuaugauucucaguguucgaugcacacucuguaguugugauugagguauuuacaaaaaacuggugccccacugagccagguucacguggaaguugggaugaaacaggauucugagaggacaugggaggaacauggguuucacuuuguuucuuuauuaaucuuugaaauguguuuguuuauucauuuagcacucauuuuuugagcauauacuauaucucaaauaucagguccuaggaguacaaaauggcaagucaaguccuugcccucaaggagcuugcagucuaggaaaagccaacaaaccaacuaaugaugugaggacagcacacaaagguaccauggacucagaugcaggagccaggaaagacacuagagacagguugccugugaucugagcuuuaagagacaaguaggaauuagccaggugcauuccauaugaguucuuccagauagcuggaguccacaugccugagggaauaugacagaagaucaagugagggagccaggcaaaugccagaucacaaagaccaugugucaggugaagguuauggaauugaaaugucuuaaaacuauaaggagcuuugaaguacgucaaaaugggcaauaaauugaucugauuuucauuuuagaaagacuucuuuugacaacacuguggaaagcagcuugggaagggggcuccagacuuggugcaguggaaccaauagguauggucacgugagaaaucagagucagaaaaaaaagcaguggcaggggaaauugagaggagauaguuucuagugcugcuacagagguagcuauucuaaggcuugaugaccaauugguugucaaagauaagagggaggaaaaaaaacaaagggucucccagaugugugcauuuagugacugcauaaugcaucaccuccacuaaaugauucaucuguucuucaucccuguuagucuggacaccaaaaauaucacucugccuaaaggggggaaacauuucuuugagggaaaacccuuuugcccuauagcuaaacuaagccauuggaaacuuuuuagggcagaaaugucagaggcaugaacagggcuucuggaggagggugaggucuccagguucuccuggcuagugaagaggcucauguucucauuagcaaacugauggccuccaucgauggccgugauacucacagggcgugguucaaagccccagaucaucagggcuucuagagucuacuuaaucaggacaggcauuuauuuaaagugcucugaagcuaacugucacaaauagggaaccuuaguacuggucaguugggaaccaagguuauuaccaagaagauagugucaggugucaaguguggaagucaggacaaggccagauguaggagauaagagugaaaccagacgugagaagguuggagcguguaaaggaaaugggucacaggacaagcaguucagaccugaggccaagaagaggaaggcaagaguucucuugcggaucucagcuagaaaacauugcuguagaacauaggucacuuuguuuguuuguuuauuuauuuauuuauuuuaagcaaaagcaaguuuauuaaggaaguaaaggaggccgggugcggugacucacaccuguaaucccagcacuuugggaggccgaggcggguggaucaccugaggucaggaguucgagaucagccuggccaacauggugaaaccucgucucuacuaaaaauacuaaaauuagccgggcgugguggcagccaccuguaaucucagcuacuugggaggcugaggcaggagaaucgcuugaacccgggaggcagagguugcauugagcugagauagccccauggcacucuagccugggggacaagagcaagacuacgucucaaaaaaaaaaagaaaguaaagggauaggccgggcacuauggcucacuccuguaauaucagcguuuuaggaggccgaggggggcggaucaccuaaggucaggaguuugagaccagccuggccaacauggcaaaaccccgucucuacuaaauauacaaaaauuagccgagugugguggcuugcgccuguaauccuagcuacucaggaggcuggggcaggagaauggcuggaacccgggaggcagaggcugcagugagcugagaucacaccacugcaccccagccugggcaacagagcaagacuccgucucaaaaaaaaaaaaagaaaagaaagaaaguaaaggaauaaagaauggcuguuccaccggccagcaaagugggaugcuccacuaaggacacuuacagucauuuucugauuauacucuaaacaagggcuggcuuauugaguuuucugggaaagaggugggcaauucccagaacugaggguuccucccauuuuagaccauagagcguaacuuccugacguugcuauggcauuuguaaacugucaguggcacuggugggagugucuuuuagcaugcugaugcauuauaauuagcguauaaugagcaaugagaaccaccagaggucacuuucauugccaucuugguuuuggugggauuuuggugggauuuuuauugcagguuguuuuaucaguaaggucuuuaugacguguauuuugugcugaccuccuaucucauccuauaaguaagaaugcuaaccuccugggaaugcaacccaguaggucucugccuuauuuuagccagccccuauucaagauggaauugcugugguucaaaugccucugacauauuucaccccuuccuuuuauaagagaacccuuaauccuaagggcuguagagggaugaagauccaucuucugugacuucuucaggcugaauaggggcaaugauauuacugccuauuagggucucuuguauuugggguagagaggagcucugucagaaagugucaguauggaggcugggugcaguggcuuacaccuauaaucccagugcuuugggaggccaaggcaggcagaucacuugacaucaggagcucaagaccagccugggcaacauggugaaacccugucucuacuacaaauauaaaaauuagccaggugugguggugggugccuguaaucacagcuacucaagaggcugcggcaggagaaucauuugaacccaggagguggaguuugcagugagccgagaucaggccacugcacuccagucugggugacagagugagacucugucucaaaaaaagagaaagaaagcgucauuauggugagggccauuuauaacucugacaaaaggugauaucugaaagauuaauaaguguucaauuuaagaaaacauucaguaagcuuauccugcauuccuacacaaagaguacaacagcaacacauuccacaaugguaaagcaaaauaaguaaaauuauucaaaguaaacuaaauaagaagucuuuccaugaacugggcaauuguugaaaccaaguugauauggggucacuagcuuauuccaauaugugcccagaauuagaauauugauccagauuuuuacauuaucuaucccucuuguuucuucuaaguagcagccagagaucacugguugguucucaggaauaagcagucaguuuaaauugcagaaaaaaaacuuaaaaacuacugauaagacuagacucuggccgggugugguggcucacaccuauaaucccagcacuuugggaggccaaggcggguggaucaccugaggucaagaguuugagaccagccuagccaacauggcgaaacucugucucuaugaaaaguacaaaaauuaacugggcaggcgugguggcgggcaccuguaaucccagauacucaggaggcugaggcaggagaaucacuugaaccugggagguggagguugcaguaaggcacaauugugccacugcacuccagccugggugacaagagugagacuccaucucaaaaaauaaaauaaaauaaaaugacuagacucugauaacaugcguaccauaguuuuugaaacauaacguuuuucucuccagucucccauuuuuacuaaagacaaaucaugguaacugauuugcuuuguuauacuuggccucauuauuuguauaaagugcagcaacaauaauuauuuuucacauaggcuuuuaaaaucagcuuugauggaauuuuguuccuuagaaggaaucucagauaagacuuuuuuaaagcugagcccagccaugggucuguacccucaaauaucuauaugaguuggguaaauuucucucuucuugagaucccaagauaacuuggggcuccuggacuugucauaaagugacauucuuuacuuaccacaggucaagaacccuguacagggacuacguagacaauguaugaggccaguuuuccuaaggggcuuuuauuggcacuguaagucaaguuugauuccuuaaaggaaagagugucauuccagucaaagccuuggugaaaaaaaaguuucuccaauuguguucugauacaaaagaaaacauucuuauugcauuuaugcaaauaauuauauugccauaaguuaaaaaugcucacaaaugguuucugaauuuuggagaaauugggcagagagaaacaaauaugcuucaaauuuuguucacaggaguauacuuuacucaauuguuaaaagcuguuaauagcucaaaagaaaaauuuccuuggcucugaaaaacaaaagaaaggaucagcaacguuuuaagccaaaaguuaaaaaaagauugcuucagucuucuguuaggucaauccaugcaguuaacuccuguuuugcuugauauucaugaacauuucagcucuucaugaguccugaaaguuuuuuccucuauuuuaaugucacaauuuacaaaguuauuagaaaccuacauucaauaacaccuguuagaguucuauaauugauuauaaaaccaccuucuaaagaggacaaagacaagacaacaauuguccgugggugacaaaacaccuuaggauagccucuauuaaagccacaguugacuaagaauuuugguuacuucuguggcauacaacaauuuuuacauaacaauuauaaugauuaacaacauacacuaagucauaucagaauuguaggaguuuccugugauuuuggaacauauaccaauaacauauuuauacaaauacagcccaaagaaagccaagcgccauuucauauuugacagugcuuccuguaugauuuuuauaccaaacaagccaaacuucaccauugaauuagugcauuauugaugucaaacucaauucuuuuuuuuuuuuuuugagacagaaucucacucuuuugcucaggcuggaaugcagugacgugaucccagcucaccgcaaccucugccucccagguucaagcaauucuucugccucagucuaccgaguaacugggauuacaagugugagccaccacgccuggcuaauuuuuguauuuuuaguagaaacaggguuucgccauguuggccaggcacagggaccucaacagcacaugccagugaggaugggucucaaacuccugaacucaggugauccaccugccuuggccucccaaagugcugggauuacaagcaugagccacugugcccaggaucaaacccgauucuuaauaaaacuuuauagauaaaucuauccaauuuuaaugucugaccauaagguaagguucuuauaaaccucuuaaaacccuuuacaauuuuuguuaaagagcagauuaguguucuaagaaaacucuguugugcuuuuauuccagucuucaauuuauggauaaacugaauaauaccccuuuaauuuuagcuaauauguucacacacagaauuucuuuuacaagauuaauuuuucacaaaccuuccacaacuuguucaaacuucaacuuuuuccuaucuaaccuaaaacaauccuuuaacccuuaaaucuaggcaaaaaaaaaaaauccacauucacaugccuuuuuauaaucuuuuaccaaaaacacauuucacuuuccuugcauguaaaacugauuuacuuaagucucaugaacuaaaaggcauuuauacuuuuuacuuuucugacaauauuugauuuaagcaccuauuauuuuuaaaccaguuaaucaaaaugcuuucauaucacacacacaacccauauaaauacacagacaggcagaauaauauucaguaguuguuaagauuuuucauuugccaguuucuuaaauggauuauggguuucaggguagagcgcuuggaggaacaggcccaggaaagcacacaguuucuagggcaucauaagcagguacagccaaaguuggccaauuggugcugcagucuauuuccuuugggccagaguuuccucaguauugucccuucaggguucaccuggaagauguuaccgggaaggagucccaauccagaccccaagagggaguucuuggaucuugcccaagaaagaauucaaggcaaauccaaagaguaaagugaaagcaaguuuauuaaguaaaggaaacaaaagaauggcaacuccauaggcagagcagccggucacuuuaaauucauuucuacaaccuaauuuuugacauauuuuagaugccaguucauuuacuguaaggcauaagauuagacuuguuggcaucaaaggacugugacuucuaaaugaaugcauauaauaaagagauauuuugccugcaaggccaaugagacccacuuaggauggucuuaggcucagcauuauccuugaacagauuuaugcauauuucuaacuuuuaaauuuucauuuacauuuguuuauuuuauuauacuucccaagagaagauuuucuauagaaguuuuauuaaauucuuccuauuguaccuaaacucuguccccauuguccuucucuugcuccagauugucauaucucagacugaugugucuaucagaggcacagggaccucaacagcacacgccagugagucagucaucagauuauaguagccugggaauggggugaauacaggcuugaaguggacuaguaucuauuuccaaggaggcccaaucuauuggguaagccauugcagcaaguguuucuagcuaacaagauggucagagucaggcaggggggccuugcugugauucuggguugaccuuguuuggagcuagaugacuauagccagcaucuaggagagaaaacugguucaagucacuaggcuuggaaaugucaucuugccagacccucuuauggucuugacuaacugggcuggguuuauuaccaguagaggaacagacaacuacaucagggcagaagcccaggcacauggacauggaaaaacauaugcaucacugaggaagagccuagagcuugauguacacacagaugcuugagguucacccugguccauuggauacugggucuaaaauauguuuucacauugguaauucuaggccuuaucugcuccugggggcagaggucccaccaaauggugccugcauggguccauacugacuguacuugagagaggcuaaggguccuauaagacuggagaaagaggguugauggaaauagauuagccuugauugccuggagaaugccagcugguuuucagcccccaauacuuuggagcagaauuaguuaacuuugagugauggguggaucuuucuuuucuucuaauuuaacuugcuguucauguuuagcuuacauacaguauugggucauuuuuugcauaacuuuuuuuuauuucuaacagacuuuauuuuuuagagcaguuuuaaguucacagcaaaauugagcagaaguuauagcccuugccccacgcaugcacagccucucugguuaucagcauccccaacccaaaugguacauuuguuacacuugauuagcccacauugauugacacauaguuaucaccuggaauccauaauuuacauuaggcauuaggguucacucaguguuuuuuuuguuuuguuuuguuuuguuugagauagagucucgcucugucacccaggcuggagugcaguggcacgaucuuggcucacugcaaccucuaucucccggguucaaccaauucucugccucagccuccugaguagcugggauuacagaugccugccacuacgccuggcuaauuuuuguaguuuuaguagagaugggguuucacuaucuuggccaggcuggucuugaacuccugaccuugugauccacccaccuuggccucccaaggugcugggauuacaggcaugagccaccaugccuggcucacuagguguuuuuaaaaggaaaaaaaaucucacuuacuuugagaagacucuugugcuuucacauguauaaauauaagcacuaaaaucacaugaacauacauucauuugaaguuuucaaggaaauaaucaugaaauguuucagauuauuauuuaaguaaaaaauuuuucuaggaaugcauggaccccugagaauuuagccacagacucucagggauuuguggaccucaauuggaaaacauugcuguagaacaguaguucauuuugaacucauuuuugcaagcuaaauuuugacauguuuuagaugcuaauucuaggaauguucucccuuuucuaagaaaaguccaagcauuuuuuaccugcucuaaaagaauaucaacggcuuuuauguuucagagacuggaugcaagagauuguuuaacaaaucccaucccaucccugagaaugugucuaggcauuugcucuuugcaaagccagaugcaacauucauaauaacuaaggcuaucuucuggccagcacugcaaguguaucuuuugucuacauucuuaaguaaccacaucaaauagcaucaacccacuuggaaauaauuuugaagugauuuggaucucucuuguauauuuucccuauaaaucccuagccugguaggcguguauauuuucugcugcaauauuuaaugcuuaguuccuugccuacaucuaagaaauauuaauuuuagaaggaauuggauacugauauuggcaaauuuuuaugagacuggcuaaaggagaaagaagaaggggaccugugauagaaucuuccaugacaaggaggaaauacuggccucagucuccugcagaagcaggagcucugguacacagguggggugcccacugguacagcucccaucugacaugaagcaggcaagccaaaggggagcaagagcaaugcaaccuguaagacccauccucagacauucugcuauugcccccagacaauggaaggggggcgacagcuguccaugggggcacugcuaagaggguguugaucagcagaucaggacuguaacucaccauagugguggacugcccugaucuggagaccacugccuuucgagaauaauucacccuacagaagcuaucugagcaucaccagacagggucuuccugggaauuagcacauaucccaaauuuccuucagcuuugccugcccacaguccccugaaagcccucccuuuuucugggugugagaggaauggcugggcaucccuuggcuuauccuccuucuugcccaccauagccagcaucucagagugaacaugcacgagggagguagaaagacuccauauccuuguucuuuacaacuuagaaaagccuaaguuauaggagagagauagcacaauggaaugcugaauuagagguaaauaauuggucuguuuuuuuuucaccagucuaguuacuacuauuauguaaaauaucuaauuuuacauacccuaaacacccauacccaaacaccuugacaaaggaaucauuuuaccucccaaacauagucaguguugauuucacaaaauaucccuagaauuacucuuucugaggcuaacaggacuacuuagaugguuccuaaagucccuucuaacuccugcauucucugguuaaugaaucagcauuagucauguggaaggaagguauccuccucaaacucuuuuuaagaaugaucucaaggaauccagagugcucauuaaguuggugaaagagucagugcagaaugcagcucauacauauauccugaugugauguuggcaccucucaagaagcugggaaagauguccaggcuggucauaggacucagccccuauuauggguccagcagccaguaauaguaagcaaugucuacuucaaaagauaucucuggccaggugcaguggcucaaucccagcacuuugggaagcugaagcgggagcaucacuugagcccaggaguacaagaccagccugggcaacauggcgagaccccaugucuaccaaaaaagaauuuuuuuuuuuuuuuagacagauucucacucuguugcccagguuggagugcaauggcaugaucuuggcucacugcaacuucugccuccuggguuuaagcgauucuccugccucagccucccgaguagcugggauuacagucacacaucaccaugcccagcuaauuuuuguauuuuuaguagaggugggauuucaccauguuggccaggauggugucuaacuucugaccucaggugaucugccagucucagccucccaaagugcugggauuacaggcgugagccacugugccuggccaaaacaauuguuuuaauuagcuggccgugguugugcaugccuguagucccagcuacucaagaggcugaggaaggaggauugccugauccuaggagguugaggcugcagugagcuguguuugcaccacugcacuccagccuggaugacagagcaagacccuauuucaaaaaaaaaaagauauuucugaggagccaugcucauucaagacucacugcucuuagaagagguguuaaucuggccaggugccguggcucacaccuguaaucugagcacuuugggagggugaggugggaggaucaucugagaccuggaguucaaggucagccuaagcaacagacugagacccugucucuuaaaaaaaauaagagagagauguuaaucuauauuaaacaauugaauagugugaagauuuuguaaaacuuuuuaaaucaccgauuauacaaaagcucuuauugaauuauuaaggaguuagcaauuacuauuaaugcuguugaauaugaguaagaacccacuuaacuucaaucagaauccaucgaucaagcuuaaagccuuaucucauaguucccuuccuggucugucagcauugccucauagagagggaaauacaucccgcaucugccucaucaugaacuuggguggccaccaggauauugcucaugaaagcugcuuuucuuucuuuuuuuuuguuuugagacggaguuucacucuuguugcccagguuggagugcaacggugcgaucucggcucacugcaaccuccgcuucccagguucaagcgauucuccugccucagccuccugaguagccgggauuacaggcgcccgccaccacacccagguaauuuuuugcauuuuuaguagagacguagucucaccauguuggccaggcuggucuugaacuccugaccucaggugaucuacccgccuuggccucccaaagugcugggauuacaggcaucagccacugcgccuagcccgaaaguugcuuuuauaaacagguucaaggccgggaaauccauucuccuccaccucccaaagugcugggauuacagaugugagccaccgcacccagccaguucauaguuuaaaacaaagaugauagcagccccuucucaaaacaaaucuccuucuugccuggggacuagacugccuuuguaggacuaacgaauuaggcacaaaauuaaacauuauauuuuaggagucaugcagcugggggcuacaagauucugacccucccuaaacugcuccuaagaucagugcuugagauauuuugcaggccugcacuugauggaucagcugacaccacccagaucaauuaacuggcucaucugaucuuguggcccccacccaggaacugacuuagcacacgaggacagcuucaauucccuaugauuucaucuccuacuuaaccaaucagcacuccucacuaacuggcuucccccaaccuaccaaguuguccuuaaaaacucugauuccagaaugcuacgggagacugauuugaguaauaauaauacuccggucuccauuacagcuggcucugcaugaauuaauuacagccggcucugcaugaauuaauuacucuuucucuauugcaauucccguguauugauaaaucgacucugucuaggcagcaggcaaggugaacccacugggugguuacaacauuagauagcaaauuggcaauuaaagaauauaucuguagagacaggaucuuacuaauguugcccagcuggucuuaaacuccuggccucaagcagcccucccaccaccucagccucccaaaaggcugagauuacaggggugagacaccacaccuggccaaauuggcaauuuuugaagaaagauuucucacaaggacuuugcaagcuuuauguacuuuauuuguugcaauaauaugaaaugcaucuuucugggaaggagaacacagguaacugauuucaguguaauaccuagcacucaugccuugcuaauccuuuuuauauccuaugagaaaggaaaaauccaggccgggcgcgguggcucaagccuguaaucccagcacuuugggaggccaaggcagguggaucacgaggucaggaguucaagaccagccuggccaagauggugaaaccccauuucuacuaaaacuacaaaaauuagccaggcgcgguggcaggugccuguaaucccagcuacuggggaugcugaagcaggagaaucaccugaacccgggcggcagagguugcgccacugcucuccagccugggcgacagagugaggcucugucuccaaaaaaaaaaaaauccauuuuaugguuagauuugggggcuucaagccguauguggaaaaggcucucuuagggcauuuggucugucugggcuccuaagcugcuuagaaaugagguccuuaucacagcagauacuuaauaaaagugcacugaucuuuauauaccucuuuuuucaguccuuuuucuuuuucucagaucgccuuuuccuucucuuacuuaucuuuuccccuauuucuuuucucugcguauggcuuagguuaguccuuggcggugcagagacaccccccagaaguuguuggacccugcugcaaccucccugcagcuuagacuucauuucuucacacuccuguauuuggagcagcgacgcuagugccaggcccucagaccaggagacaguugcugccucccacaguggcccuuggggggcgauauuggcagucccagguuaggcuuccacguccuuggcuagccuuaagguuagcucugaacucuacugaccuuugcucgcuuuggaugacaaaggaaaugaucgaguuuagagaugggccagagguggguggagggguggcugaaccuuccggcuugcgcuguacaagccacaagaccaaauaagggcgugugagccgccuccgucuguauuaaaguucagagugcagugugcaaaagugggacucgguuuucagagauaagcuguuacccaacccugcuugaguuccagcagcggaggcugcgaagucuccugcucugagcagggcugggucugggggagaaagaccugggccccugggcuugcuuagcuggggagaggaaagaaggggggcuucccucaccagcaccuggugacugaacggacccacaaccccacagauuuucacaaaggguuuccaugacucucccgacuaaaaugugccggccagugugacucauuagaauguguaggaaaggucacuguuugaggauauucagccagugggggaaaaaaccacaacguuauuuuaaugaacgcuuuuagccuggcuuguuuccugaacauuaaggucuagggcgggacuucgaguuuggggccuuuuccagagguauuaacacuguguuugcuaaauacaccccagggaaggagucgucgggcuucuacgagucacacuuaaaagacuggcaagaguuggcuucuucuguuguguucuuagcuuccaaaauaguagucucuccucagagccagacgcgcaaugccaucauguuaaugaggugccucaugugcuucaauagccacugacugaugguaccccgaaccugccuggauuccucaccucuuccccugcccaucucuccuucccgcagcaaacugcucauccugcagcaguccgaaccucugccucauuggcccuaagcuuccuaagggaagggaccaugacuuguauucauguuuauaucccuaaaacucagcccucuguuuggcacauagugugugcuuaguccagaucacuuaaauguacaaugauuucauucucucggagccccgcucugguggugugggucccuggggaccccuccagaugccuuucuccagccauggcugcgcaggcaccgagaagccgcaggcugguuccagcucacagccucucgccucaggcccacacugcuccuccugcugucugccccagggcuugcgauugcccggggguccccaagcgggcucaacucugaaagauuagagagcuaacagccuauggagauaaauacuuccuucuuuaucuuccugggaagauggacaguuguaagaugauuuucuuacaacuuucagacaguccugugggaacacacagccagugcccauaaguagggccacaucaguagagcaucccugcuucccugccuucuccaucugucaguggcuucugcuccuggggucacaguccccaauaaaguacacacuaagccuucuuccuaggggagcugagacucgaauacauucagagcccuuuaagaaguucucucacagacuuauuuuuguuuucaaaauucaauuccucuaaauauauuucuguuccucuuucgucuaagucucauucuuuuugacugagaagucagaagcaaaauuaaaguuuagugacuaggguuuuuuuguccuguuauacguugacauuccuuaccguggguguaucugugcuuucuuugcucuuacucugaacaugcccaaaaaaacucuuguguuaucuuuagcauauuucauaagccacaauucaggaaguuagagaaauugcucccuggugcagagcaacagaacugccgaccucuuuccacuccaauugcggugaaagugauaucucucugccugagcugacguuggccuuuaggcuucucuaauuauuuccuuagguuagauuucuagaaacacagggucaaagggcacagauauucacauauaggcaaguuaccuucuucuugagauguagcaauuuaaacucauaacagcaguacauaacagugccccuuucucugugucuuucuccaacacagacaucuugcuuuaauuuugcauuuauuugauucuuucugagaagcagaaggaauauauguuggccguuugcauuucuucuuuucuaaauuaccuguuuucuuuccuuccuuccuuccuuccuuucuuucucuuucuuucuuucgagacgaagucucacucuuguugcccagguuggaguacaguggcucagucucggcucacugcagcccccaccucccagguugaggcuauucuccugccucagccucccgaguagcugggauuacaggugccugccaccacgcccagcuaauuuuuguauuuuuaguagagaugggguuucuccguguuggccagacuggucuugaacuccugaccucgugauccacccgccuuggccucccaaagugcugggauuacaggcgugagccacugcguccagccuauuacuauuauucuuuuuuucuuuucuuuuuuuucuuuuucuuuuuuuuugaaaccggaguuucgcucuuguugcccaggcuggagugcaauggcgcgaucuuggcucaccgcaaccucugccuccuagguucaagcaauccuccugccucagccuccugaguagcugggauuacaggcacgcaccacugugcccggcuaauuuuguaguuuuaguagacacaggguuucuccauguuggucaggcuggccucaaacuccugaccucaggugauccgcccaccucagccucccaaagugcugggauuacaggcgugagccaccacaccuagcuaaaaauucuuuaauaggucucuuuaauguuuuaaguaguccuagauuuccccugugaaccaucuugaaaguuuugccuuuuauucucaguucucuuuugcuggcuucuuaucaggaaacaccaccugacugauuugagauguaaagugauggagugcaaagaccacaggucucuguauucaaaggucuaggugcaagguacaaccuuaccggauauuucagagcuugucuuuuauaauuuuugagcugagaaggucaggugagauaaacuguauggacuggaauucugauuugagauguaaagugauggagugcaaagaccacaggucucuguauucgaagguuuaggugcaagguacaaccuuaccagauauuucacagcuugccuuuuaucauuucugagcugagagggccaggugagauaaacccuauggacuagaauucugaaaggagagcaguaugucaacaaaggaggauucagcaacugccugaugcaaucucuaguuaucuucguccugcaccagcaguauaugaugcuaucucauccaacuccauucuucagauuugucaucucuccuuuacuuggauaaaaccuggcuggaaacuuggcuucaguccuccauauccaucuguuuuaggcagacuuaacucagcuuuacaucuuugcaaacuuacccacgcacaucagcauccgagaaauuuccauacucuuugauuaaaauugcaguaaaagucacaaaggaccuugcuuaaaaugaaaggaaguuucuaggaacucuaagcucaguaacuuuaugaccauucccuguagagcugcaaaggucuggauuugaaaagucauaaguagcaagggaauugcgccagaauaccugucuuuugcuggagcaaauccauugccugguucaugccuaugucacauaggcagggcaaugccagacuuuucuuuucuuuuuuuaaagacagaguuucgcucuuguuguccaggcuggagugcaguggcacgaucuuggcucacugcaaccuccaccuccuggguuaaagcgauucuccugccucacccucccaaguagcugggauuacaggcgcccaccacuaagcccggcuaauuuuguguuuuuaguagagaugggguuucuccauguuggucaggcuggucucaaacucucaaccucaggugauccgcccaccuuggccucccaaagugcugggauuacaggugugagcuacagcacccggccuucuuuuuuuucucuuuuuuuuaauuuuuuuuuuuugagacggagacuugcucuguugcccaggcuggaaugcaguugcucacugcaaccuccgccuccuggguucaagggauucuccugccucagccucccgaguagcugggacuacaggcaugcgccaccacacccggcuaauuauuguauuuuuauuagaaaugggguuuccacauguuggccaggcuggucucgagcucuugaccucaagugauccacccuccugggauuacaagagugaucuguccccuccccuccccucaucuccccuuccuccacuccucuucccuucucucucuuuugagacagggucucauucugcugcccaggcugcaggugcaguggugugguuaugguucacugcagucuugaucucccaggcucaagugauccuuaugccucagccucccaaguaguuaggacuacaggugcaugccacugaccuggcuaauuuuuuaaauuuauuuuuuguagagauguagcucagaauggucuugaagcccuggcccaagcaauucucccuccuuggccucccaaaguccuaggauuacaggcaugagcuacugcgcccagcccagacuuuuuuguuguuguuguuguugcuguuucucacccagguugcaguacaguggugcgaucacagcucacuggagccuuaaccucuggggcucuggcaauccuccugccucagccucccaaguagcugggaccacacacaugccaccacucucagcuaauuuuuuuuuuaauuuguugagacagggucucacuauguugcccaggcuggucuugaacuccugugcucaagugauccucccacuuuggccucccagagugcugagauuacaggugugagccaccacacguggcccccagauauucuuuaaguguaaagcuugacuacuauuugaggcuugacuucugcuuucaaauugauuuugaauuacauacaaguaauuuccaaggagagucaguuaacaagauaaaauuguggucuuuaccauaugugcauucuuuuauauucucagccccauuagugcuuguauaaguccauguguacuaaguaaaucucuuuuaaccaguucuuuccaacugugaaaagaaguaaauuauauggggcugggcgugguggcucgcgccuguaaucccagcacuuuggaggcugaggcgggcggaucacuugaggucgggaguuugagaacagccuggccaacauggugaaaccccauuuucauuaaaaauacaaaaauuagucgagcgugguggcgggcaccuguagucccagcuacucaggaggcugaaguaggagaaucgcuugaacucaggagaugaaguuugcagugagcugagauugugccacugcacuauagccugggcaacagagcgagacucuggcucaaaaaaaaaaaaaaaaaagaaagaaagaaauuauauggauuuuucagggagcuuacaaggauaagaaaauaggacuuggcugggcgcaguggcucacaccuguaaucccagcacuuugggaggcagaggagggcgggucaccugaggucaggaguucgagaccagccuggccaacauggugaaaccccuucucuacgaaaguacaaaaauuagccaggcaugauggcgggugccuguaaucccagcuacucgggaggcugaagcagaagaaucacuugaaucugggaggcggagguugcagugagcugagauugugccacuguacuccagccugggcaagagagugagacucaaucucaaaaaaaaaagaaaaaagaaaauagggcugaggcaggaggaucacuugauaccaggaguuuaagacuagccugggcaacauagcaagaccccauggcuauaaaauuaaaaaaggauuaaaaaguagauaauauuaaaacaccuuagauuuuucaaaguaauggagcucuuuuuuuuuuuuuuuuuuuugagauggagccuugcucugucacccaggcuggaguacagugacaugaucucggcucacugcaaccuccaucucccagguucaagcgaucuuccugccucagccuccugaguagcugggauuacaggcacgcaccaccacacccagcuaauuuuuugauuuuuaguagagaugugcuucaccguguuggccaggcuggucucgauuuccugaugucaggugauccacccgccucagccuccuaaagugccagcaccaaugugcccggcuggaauggagcucuuaauauaaauuguacuuauuaguuuuucguuucagccuauaaaauguacaaaucuuucucuuuaaaaaaaaaaaaacacuccuuugaugcuguaugccuugcaaguuaacacacuuuccaucuacucuucauagcagaguucuuacaagagagauccacgcaugugcuuuucauuucaccauugacucagaaguuacauuuaugauuuuaucacaaagaaauauugagagaggcauacagaguuauggauaaggaugcucauuacaaccuuuuuacaauacuaaaaaauuggaaacaaccuaaauaauugaugauagggaggcuuuaaaaaauuauggcaucuauaaaugagaauuuggcuuugcugcaaauagcagaugacccacaauaacugugguaggaggagggaugcuaucugggaccgugugauggcucacuccccagaguccuugcagcuugguuuccuccuuuuucauuacucuacucugucuggcuucauaccuaagauuacuucacagaccaagagggcuucuccuguucuaguuaucagcaagagggacuagacaaagaaaacuggggcaacuaucauucaccaacugucucuuaaggaagcauccaaaaacugacuuacauguuuaucuaggguagaauuguuacuauauuagagaagacagaaacuaugcuuggacccaggccuugagcugauuaggguugaacuuuaggcaaagaacaacucagauaguuagucuaaaaggaguuuuuucuacauuuaucuguuugaaauuucccagcaucaaauuuuauauuuuccuauauugaggggaaggggccccauuaggauauuuugcccuuuugcccaauguauacacuuuuuaacccauaaucuguuuuauaaaauugcaaucuuucggccuggcgcaguggcucacgccuguaaucccagcacuuuggaaggccaagguggguggaucacgaggucaggagauccaguccauccuggcuaacacggugaaaccccgucucuacuaaaaauccaaaaacaaacuuagccgggugugguggcgggcgccuguagucccagcuacucggguggcugaggcaggagaauggcgugaagccaggaggcggagguugcagugagccgagaucgcaccacugcacuccagccugggugacagaaggagacuccgucucaaaaaagaaaaaaaaauugcaaucuuucaaacaucuugcuuacaugcaucagcccccaguggcugguauaauucccuuugguucauccaaauauagaguacuucugucaagcaacuagugcuuguuaaacccccuaacacacuuccuugcauaggguagaagcacaauuacuuauuguuuauuuauuuuaaaaaauuguucauugacuugaguuguaccauguaccaccuaagaaauagaagaauaaggcacaggccuagucuuauauuuuaaguuuagcuaaagagacacacaaaacaacagaaaauaauagaauacuauucaaaucagguacgaagugggguagucuaagcuauaguugguagaggaguucagugaagguuucuaaauacaaggaagguguguaguaaagaauuuggccuuguccaaugagagaucuggucucucauuggcuuuugggagguuaucugugucauaccugauagcagugucuuugcucugugagggaagcucacuuggagaaaggcucacaggaacagguguugcuccacgccuuucuuuuaguggcuccacccccugauagugggugagaucaaucauuugcuuaugacacaguccuagacuuaagaguuggaaggacucucaggcagucaucaggugcaucccagaauuauuuuaucuuuacugaugaugcagcuccugccaggucacauggaaagcaggggagcuagaacucggguucugugucauccuaccccauguucucucugccacaucacauugccugcucgugacacuggaccacuguaaucauggacgguacucugucccugagcuucuggggugaaacuggcuauuaacccuugccaugucucccuucccugagccuugaauccugcuugcccuguggugcccccaugucccccaguacgguucuccccgcugcccucuauaaccaagcaccuggcagguuauugcuuuuccauaaagcuggaaaacucuuagacagugagaggcagguggccagacugcugcuguccuuugaagguuuagggccaagacugagcagcaauugaaaguauccauugaacaccugcugugaguaagacaucgccucuaucuuaagccuuugcucuauuccaauggaaacuacaguuuccaggcucccauguccauuggcuucuggagggguuugaccaguagauggcaaugauggaugacuaggagguagcagagggaagaaccagguauuucccccauccuccacccuaaguggcauguccaucagcagguugguguuuucccugacaucuagcuaguucuccugacaucuaguucccaccacugcuccccuuccauggcucugcuguccccuaucuuagaggugguggugcccuucugcuguggccagucucugcguuguuucacuguuuccuguuuggccucucagcucuucccauacaguggguaaacaggucucuauauuaaauuccuucugaaauaccugguggucuccauuuucuugguuagaccuugacugauuaauggcucauguaacauccguccaucgggggacuuaugauagguuggagagucaagaauuaaauauaugcagccuguaaucccagcacuuugggaggcugaggcgggcggaucaucugaggucaggaguucuagaccagccuggccaacauggugaaacccugucuguacugaaaauacaaaaacuagccaggcaugguggcgcacgccuguaaucccgauuacugacaggcugaggcaggagaaucgcuugaacccagguggcggagguugcagugagcugagaucaugccacugcacuccaaccuaggugacagagcaagacuccgucucaaaaaaaaaaaaaaaaguauauauauauauguauguaaaauacuaguaaaauaaaauguagagauuccauacauguacuaaaaaucacugaguuauuagcugggcuugguggcucacaccuguaaucucagcuacuugggaggcugaggugggaggaucacuugagccuggaagucaaggcuccagugagcugugauuguaccaccgcauuccagccugggugacagagcaagacucugucucaaaaaaauaaauuaucagccaggugugguggcucacgccuguacucccagcacuuugggaggccaagguggguggaucacgaggucaggaguuugagaccagccuggccaauauggugaaacccugucucuacuaaaaauacaaaauuagcugggcaugguggcacaugccuguaaucccagcuacucgggaagcugaggcaagagaaucacuugaaccggggaggcagagguugcagugagcuaggauggugccauugcauuccagccuaggcaacaagaccgaaacaccaucucaaaaauaaauaaauaaaauaaaauauucaggagaaaaaaugaaaaaugaagagugaguagauuagacuagugaucuccaaacauuuuuaucacacuccccuaauggcaagaaacaacauuugagcuugcaccuccauauuuauguacuuauuuauucaaacuguguacauguuaaacccuguugguauaugaugccuuauaaaauagcuacaaaauauaaauguaaacagaaaaacagguaaauagaaguccuggugauucauugcuuuaccucaaugagucaucuuacacaucuccuguggugccuaccccacuuugaaaucauaaaccgcuuguagaaguggccaucaaagagcucugcaagggacugcaagaaagaaggacugggggccaggugcaguggcucacaccuguaaucccagcacuuugggagacugaggugggcggaucacaaggucaggaguuugagaccagccuggccaauauggugaaaccccgucuuuacuaaaaauacaaaaauuagcugagcaugguggcaggugucuguagucccagcuacuggggaggcugaggcaggagaaucccuugaaccugggaggcggagguugcagugagcugagauugcuccacugcacuccagccugggcaacagagugagacuccaucucaaaaaaaaaaaagaaaaaagaaagaaagacuggggaguucuuucuuuuuuuuuuaaaggaggguuuaaauuaggcuaaugcagcaauaacagccacacuuuugauguuuacacauuucuuuacaguucuugaagucucgcucuguugcccaggcuggagugcaguggcacggucucggcugacugcaagcuccaccucccagguucacaccacucuccugccucagccucccaaguagcugggacuacaggcgcccgccaccacgcccggcuaauuuuuuuuuuguauuuuuaguagagaugggguuucaccguguuagccaggauggucucaaucuccugaccucgugauccgcccgccucggccucccaaagugcugggauuacaggcgugagccaccguuccggcccuuuuuacaguucuuaaaugcuuucugaccuguguuaucucauugacucuuucaaauaaugagaaaggaagugaaucaaaauaggagauagauuggggaaaacuugaacgugugaccaagaggaguuuggacuugaucauaaaaguaaugaugcuuuaucagaugugucacaucacagagcagauauuuacaguccaaagucccucccuaaaugauuggccucacccacaaugacuggguggagccaccgaaagaaaggcauggagcaacacuucuuccugcaucgccccucaaaagagcagaucccaguucucugaagauaaauggaaggcagccaugaacuucccccucuuugagguuuaucuuucagcaccuuagcaccucagaacaacagagaauuaguaggcuuagccuacuauccuccuauccuuucucucgugugcuaaaguuccauacaauauuacugguguauucccucuccaaaaugaugccuuaauacauuuaugugaaccucucagccaggaguauguauguagcuauugucauuccaagacauuuucucuguucccauuguccauuucuccuucagcugcgugagcucaggggcuuauguuuuacacacuauauucagcuccauuuccaggaaacaaaacugaacuuuguccugaucccgcuuuaucccuuucuccugauccugucccucaccugcugagcugucuguccugcucacugcaggagcacuaugagaaccacguggaguggccgacaggauagggcuuugaaaaguacaaagcugcccucuguagaaaacacccuaaagcagagguucccaacccccaggcugcagaccaguacagguccguggccuguuaggaaccaggcagcacagcaggaggugagugacgggcaagcaagcauuacugccugagcucugccuccugucagaucagcaguggaauuagauucucauaggacugcaaaccuuauuuugaacuccgcgugcgagggaucuagguugcacgccccuaugaggaucuaaugccccccaccccuguccauggaaaaacuaucuuccaugaaacuggucccuggugccagaaagguuggggaccacugccauaagggguuggcagaugaaccagcugaagcaaaggaaacaauuacauuauuuauugcugaggcucauguuguuuuugugcugaaaaaccuccagugacucuccuuugcccaaaguccgaaagggggccaguuaaugaccuuuguccauagggaggugauaacagccugccugguagggagcagagcccauguccucucaguagcauuauggguguugcuguaggaccugacccaaagagagauagguaucaguuuauaagauuaugaauaauauuuucaaaaaagggggccaagaugaggccuuagucucauaucaggugacaccauagaucaaagcacagaaaagagacaggaaggauuucagcagguuggagaaggagauaggccugugauguggccagguggagacacagauaaguugaaguuuauucugguaaagaccuuuguaccugacaugcagcaagucccaguccugauggagggaggauguagccagcucccuagugcuaaagcauuuuggcuuugcaggcaaaaaccugcauucaaaaucuaacuauaacagccuugcaaacaagcuacuuaacuucaucgguaaaggcucugucaaaggccaggugcaguggcucacgccuguaaucccagcacuuugggaggcugaggugggcagaucaccugaggucaggaguucaagaccagccuggccaacuuggugacacccugucucuacuaaaaauacaaaaauuagcugggugugguggcgggugccuguaaucccagcuacuugggaggcugagcaggagaaccauucgaacccaggagauggagguuacagugagcugagaucaugccauuacauuccagccugggugacagagcgagacucugacucgggaaaaauacauaaauaaauaaauacaaaaauuagcugggugugguggcacguaccuguaaucccagcuacucaggagacugaggugggagaauugcuugaacccgggagguggagguugcggugagccgagauugugccacuguacuccagccuaggcgacagagcaguaaucccagcacuuugggaggccaagguugggccaaucaccugaggucaggaguucaagaccaggcuggccaacauggcgaaaccccaucucuacuaaaaauacaaaaauuagcugggcgugguggugggugccuguaaucccagcuacucaggaggcugaggcaggaaccccggaggcaaagguuguagugagccgagaucucaccauugcacuccagccugggugacagagggagacuccaucucaaaaagaaaaaaacaaaacaaaacaaaaaaaaccucugucaaaagauguucaugagguuaaugaaguaacauaucuuuguacuuuuuauuaaaguacuauuacuaauauucucauaaagugcauaucaucaugccuugugcucaaguucauuuuuaacacauuugucuccccaacuuguggacagagccuugucucauugauguuguuucuuacccucagcaacaagcauaaagcuccaaaaguguguuguguggaauuaugcauuaauuucuaguuguuucauguuuguaaaucucaccuuaacugaaaucugcugaagcuuaagggcagggacccuuacccccaauguaacuaucauaaaacugggcaugcaccuacuggagcuuagggagaagguugugccugauuagaaaagguguucaaguugugcuucucucuuguagggauuucccagaugacccaggcaugcagugggacacagagcacguggccagaguccuccuucagcacauagaagugaauggcaucaaucugguaagggggcagcucccugaauggaaaaccugaggucuuggucccauucacaccaggugguuucuguaauuuuuucuguggccacccucccacuuccaguccuucuccagggccacucucuaaggaggccagaacuuccaaugcucaccauuaaaccuacugaagaacaaacacaccuuuugauaucuuuacgaucuugugugagacugaauaacuaaauuaucagugcucagauagaggcagaaguuuuuucuaaacuguguccuccuuaacacccucaagcccccgccuuuguccugccaucuaaaaauucaggucccccagagccugcccagugauucucauuuauacagaacuugaccucaccuuuuaccaagcauuuucacagaguaucauuuuaacuuuaaaaguaaaauuugugacugggugugguggcucaugccuguaaucccagcacaucgggaggccgaguuggacggaucaccugaagucaggaguuccagaccagccuggccagcauggugaaaccccaucucuauuaaaaauacaaaaauuagccgggcgugguggcaugugccuguaucccagcuacuugggaggcugaggcucgagaaucgcuugaacuugggaggcagagguugcaaugcgcaaagauuguguuacugcacuccagccuggguggcagagugagacucugucucagaaaaaaaaaaaaaaaguaaaauuaucaguuuacauugaagaaacugagguuuugcagaggccaagcagcuuguccaagguaaacaagugguggugaagccaggauuuuuaagcauugauuucuucauuccaaaaaacaugagaaugcauucauacccacuaaggaagaaaauuuuugaugcaauuagagcaauagcagagauuuguauuuacugcaaugguggacaagccuagcaacaccagucucagcucuucuaggaucagcaggacugcuuagcccauagucaauuuuaaagcugccaaggaggcuuacugucuaccacucaaaaaauauauaauaauccuucaugagguaauaucuaaaauuccacauuuaaagccucaccauuuggcuuaaguuuugauuaaguucucaugaaaacaugaauccugcuggcagagaaacauauuaggcuuuuuuuuuuaauuuuuuuuuuuuaagacacagguucucccucuguugcccaagcuggagugcaguggcugccucagccucccaaguagcuagaacuauaggcacaugccaucaugucuggcuaauuucuuuuuucuuuuuuuuuucugagacagaguuucccuccaucgcccaggcuggagugcaguggcgggaucucggcucacugcaaccuccgccucccggguucaagugauucuccugccucagccuccugaguagcugggacuacagacacgugccaccacgccaggcuaauuuuuguauuuuuaguagagauggaguuucaccauguugaucaggcuggucucaaacuccugaccucgugaucugccugccucggccucccaaguacugggauuacaggcaugagcuaccacacccagccaauuuuuaauuuuuuuuuuuuuuuuuuugagacagagucucgcucuguugcccaggcuggagugcaguggugugaucgccgcucacugcaagcuccgccucccggguucacgccauucuccugccucagccucccaaguagcugggacuacaggcgcccaccaccacacccagcuaauuuuuuguauuuuuaauagagaugggguuccccuauguuagccaggagucuccaucuccugaccucaugauccacccaccucggccucccaaagugcugggauuacaggcgugagccaccacgcccagccuaauuuuuuuuuuuuagagacaggaucuugcuguguuggccaggcuggucaccaucuccugggcucaagcuguccucccucauuggccucccaaagcacugggauuacagaugugagccacugcaucaggcccugagagcagauuuucauugauauauucauuggacuguuucuguucucuaaugacagaaauacaacugaaauuuaguacacacaggccaaaacaggcaccuaauuugcucacccugagucaccuaaaagcugagcugcagaugggccucagguacccugacccuaccacgacucaucuccaucuuucucugcauguugguuuuauuccuuuuccuggcuggaaaaauggucaccagcagcuugcaggccccacacucccugccuacccuucccagaggaucugagcaugaaagcgguaauguuagauccaugggcuuaggaauaaugccuagcugugcugacuggggcuugccuugguucucuuacuccuccucuucagcccacacaguuugaaguucucagagccuccacagccucgauauguagacagagcugagguuggagguugucauggccagccugaaguacucccuggcaccucauuuuccaugcuagugccuucccagucccuaaauacucucuguccuccccuacuucagugcacgagaacuacuggucuuccaaauugcuccugcuguaggguacucuuaucuuuuuuucuuuuucuuuuuuuucugugagacagagucucgcucugucaccaggcuggaaugcaguggcgcgaucucagcucacugcagcauccaacucccugguucaagugauucuccugccucagccuucugaguagcugggacuacaggugcgcgccaccacgcccagauaauuuuuguauuucugguagagaugggguuucaccauguugccaggauggucuuggucuccugaccucgugauccgccuuccccggacuuccaaaaugcugggauuacaggugugagccaccgcacccaggcuacucucaucuuuuuaaacuuggaauccaaaauccucuauaaucugacccuuacugaaguccugaacacuggugaacaacguuggucuuugccgaggggccagauuucuuuuucagaccauguugcagcugaccuugacccugaguaucugagggaggagcuuuggggcacaggcagcucugugugccauucuugcuuucagaagagucucccauguuugggucccagaaaagugaucugugguccaggcaccccuccagaccuucuucucaaagaagagcuaacuuugaugagcccuuuuugaggcuccggcaguauuugcuguguguacugcaacauauguugcuguuuauucuuaaaagugcagaccacgucuugcaaacuagacuaaggccugugaaggccaaggcugugccugguaucuuuauaucuccaagaacuagagcaggccccuggacagugcuccuuaccaaacugcugcagcuguuaacugccaccucccugccuggaagucuuuccuguggugcugagcugcucacacuuacucaagugagucgacuuuuauugucaagagaaucuucaauugauuuaauugcuauaaacaaggaaaucguauaaaacagcuccuuacuaauaaauuucuccuuuuuuuuuuuuccugaaaugaagucucgcucuguugccuaggcuggagugcaguggcaugaccucggcucacugcaaccuccgccucccggguucaagcgauucuccugacucagccuccugaguagcugggacuacaggugcaugccaccacgcccagcucauuuuuguauuuuuuuuuuucuuuuuuugagacagagucuugcucugucgcccaggcuggagugcaguggcgugaucucagcucacugcaaacucugccucccggguucacgccauucucccgccucagccuccugaguagcugggacuacaggcgcccgccaccaugcuuggcuaauuuuuuguauuuuuaguagagacgggguuucgccguguuagccaggauggucucgaucuccugaccucaugauccgcccgccucggccucccaaagugcugggauuacagguguaagccacugcgcccggccuacuaacaaauuucuugugacacacuugcuauuaauaaggaaacucaaguugacaguacaguugggaauaauuucucuggccugcacuuagugccauaguagaaguauaggaucaugcuaacaccguggcuaguguagcuauaacuggccaucauucgagcugagcauggguuuccauucagcccagaaguuucaacugcacacaagagaugaugaagcagcaacacagaagcacagacagagguguggagcacagucuaagccauggggagagauuuucucaccugggcugcaccaggaugagagcauaagcucuccaccaucauccaaagcaaagcuggcucugcagccaucaaugcaggaaacuggguucugucuggucccagcucuguaguacugcaggaacaucauaaagaccauaaggaauggcagacaggacagaguuuugaaaaguacaaagcugggugggugcaauggcucaugccuauaauccuagcacuuugggaggcugaggugggaggaucacuugaggccaggaguuuaugaccagccugggcaauauaucgagacuccaucucuauuuuuuaaaaaauaaaauaaaauaaauguuaaaaagaaaaguacaaagcuaccauccuuggaaagcagccuagggggguaguagugucuucucuggguguuaagcaggcuagguccugggccucaaccccucuaccucaacuuucauucaguaaguauuuauuaaguacccaauaugggacauuugcuuuagguggugaacugggaauacaacagugagccagaagcacuuagucccugcucccauagagcaggaugugucaguacagcacuauugcgcauuugagacuggauaauuuguuguggggguuggccuugugcauugaaggauguuuagcugcaucccuggccacuacccacuagaugucaguagcaaucccccuccucaguugucacaaucaaaacgucucuaggccgcaagcaguggcucacaccuguaauuccaacacuuugggaggcucaagcaggggguggauugcuugagaccagccugggcaacacagugagacccugccucuacaaaaaaauuuaaaaauuagcuaggugugguagcaugcacuuauaaucccagcuacucaggaggcugaggcugaggugggagaaucacuugagccugggagguugaggcugcagugagcaugaucacgucacgucacugcacugcacugcagccuaggugacagaaugagagccugucucaaaaaaacaaacaaaaaaaaccuccagaaguuaccaaaugacccuggggcaaaacuauccuaggugagaaccagugucuuagaaaccagagcagccccacaguuaccuauuuauuggggucuggguaagauuuuauuugaacaaauacuuuugcacuuuaggaaaaaauaaaaguggauggaguuuuguaaagaaugacaggugccauugucauguacaaaucugcaaaguucagagagcugaauacaauuuagcuuaacccuacuugcaacagaaagggggaaacuacaagguacaggaugagagaaaaaacaaagacuggagaauuucaaaagugauggagcugaauuucaugugaccccaaauccacuaaccaagggacugccugcccuccagcacccuucugauauccauccagccagagugcuagccagcuccaccugauggcaacagccugggaguugagauacucuaggguuuucugcuguacaguuuucuuuuuuguagcaagaugggguucuuguucuugucgccuaggcuggaaugcaguggugcuaucauagcccacuauuacaucaaacuccugggcucaaaugauccuccugccucaaccuccugaguagcuggggcuacaggugcacgcuagcaagcccagcuaauuuuguuguuguuuuuugagauagagucucacucugucaccaggcuggaguacaguggcacgaucucggcugacuucaaccuccgccucccggguucaagcaaaucuccugccucagccucccgaguagcugggacuacaggcacgcgccaccaugcccagcuaguuuuuuuguauuuuuaguagacacgggguuucaccaaccuggccaggcugaucuugaacuccugaccucgagauccacccaccuuggccucccaaagugucgggauuacagacgugagccaccgcgcccagccucgcuguacaguuuuuaaacacuauuucuucacuuaaaccuagcaaggaaaguagagcuggcauuacuuuuccugaucuuacacaugaggaaaccaagacauuccauguugaaauaacuuccaguaguaaaguuuucugacuugcccaaggugcuguaauuaacuagaguuagagauaaaaguagacuuugaucucccccaaccaccaccccaccacccaccuuguucugcauggaagggugggaucagaaccagguguuugaguuauacgaucuuuuuuuuuuuuuuuuuuuucuugagauagaguuucccucuuguuggccaggauggagugcaauggcgcgaucucagcucaacugcaaccucugccuccuggguucaagugauucuccugccucagccugccaaguagcugggauuacaggcaugcgccaccaggcccagcuaauuuuguauuuuuaguagagacgggguuucuccauauugaucaggcuggucucgaacccccaaccucaggugaucugccugccucugccucccaaagugcugugauuacaggcgugagccaccgcacccggcuggcuuuuaaacaauaucaacaccgaaggggugagauucuuagagugacaguucagagacagucaggagaguaggggagauggaaacaccugcuacuaaugguaaggcucggcugcgacugcccagcccugggaaagccuuucucugcagagcacuugaucccacggaaacuuggcaguaagagcuuuaaaaggaaagggagagggaaaugaaagcgagaggguucugucagggagcugcucgguuuuaacaaaggaggccauucccauggcacaacccuucuuucuguuaucaggagaccauguugacauuacccugaauucaccuaaacuggugcugacucuucaugagguucccaaugauuccugaaucucaugauggccagaagccggucuccucauggccauggcacucugagaggauguuuggugacuggaccuuguguuuugugguuguuuccacugucuccacuucuuagauuugguccucuugcuaggccauagggugugccagugcaguaaaguccagggcaccuuggccuaggugcuaacuccuucaaaguuucugcuuuguuuccacagcugcauguuuccagccugugcugugcacgcugggugggagagggcaacuugaaugcaauaacuacaccuagcacaguuggcaagacucuuucuuuacuaucaugaaggaaaccacauuuaaaaauguguccccuuauguauccucugggcauugcauauaguucugucaucaaagguaagaaugauuuuaaccccagugccugguacagaguaagugcucaguaaugucauuagcuguuauuacagcuauuaccacaaccucaaaaaaaaaaguuuggcugagcacagugucuuaugccuggaaucccagcauuucaggaggcugaaguaggaggaucgcuugaccccaggaguuugagaccagccugggcaacaugacaagaccuugucuuuacagaaagaaauuuuuuuaaguagcugggcccgguggcacgugccuauagucucagcuacuugggagaggaagacaggauuucaaggagcccagggguucaagguuacagugagccaugaucacaccauuccagccugggcaacagagggagaccuugucucaaaaaaaaaaaaaaaaagccuggaugcaguggcucacuauuuuuaaaaaguaaaauaaaauaaaauaaauuuuaaaaagaaaagcacaaggcugggugcaguggcucaugccuguaaucccagcacuuugggaggcugaggcaggugcaucacgaggucaggaguuugagcccagccuggccaagauggugaaaccccaucucuacuaaaaauacaaaaauuagccgggugugguggcagaugccuguaaucccagcuacucaggaggcugaggcagggaacugcuugaacccgggaggaggagguugcggugagccgagauugugccacugcacuccagucugggugacagggugaaacuccgucucaaaaaaaaagaaaauuacaaagcugccauccuuggaaagcagcccagggggauaguagugucuucucugggugucaagcaggcuagguccugggccucaaacccucuaucucaacuuucauucaauaaauauuuauugaguacccaauaugggacauucacuauagguggugaacugggaauacaacagugagccagaagcacuuagucccugcucccauagagcaggaugugucagugcagcggcacuauugcgcauuugagacuguaaucccaaaaugccuguaaucccagcauuuugggaggccaaagcaggcagauugcuugagcccaggaguccaagaccaaccucaguaacauagugagaccuugucucuacuaaaaauuuaaaaaauuagccagguaugguggcaugcaccauacuacuuauacacuaauuuaaaaaagccacugcauccaggcuuuuuuuuuuuuuuuuuucgagacaaggucucccucuguugcccaggcuggaauggugugaucauggcucacuguaaccuuggaccccuggacuccuugaaauccugucuuccucucccaaguagcugagacuacaggcacgugccaccgggcccagcuaauuaaaaaaauuucuuucuguaaagacaaggucucgccauauugcccaggcuggucucaaacuccuggggucaagcgauccuccuacuucagccuccugaaaugcugggauuccaggcauaagacacugugcccagccaaacauuuauuuuuugagguugugguaauagcuguaauaauaguguauaaguaguguauuaauagcuguaaaaguagugucuucccagcuacuuaggaggaugaggugggaggauugcuugagcccaggaggucaaggcuacggugagcuaugaucaugccacugcacuauagccugcauggcagagcaggaacgcuuaaccaucucauagauaacuagauuagucuucuucuagggaccuaaagagcaaagcgauaaagcgagcauaaaagcaguuugaaaaguaagugacagaagcaugaaaagcaucguuuuugaauuaguucuuacuuggauuccauugaugagcacaaaacaguaaucugguucaggauagaaauauaaacauuaggccgggcacgguggcucacaccuguaaucacagcaccuugggaggccaaggcggguggaucaccaggucaggaguugaagaccagccuggccacauaacgaaaccccaucucuaccaaaaauauaaaaaauuagcuaggugugguggcaugcaccuguaaucccagcuacucggaaggcggaggcaggagaauugcuugaacccaggagguagaaguugcagugagccgagaaauugcgccacugcgcuccagccuggucaacagagcaagacuccaucuuaaaaaaaaaaagaaagaaagaaauauaaacauuaggccgggcacgguggcucacgccuguaaucccaacacuuugggaggccaaggcaagcggauaacuuuagucaggaguuugagaccagcacagccaacauggugaaacccugucucuacugaaaauacaaaaauuagccaggcaugguggcacguaccuguagucccagcuacucaggaggcagaggugagagaaucucuugaacccaggagacagagguugcagugagccaagaucgcaccacugcacucuagcuugggcaacagagugagacuccaucucaaaaaaaaaaaaaaaaaagaaagaaagaaagaaaaaagaaauauaaacauuaaucauuagaagacuuucuugaauuauggcauucuguuguuaaaauucuuccauuacccaccacuucuguugacuuugucaacauguuaauaaauugaggcucauggugguaacuuuaaaguuacaggauccuaaaaugucuucugaauuauuaaaaaguguguguguguguguguguguguguguguguguguguucagugccaugaacagugaaguuaacuauguacuuaucuuuucaaauaagggauccaguaaugacucucaagaugauccuucuaaccagaguguuugcuugccugaaauacgauauucccucacagaugagcucuccagaccccaggagaaagaauaacugaucgaaacucauguacuugguugguagcugucagaauaagagugcaggucuucugauucuuuuuuuuugagacagaguuucgcucuugucacccaggcuggaguccaguggcgugauauuggcucacugcaaucuccgccuccuggguucaggcgauucuccugccucaaccucccaaguagcugggauuacaggugcccaccaccacgcccagcucauuuuuguauuuuuaguagagaggguuucgccauguuggccaggcuggucuugaacuccugaccucaagugaucugcccgccucagucucccaaaggucuuuuacacagugcuucuuccugcagcguagcacgccuucucacauagaggaugcuuguaaagagcguggacuguggagucagaaagaucuaaaccccaagaacagcuccaccacucaguggcaaggugaucacagcuucggccucugcuuccugaacuuccucagguguaagauaggguuaauacuaugucuuugcucaauaaauguuagccacucuuauuauaacagagggcuugcuguacaugcagucauuaugcuuuacaguuuaaaauagaaagaccaagagcgaaucccuucccagcccauuccaaucccaguuccagguuccuucauccaugcaggauggucaccuuuccuuggggacagcuugccucuuuucaucaccccuaaucaaucauucuauccuuucuucaguccuuguugucguuuuuauauuucuuuuauuauuugaguuagccuuauuauuauuauuauucaaauuauuauuuguuuuuucuuuuuuuuagcaauuauuauuaucauuuaucucagaaaaucucuaugacaauugugugaaguacaauuaugauuacauaugagauaauugcaccacagacauguuauauaacuugcaaaaagccacaaacccaauaagugguaaagcccaaagcacagagguuuucuuucuuuuuuuuuuuuuugaucauucuuggguguuucucgaagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucagagaucaacagcaucgcaaggcagaagaauuuuucuuaguacagaacaaaaugaagucucccaggucuaccuccuucuacacagacacagcaacaaucugauuucucuaucuuuuccccaccuuucccccuuuucuauuccacaaaaccgccaucgucaucauggcccguucucaaugagcuguuggguacaccucccagacggggugguggccgggcagaggggcuccucacuucccagacgggguggccgggcagaggcgcccccaaccucccggacgggguggcuggccgggugggggcugcccccccaccucccucccggagggggcggcuggccgggcgggggcugcccgcagccccccaccucccucccggacggggcggcugcugggcggagacgcuccucacuucccagauggggcggcugccgggcggaggggcuccucacuucucagacggggaggccgggcagagacgcuccucaccucccagacgggggucgcggccgggcagaggcgcuccucacaucccagauggggcggcagggcagaggcgcuccccacaucucagacgaugggcagccggguggaggcgcuccucacuuccuagacgggauggcggccgggaagaggcgcuccucacuucccagacugggcggccgggcagaggggcuccucacaucccagacgauggguggccaggcagagacgcuccucacuucccagacgggguggcggccgggcagaggcugcaaucucggcacuuugggaggccaaggcaggcggcugggagguggagguuguagcuagccgagaucacgccacugcacuccagccugggcaacauugagcacugagugaacgagacuccgucugcaaucccggcaccuugggaggccaaggcuggcagaucacuugcgguuaggagcuggagaccagcccggccaacacagcgaaaccccgucuccaccaaaaaaauacgaaaaccagucaggcguggcggcgcgcgccugcaaucgcaggcacucggcaggcugagguaggagaaucaggcagggagguugcaguaagccgagauggcagcaguacaguccagcuucggcucagcaucagaaggagaccuuggaaagaggggagggggaagggggggggagagggagagggagagggagcuauuuguuuuuucuuuaauucauuuguguagaaaugaaauguuggaauacagacugagcuuguaguuaauaaacagauauugauauagcugugaaaauggaaacagaggcaaucuaugaauaaauacacuuuuuccaugaacucaaccccaggacacgguggacauuguccuucaaagcuuuuuuugcccucaguauggcaugagaaaaagagaaccaguaauucaggcuguaucugcauaaacagaguucacuuagaagcuagccaggaauucuaaaugugcuaauaaauggcuaaaccaauaagcaacaaagauauucugaacccaaguuacuaucauggcugaauuccacucugcuccacuggcuaggaacaagaguaaaacaucaaacccuggaaaacagucucuauguggucaaccacagcacuagcuacacaccacugaucugcucagaagucacuucagauagaugcugcauuugaaaaguuucaggguucuguucucuccuucccaagggaaggagacagcuccauugaaguugaggugguggagaaggcauucagugaaaacccuguguuucucuacagguggugacuuucgaugcagggggaguaaguggccacagcaaucacauugcucuguaugcagcugugagguaugauucuccgggugauggaugugggggaggguuuguuuauuugauuagggcucaugguuuaaagucuaaagcacuuucccacuuguuaucugagcccaugaaacucacugcuggcuuaucuucuagcccuuuuuggccauguugcucacugcaucucaccauguccucucgcugagaaaucucucucaaguccuaguacgaaugcucgucuccuaaacagcugaauucuuuuuuauacacugaauacugcgaaugggguaauugacuuuauucaucucuuuucuguggccacaggaagcuugagggccaaauuugcaagcccuguggcacuggacaagacuuuaaggaaugagugcugucaaucagugugccuccaccuucaccaucuucuuccccuuacucucacuuccgucauguguuuuauacaacucucaaaucuuucuuggagaaggaggauauacauacauaauaugaaauguguuuguucuucacagucacccgauuuuacugauauuuauuugcauuuuaccaauaaaaagaaaaugcaagcucaaagguauugagugacauagagucauacaaacauagauguguuuccuguccccuagcaaagugcuucuccugggccccugaucagugguguggcaggccugucccagcuacugaggaaggaaagaagcaacuugaagggaaggacuuauuuaauaaccuucuucuaaacaugcuuaacacucagacugaagcaaugcaauauguaaaguuggaaaugaccucaccaaccauuaaguccaaucacugggaagugguuugcccagcaccacaagguuaaacuauggcagaggcagaauucaggaauccuaguucuccauucauuauucugucagauguaugugaagaccaauccaaacugaagacccuccuuguccuuaaauuuuacaucacuugguggaagaugcuagaauuuuacccacauacucuuucuaggcagauuucccuguuuccuugacuauggaaugaggggaggcuagacuguucucccuguaaagacuauucgguuccugguccagccagcagccacagcuuuagaagagacaugcuccuagucgcauuaggucccuucaaauucaggaaagaaacauucccugguuacagucugaaauacaaauuuuuuugaugauauauggaaaaaugaggcagccccagaguggucuuuccaaccacaugguuacucugaggccuugagcuuccaagacuagcauggacagcaagccccauggagaacuggaaaaauggucccaccucauucuggaugcacacugagccuggugauuucucuccgagaauuuacacugcaccagagaaaggaucaggucaggucuauugcaaacaaagaguaccucaacaggcagggggcuggggcacuugagauugagucaccuggucccauuccugguccagucaccacugaaguggagaaaauagagaaggcgucauucugggcagagaaagaacccaaggggacaacucuguguagauagaacugccuggggccauuuuccucagaagaggcuggagugccacaggcucucagcacgaaggagggccacugugcuucagauaaaacaauucauggacaugccaccaaucugccacaaccuuuuuccccacagucaucucuugccugcuaaauucguuagacucacguuaguccucagccaccuugaaccuucuguggcaucuggcccugccugucccucacugcaaugcugcuuugacuuauauggcaccagcuugcccuccucacucuggccuuucuggcuacuucucauucucuucccggcuucccucccaccaguggccccuuggucccccuguccccagggcucacuccccaguccuccucagcacagcuucuccuguggcuuuaagggcuauaagcucuacuuccagacagcgccucuagcucacugcuuucccuggacaucagaauauccacagggcuuugcccagaguacaggacaagccacuucauucucaggaucccagaaaguuuuuucagucuuuucuuuucuuucuuucuuucuuucuuucuuuuuuuuuuuuuuuuuuuuuuuuugagacagagucucgcucugucacccaggcuggugugcaguggcgugaucucagcucacugcagccuccgccuccugccucagccuccugaguagcugggaacuacuggugcaugccaccacgcccgguuaauuuuuguauuuuuauuagagacggaguuucaccauauuggccaggcuggugccgaacuccugaccucgugauccgcuugccucggccucccaaagugcuggguuuacaggcgugagccaccgcgcccggcuccuuuuucagguuuuucuaccucucaggcucugccaggcagucaguuccaugaauuugucaauugucucucaacuucucuuguuuaaccccugcucccaagagucucuguucauaugugugucuguguguugcuggggcuaccuucccaauccuucucugcccccagcuuucuaaacaacaaaguggggaagagacuuggagcucauugcaguugacacuccccuccucuuaagguggcgagcacagaaugaccugcacugucagaagguaggcguagggaagcucagaaaggagaaaggaaauaucagggaagagcuaucaguuagcauuguaaaauauucccccaucauacucacauuacacuuccaagagaaaaacuaugaagaguccagcacaguuaccuucauucucuaaugggcaaagcuuggaccagaguacuucacaaaccacagaccagccucuggauuggcugucccuagcucaggugcccauccuggucccuucagcuguugccagagguaugggauccuggaaaucuauacagugauuuaugcaaaagaaaccaccuggagacucacauggaggggaccaugggcauggcagccuuuccucugaaggccccuccuguuaccuacaaaggaaaugauccuuacuccucucacucuuguccuaucccuccuccagggcccugcacucagaagggaaguuaccuaaagguaaggcuuguuccuuuugcaaagggccacaagauacugucccucugagaaacuuaugagggggaaauuugcaaauccacagagagcugcccucagccgagcagaggcagugguuggggaggccgccacacucuuccugacucaccucaagguaccuggcagguuguaucuaccagcaagugccugccugcagggccaccucuggaugaguggggaggccagguuugccccucaaccugucuagcuuuuucacaggguggauguuuuacaccucugguauucuuccagucugaacucaaucccaucccccaaccaauuaggcagguuguaaaugacugcugggugcuugaugaaccaaucugccugaguuaggaacucuuccuaacccacauaaaguauuugacccuaccugaccauuuacugcaugacccccaugcuuagccucucuggaccaguuucuggucugucauaccucaccggcgcaauacgaagauucaaugaaugaaaacguaaguaguuugugcccuuucuaugugggaugacugaaaggagcuuaccaagccaugaugacuuuggaacaugacuauaguuuguuugauucuuauaucaauccugugagacaggcaggucucacacuaucaacaccaauuuacagauuagaaaacugagacugagagugguuaagggacuuugccaagucugucaauucuugacugacagagcuggaaccaggucucuaaacucccaauacaguaauuccugucuccuuuacuuccuuuggcuuugagguagccagaucucaaccucuagcagccaaccuuuuucugguagggcacaccgcaggguagaggguagccagccaggucuucuauggcccuuuuacucguucuagcugcaagaaucaugggcacagggcagcuuuagugccacagaaacacguggcaaugcuguggccacuguccugcccugcccugagccacaggguagagggaggaugcucaggggaaaaucuggcuggaggccucaaggcuuaucacuucacccugucuccucuccauccagggugcucugugcucacgcuucagucugugaaugugcugcgcaaguacaucucccuucuggaucugcccuugucucugcuucauacgcaggauguccucuucgugcucaacagcaaagaaguggcacaggccaaggugaggauuguaaauuccuggacaccccaacucagaucccugccccagaccccugucuccucaaagccccaccucugcagaagcccuaacugaagguuuuucacagugguucagcaccugucccugagaauuagggcuaggccagcuagaucuugggaggcauagauuuuucaaugacuuuagccuuuuuuuucuaauuauaaaaauaauauaugcuuuuucuaaaaguaaauaacacaugcucauugcagaaaaucuugaaaaacauaaaagcaucaaaaagaaaauaaaaauaagaacaauuaccugcagucccaccaaucacagguaauccuuguuaacauguugggcuacaucuuucuacucuuuuuuuuuuuuugagacggaguuuugcucuugucacccaagcuggagugcaguggugcaaucucggcucacugcaaccuccgccuccuggguucaagugauucuccugccucagccuccugaguagcugggauuacaggcaccgccaccacacccggcuaauuuuuuguauuuuuaguagagcugggguuucaucauguuggccaggcuugucucgaccuccugaccucgggugauccacccaccucgaccucccaaagugcagggauuacagacaugauccacugugcccagcccuacucuuuauauauauauaauguguauguguauacacauuucaaaugggaucacacagugccuauuuaaaaccagcuuuggccaggugugguggcucaugccuguaaucauagcacuuugggaggcugaggcgggcagaucacgaggucagggguucaagaccagccuggccaacauguugaaaccccgucucuacuaaagcuacaaaaauuagccaggcgugguggcaugcaccuguaguuccagcuacuugggaggcugaggcagaagaaucgcaugaacccgggagguggagguuguggugagcugagaucaugccacuguacuccagccugggugacagagaggauucugucucaaaaaaaaaacaacaaaaaaccugcuuuaacaauacguuaugggcugggcacaguggcucaugccuguaaucccaguacuuugggaggccgggguggguggacugcuugcugggcaacagagcaaaaucccaucucuacagaaaaauuagccaggcaugguggcacaugccaguggucccagcuacucggguagcugaggcaggaggaucacuugagcccaggaggucaagguugcaaugaacccugaucauaccacugcacuccagccugggcaacagagccagacccuagccaaaaaaaaaaaaaaaaaaaaaaucaaaacuauuuauuaugaacauuuucuccuauuucauuuaguauucaaauaccaauggcugccaauuacgccacuguauguauauaccauaagauauaucacgaaucccuuacuguuagacauuuugauuugccacuuuaucacuguuauacauggagcgaugcucccagcuugaguuuaagaagaauucagaccugccaggagccucuguaaagagccuaggggaggccagacgccguggcucacgccuguaauccuaacacuuugggaggccgagacaggcagauugucugagcucaggaguuugagaccagccagggcaacacggcgaaaccccgucucuacuaaaauacaaaaaaguagccgggcgugguggugggcaccuguagucccagcuacucgggaggcugaggcaggagaauugcuugaacccgggaggcggagguugcagugauccaagaucgcaccacugcacuccagccugggugacagagcgagacuccgucuccaaaaaaaaaaaaaaaagagcccagggcagacugcaagaagcccacaugcagggugaggaagagcuaggccagcucaggucauccuagggaaaacucuuagcuguccauggaacaggugacugagugccaucagaguuagggagagggugggcugaggagaauuauuccucaguuugucuccaggugcaucccccuguagacuuaagccccccacagagagauggguagcauaacaagugaaagaaccaagucggggauuguggcucgugccuguagucucagcugcuugggagguuggggugggaggauggcuugagcccaggaguuugugucugcccugggcaacacagcuuuauuaggaaaaagggaaggggaaggggaaagggaagggagagagaggaaggaagggagaaagagacagagagaaggagagagugagagaaagaaaaggaaggaaggaaggaaggaaggaaggaaggaaggaaggaaggaaggaaaggagggaggaaggggaggagaggggaggggagggagggaggaaggggaagggaagggaaggaaggaagggaagcgaaggaaggaagggaagggaaggaagaaggaaggaagagagagaggaaagaaggaagaaagaaagagaggggagggagagaaaaggagagaggaaggaagggagggagggaaggaaagaaggaagggagggaaggagggaaggaagggaggaaacgagggagggagggaaagcgggagagagagagagagaaagaaaagaaaagaagaaggaaggaaggaaggaagaaaggaaggaaggaaggaaaaucuaagagaauagaaacucaggauaaugauuuugguuuugggguuuuuuuguuuagcuuuauuuucuaaauuuucuuugagaugaagucuuccucugucacccaggcuggagugcaguggcacaaucucggcucauugcaaccuccaccucccagguucaagcaauucuucugucucagccucuccaguaacugggacuacagguucacgccaccaggcccagcuaauuuuuguauuuuuaauagagaugggauuucaccauauuggucaggcuggucucgaacuccugaccgcaggugaucuacccaccucggccucccaaagugcugggauuacaggcaugagccacugugccuggccauuuuuuuuuuuuuuuuuuuugagacagagucuugcucugucacccaggcuggggugcaauggcacgaucucagcucacaacaaccucugccucccagguucaagcaauucuccugccucagccucucaaguaacugggacuacaggcgcaugccaccacgccuagcuaauuuuuguauuuuuaguagaggcaggguuucaccauguuggccagguuggucuugaacuccugaccucaaaugauccgcuccccucugcuucccaaagugcugggauuacaggcaugaaccacugcgccgggccuuuuuuuuuuuuuuuuuuuuuagauguaguuucgcucuuguugcccaggcuggagugcaacggugcgaucucagaucacugcacccuccaccuccuggguucaagugauuuuucugcaucacacucccgaguagcugggauuacaggcaugggccaccaugcccagcuaauuuuguauuuuuaguagacacgggguuucgccauguuggucaggcugaucuugaauuccugaccucaggugauccacccgccuuggccuuccauagugcugggaucacaggcgugagccaccaugcccggcccauauuuucuaaauuuucuacaguaaaccuuuguaccuaauaagaggcacuuugcuagguacugagagugcaguguugagcacauauuaauuaucuuguuucuucaauagugcauucguuuuuguauuuuauuauuucuguccuacuucauuuaugguuuuauucuuuuccuuccuuccuuccuuccucccucccucccucuuucugucugucugucugucuuucuuucuuucuuuuuacuguuauuuuaugguuuuuuuuugagacggaguuucgcucuuauugcccaggcuggaguacaauggugcaaucucggcucaccucaaccuucgccucccggguuuaagcgauucuccugccucagcgucccaaguagcugggaucacaggcacacgccaccacgccuggcuaauuuuguauuuuuaguacagacaggguuuccccauguuggucaggcuggucucgaacucccgaccucaggugaucgcccaccucagccucccaaagugcugggauuacaggugugagccaucgcacccagccuauuuauuuauuauuuauuuuuauuuuuugagacagagucuugcucugucacccaggcuggagugcaguggagcgaucucggcucaccacaaccuccaccuccuggguucaagcaauucuccugucucagucuccugaguagcugggacuauaggggcccgccacuucgcccggcuaauuuuuguauuuuuaguagagacuggguuucgccauguuuggccaggccagucucgaacuucuggccucaagugauccacccggcuuggccucccaaagugcugggauuacaggcgggagucaccgcacccagccuguucuucuuuaaaucucuuuaacuugaaagguuagcuuuguuuucauuuucaaucuuuaaaaaaaaaauacuuuaauacuauuaauuuuccuugaaguguuucuuuagcuacacaugauaaguuuugauauguaguucuccuauugucauuuaauuauaaguaauuuauagacuccauugugaguuccccuuuaaucuuugaggguauaauuuacaguuacaaacaugugucgaucuucauuauuuguaguucuauauuuaugaaugcaccuacucacuaaaauucauuuguaacuccaaagucagugcucgaagugcuuuuguagucauucguggacacucgcagaggggugaaacaugagucacuggaugcacauaugcauguucccagcuguuucagcucuccuacuguaaaaaaauaccuuuuuguguauauuuaaugccccauuuuucucauuuuugugguuuuuguugauuuugcuguuuaaaauagccucuaaggaugaugcugagugcugucuugcauuccuaagcacaagaggcuguaaugugccuuauguggguuugaucacaagcaugaguuacagugccauuggccaugaguucagugcuaaugaaucaacaacauguauuucauauggaguuuuuaaacagaaauauacacaaaacaagguuauauauugacugauugaugaaaauauuguggccaaaggcuuggaggaacccaacccuguauuuccacuagaaacaaugguucaguauucacuaauucaguguuuucagugacuuuguagaacuaccacaaaugagaauggcauggcuguguguguauauguggucuuuuuuuuuuuuucugagacagaguuucacucuuggugcccaugcuggagugcaauggugcgaucuuggcucacugcaaccuccaccucccagguucaaacgauucuccugccucagccucccagguagcugggauuacaggcaggugccaccacgccuggcuaauuuuguauuuuuuaguagagacgaaguuucaccauguuggucaggcuggucucgaacuccugaccucaggugauccucccaccucaaccucccaaaguggugagauuacgggugugggccacugugcccugccguguauggggccuuuuuauuguuaauuuauaauuuaauuacuuuguggucagugaaugguuuucguaacacugaucuuuuuuuuuuuuuuuuuuuuugagacagagucucgcucuguugcccaggcuggaguguagugguaagaucucagcucacugaaaccucugccuccuggguucaagugauucuccugccucagccuccugcguagcugggauuacagacaggccggcaccaccaagccuggcuaauuguuuuguauuuucaguagagaugggguuucacuauguuggccaggcuggucuugaacuccugaccuggugaucugcacaacucagccucccaaagugauaggauuacaaacaugagacaccgugcccugcccaaagcugauauauuuguuagcagauuauuucucuuauuuauuuauuuauuuauuuugagacagaguuuugcucuuguugcccaggcuggagugcgaugaugcgaucuuggcucacugcaaccucugccuccuggguucaagcgaguccccugccucagccuccugaguagcugggguuacaggcgugcaccaccaugcccagcuaauuuuggauuuuuuuuuuuuuuaguagagauaggguuucaccauguuggucaggcuggucucaaacuccugaccucaagugauccaccugccucgggcucccaaggugcugagguuacaggcaugagccauugcgccuagccaauucgucuuauuaucuuauaaugucucucuuuuguaaugguuuucccuuuaucuucuauuuuauauuuauuuauuuauuuuuuugagacggagucucgcucugucaccaggcuggagugcaguggcgaucucgguucacugcaaucuccgcuaauugcaaucuccucuaauugcaaucuccgccuccuggguucaagcaauucuccugccucagcuucccgaguagcugggauuacagguaugcgccaccacgccggcuaauuuuguauuuuuaguagagacagaguuucuccauguuggucaggcuggucucgaacucccgacuucaggugauccacccaccucagccucccaaagugcugggauuacaggcgugagccuccauaccuggcaagucauguagggucugacaaugaauauaaaagggguuauuuacauaaaaguuugugaagauauuagcuuagagaggcaaguuaauuaugguacuuagagauaaacaggcacauccuuuuauguauaucuagugaagucaguugcuguaaucuauucuguuuaaaaacugaacuauacuaggucugaauaacaagauaauguacauuuccccuagaagauaggaacgacaacucacaccugugugccauuccuuuuuuucuucuucugauagugauuggaccuccccaaacgaccuaacucagaggaauuugggcauaguguacuagcuuucuucccaugaaacaucccuguuuguguuguauauuugagguaguagcaacgugauuaagaauguggacucuaacuggccaggcgcgguggcucacgccuguaaucccagcacuuugggaggccgaggugggcagaucacuaggucaggagaucgagacuauccuggcuaacacagugaaacccugccucuacuaaauauacaaaaaauuagccaggcaugguggcaggugccuguagucccagcuacucggaaggcugaagcaggagaauggcgugaacccaggaggcagagcuugcagugagccaagaucgcgccacugcacuccagccugggcaacaggcucaaaaaaaaaaaaaaaaaaaaaaaagaauguggacucuagaaucaaucaguuggcucuggguuaaaaucucagccagcucuacuaccuacuagcuguuugagacugacgaguuuccucaucuauuuauuuuuuaaaaaacaguaauaacaguacuugauucacaggguuguuaacauugagaugaugcauguggacuguucugccaguuuucugguaucccauggugagugcuguagcuacggugagcauuguguguuauaaucacagguaguaggagaugggaaagcaggggccaugacaggaggccaauccagagagguucguggguuacaggaagaagacagauaaggcuauagcaugaagcauauuaguucgaggaaggauuuaaggugcggaggccagaucugaaaguaaugaaacaacuccagugcaacuguuucauaacugguucucuuugauucuucuagaaagccauguccugccaccgcagccagcuccucugguuccgccgccucuacauuaucuucucccgguacaugagaaucaacucacugagcuuccucugaagccuugaaggguuuucagauccaaggaacaaaggggaaaauagacaaaggagugcagaggaccuggccuggcacuggcuuauuuaccugagcucaaggagauccccgcuggagcagccucugcaaaagggagcccauguaggccaggggcuguccaaacuccagcuucuuccccugggaaaaaacccaaagaaccaaaaacaaaccaccccaaggauaauaauagcuacacugcuagcuucucaaguucuugugaaaaacaauuuacauaaugacacaguagauguggaacaccuagcccagugccugggcaggucccuauuaucauaaaugaacauaaaagugcucuaaaaacacucca

SEQ ID NO: 192253 - RNA, 50153 nt, Homo sapiens
gagcgcggggagcgccgacagccgcccgcccgcccgcccccgcgacgcccgcgcgcaacaguucccccaaaguugcagcccgggaggcgagcgcgcacgggcggccgaggggcgggcgguuggcggggacgcggccucgcggcccagagcggagagucccggcgggcggcggcggcaugggcacccggcagaccaagggcagccuggcggagagagccagccccggcgccgcgccgggcccccgacgcgaacggccggacuucugggcgucgcugcugcugcgcgccggggacaaggcggggcgcgcgggcgcggggaugccccccuaccaccggcgagucggcaugguccaggagcugcugcggauggugcgccagggccggcgggaggaggcggggacgcugcugcagcaccugcgccaggugagcgcggggagggggcgcggggggcgcgccgggccagggggcgugcugggccggggggggcgccccaucccuaaccgaggaagccgggggcaccgaggggcaccgcccaggggccccuuccgcggggauggagcccugucuggcagcaggugccucggcgcuuccgcugaauguggggccucagggcagggcggaggaaggcuggccgggugaggcccgccgaaggggaccuguuggcauaauguccccacugcucuccuccgcaggcagagaaggaggcuggucuccggggacagucggugggcggggaagcagggaugccugccugaucugggccagggcucuuuucuuccugucugcccacuggcagucacucccggccgaggguccucaaggaaugcgguuaucaguuggaccuggcuuggcuucccgagagcgaguccaggggcacagcccuggggccaaugagauuccagucccuagguccuucacucgccugggaggcauccuggauuguaguucaaggaggagacuguuuccucuccccugacuaacuucagcagauccucaaccaugagccccugcggaaagcgguagagacaggggagcuggauuuggugcccugugugaccaccuggccagcagcaacuucaggagacugccaggacucuguccuuagccugugccugucccacuggcuagggacagauguugcggaauuggccaguucccucugcuuuggggcugcccugaggcuaaugcuaucacucaccucucuguggcuuguuuuccuuugucaguuucuuugguggggagaggagcauggcccaugccauggauuuuguugaguauaagacaggcaggggagugcaaagcugcucuccugcaucaccaagcagguugucuuggccuggcuuugguggguagacaauccaggccccauauucuugcuagacugaccccauuagagguggagucuaccguggauggcagagggaaaaucucaggugaccuuucugggguuuuccagucgcugcugaaagaggcuguaggagcaccuucuugggaggagcuuccaaaaucuaaucagacccacaucccucuuggguucugcagcacucuuccccaccuuuguaucuggugcgcucuuacccuaaaguauguguccccaagcugugcacugcacagggagaggcaagcagagacgaggggacuugggaagaugugggacuucugcuucugccucuguuuuccccaacaacuuccagaaugaugcccgagacgcugcuggauccccaugugccuucucugaguucagucaucaaagaaagaugacauuaugcaccacugaacuuuagcaguguguauuucuuugucuuuugaaaauuggaagcugacauauggccuuuauaguaacucuuucacuuuuaaacagaauauuggguuuuccagaccaugguauccuauuuacacaccauacaguaagguuuuccugaucacaugcuguuucccccacccugcaaugggugcuuugggggauacagaagaacagagggagcuggcaagcacuucuuggagggugcaagaccagagcgaagcuugcaugauggagggccgcuuggaggcccacgggaggagacuggacccaaagugggcagauacuuugggcuccccagucccuguagggcugagugugauuccacauccuggggacacugagcuucucccugccuugagggagaguagauaagccccugcagccccacugugggauccuugaaacaagaagcauuuccucagacaucugcacaugggucuuauugguguccugguacccgccucagcugcaggacugggagggcugaugggggggugggagggggcuuaucagacuucccccuuuucugugaaagcagcagguccucaggcucugggcuucugggcuccuguugggcucccuuaaccccuggcuggggaugcaagggccgugggccuggagcugcccuguguggccuggaacggauggagcaggaccccucccgaaaguggucaugggccuugagcagugugggaguggagcacaggaguguucacuugccuaugacagagagguggcuuucuaggacccugaggccauuuggaggaauguccagcuggauuugugcugugcacugaaguggcucuuucuccaaaauugcauuuuccuuuccauuccaguuuccuucucuagucuggugguggugauguucagaaagggaaugagcagcuagugagagccuugagaacacacaagccucacaggggucagaccagcaagaaccucuuccucagcaagacagccaguaaagacaggggucugcaaagcguggggcacccuguucugcaggaaugucaugcaggccucuggggugggagucaaugagcaggcacagaaccagggaggggcagcagcgaggacaguagcccucaccuccauucacacagcauguucuccugcauuugauaacuuggguuuggcugcuggauuuguguaugcccagagccauauggcugguggggacucgggagccuuuguuccugugcuucuuagccucuuugaguccuugaucuuuuugaggcucugaaaaagcuacacacaaucuucccaggcaaaugcacugacucacgcaaucucacaggcaauuucggaggguucacaaagccccugaaacccagcuacagacuccaagcucagaaucucugcuccaguccaauaccacccuucucccugcugugacuugcuccaggcuggggaucuggaaacagggaccugacccgggugcauguguggcaguucacggugggcugaaggauuguggcugcuggugccacuucuucugaaugccccucuucagcaucuaagauuuggagggcgucucuccagcuugucacuugcuggagagguaucaggaggccucauucagcacaaaugacccugagcuguggccaggggugcaggcaggaugccaggcagcugccuugaaggaacagaaaguaauccccuucccuuuaagauaaguguaaucugagaagaguccagggccaaggaucaaguaggcagcucgccuuccgguccucagucagcugugaccuugggcccagcagauaaccucucugaguuguguuucuuuguuucccaaagagggaucugggguacugagcacagcaaaugcuacaaagugaaugaaaugguguuggugcugccauucaagacacauucucuuggugacugugaaacaggagaaucugccuuacucacuuugggucuggccccaguaggggcaggguuguggcauccuuucucaggcauggcccaagaauuuuuuggauuccaucuaccuggccaggguucagucuggaucaaaaacucacugcacauuuagaagcaucuggagcgaaugcucguggagauaaaacaagccagcuuuggaugggagaggccauuccucugcccuuuccuggccgccauccuuccaggcuuuccccuuccccagauguccuuccccuugggcucaggccugcugucuuuaaggagcccuggagaagaaauaaccuuccgccauugagagagggcaagugccaggccaccuugagggugagcugucaucucuucaccccagcaguuucccugaguccucaaaauuuuagacugagcugucggccugcgucauggagcagcagaaaaaggcgucuguuucccugggauacacccagcugagguagccccugucuucguguucaccagcaccccagcuuucccaugagaagaggcugaugggguugguuuacucgaaguguggcgcacaccucuuaagcagggcuguuccuauguuaacuuguuugggccucccagugguauggcuagggccuggaauccugguuccugcugcugucugggguggugaggcuggcuucacucugcaccugggaacaggaaccacaucagcuaaugccaacaagaaccacugaggccaggcgaaaugcucacaccuguaaucccaguacuuuaggaggcugaggcaggcagaugacuugagcucaccaguucaagaccagccugagcaacauggcugucucuacaaaugcaaauacaaaaacuagccaagugugguagugugcaccuguagucccagcuacuugggagacugagguaggaggauggcuugagcuugggaagcagagguugcagugagccgagaucaagccucugcacuccagccugggccacagagccaggaccuaagaguuuaacucaccccucaaguggagcugagcaauggacagacaccuggagacucccuggagauguggagacuggacaggucguuacuaccuagaagcagaaagaugagcauaaugaccucagaaggucaccuuuuuccuuccaccuccaccuaagaacacuucuuuaggcaagcagguuggaaggcuaccagacaccgagcaggggggcccuacgcugggccugcucuucuuccuccaccuggaaugcuuuucauguuuccacugaaugcaccuuaccuuuccagggccaccuuccugggcaugucagccgaagcucagagauccauguggcucuuaguuccugccacacugggaggcauucaauccaugcagaguuuuucccugauguuccuuuuguuugucagauaaggucaagugcuuccugagggcggagacccaccaccaccacuguuauccacuguaugguauugaaaaccuguaggcucguggcauaccuuagugagucugugugccgugaagaugugcguacgcgugugugucugcugcugucgucaguguguccucagaaagcacuuggauuccccagcuacggcugugcaacugugggcugauuuaccaggcuuguuaguacugucaugagacacagcacguuugcuuuccgugugguuggauuucugggagugauguccacagggcuuggcuguuccuggcagccugccaggcggugguguucuuggagagaggaguggcauggugcccaggcucuguggcacuacgggaucccauccggcaggugcagucuggggccucugccgagguggcgggaggggagcggagccugaugggagagucuggccuccacauuccugaucggcucuugugcugaaucauguucauuuccuucacaaagagaaaccuuccuuuuuaaaauccgccgcucucugccugggcuggaucgaggcuuuuccagugauaaagaugcagagggauuccugugucagagccugcuucauugguuuccaaggcugccagggacacuggcuggggaaauagcagccucuguaguggcuaagcacgaccgcaggggcuguagcugggccgguuauucugacuuuagggucuggugaggcugugggaugggguugggggguccuuuuuucuggaacaaaugccaccuccucagagauuaccagaaacugcuuugcugucuucagagguccuaaaguacccuggccuccauccauggaccgucagggugggugcacccuccccuccccccagugucauuucauugccaugcgugcuuuucuggggcagaggccauaaaaacuggcacacagucuguuuucaggaaauucuuacagaauggauugaaacuucccaucaggcacacacuuccuccagccucugucccuggcguucucucucaggagacagcgggguuuggcucagacuucugaaguguuucuacugugaccgugggccuggguauucccccaccccgcuguaaccugugggguggaagccaugauuccucccugcauccccacucccugucugcaggggagagacuccuugaagaaggguuauccagugaccagggucuucuccaacuccuccaucaggaugcagaggggguggggucagcauuggagauucuccccgcaguguggggauccucagccagccaucugucuccccuuccccaccaagagcagugcugccggugcccugcaagaaaaccacgcaugcgcgcccacgcauacacacacacacacacacacacgaacacacacacacacacacacacacacacacacacacacugcuuguccuggcuccuccuggcuguucuugccgacugucuuaguccuuuccggcugcuauaacaaaauaccauaaacuggguggcuuauaaacagcagauacuuauuucucacagucuggagucuggaaaguccaagaugaaggugcuggcagauucacuguguggugaggcugcuuucuggugaugguacccucucgcugcauucuggcaugguggaaggaaugaagggucucucuggggucucuuuuauaugggcaccaaucccauucaugagggcuuuagccuuaugacugaaucaccucccguaggccccaccucccgauaccaucaccuuggggguuaggauuucaacauauacauuugagaauggagaggaggggacgcaaacuuucagcacugacugucauauccucucccauuaagagaaacuggaauggagguaggagagggcccaggcaucuaaaacagcacauuugguugcugcgucuuggacucaccauuacuagaagggcuggguguucugaaugagaacagagaccuuggcgcgccaagcaggggcggggacccccuccuauggugccugcucuccucccuacccccacccggcccugagcagugcccacguggcucuccaggagcauuucccagcuuuuuuuuuuuuuuuuuaacuuuuauuagcucagacuccuggcugcugcagccauauggagcucugccgacggcugcugcucaaagagauguggcauuuuguuguuucuaacuuuaucuuaaccaggagagacacaggagcacagcugagaguggggagugcccucguaugugaguguguuggggccaccuucagagcugccccucgcuccugcucggcccucaguguccgcgugucuuucugccucucugccucccacucccugcagcuuuucuuugugucucuguuucuuucauuuugucuucccugcuguguguuuuucccuucccugggugagaagcagacucuuguuccucugccggaucuuggucagcuccccucucagccucccauccuuugccagcgggaaggugggggaguggggccaugagaacuggaagugguugguggcggucaagaagggugcccggcucgauuugauugucugagugucagccgugccuugggcaggagagcaggcauuagggacaccuccccaaucugcacauggcuuucuaguccauaaagccuuuucucauguuuauuuugcugcuuaggggguggauuuuuuuuuguuuuuuguuuguuuguuuguuuguuuguuuuugagacggagucucgcucugucgccaggcuggagugcaauggcgccaucuuggcuuacuacaaccuccaccucccagguucaagcaauucuccugccucagccuccugaguagcugggauuauaugcgcacaccaccaugccuggcuaauuuuuguauuuuuaguagagacgggguuucacuauguuggccaggauggucucgaucucuugacuucaugauccgcccaccucagccucccaaagugcugggauuacaagcgugagccacuguacccggccucauuaggugguuuugugaaguugacacaauguugcuuaaaguaaaaauggugguuuuuaaaauauuauaaaagcaauauacaauuauagaaaaaugagaaaauuagaugagcagaaaauuaaaaaaguaguaugcauuaaaucauuuauucaacaaucgaguuccuguuccuccaggcaccagucuaggaacuggggaugcaacaggcaacccaccaggagaaaaccauggcagcagcuguuucccuuccuccgggagggauggcaaggaccccagaagccaccaccaguacaggugcgcagcguggcacagaagggaggcuggcuucacugggagccaggagcccucaguucuggccccaguggaaacccuaacuugcccagcccuuucccuucuuuggccucaguuuccccaguuccagaaugaaggaguggugggcgaaaugaccccugaguuucccuaccacugcugagauuccaccaggugccugugguuuuggaaagacccauucauucccauguguggucaguuauuucuuccaggcccugagccagauucacauucgaacccuaaggucacccaccuuggccucagcuggugcaagagcugggaugcagcggucccaggacagagaggggacagauaccuccccaccagguacuggggccgacccccauacugccgaggccaaccugucugugcugaccgcaguccuagcugacggagggugaaaggccacaucacauggugccaggggcagaggccagaaccagggaaccugcagacuuucacacaugagcaaagcccagcccucacagaggcccgagcugcccugugugccacaaaccauucaucucagagcacuggggaggguaaugaggcuggggcaggcucugcugggaccugcuguccacaugacucagugccuggcucccuugccaccuuucugccuacuguggggcugcucuggccccuugcacaucuggucucucuccccucccucuacuucccacucuggcuuccuucucugaggggcugcucuccaugcucgucuggauggagccuguccccacuccagccucuguccuguccacagagacccagaccugccagccccagccgagcuucaggaccuuugccuucagagggcaagaacccugccuggcaccugacugugcacuaguacuugguucuuucacucagcauacgucccugggcaccuaaguggagcuggcaccaguugggacaaguagggaaagcagggccggccaagaugcuaauuucuagaagggcucagggcagucgcugaugccauagaggacuggcaagugacugcagggcuggccauggucagauuccagcucugcccuugucucuggccaugggggccuacacaggugcagggcacggcacacacuggcugcugggcaaaccccuuuccucaguggggcucaugaguggacacaggcgcuaggcccaggaccugugggaagccccgucucccccacuuccuaggugggcuugccugaccugcucugcuggugccucccagcggcccugguccucaagccugucccucuccugcccacuuggccuucccacggcccucagcccaggucucucccagagcaugccagggaccugugggaagagcccccagcuaucucggaacccccugcagugcccccuccaggcacauucccaccccauagccgcuguccccauggagccuccacccacagauacaggugccaaggaggcuugcaggacacccucguccacugaaggacacccagcaccacagggagccagcacuugcagccugggaagucggcaaccugugaugccccccaucccaccccacugcccuuaguuucugucuaugcagucacagccuccuggagccccagguucaggcccuacccaauagaaaggggcaggaguggggcagguuucucuccauuggcaccgggggcagguaagggcccaggagguccugccccacaccaagcguaacagucagaauuccugcccuggaccuagaccgcccaguagacaccgcgcaccuggcaguacccccaacaccccuuuccccauggggaccuggggaguccucugcguaugcggacuauggaaagggcuguauuguagauggugggggaaucaggggaacaggagcugcaggugcuccuggggaggcagggcucuguggugggcugggcagcuggaaacaaaaccucuguuucugauuuccucaugguaaauggucagccuggagcugccugccccacugucuggagggccuguagcucagaugcaggaugaggacaagcacagacagggcucggggaggagacaugucuccccuccugugcugaaugccagggccaucuugccgacccacagacaccuucuccugccaggccaucaugggggaggcaggggguagccagugaauccuccugcagugcaccugccggggcccagguguggaagauugaagcucugcauuccuauggaagggccuacaguggacucagcaugacagagagaugcuccugaaauugguucauaauuugcugcuuaaggcucuuaaugucuucccguagggauguuacuuccuguauuaggguucuccacagaaacagacucaaaaggagauuuacauguauaaacaccuacaguugacuaucacacuuccugugagcgggcaggagagagcaggggccacagagagggaagcauggaggggcucucaucucaccuggcaccagguaggugcugguaccugguguaguccuguggccuuguaauaggcuaccuggcugccuugcacauuguguucuuaccggcucucuccuggcaaugguccuggcucgcugccaucagaggacaggcagcgcugaggcucuaauguccuuagaaggccaaggggccuggaucugccucugccccucucccucacuggaggaaauggcagcaggagggguuccacggcuccuuuggugagaagaccugcugcagucagagcugagauguuugacagaggcgcacacagcccagagacaaggaguggccugugcagggucacacaggacugggaccagguccccaauucccaagacccugcccagcccaguggucccuggagaaguacuggaagugaugccugggucugucccagugaaaaacuugguguuuucugagcuuccucagguugggacagguggccugacuucccucgucacaggcaggguagaagaggggcucuggggcacagaggaccugugcugccccuucccuguagcaggagaaggagauggggagggacagccucaggagaggggaagaauggggagcauaguuaccuugaguguauucccugucaguggucuccaguuuuuuuuuuuuguuuuuuuuuuuuugagacgaagucucgcucuuguugcccaggcuagagugcaguggugcaaucucagcucacugcaaccuccaccuccuggguucaagugauucuccugucucagccucccgaguagcugggauuacaggcgcaugccaccaugcccggcuaauuuuuguauuuuaguagauaugggguuucaccguguugcucaggcuggucucgaacuccugagcucaggcauuccgcccaccucggccucccaaagugcuaggauuacaggcaugagccaccgugcccgggcagcggucuccaaucuuuuuggcaccagggaccaguuuccuggaagacaguuuuuccauggcccggggugggggaugguuuugagaugauuuaaacacauuacacuuauuguguacuuuauuucuguuauuaccgcauuguaauauaaugaaauaauuauacaacuccccauaauguggaaucagugagggcgcugagcuucuuuuccugcaacuagacggucccaucuggggugacaggagacagggagaaaucaucaggcauuagauucucauaagugugcaaccuagaucccucacgugugcagguuacaauaggguuugugcuccuaugagagccuaaugcugccacugaucugacaggaggcggagcucaggugggaacacuggcccacuguucacguccugcugugcagccugcuuccuaacaggucacagacugguacuggucuguggcuuggggguuugggaccccugcuccaaaugacacuuuuucaacaguuuauuucuuaaaguaagauguugagauggugguggucaugacaaugaugaccuaguguuggaggaagcagagagcaggaccaugaccugaagagguguucccagcgaggggcaagcuucaugagcucgcugccuccauguuagauuuucgcuacagcucugcugcuggcagcccaggaaaaccaaggacuuggggguguagaggccauucagugacugagucaggucacucaaggaugccuauccccuugguuuccuucacugagguggaauguggcuucuagcccauagagugccuuuaugagaaguggaagaaggugccugucugguugggcacagccagagucaaggcuuggugaguucagccccgcucagacacccuugugcaguacaugcccugcacagcuguacuuggcagccuuggugagaccacacagaaguuuagaguaucagcugaggccuuuaaugagcuuuagcccuucucccaugcaucuucuugggcacagccuucucaaaucaccugaggcaaugaacuguggaacacugugccucucaggcggguacuugcccucuuucucuugaaucgaggagcugaagcaauugggaaucuucuagaaaguuccagcuaccaguccuguaugacccugcacaggccacuccuugucucuggcucucaaagaggaucagacagaaucuaagacaaccugaguggaucuggacucacccagucaggggcaccgagggcaccagcggaggcaucaggguuuccuuguugggcuuccaugagccccggacccugcaguauugcagggguccaggauuccccucaagcuucccagacuguucauauccuugccucuagcaguucugggggaaugaggucugagugcucccaccccgguaaguaacuuccacuucuucaggcuuagucacuccagucgauuuaguuuuuccuaggacgugccaguccucugaacuuuuuaugauucucagcugcagacuuauguuuuccacagccuucuggcauuguggcguuucggaguaaaaacagucuuaggcaggauucucacuggugggguuuccagacagcuauuggcccaagacagaccagcaggaacucagagggguugguuugggacauggaaacucagacacgaaagacaguaaguuaccuguuccaagaauucccaucucuccagaaaagguccagcagggcgaggcgaauagaaauggcuuuggugucgcaugucuuagggagaggccaguccaugagccaggaccagaagagggcucucugaagguaaugggcacacggagcagggagggacuuuggacuggaauuagacucuuuuagaaaaugggaggccaggcacagcggcucacuccuguaaucccagcacuuugggaagcugaggcaggcagaucaccuguagucaggaguucaaguucagccugaccaacauaguuaaaucccaucucuacuaaaaauacaaaaauuagcugagcgugguagugugugccuaaucccaacuacuugggaggcugaggcaggagaaucgcuuaaacuugggaggcgaagguugcagugagccgagaugacgccacugcacuccaaccugggugacaaagcaagacuccaucucaaaaaaaaaaaaaagaaaaaaaaagaagaaaaugggcaagagguggagugugggcagcugguuggggaccugagagcagguaugcagcaaaaugcucuaagucucuaccugggccaugcucugagggagggaguccaccgagagagacccucagggugagagcagggacgcuggauggagagagaggccugagaugcugcaggaagcucagggccuuugccugacccauugcauuggcugucuugccucacccaccgccacucccacccacagcuccuaccuccucccucccggugucucgaagcuguagacaaacucagugaccacugagaaaccagguauaggccccucccagcccugaggacgccacccccaccccaugcccucuucugcagcccggaagccucgcugauuuuccaccuuugcggggagaaucaggcccugagaagcagggcccuaagaugggaacuauucugccuggcugcaggggucuggcagucuggcagccccuugguguuccuccuggcuccugcugggaaggccccuggaagggcaucuguggcucccuuccugggccggcuucugcccuccccacugcccagagcacauuuuugaaaggucuuggggaaaguggccaagcguggagagguggaagagcacaggcagggccucauccuggccacaguuguggauccuacggcccuccuccucuaucccgccuggucuccccuuccugccugaaguugaaagcuagcuggauuggagcuggauuccucauccagcaugacucaucucugcucacccagagggagggcagcaagaggucugaauccagauucuuggaggucuggccuuggccuuggccuugccucugaccuagagauuuaaaguggugaagacgcuuagcuugugaugguuaauuuuaugugucagccuagcuagguuguggugcccaauuuugggucaaacacuagucuagaugcugcugugaagguauuuuucagaugugauuaacaucugaggcuaggcaugguggcuuaugccuguaaucccagaacuucgggaagcccaggcggguagaucacuugagcucaggaguuugaggccagccugcccaacaugguaaaacccccggucucuacuaaaacuacaaaaaucagccaggcauggccgggcgcaguggcucacgccuguaaucccagcacuuugggaggccaaggcgggcggaucacaaggucaggagauugagaccauccuggcuaacacggugaaaccccgucucuacuaaaaauacaaaaaauuagccaggcgugguggugggcgccuguggucccagcuacuugggaggcugaggcaggagaauggcgugaacccgggaggcggagcuugcagugagccgagauugugcuacugcacuccagccugggugauagagcaagacucugucucaaaaaaaaaaaaaaaaaaaaaaaaucagccaggcauggugacgggcaccuguaaucucagcuacucgaaagacugagguaggagaauugcuugaacuuggggaggcagagguugcagugagccgaggucacgccacugcacuccagccugggugacagagugaaauucagccucaaaaaaaaaagaaaucugaaauaccuacaugugaaaucaguagacuuugaguaaaaacaaaagccaaauaaagccaggugcaguggcucacuccuguaaucucagcccuuugggaggccacagcgggaggauugcuugaugccaggaguucaagaccagccuaggcaaacaaagcaagacuccauuucuacaaaaaaaaaaaaauuuuuuuuuuugagacagagucucacuccaucacccaggcuggagugcaguggugcaaccucaacucacugcaaccuccaccucccggguucaagugauucuucugccucagccucccaaguagcugggauuacaggcaugugccaccacacccagcuaauuuuuauuauuauuauuauuauuuugagauggagucuugcucuuugcccaggcuggagugcaguggugcaaucucagcucacugcaagcuccgccucccggauucaugccauucuccugccucagccucccaaguagcugggacuauaggcaccugccaucacacccagcuaauuuuuauuuuauuuuuuaguagagaugggguuucaccauguuagccaggauggucuagaucuccugaccucaugauccacccaccucggucucccaaagugcugggauuacaggcaugagccaccaugcccggccaacacccagcuaauuuuuauauuuuuaguagagagggaguuucaccauguugaccaggccggucucaaacucuggaccucaggugauccgcccaccucagccucccaaagugcugggauuauagucgugaaucaccgugcucagcccguuucuacaaaauuuuuuuuuuuaauuagcuggugugguagcacguaccuguagucucagcuauucagggggcugaggcaggaggaucagccucccaaauagcgggacuacaggaguacagaaguuccaggcugcagugagcuaggaucacaccaccacacuguagccugggugacagagagacucugucucaaaagcauaaauggauaaaagcugauuacuuuccauaauaugggugagccucauucaaucaguugaaggcuccaagagaaaagagaggucccugaggaagaagaaauucugccuucagacuccagacagcacugccagcuccuuccuggguccccagcuucccagccugcccugcagauuucagacucgccagcccccacaaucaugugagccaauuccuuaaaauaaaucaauuccuuccucucucuccacacacacacacaucuuaucaguucugugucucgagagaacccuggcuaauacuuaacuuccaagggcucauagaggcagagucagaaauuucuaggggcucuggagcgccccaucccugccacuagcucacuguaugagacaaccuuccagcccccagcuuuucacucugagaaaugggcuguuccuaugaagacacuccugcuuggaacucagguuguuagggagccagaaggauccucuaagucguuccucuaccucuuugccauuuuaccugaaaauccuuugaggaugaaccaaauguuucucucuuuuuuuuuuuuuuuugagacggagucuugcaccguugcccaggcuggagugcagcgguggcacaaucuuggcucacugcaagcuccgccuccuggguucacgccauucuccugccucagccucccgaguagcugggacuacaggcgcccaccaccacgcccggcuaauuuuuuguacuuucaauagagacgggguuucaccauguuagccaggauggucucaucuccugaccucgugauccaccugccucggccucccaaagugcuaggauuacaggcgugagccaccgcgcccggccucaggaugaaccaaauguuucauuucacuugggcagaauguacugcagagagggacaaauggacuugaaugcauuugccagaagguauaaacaaccgauucagauaauuucccaagcagagagauuaggagggcgcugggaugggugacaaagugcugagaauuuguggaauguaggggccuguggaccucagagaccaucuggccccaggcauacugcagaaucugagucccacaagagguccuggggaagcaggggaggugcuugggaaauaaaucugggaaauacugcaaaugccaccacccuuucggagucauaaaacaguagcugaaacguccagcaggaaaaggaaaaugguuauuuguugaauucuuuguguuccaaaccuauuugguccaagucccucuucugcugcccucuccaacucuggaagaaugagcuggugcaaccuucucauuuguagguggggaagcugugguguaggaggguggcuugcccagggccacacagugacuuaggaucuaacccacgucugucccccaccgucagccacgugugggcagagccaugaccauggaggagcagacaaaacccuucauauggcuugaugcgccucccaacuuacuuuagauuauucugaagagaaagcauccuuuugauauuuauuuguugcuaaagccguuucucggauuuuaauuaaguuacacuuggcaacggcugggcaucuguuuccagaggccuguuucacacagagggugucauuuuuuaagacuucaaaguuaaaacacaaacaacacacagucaugaagccccucacugagcaaagcugccaaacaucgcugcccagcccgcugacuccugcugggcaaggcagaccugguggcaacacucgucaccgucgaggagggccagccugccggggugccuggcuucaaaaaccugcaggggccacguggccuuggacaggugggagagucaugagcugccccuggacccucaggugggaccagagaaccccagucuuuaccucucaucccucagacaggcugggcaagucugguggagcggggagugggugccaaugaccccccaccagcaguuucuuggcucagaccucugcagagcagcccucccuggcagcaucuggcugacuucggucagcugggugcuaauggacaccuccuuggguaccaaacucacaggccuguggggguggcgggcaccaagccagggugcccucgagaggcaacccccaagacugggaccaggagccgggcaaugcccaccuuagacaucagcaggacugugaggaggccucaccuucaaacaggguucccaugccguccagugguuuuguuagggggaggggauguagcaguugcuuuuauuacuuuugcuagucugcuuugcuuuggugucuuccaagccugagcagugugccucgggcucuuaacugcauaguccucccugucuagcugugcugaugcucccugcccuggacucugcagggugcccaccucaucugcauuaucugucauuaguuauucuuggggcgcgcgcgcacacacacacacacacacacagacuacuuacaacgacuugaauuuucucaauauucaauauauauugaaguggaaauuuuuaaaccuaguguuuccugaagcauuuaacauaccaauuucauuauuccccucacgaaucuaguccauuuaaaugucgauguucaaggguaggggguuuauaacuuaaguaauuaaauuucuuuaaauaucuugauguaacuuuauaaauuuaacauaaccaguguucuuaaguuuauaaauacucauccuaaaaagcaggacuuuccuggguuccuaaauaguucuugaaauuuaauaagcugauaaauaugaugacuauuaguucucugaaacauuucaaaacuuacaaacuuggcugaauccacuuccgguguucugcuuaaaaucauaagcuuaaaaucagcuacucaauuacccguuuuaaauggggauuggaaggccaaucuguuagauacucugauacgccuaauucuccuuaacaugacaaaugugugaaauaccagauuuccguaugccccagcgcauuagcacucacuuugcuccagggccacccuguguaacuguggcacuuuuggggccaaaaacgacaagggggcuaaaggcgccuuguugcugcacugaggagcaaugccccucucuggagcagucaagcccacuggugccacuucugcuuuugcaccccacguaccccuccagugggggggucucagucccggucuucaaacugcaucaccaaacuccugcucgccuuccgccauccacgcagcuuugucacuggcuuuuuguugcuuuuuuuuucugcguucuuuugugguuccucucgccaggccccacaucuuguagcuacuuaguggcaccuccuuggaugccaggaugcugcauccugggccaugcugaugagaagagucacagggggccagagggcaacccuuaguggccaccuuccuugugguccagaaauccugccucagcagugccggcugaugagugucucuccucugcuuguauccuuccagugacagugagcucagcacuauuuuuuuauuacgauaaaauauacaaauauaaaauaccguuuuaaccauuuuaggugcacaguucaguggcauuaagcacauucauauugcugugcaaccauuaccaccuuccaucuccagaacucuuucaucuuccucaaacugaaacccuguccccacccaacacgaauucccccuuccccagucccagcaacugccauuuuacccucugucucugugaauuugaguacuuugaaugauuagauacucuuggucccucacguaaguggccucaugcgguauuuguccucucguuccgagcuuauuucucuuaguggagucuucaagccucauccuugucguggacagugucagcauuuccuucaucaccuguuuuuaaagguucuuucccauguugagcugagaaccaccuuggggauccuauaggaagcauuucugacuaguacagcccugccccugggagcagacagcaaaggagaguguacccacagaggcuucagggcugguggagacagcaaguugauuucuggcaauaacguccuugguugcccacagcugugcucuuggcugaggucugcagcuguggaagaagggaggggucccggccacuugccuugaucucuucucccuuuugccuggugugccccugggaaaaaugccaccucuguccugauccaaucuggugcauucauuuccuggggcugccguaaccaaugaccacuggcugagugacuuggaccaaccgaaacauauucucucaugguuuggaggccagaagucugagaugagagugucggcagggccguguccauccagagauuccaggggagauuucacucuuucucccuuccagcuucuggugguuguggccgcaucacucccuucucugccuccaccuucacauugcugccuucucugugucucuuguaagaacacuuguuuuggauucagggcccaccuggauaaaccaggaucaucucaucucaggguccugaagguaaucugugugugaagacccuuuuuccaaaugaggucacauucacaguuucugggcacaagcgcaugggcaugucuuuugggggccaccauucaucccacugcauccuguaucuguuucucucauuaggugcauaggucugugccuggcaucccucccuuccuugucgcacauggggaaagaaugaagucucccccuagaaucucuagagggagugcagcucugccaacacccugauuucagauuucuggucuccaaaacuaugagagaauacauuucuguuguuuaugauuccguccuucuucuuaugagaccauugucuuccuagagaagcaagucuucucugugcccagcuccuuaacucugggaugucccagcuucucucccugggggcuuccucaggcuguguuucccuaacagcaccugacauuucccuucccuccccugggugucccccaaaggcaagccggaaugucacggggaagaggacaggagcccuggcacccagcugaggccuggcaucccccagccuugucccucccuuagcaguggcugccagugauguucuagagccaggagggggagcagccugguucugcuuccugcuugcucuccggacucuaauuaauuuccuucugguagacuguguuugauuacacccucauuaaguagcuuugcacaugcgggucccggugguuucgauauugaagcaucuaccuuugcugguuaauauucagcgcuugcugcguccuccuuuccccggcucuguuguugcagaaacuguggagucaugccuggaggagagagacaaaugaaagcuaauuucccgcggggccuuccuucugggagugggguuaaaaaugaguuuaagagggaaggggggaguugagguuuaaaauagaguauggcugacggccuccucuguggcuuccccuagcuuuccccuaagacaccuaagacgaugcaccaaaaaaagacaaacacucagcacacuggaaacaaagacaggugggcagucugagaggagccuccucacugcuagacacauggagcagggccaagaaagacacaaugcagccuuccucccaggaaucugagaccuccggaaggaagggaggaagccacuuucucccuuagucuguggacugugccaaucagaaagccaggcaacugguccuguaccacgcaagugacaauuuggagguaaaaggagggcucuuccacuccccucucccuucauccucucccaugccucugucugcaucgguucagagacagcaacucccaaggcgggaagagauggcaucugagaaguccagugcagccagccagugggcuuacccaaggacaggaaguguccugaacauacagacauuguuauagauuuccauggacuucacuguugugaguguuggagauucaggccaugaagugggugaagaugucccuucucaaggucagagucacauaagcacagugccugagacucauccuggggcuggacucuucugcaagccagagcccugagagguggacucagucccaacccaaggaggccgucauggggacaaggaugcgcugauagacgugggugucacuagaucuuggccucuuugagagugcacaagcuggggaggggggaagccugagcguaggauagauacccuggaaccugaaccccgaccucugaaaaugaucuacagcacgauccagaagaaaugaacuuugugggaaaagaacaaaaggccacccaaagaggccaagcugugauggaaaagaaaaccaacaggaugagaugaaaggggagauuaacaagcaaaauaagaauugcaaggaaaugaaaugcuaggcgacuuacaauccuucuugggggcagugagagcggugaugcuggaugugaaaucagugacauggaaggcaaacuggaaacccuggaugaaaguguaucaugcacagaauaccaaaaaagauaaauccagaagacacagagccaguguugguuuuccugaggaagagacagcuugaaaaaaggucuguguuugcagaccaauaccugaaaguaaauccaaaggaaacagauccgccacuagacacaugguggcaaaaauguuuaauaaccaagugucagggguagaaaaagaauggccagauagaaugugcacccuccccugcccccuccuaucccaagaaggugucuauguuugccugccugggggucuggcucugucacccagguuggagugcaguggcaccgucauagcccacuucagccucaaccucccuggcucaagcuguccuccugcuucagccucccaaagugccgggauuacaggcaugagccaccgggccuggccccuuuuaaaauuugugguaaaauacacauaacauaaaauuuacuaucucaaccaucuuuaagcauacagcucagugguguuaaguacauucacacuguuuacugugcagcugaucuccagaacucucaucuugcaaaacggacacuguguccucauuaaacaguaacuccuccuucccuuccccccagccccugguaguacccaccauucuacuuucugucuguaugaauuaacuagucuacauaccucauauaagugaaaccagacaguauuuguccuuuugugucuggcuuauuucacuuauuugucccuguguccucaagguucaccaugcuguagcauguguuggaauccccuuccuuuuuaaggcugaauaauauuucguugcguggcuagaccacacuccguguacccauucaucuguucauggccacccggauuguuuucgccuuuuggcuacugugaaugaugcugcuggaaacauagcugcuguuugagugccugcuuucaguucuuugggguauauauucccaagaguggaauugcuggaucauauggcaauucuguguuuaauuuguuuaaggaacugccacaccauuuuccaugguggcugcaccauuuugcauuccuaccagcagcgcacaaaguuuccaguuucuucacauucuugccaacccuuguuauuuucugggauuuuacggggcuuuuuggaucugagaacuggauuggccagagaaguuaaguuuauuuguauuagaaagauuuuggcuggguuuucaggguggaaaugagaaagugggggauguuggaguaguaagaaagauacagggaagggauuuuaggaguuugggcgaugucaagaaugagaugucccuuuggugacuuggagaaguugcuguagagauaucaguugcuucagaggccuccuauaugcugaacugauauucccaggaagaggacagugugcuagggcuguccaguaggcacagugggguuuuguggcaaggacagcccuacaggcgccagggccgaacaagcagcuaaagaaacaaaaaucagauagccucauucucaucugcaggacugaaagucagaggguagccaagucugcgauauuuugcagggaguuucuguugagccagguugucuucaggugugucaucaacaugaaggaauucucagggaggccagagcucagaagagaaagcaucuguguauuccuccuggggggaaacauguacugggugacuucccuacugcacaggaauacagagugaaggugugaguccaacuguggggaggcaucaacgagugaguggcagugaucauguacacuccaugccauuaccuugcacacacgugaaugcaaaaugccagcuguuacauucauaggguuguuuucacaucuaaaaaaaauaacagcagcuccuuacagugccucacgcuuguagucccagcuacucuggaggcugagacaggagcaucacuugagcccaggaguucaagguugcagcgagcuaugaucgcaccgcugcaauccagccugggugacagagcaagaccuugucucaaaauaaaaaauaacaaguucacaagugaaaaaauaaauuuuuaugaaaauaacuauauuuuccaaaggaaaagaaaaaccaagugaggagagugguguugcuccccauuuuugugacucucuuuagucucacuuucuagaagacggcuaucagacuugcgcuuuugcacugggucuugcgacagguuguuuuaauugacaucuaugaagaaaaucuggcaucacauagauaugucauuggaaaagagguccccacagcaccccuaaaauggucuuaagggugcuuccccaaagucuacagaccacacuuugagaaaugccauucugacugcccuguguaaaucucuacucacuuuuuggaaacaugcaccccuauucccaagcccaucaucucuucccauugcagcgaguccccagaccuguuuauccaagcuccaguuauguagggcccccuucuuugaaaugccgugugcugcugugugcuggguccggcagcucggaaagggagccgagagugacucggugucaggccagccacacucuccgagcgucacuccccaccagcagugacucaggugcaccugcugguguucccagacauccugaugaggaacuguccacaggcacaguuccuagaggugguaccguuuagaccuaucaugaggaaaaugggauuguccucaaugccuugugcuuuuuaagacaaaccagccccuccaagacuaguacagugcacaggaggggcugcagggaccacaccuggaucugauucuuccacuucccuugcacaugcagcaggccuugugugccuacccccauucugugucuuccugagaaggagggcaggccaugggugccgagucugaaaggagcccauucccagggcuguggcccaggcugcagccuccugagacaccugaggaucuggugaccucuccucccucacacccagcccuguggguagucccagcagcuggugacaccaucaucuccaauagccuggcuuaggggaggggggauggagaggacaucaaggaggcaggaaguagcccaagguccucaggacuaugaagugcccucaguuagcacaagcauccugugggccuaggugggguugaaauaaagcaauaaagcaauaaugugugccauggccuuuggccagccucuaucuggcuuucccuguuguagcccugggaccuuggggagccccaccccagcuggaauucacagggcgggccgguguuggccgugacucacagugacccugagcugccuuucuaggagacccuccuccuucccucccauccugccucuacacuccuuuuccccuccuaagcaacaaccacaugaacccagacagugcuccagagaggcagagccacagucagcagcugggcaaccagggggauggcgcggggagacggcaggggagugggcuccggaaaggacauuuggcaucuucacagaccugcccaaccuccuggguuggcaacugggauuuucuugguccuuccagggauggccuagacuagcuuggagauguaggggguccaggaagauggggcagggcugguaggaacacaagaaacccaggcagucaucugguccagggcuuucaagcuuuucuuuggaacagaacugcguucauuuguuuguaaccaggagcugcuuuguaagagcugcagcccacagcccugcugguuccucucaccucucucgucuaccgcagccccugaccgucagccucaagaucuuggaacacaguuuaauaaccacuagugugguucaucugcccauuucacagauagggaaaugaaucccaagagggaagucucuugccacagacuuacagcgaguuggggcuggccagggccuaaaauccagugcuauuucccagggucauuuagggacagacugcagggacaauuguaagggggagaccacuaggugccaggggugcucacagaggagaggggugcccaggggcaaagcagaggaggcauagaggcuggcauuaaguugccaaccacagaggagcagcccagccugcucgaccgaguguaaaagaaaaauagcuccaugccucuggccuccuccccguggccaccagugcagccucugaccaugggaauaaccaccccucuguuuccaccucaucugcccuccuucuccagcucccuguccccaggaaggggagccucaagcuguaggcagggacuggcuggcaaaccaggcacugggccacagcucguuugaccacacaggcccucugagaccguagaacacaaguccuuugacuuucggccuuccuguguccccagcuuccucccgccucagggaggcagggcugugauuuugcacauuagugggugauaguuugugucccggggucccucguguccacacggcucugacacacccuccugaccaugaggccaguguggacucugugugcucagguccccgcccagcccugacuccagaauuuuucuagggagagagcucauggcuuuugacacauucucaauugggucugugguccaggagaucgagaaccccugcagaaggugaggacgggccuuccagggaggagggggcagaaauguaguagaaagggcacugcugcuuucucuguucccugccagaggcuuuacauguaacacuuggucuuguuccccuugccuccuugugaugcuggggucacuguccccguuuuacagaugaggaaacugaggcuuagcauugucagguugcuugcuucaggaugcagcccuggcugagggauugaaaaagccagggcagggccagaggucaaaggcggguauuguaccugcuucuacaagggggugcagcucuagaaccuguaccagccagugcuucagaagccuccccugacugcauccaugacagaccuugagcccccagguccugguucccagcaaauuuuuucagcagccagagagccuggcacaggaccuggcaguucgccuccaagguucauuccugccauauggaaaacagcccucacaacuggccucuuguguccucacugaggcguuaaugagggugggggcagagugcccccuaaccacggcagguaggaccuggcuggcaguugggcuccaaggggcuccccacaagaggcuccucccacccccaggcaugacacccaggcccuccagagcccccagcaaagacucuuuuuuugcuuguaucaaugucagcugccagaccgcagagcccgucccugcccgccaucuguccagcucagccacccucucaccacccccuggcagauaagagcagugcaaucugcagaacaugcccagggcugaggccgugccccacccccauccuuccugaaauuccaacagcacagaaggcgugggccuuggugucuccaucuguagagaauauaugaugauguccagccugcgugccuuccagggauuucuaagaaucauguggggaagguauuuuaaaaguucagaauacaaacaaaaugacaaggagcaaacucagcugguuacccacacauucccugcccagacgucccguccccagggcacuggaccccagccaccugggcugggagccuuucucugggcugugcuggggcagcugugggagcccccagaaugaggacagccugcagugggugggccugcuuugccucccuacccagggaugucucauguuccccaggauggugugaggacagucuccggaugggaaugucagcauugccuggucugugcagggcaccaagcuagggucagggacugucguguagcucauacccaaggauggcagaaauugggaggggggggcuugaggaaagggagcaggcguaccucccccuuucacguggaguggcacgaaguuuaguccccaccccagggcaggcacgucaugucuccuuacuucuccaaagccgaucacuccguuuuaagcucaggggucucaugaccuacuuuagaugaaggucacaggauucuucagggccugcuuugggggagaacagcagucagagagaccuuccugugucagcugccuccucagaugccaggguaccauauucuggggugguguguccugagcccccaaacccaauuccuuccucagacccagggaagcucugcuccagcgguuucugccgcggccccaccacacuuaguagcacucgccuccaagcugcuccccucccaucgggaagauuccacucaguaccuuucugagggaguccugaugagguuuccuucugggugccuggcaggaucugcuuacaaccccaccacucagaaacccccaaggcaaaggaacacugaggcugcaucggcuacagaaggagcaguaaaaacaacgucagaagcaggaagaaaacacaaauaaauaucauuaaaccauccugucacaaggcaguuaauuccaaauuuugccaccauagagaagcagcugcuugcaccgaggcaggccacccuuggcuuccuccucuggaaaaccagagagacaaaggucaggggcuguccuaggagagggccacaagccaggaccugcacaaacugcagagccugcagaggccagucccugcucuuccucaacuuggaggcaaagacaaacaggagaggccugccccagccccugagggaaguucugcagaugcuccccaccggggcucugggaggcagagucgccucuaggggucugugccuacuucucuuggggauggugggcgagcugggugggcagccagcccugaccucugggcauccuuugcucuugcaggaccugggcauggagucgaccucgcuagacgacguucuguaucgcuacgccagcuuccggaaccugguggaccccaucacacacgaccucaucaucagccuggcacgcuacauccacugucccaagccgguaggguggcugugguccgagccagccaggucccggggugugcggugggugccuuucugggcagagcagcuguaugcccaaggaggacuggcagacaggcccaaggaggacaagcccguccuccaggcaccaagagcuugaggugcucucccuuggugccacuagcacagauugguuuuguuuggcccagggggugaauucauugccaacauuuaaaaaccagaauuuuucacaugaucccuguauucagcugcccuugaaaaacuggaagcuccagcaacaugaagcccucauuucugcagggcuggagcuaaguagccaucccuguuauauggggccaaggccaccacauacaguuguacagguuguaccuugcacgaaagcaugcguacagagggguagugggguagggggaggcaggggaaaguucaaauccagcccucucucuacccaccaagccaugagcccuggugcaagcccuugucucccuggaggugaacuuuuucuuauuugcacaaaggugucauagaaggccguccggggcccugcauggggcuguccgcuuugccucaguccccaccacucccagaugucuucaccucugaggcugaguguccuuugacacccaccccuucacucaugucuucuuccuacuggcccugggagcucggaagggaaagcuccauggcucuccaggcuccagaucugcagcucagcccugccuggaugggagguucugccauguuccugcagcuccaggucuaggcucccccagggcuaugcagcccgaccuggcgggaaggggagggccggcuggggacauuuccacacuugagcgcuucucuguugcuuugguuuuuuucugucucaucccucaauuuccaguggcuuccaaaagaagugcuuccccacuggcagucaggaaaccagagcaggacgaaggggugugggagggaaguuuuuccuuuugguguaggaucuaggccgggagugagaugguucccaagcccaccugucgcucggccuggauacagacuugacugugguccuacagugagcuggagccuugcucuggaaagguguuuccuggggcugagcuccaucugcggcuuugucgggggccuucucucugacucuggggcuaccugaugcaaaggcucugagguggggcccagcuguggagggcugggagccagccagggucaggagcacaauguugcagaaggcagggaugcagggcccaaugggaggggaaggaaagcugguguugaggaagccucgaggccugauuggugccaggagccacagggagcuggcuggggcuggcgccuccgucgcuucucaugcaguuccacccgguucugccuagggaggugggaagggacgggagucaggccugugaggaggccuugccaggugccagacucugccuuuccuagagcagcaauggaguugcucacagaugagagggugaaaggcgauggggcucucaaaaaagcaaaaaagaaauaggagggcuauguauaugcccaucuuugaguuaaggaaaacaaaauucagguaaucaagugaucugagcaagguuacaccuccgaggagaaccacaggugugauuugggccuaugcagugacccagagccgggcgggacacaggccgguggucccuggguggucagugcccaugggggcaggaggaggggccuggugggagcagccgagcuccccucccuccccaaccugccccucacagguugccucauggacagccuguguggggagaaggacccacccucucagagagagaggcaggccagggaguggguaagggccacugugagacccugugagacaggaccaggcaaggccaggaggaggggcgggaacuccugccuucugaucuucccuuuccaucuggguagaggcggggccagggggugcauaccuggguuguugugguccauucagguggcuguaacaaauuaucguagacuggguggcuuacaaacaguagaaauuuaucucucacacuucugaaggcuggaagucugagaucugggugccagccugguuggugacuggcaaggaccuuuuucuggguuacagacagucaccuuccuguguccucacauggcaggaaaugggcaaaggagcaggaaucccauugugagagcuccaccccccuggccuaaucaccucccaaaggccccaccucuaaauaccaucacccuggggauuagguuucaacacgugaauucuggggagauaccaacauucaguccauugcaugguguaaccuuccucagaccacuucaacaccuggacuuuguuuuccucaaaacaaaaucagagccagccagagugggugagcccugcuaaagcccagagaccuggaaggccccuuucgugcccauguggcaagcgaggcucucuggaugaggcaggggugggagguccccaggcuggugguaggagcagccccuccauccaccccagagggcugaccaggacauccuggucagagcaauuugcaucugagaaguucaugucagcccacguuaugggucuagagauuauaggcagaggugucaagaccggagagcucguuccaaagguaaauuggauacuacacggaccucacugaacauccuuuagugaggggcugugcuguaguuuaaacaaaacccaaacuccucaucuggcuuugccugagucucuugagcuccccucucccacuugccacccugcgagcucugcucuagcacgugggccucccuccucuguuccugacaccuccacacccucuccuaucuuagggacgucgcugcucccuuugacugcuccagccucuucugucugaguugccuucuccugaguucagacugagccuacggccucugagaggccuucguugacaagccugccuaguguaggcuccugaucagccugucucgagccccauuuauuuuuccauucguuucucuguuuuacuuacuggucucugaaauuaccuugcuuauuuauuuguuggcuaauuuauugucuguuuuccccacuagaauauaaacucugaagggaagggugucugucuuguucauaauuccaaccugcaccaggcaggaagcaggcaacauauuccauugugaaguuugaagagaguuuaguaaaggguugaggacaggauaaaggaagucaacaggggacauugagacauccaaagacagcaguaguaggaaguuguuucacaggaggacaagcuguauugccagaggcagggugagaacaccugguccagagccacgcugcauuauccauugccauauagcaaacuaccccaaaacuuaguggcuuaaaacaacagacauuuauuguuauagucucuguaggucagguuugcaggggccgcuuaaguagguaguuuagcuuugggucucucaagacauuggucagggcugcaggugucagaaggcuuaacagaaguuggcaggucugccagucucgguggcucacaccuuugggaggccaccgagcacuuugggaggccgaggcagguggaucaucugagguuggaaguucgagaccagccugaccaacauggagaaaccccaucucuacuaaaaauacaaaauuagccgggcgugguggcgcaugccuauaaucccagcuacucgggaggcugaggcaggagaaucacuggaacccggcaggcggagguugccgugagcugagaucgcgccauugcacuccagccugggcaacaagagcgaaacuccgucucaaaaaaaaaaagaaguuggcaggucuacuuccaaggcggcacacucgcccuguagccucuccaugggacugcuugaguguccucacaucauggcagcuggcuuaucccacaacaggugauaauauagaagccauaaugccuuucuuucuuuccuuucuuuucuuucuuucuuucuuuugacagagucucgcuguaucaccuaggcuggagugcaauggcgcaaucucgacucgcugcaaccucugccucccggguuuaagcgguucuccugccucagccucccaaguagcuugggauuacaggcaccugccaccacaacuggcuaauguuuuguauuuuuaguagagacgggguuucaccauguuggccagccuggucucaaacuccugaccucaggugauccacccaccuuggccuuccaaagugcugggauuacaggugugagccacuaugccuggccuugcuuuuuuguuguuguuguuguuuguauuuguuuguuuguuuguuuugagacagggucccacucugaugcccaggcuggagugcagaggugugaucauaacuuucugcagccuggaacuacuaggcucaagugauccucccaccucaccuucccaaguagcugggacugcaggcaggcaccaccaugccuagcuaauuuuuuguuuuuuuuuuucuuguagagacggggcacucacuauguugccaaggcuggucucaaacuccuggccucaagcaaucccccucccuuggccucccaaagcacuaggauugcaggugugagcccaacccccacaauaccuuuuaagacccagucucagaagucacaaaccaucauuuccaccauucuauugguucuaaugauucuguugcucacuuagaccagcccugcuacaauguggaaggacauuacacaggggcacagaugccaggagccgagagcagcaaggcugucuuggaggccggcggcugcacaugccgaagugggggaaucagaauaaacucccccauccgucucuccuccugcccucuggucuugcugccauugcucccauuagcugaacccaaguggaagccagggggaagagagcccagugaugcagucucuagagcccagccuucugagcagagaagggcagaguggacuguggggcaagaggaaacagaaaagccggcacacagucucugcaucuggaaugguguccaguguaaugagggggacagucaacauuugaugaauguaugaaugaauuuauggaugagggagggauagccuugaauggagggcaguggagggcugugcuugucgggguccuggagcaguuacagaggugccuggggagugaagauggcagaugguaucacugccugauggcugagagccagagcagugucgggugcugguaccccucccaggucagccugcaggucagcacgucaucuuuccugacagauuaaugagaagccccucaaacacguucugccccaggaccugggcagccucacugggaaggucuggagaggcugcugcccugaccugcacucauagucacuugacugugccacaucccacuccugccaucuucagggaucgggggaggacugcaaagcauugauucagcacacagccauugagccuucugggcggguuaggauucugcugcacauaacagaagcccaggcgggcuggcuccagcaaggaagaaaauguguucuacagauaucgaggugucuuguggugcccacgggcagccaaguuagaccaaggugcuagaacuauagauaagcacggugcagaggucccuccuucccuccucgcugcucuacccugccucccucuguguucccucugcacagacugcucuucccccugccgcaugguagggaauguggcuagcuauggcucccagguuacuucucaggguuccagccacuggaggaguuaggguaugugugucucagugucaaguccagcuuccuccuccucuuccucuuccuccuccucuucuuucuccuucuccucuucuuccucuuccuccuccucuuccuucuucugcuccucuuccuccuccuccucuuccuccuuuuccuucuucucuuccuccuccucuuccuucucuuccuccuccucuuccuucucuuccuccuccucuuccuucuucuccucuuccuccuccuccucuuccuucucuuccuccuccucuuccuccuccuccucuuccugauccucuuccuucuucuccuccuuucuccucuucuuccuccucuuccuccuccucuuccuccuccuuccuccucuuccuccuccuaccccuccucuuccuccuccucucccuccucuuccuccuccuccuacuacugcuacuccuccuccucccccuccccuuccuccuccuccucucccucuuccucuuccuccuucuccuccucucccuccccccguuccccaccuucuuacugcuccacuucugggccagugcugccuaguccuguucucugcaggagggagcccuggagggguucuuugaaaaguggaagaguugggaaaaaaugagacagucucacugaaggcuuuucugguuguaaaugauagaaacacuuugaacugaccuaagccaaagacaggauuucucacaaggagggcagcagauagcgguuaggagcaucagccucagagcuggcugacuuuagauccugacuccgucuuacaagcugggaggccuugcccaucuauuuaaguucuuuuugccucaguucccucauuuguaaagcgggguuauuaauaauaccugucucauaggguuguaguaagguaugggacuauaguuuguagggcacuuagggaggucgaggcagguggaccacuugaggucaggauuugagaccagccugaccaacauggugaaaccccgucucuaauagaaauacaaaaaaaauuagccgggcauggauggcgggugccuguagucccagcuacucgggaggcugaagcaagagaaccgcuugaaucugggagauggagguugcauugagcugagauugcgccacugcacuccagccgggcgacagagcaagacuccgucuaaaaaaaaaaauuguagggcagaacugugugguacuuuucccucacucauuauaagggucauggcugacacuccuauaaccagacacaggguaacaaaaaagcagaacaaauguguuuaaucaaaauuuuacgcaacaugggagcuuucagaaaugaagacgcucaggugaggcacgguggcucacaccuguaauaccagcacuuugggaggccgaggcaggcggaucgucugaggucaggaguucaagaccaaccuggccaacauagugaaacccugucucuacuaaaaauacaaaaauuagcugggcgugguggcacgcgccuguaaucccagcuacucgggaggcuaagccaggagaaucacuugaaccugggagacggagguugcaaugagcugagauggugccacuguacuccagccugagggcggggacagagcaagacuccgucacuaaaaaaaaaaaagaaaagaaaagaaaagaaaagaaaugaggacccuuagccccagcuaccugggaggcugauacaggaggauuacaugaguccaggaauucaauaccagcaaggccaauauagugagacccccaucucuuuaaaaaaagaaagaaaugaagaccccaaaccccagggaaagagguuuuuuuguuuuuuugguuuuuuguuuguuagaauuuguuuauuuuaauuauauuuauuuauuuauuuuaaaacggaauuuugcucuuguugcccgggcuggagugcaguggcgugaucucggcccaccucaaccucugccuccuggguucacgcgauucuccugccucagccuuccgagcagcugggauuacagacaugcaccaccaugccuggcuaauuuuguauuuucaguagagaugggguuucuccauguuggucaggcuggucucaaacucccaaccucaggugauccgccccccucugccucccaaagugcugggauuacaggcaugagccaccacgccuggccuguuuguuuguuuguuuuuugacagagucucacucuguugcccaggcuggagugcaaugacgugaucucggcucacuggacccuccaccuccuggguucaagcaacucuccugccucagccuaccaaguagcugggacuacaggugcccgccaccaugccuagcuaauuuuuuguauuuuuaguagagauggaguuucgccguguuggccaggcuagucucgaacuccugaccucaggugauccacccaccucggccucccaaagugcugggauuacaggcgugagccaccacacucagccagcuaucuguuuuuauacucaggcuugguaaagagugcacaagcuuguagaaaugcgauuggacaaagggugugaucuaauggugauaggccgaggggacccaggaaggcuaucugcucagauucuucuuggccucucucugcaguguuccuuccuaccccucuggaauggucuucaagacagaagggagagagugaccugccuaguuuuauggcuugcuuugagggagagggguucuggucucugugaccugccuuggggaagaagaauucugguuucucugacucacucugggggagaagaagggccagagacaggagggcagcagaagggcagaaaaacuuugcuucugaggccuuccaauuuccguuaguucaaagcucucugcuggccccggcgccaugcuuuggaauuguguucugagccccaaaauguucaugcaaacagugcucagaggagaugcccaaugcaucgcagcugcucaauacauguuagcuguugucaguuuaguucagacaagcagaagggaacucucacuccugagagaacaucagcucacuugugcucucaaggcaacucuaugagguguccauaucuauuguuccugucuagccagugaggagacgcaggcuccucaguucucccugguaguggcagauacacuuccaucccgagccuggcccugugcguggcugcccccuuguggcaauggcagugcagugaugcccccuuguccucuguucucgugugugugugugugcgugugcgugugugcgugugcgugugugcgugugugcguguguguguguguuuaggagucccacaccagucccacucuggcgcccaggccagaguucaguggcgcgaucucggcucacugcaaccuccaccucccggguucaagcgauucuccugccacagccucccaaguagcugggacuacaggcacccacgacuacgccuggcuaauuuuuguauuuuuaguagagaugggguuucaccauauuggacaggcuggugucgaacuccugaccuugugauccgccugccucggccucccaaagugcugggauuacaggcgugaacuaccgcgcccggccucuauucucuucuuuuaaggcucagcugcccaggcugagaggguggacagggauuuuggccccagauuuuggaaacccugggaagugauugaaggaggagcugcagcugaggggcucaguucuaagcuuuggagacuggcuacauucuguccuggggugguuccaggagugaugcugggcagaccaccugaucccacccauggucuuugaaccagugcuucuccaccucagcugcacuagggaaucaccuggggaccuuuuaaaaauccccguguggccaggcaggguggcucacaccuguaaucccagcacuuuaggaggcugaggcgggcagaucacgaggucaggaguucgagaccaggcuggccaacauggugaaaccccaucucuauuaagauacaaaaaauuagcggggugugguggcaggcgucuguaaucagcuacuugggaggcugaagcaggagaaucguuugaaccugggagauggagguugcagugagccaagaccgcgccacugcacuccagccugggcaacagagugagacuccaucucaaacaaaaagaaaaaaaaaaaaaucccugugccugagccacccacccaucauugggguggcccaggcaucaguguuauuuuguuguuguuugguuugguuugguuuuuugagacuaggucucacccugucuggagugcagaggugugaucacggcucacugcagccuucacuuucggggcucaagagccuccuaccucagccucccggguagcugggacugcaggcacaugccaccaugaugggcuuuuuuuuuuuuuuuuuuuuuuuuugagagcaagucucacuauauugcccaggguagucuugaacuccuggggucaagugauccuccugccucagccucccaaagugcugggauuacaagagugagccacagcaccuggcccaucaguggacuuuaaagcuccccugagauuccaggccgggcgcgguggcuaacgccuguaaugggaggccgaggcgggcggaucacaaggucaggagaucgagaccauccucgcuaacacagugagaccccccgucucuacuaaaaaugcaaaaaaauuagccgggcauguuggcgggcgccuguagucccagcuacuggagaggcugaggcaggagaauggcgugaacccgggaggcggagcuugcagugagccaagaucgcgccacuacacuccauccugggcgacagagcgauacuccgucucaaaaaaaagaaaaaaaagcuccccugagauuccgguaugaaagauuccaagguaaagaagcacagcucuagaugggccaucuccagugucaccuccuauucucuguuuuauuuauuuauuauuauuauuauuuuuuuuuuugagauggagucucacucugucacccaggcuggagugcaguggugcgaucucggcucacuguaaccuccgccuccuggguucaaacaauucuccugccucagcacuccggagcagcugggaucacaggcgcccgccgucacgcccagcuaauuuuuguauucuuaguagagacaggguuuugccauguuggccaggcugaucucgaacuccugaccucaggugauccauccaccuuggccucccaacgugcugggauuaacaggcgugagccaccgugccuggccccuauucucccuuugagcucuaaggucggcucccaccauggccccacucccugaacuugugcuggccauggccuccuuguuggagacccaguggccucugggugggggucuaaccccauuagucacucuucuugguguccagacuccacuacuccugcugcucugauggagucuucucugacugcuguguguccacuguucucucucccuccugcuuagcucauucucuggccagggguuuaaucuuacugaugaauguguccagccuggaccugucuugagccccaaccccauaaguccaguggcauccacagcuggagguauugugagcuccucaaacuuaccauggccccacaugagcaggucaccccccuccugccuucucacccacuucuugucuugagccccuugccuucuacucaugucccaagcccaaagccuagacccuccucacccucccugcccacaccuucuccauccagcauaucagucagcuguguggccucuguccccucagccccuuccaauagccuggcccugagucauccucuccaccuccuguccaccccucucuccaucucccagucugaggaacaucccccuugagggacuccccugcagcccccaugaccagcuccuccugcuucacccgccuugcuucccuccacacagucauguggccagguucagcaagaagcuaagucuaggaaccaaaagaugucagcuccagggguggggaaugaagccguaaaggcagaugcucaccugcccccacaucugcaacacacaagagugacacacaggagugacagguguaacacacaggugugauacaggugcaaguggcaggugauacaagcuuauucaucagacagccaggcaccaggaagcugggggcagggguggggaugggcugugaacuggagcccaggggccuccuccaaauccguucuguucagucucgggcccuccuuugcuuccugggucccuccacagaugccucucuccuuuggacauucaacugccaucuucccaacuccucucucucuugucccccuuccucagagucuccuucucuugccuucccaucagccccaagcccauccccagcccucugggccucaggcucccccacugcauaaugggaauaacgaaaguaucuacugccuuggggugcugugggaauuccauaaccuucuugcgugaugucuggugugcagggcugacaguggcuugaaccauggagggaccagaugugaucaggccccaggccuucaccugcccucaugucaguaacacaccccacagccgccacaucaccaagcccugccacagacuguuuccuccucacucaaggaugccucacguuuucuuucuccaucugaaaucacuaacccaucugcucuuaaaagcugagcucagccugggcgcgguggcucacaccuguaaucccagcacuuugggaggccaaggcggguggaucacuugaggucaggaguucaagaccagccugaccaacauggugaaaccccaucucuacuaaaaauacaaaaacuagccaggugugauggcgggugccuguaaucccaacuacucgggaggcugaggcaggagaaucacucgaacccagguggcggagguugcagugagccgagaucgugccauugcacuccagccugggugacagagcaagacugucucaaaaaauaaauuaaauuaaauuaaaauaaagcugagcucaaaucugagccugggcagaagucaucuucccuccuugcccugccagaauucucugugcuggugccgcuaucacgguauucacuuagagugugccuggagagcuugcuguggguugggcucuauucaaagcacugcgcuaguagugacucauuuaauccucacagaaacucuugugaggucuguacuguaauccuuucacagaugugguuuggagcacagagaagucaagcaauuguccaaggccacacagaacgggacaaagccaggacuugaauccccacgguuuggccccaggucuuugcucuucacuacucaauacacugcuuguccacuagcagaggggugugggaaucguaaugacaaagcagccuguugagcacccacuccaggcaccaugcugagcacugugcgugguuaacgugccggaccuccccacaccgagucguuggccacauguggguuugcaucugaguccagcgcuugcauccaagccucagcgcuugcauccaagccucagcacuggcccacuggcaggagcacgcuuuugguccucacucccuggagggacucaugcccucacccuguccagcacgaguuuggcuccggggacuguuggauugacuuuccuagggauguaguuggagucuguagcaucuuucagcugcaccauuuaacccagugucugccauaacaaaaaaucacagacugguggucuaaacagcagacaguucguuucgcacagcucugaaggcuagaaguccaaggcuggcugguggguuuccuucugaggcucucuccuaggucugucagucccuccuccuccuguguccucaagugguuguuccucugcaugucuguguccucauuucuucuucuuaggacaccagucauacaggauuagggccuacuccucugaccucauuuuaccuuagucaccucuuuaaaggccuugucuccaaauacagcugcauuccaagguacuagggguuaggacaucaacuugugauugucagcgggauacaguucagcccaugacacccaggguuucaaacucagaugccaacgggccugacaggaacgcaugugaaugaacugcgcugggaaagacuuggccuccucauucauuuguucucacuuuugagggagacacagguaaaaauaucucauuuuccccuuuacuaugugaaauacaaggacacgaacauuuguucauggccauauccuagcuuccuagaacaagugccuggcuccgaguaagugcucaauaaaucugcugagcaagagaaugcacagagcggcccuggacauuggggaguggcagggaucauggugagucuuggccagggggucagcaggcacuuggcuccagccaacuuuuguccgaucuccuggaauccagacuuacauaaaucuguuuuucaaugcuagcaacuaauucacaaaaacuaaaaccauccugcagaucuguuugcagccacugcugucugccuagggugcccacccuaggccagcagagcagggccucccccagcucagccugggggagcugggcucuuacccgggagacaggaagccugggggcugagacuggugcacccagccacucagggcccuaccacccaugguugccucugcaggaaggcgaugcacugggcgccauggagaagcugugccggcagcugacauaccaccucagcccccacucccaguggaggcggcaccgggggcuggugaaaaggaagccacaggccuggugaguuacacucccccgggcaggucuaugccaggcugaguguguguuacagggcaccccucccagggauguagggaagggaagggcggagucaugggggguggucauagaagcugccugaaggagguaagauggaaggaggauuccagaguggggaaacaucuagagggggacccuggucuggugggugggaggaagaugugagaaauuucuaauuccuggugugcuaaagugggcacucccagauaagcacaguguuuggcucaugccuguaaucccagcacuuugggaggcugaggcagguggaucacuugaggucaggaguucgagaccagccugaccaauguggcgaaacccuguaaaaauacaaaaauuagccaggcgugguggugcacaccuguaauccuaguuucucaggaggcugaggcaggagaaucacuugaacuagggagguggagguugcagugagcagagacagcgccacugcacuccagccugagcaacaagcacucccuaguaacuccucaguuaucucagauguccccagggggacccagaccccagcccugucccugguccauacagcaacaaggggguucagagucccuugaagauugguagggguugaggggcauguaggacacagaaccugugggcugugauaacaccguaggaagcaaguagaggggagccuggaaguaaggcuuccuggagaaggaagcacaccugucuuuuugcaaaugauagcugaguggugugcccucacaaagacucugccaaggccuuggugcuggugcuagcucaucccugcaggucccugcaggcuggggaaggaagggcugucccccucccucauggagaagaaagaacucuggugccuccuucuguucuggacccgccccccacccccacccacaacuaggagauggauccuggagaggcgcauucccagguggaugaacaguguaaggcugugauggugcuggcuacgggaggggcucuaccuggguagaggggacauauauggggauacagcaagacggggggcccuuggaaccuggaaugccaugagacugagcugguucuuuagcaauggaaagcugguaguuugagcucugcuggaaccuaagggccucuccugguuccccacacacacccaugcucaguccauucuucauucggaagccaugucaugaggucucauuccccucggguggaaucucauggcaccugaaugaaauccaagcaugggccucugauuugcucuccucgcccccucgucucaccucuccugcucucccgccccagccacacuggccuuccugcugguucacagacacaccagucccuuuccagccucagggccuuugugcccucugcuggaacuuucaccaaacucuuuugauggcccaugcuuacuuuuucaugugucaguccacacgcuaccuucuccugaguagccacagccccacgcuacaguaucgccccacacucaggguuuuguuuguggucugucucccccuaguagaggaagaacagggauuuuguccauccuguucaccacugugacccuagugucuaggauacugccuggcacacagaugaguuuaacaaauguuuguuaaaagaacaaaugggcugggcacgguggcucacgccuguaaucccagcacuuugggaggcccagaugggcggaucaccugaaguaggaaguucaagaccagccuggcuaacauagugaaacccugucucuacuaaaaauaaaaaaauuagcugggcaugauguugcacgccuguaaucccagcuacucagaaggcugaggcaggagaaucacuugaaccugggaggcggaaguugcagugagccaagaucaugccacugcacuccagccugggcaacagagugagacuccaucuccaagaaacaaaaaggaacaaauuagggaggagauaucacuguugucaauugacugguuaggaucacccaacugguaagugguggggcugaauucaaacccagcucaggcuguucaccaccacacugcuucccugguggaaugggucuuuauuaaugacauugauaauagcaccaaaguuaaaucaagcugcacagauggcuggcagcauuccaagcauuuaaaugucacgccuugagaguuuuacuuuccaacucccuggggcuggaccccagucagagucaaaaugaacaaacuguggacagccucccagcuuagaucucaaggacaaauguacccuguguugccaggaaguacaagccaugaccuuugagcuguugacaguagcauaugcucuuggagcaggcugggagcccccuccaccucccucuccuucccagcacacuuagaaaugcggaaaauggggccgggcacgguggcucacaccugugaucccagcacuuugggaggcugaggugggcugaucaugaggucaggagaucgagaccauccuggccaacacagugaaaccccaucucuacuaaaaauacaaaaaauuagccaggcgugggggcacacaccuguagucccagcuacucgggaggcugaggcaggagaaucgcuugaacccaggagguggagauugcagugagcagaaauggcgccacugcacuccagccugggugacagaacaagacugucucaaaaaaaaaaaaaaaaaaaaaaaaaaaugcagaaaauggccaggcguguuggcucaugccuguaaucccaaugcuuugggaggccgagauggguggauuaccugaggucaggaguuccagaccagucuggccaacauggugaaaccccgucucuacuaaaaauacaaaaauuagccaggcgugguggcagacgccuguaaucccagcuacucaggaagcugaggcaggagaaucacuugagcccgggaggcagagggugcagugaaccaagaucgugccauuguacuccagccugggugacagagcgagacugucuccaaaaaaaaaaaaaaauguggaaaaugaacaucucaccacugcaccugggccuuggagccagcaaacagauggcgggggugggguggggggugugcagggaagggcacacuugccaucagcuugaacugccugggcucugucccaagaacaagcagaagcaaggagcaaggcacucagccuccaggagucagcagcugccaccaggcucagagccccugagcccugcccugccugcugucuuacaggcuccccauagggaauccuucucugguggggaagauggucuugaaagaggggacucagagauccuuugugccauucaugggggcugagcugccaccccagggugguagaagugggaagcugaguccaggugaugaauacagcagcaaauguuuauuccucacucgccuacuauacaaggcaccauuuugcacuuaugaacuucuuccauauaucagcccaaugguacucuuaacucaauuuuucugguaaauaggggcagccacauaccucaggcuacggccagcugggcccugacagcugagacgugcggcagugucaggggacugaggucccugguugcucccaccucugcacuuguggcauccgacauccaaguguuucguaaaagcagucccuagcgucggagagccgagcagaggcuggcacugcagcuucugggggaaaggccugcccuaugugccugagccuuguuuguccuuuuucccuucagccucaaggcuguccuggccggaagccccccagacaacacaguggaccugucgggaaucccacugaccucccgagaccuggagcgggugaccagcuaccuacagcgcuguggggagcagguagacagcguggagcugggcuucacaggccucacggacgacaugguccugcagcugcugccagcacucagcacccugccccgccucaccacacuggcacucaauggcaaccgguugacccgggccgugcugcgcgaccucacugacauccuuaaggaucccagcaaguuccccaaugucacguggauugaccugggcaacaacguggacaucuucuccuugccccagcccuuccugcucagccugcgcaagcgcuccccaaagcagggccaccuacccaccauccuggagcugggugagggcccaggcaguggggaggagguccgggaagggacaguaggccaggaggacccuggagggggcccuguggcaccugccgaagaccaccaugagggcaaggagacuguagcugcagcucagacgugacauggaagugaagggccucaccagggaguccuuguuggguagaaugggcaaggcaggcaggggagggcgcuucuccuaucagguggguuaaggauauugccaaaaauuggccugggccacccaccuacagaaaggcaaaccauaucaucuggggaaggggauuuguguuaaaacuucccguugguccucugcaucugcccccuaucccauuaucugccauuugguucuuaagucaucccaggccccagagaacccucucagcucagcucauggccuuccccaaagacuuguggaaaugggcacauggcuggagguacuguaagccugagccauugugaacaccaagagcuuucccccagaaaaagaauacaguagggccccuacauguacugcauuacauuuuucauuuaggggaacaagcuccaaccagaggaauguguccccacucaaggaaggugggaaucuuuagcaaaauuccuguaacuccugguugcccgagaccccaguuccaucuaugcuagggguggacugaacguggccuaccuccuuauggagacccagcccuauuucugaggcccaccuugauucuaggcaucugcccauaggaccagcuaucgcuauauccuuugacagagcagccuacgaugccaugugguagugcucaggacagacauggugcccaugcauacaggcauaaaguccuguucagaaauccccuauccaccuucccuacccacugcuggcugaaaaacuaccagacuucuaugugggcucugauguccuuagcaugcaggguaagugacaaaccuggcuuccuucuugucacuugccaguaugacuucacugaccuagacaggccguaagaacucuuuccccauaacucuuaaguaauccaccaacacauuccagaaaaccgacugcagaaggugggcuuuaaaaccuuaaaaaccuaggacaaugaaggaguccaaucccuuggcagauccaacaagauggcuggggagagggagaaacaaacuggaggcucccaaaggaaccuaacuuagcaaagguucucaucuuauacccuccccuuacccaaauacuguccuacugaaagggcccuaccaguuaagggaucucuucuaaauaacaggcaaccccuagauccaaguaguucaguccaggaagacugggagccaaucacucuugaaccuugugggcaaacaguaugggggaggacccucuugacaggccuugguaggcaagauuccaacacaggaagacagcaagauggggccuagaguauggggcccuacaugcuguuaagguugugguuaggaauggugcaaugcugcaggagcuggaacaaagcuacaccaaggaacagagcacagagcagcaggggccgaaauugaggaggccuuaaaugcuuugagcuuuugccuucagucuaaagcuguagaauaggggguuaagagcuuaggcugaccacagggaaguuuacaagcuagagcgaauaucuggacugcuaauaucugacaacaguaggcgaaauuuacuuuuucuucaaauacacauuuucaagaauugac

SEQ ID NO: 192254 - RNA, 25445 nt, Homo sapiens
gaaguagggcuggcguagggccgccauguugcagcaggugaggggcugagggcucgcugggaggguggcggcuccugggacuggcucugcagguuccgugggacuggagcccgcgucccccgcgcccgcuacucgaacucgaggaggagcggggcggccgggaguggagggcuguggguaguugucugaggagggcugcuggggguucugaggccgcugggggcggcgugacccgugcggcgcagagcaaguacuucuugcggcuguggggacgcccauuguuaaccagcgcgagugggggucucucuuuccucaacccuuauugccgggguggaguugaggaggagcggccugcgggccucuuagcuuccugacacccaggggugcgaugcuauuuuguaggaaucggcgacaccgccagagccucgcuuucaaauugcuguuuccaaacuaauguuguuggugauucucuccuuugugcucuuagaguuaauuguaguccacauguuggcaaccagagacucguaagauuaauaauauuuuuagaaaaaacuacuguuuauggucacuuagauugucuuaaguguuuuuuucuuucgguucacacaaaauuuguugagggauuacuaugacucagacacgguuguaggcccagggauaggguugugaccaguacagacagguuucuugccccguauuuuuggguuagggaaguggguucuaggagauggggguuggguggggagacacgauaaauuguauaaccaaagauauuuucagauaauugcaaaggcagggugaugaaauaacaagugucugaggauaggacaacuaagauuuauggucaggaaagacugcuuaugaggagaugccuugaguggagaaaaucuaauaaugguuaaauucagcuguauuacaggaaaggugucccgauccagacccgaaaagaggguccuuggccgggcguggugacucaggccuguaaucccagcacuuugggaggacgagguggguggaucaugaggucaagagaucgagaccauccuggccaacuuggugaaacccugucucuacuaaaaauacaaaaauuaguugggcgugauggugcacgccuguagucccagcuacucgggaggcugaggcaggagaaucgcuugaacuggggaggcugagguugcagugagccgcgggccacugcacuccauccagccuggcuacagagggagacuccgucucaaacaaaacaaaaaaagucuuggaucaggcaagaaggaauucagggugaguccacagugcaaagugaaagcaaguuuauuaagaaaguaaaggaguggcuacuccauagagcaaccuggagggcugcugguggcccauuuuuauggguauuucuuagugguaugguuaacaagggguggauuauucauuccuccccuuuuagaucauagagaguaacuuccugauguugccauggcauuuguaaacuggcauggcgcugaugggagucuaguagugaggacgaccaguggucacucucguggccaucuuggucuugguggguuuuggcuggcuccuuuauugcaaccuguuuuuucagcaaggucuuuaugaccuguauuuugugccgaccucacaucucauccugugauuuagaaugcccugucugggaaugcagcccaguagguuucagccucauuuuacccagcuccuauugaagauggaguuguucagguucacaugcuucugacauuugaaccugcgcccaggccggaugaggcuggagaaacacaacaauguugacuguucccacuauuuauuuauuuauugauugauugauugauucauucauucauuuaugagacggaguuucacucuuguugcccaggcuggaguacaauggugugaucucggcucacugcaaccucugccucccggcuucaagcgauucuucugccucacccuccagaguagcugggauuacaggcgccugccaccacgcccggcuaauuuuuguauuuuuaguagagaugggguuucaccauauuaaccaggcuggucuugagcuccugaccucaggugauccacccgccucagccuuccaaagugcuaggauuacaggcgugagccgccaggcccggccgacgguucccacuugauaaauuugugacgugaaccucagucgagcccuuagugcugccaggcggucauucuacauuuccauagccccuucacccucucgccuuaggcaacuauuaaaacucaaaucuucaacguuucuucucuuauccucucucagcugguaacguugcuucuuguuucacugaaaauggaagccgucggaagacaauuuucacacuagcugccuaguugcauguuuacucagggucucauauucuuuuaugauaauuggacuguuagugcuccauucuuaggucuuccugucuacuguguccugguuuccaucuccucuugccuacuggaaggcauuguucuaguaauucucuuucuuguaucaucaguuuuuuaauccuuuuaaacguuugcucacaucaacauauaaacgugcuuuaauuucucuuaccuuaaaaaaugaaaacuuggccgggcgcgguggcucacgccuguaaucccagcacuuugggaggccgaagcggguggaucacgaggucaggagaucgagaccauccuggcuaacacggugaaaccccgucuguacuaaaaaacaacaaauuagccgggggugguggcgggcaccuguagucccagcuacucgggaagcugaggcaggagaauggcauaaaccugggaggcggagcuugcagugagccgagaucgcgccacugcacuccagccugggcgacagagccagacuccgucucaaaacaaacaaacaaacaaacaaaacaaacuugacaccacaugcucuuucacuggucacuccauucuuuuuccuuuaaagacuuguaucauauaugcuugucuuuuaauucuuccagucucucuuguauucauucuagucagucucucuuccccucucccaaccauacuggaacugcucuuacugaguucccugaugaccuguuaaaaauacaguggucauggcugggugcagggcucauggcuguaaucccagcacuuugggaggccaggauggguggaucaugaggucaagagauggagaccauccuggccaacauggugaaaccccgucucuacuaaaaauacaaaaauuaccugggggugguggcaugugccuguggucucagcuacucgggaggcugaggcugacgcaggggagucgcuugaacccgggagguggagguugcagugagccaagaucacgccauugcacuccagccuggcgacagagcgagacuccgucucaaaaaaaagaaaaaaaauacaguggucucucuuugguuuucaucuuacuuaugagcagcauuugacacagaugauggauccuccuccuggaggcacuuuguuugguuuccaggacacuacccccuccuggcucaccuuauguuccuugguacuucuuuuucaguccccacagccuauuccuucuuaucuuugugaucucuaauuauuggaaugcuaggagucugucuuagccaucuuuaucuuuuuaguuguucaggacaaaaacuuuggaaucuuccuugauuccuuuuauuuacccuuccuccaccuccccagucaguccaucagcaaauccugucagcucucccuuaaaauguacuuggaaucuauuuuucaucaccuccacugcauccaucuuagaccaagccauuacuucuuggccucgugauuaaaguaguuuccuaaccagucuccuagcguugugcuuuugucccuccuucuucuccccucccccuccagauuuuuacuacaguagccagaauucucuuucuaacaggugagucagaacaugcagucuuacacuuaaaacacuccaauggaucucccuuucaacgcuuuuugguuuuagcaucuuaaaaugucauuuagcaucuuaaaauguccaaaaucaaacugcugauuuugccccgaaaucuuuuguguccguggucuuccccaucuuaguaaauguaacuccaggagugcagagcuauuugucuuuuuuuuuuuuuuuuuuaaaucuguaccacuuacagcaguaccuggcacuugguaggcacucaguauuuacugaauaaaugagaagaaaugagucuuucaaagagcaggguaagagaauaguguucuagguaauaugaaccauaagugcaaaagaaccugacggggcccaaguuuggcauguuuaaggaacugaaaagaaggccagccugggcaugguggcucaugccucuaaucguagcacuuugggaggcuaaggcaggagaauugcuugagcccgggaguuugagacuagccugggcaacauagcgagacccuauuucugcaagaaauuaaaauauuagauaugguggcuugcaguacucaggaggcugagauguaggaccugcaguagugaccccugauugcuccacugcacuccagccugggcgagagccagacccugugucaaaaaaaaaaaauggccagucugggcaggagcuuagguacuguauaaauuuccuguugcuacugcggcagugaagucauauguacuguuguaaaguucugguggucagaaguccagaaugaggcucaagggguuaaacaucaagguguggguagggguucuggagaaucaguuuccuugccugaugcagcuucuaaacaccugggaucccuuccccaucuuaaugccaugagcacagccucuucaaaucucugucucucaucucuacuuugcuuguuucaucaccuucucucacugacccuccuuuguuucccuuguaaggaccauugugaucacgucaucugaccagccuggguaauccaggaugaucucuugaccucaagauccuuaacuuaaucucaucugugaaauucuuuuugccaaguaaauuuacauauucacagguuccagagauuagaaccuaaacauuuuugggaggggugaggagguauucagccuaccacaguuaaugaagagugaguggccugagauaaggucuuagagauuggcagggaccagaucaugauaggucaugauagggagucuguuuuucagucauagugcugagagguuucaguaggggaaugauaggauuugaugugaaaaagucucccuggccgcuggauggcgauuagacuguugggaucgagagcagaaggccucagcuuuuuauucauaacaucauacgguggaucucaaucuugcuguacguuaugaucacaccucaaagcaauuauaucugaaccacugagggcuggacccaaguaucagccuuuuuuuguuuguuuguuuguuuuuuaagaaaaagcauucuaauuguagccaggguugagaaccacuagucucauagaucugaauccauuuuaccuuuucagccuuagcucaguaggagcuucucgcauccaucacuuacugcaugagcuacuugaccauuucuuagacaaacuuccuguauucccaccugugccuuucaaaauauaccuagucuagggaggccuacgcggacugucagggcccagcugacaaacucuccuccagaaagcuucuccagugcccuguaguaggaaugauuugcuuccuucccuggcucccauuugcacuuagauuucucagcccugaucacagucagcuguauauuaucgucuccuuugcuuauuuacucaugccuucaacaaauacuguaccacuuggcugaaugcucugcuagacacuaggauuuacuacaaugcaaagacagucuugguugggcgugguggcucacaccuauaaucccagcacuaugggagggugaggugggcggaucccuugaggucaggaguuugaaaccagccuggccaacguggugagacucugucucuacuaaaaauacaaaaauuagccaggcuaauuagccgagacacacuccuguaaucccaguuacucaggaggcugaggcacuagaaucuagcuugaacccaggagguggagguugcaguaagcugagaccauaccacuguacuccagccugggcgacagagcaagacucugucucaaaaaaaaaaaaaaaaaccuugucuucuagguccuccagcagcuuaaucuauauggagguaggagcggguagaugugcaauaagaauacucugagaugauuguucaaauggagauucguccaagugcugugggaacauggggauuucagagacagguuuucagcuauuucaguauuugagcuaaaaaacuugaaggaugauuugguauuugguggugagcagggcaugaggaagggaagaguuuucugagacaacaugugaaaggcaggagaugggagagagauuguaguguucuuagagaccauguaguaacaguauugcuucagugcucaacagugcucaaugaagacagugucagaagcaaguagggggcauuagauucugugaucuucuaugcuuuaugugaaggaguuaaauuuuauccuauacuuguagggaugccauugaaaaauuugagcaguagagugacauggugugauuuccauauugggaggauugcucuggguaauguaaaggagaggcuggaauagagagggauaaaggcagggaggcuggugagugccacuaggagaggaacaggaucagguuuguuguaguugaggggaauugcagugaauugaggcgugaaccacucuuagaagccuaagguuauggggccgggcaugguggcucacgccuguaaucccagcaaugggaggccgaggcggcuggaucacaaggucaugaaaucuccugguuaacacggugaaaccugucucuacaaaaaaaaauacaaaaaauuagccaggcaugguggcacgcgccuguagucccagcuacuugggaaggugaggcaggagaaucacuugaacccaggaggcagagguugcagugaguugaggccacgccacugcacuccagccugagcgacagagcaagacuccaucucaaaaaaaaaaaaaaaaaaagccuaagguuguaaaaggaagcaaugcuuugggaagguagaggauugaaggggagauucaggaucaggguucuuaaaaaaaucuuuuuuugccuaauaaguggccuugaagaaguuuauaugcauaugcugauuagaaagauucaauagaggccgggcgugguggcucaugccuguaaucccagcacuuugggaggcugaggcggacagaucaccugaggucaggaguucaagaccagccuggccaacauggugaaaccccgucucaacuaaaaauacgaaaauuagcugggugugguggcacacgccuguaaucccaacaacuuggaaggcugaagcaggagaaucguuugaacccgggaggcggagguugcagugagccaagaucgugccauugcaguccagccugggugaugagcaaaacuccauuucaacaacaacaaaaaagaaagauccaauagauagacuugaagauagaagaaaguguaaauacaggggaaaaugaugaaacaaauccccgaggaggcaugaaaagaaguuauucugagcacaaauaauugguuuagccuuggauaagaagaggaggaguugugagaaggggucauggaacuaaggaugcagucagaugauuuugugaaggagccagaaaccuugagauuauccccaguagccucggcuugcucugugacuugggagagaacaggugaggaggacagguguuaaguuguaguagccucaucugcacccuagaguuuucucagauggugcagccuaggggcagggauggaggagcugagacuucgauuauucucuggguuuuuugccagaugauuugaggaggcggguggaggaucugcauguguccuuuuccuagguuuugaauuccugaugcuguaaccacauuauuuuaucuucuauuuugaugaguaugcagcuuugcauugcaguggcuguguaaacacugaauuuuguuuugcuucuugaccauuuauuuuuccuaccaggauaguaaugaugacacugaagauguuucacuguuugaugcggaagaggagacgacuaauagaccaagaaaagccaaaaucagguaggaggagagaaguugcaugagcuguguuaguguccagugcuguucuguauguaugucagugcuagcugaugggagucaaggcagaguuguuucaaugugcuugugaauacugcauguugcuaauuugacguuuaguguacgacaaagaugacauuucagauuuucuugugaauaauuggcauacuuaauacugaguuuuaaaaucagcaaauccaauuauuugaacaccuguguuuuuaauucugugcuauuuuccaagaauguaccauuucuuuauauaguuucuauagauacauuacauuuugauuuauugugcacauuucaaaaucacauaacauuucuauucuaaauuuaauucucucuaaagaaauucacuuacugaaagcaaauucuacuugaacccugcuaaaaugcugucuuuuacuuuucuuucaucuuucaugccagucacaaaagaccacauauuguaugauuucauuuauaugaaauguccagaauaggcaaaucuguagagacagaagauagauuagcuguugcuagaagcugagggguuugaagguaaauggggaaugacugccaguggguacaaagauucugucugggguaaugaaaaguuguaaaauuggagugaugguuguacaaaucugugaauguacuaaaaaccauuagauuguuuaccuuaaauaaguaaauuguaugauaugugaauuauaucucaaaaaagcuauuaaaaaacaagaaacaggcugggcacgauggcucaugccuguaaucccagcacuuugggaggccgaggcagguggaucacgaggucaggagauugagaucauccuggcuaacauggugaaaccccaucucuacuaaaaauacaaaaaauuagccgggcgugguggcaggcgccuguagucccagcuacuugggaggcugaggcaggacaauggcgugaacccaggaggugaaguuugcagugagccgagauugugccaccaaacuccagccugggcgacggagcgagacuccgucucaaaaaaaaaaaaaaaagaaaagaaagaaagaaacaaacuaccugauaacuuugucuuaaugucugagugauuucugagggcuaaggaauucuuuuggugugauuugaaaauaggauucaaauucuaagauacaguuuccuuauuucuccaagagagauaaaauucuuuauuaucuauuuugugaaaguuuauauucaaugagguguuaaagucaucugugcauaguguauuuucuguaacuacagggccuagucaaauaguggggcuuaagaaaaagagagcuaggagguuugcuucauccuacuaaagucaccucuuuuauuuugacaaaacucuucacaguuacacgauggcuaaaacauuuuucucuacauuugcuaguaccuguaguaaaauguaauugcauuucuuucauuguguuuugguuuucagacauccaguagcaucguuuuuccacuuauucuuucgagucagugcaaucaucgucuaucuucucuguggguugcucagcagcagcuuuauuaccuguauggugacaauuaucuuguuguugucgugugacuuuugggcagugaagguaauuuugauuguuuuuauuuuaaaauuauauuuaauaugaaaaugauguauaaaaauaugaguuagcauuuugcauuauuguuaaucuuuuguuacuucaaaccucaucuguguugaagugcuagauauaucaaauugcauguaguuuuuuuuuuuuuuuuuuuuuuuuucauuuuuucccuuugacaauacaagaugagacaugcagguuacugugcugcugauuuuucugugccauauucuaaccuacaucagcuuuaaagucaaauaaacaaacaaaagugacuagcaaccauagacccuacaauguugcuucuaauccauaccauggguuuugcuucaggcuuaccuguagguguguuguauauaauuucuagauaaggccccaguguaguuuguccacaaauaccuaaaaaauaccuaccuuuugaaaaggcuccuauggaugcuuuaaggcaguguuucucaaccagagacaagcuugccacccacugaauauuugucaguguccaaaaauguuuuugguugucaugacuggaggugggaggagugugcuauugacaucuaguggcuagagggcagguaugcugcuaaauauccuaacacacaggacggccccucugcaacaaagaacuaccugacccaaaaugucaguugugccaagguugagacacccugcuguaggggauagaaagaaguguaagaaaugguuucaaacucaagaacaaugauuagagagauggauggauggauagauagguacauaauaaauagauaaguaagcauaauaaaauauuaaauauggacucuagaugauagauauuuggguauucacuguaaaauuuaacuguguguguucgaaaauauaguaaaauaguggagaaaaaaaucaaaggcugauuuuggaguuucagagacacauacugauucaaagacuaguaagauguuacaacccuauucacacccaccaauguagccauuuuuagaucuuuuaauucuuuuuuuuuugagacggaguuucacuuuuguugcccaggcuggagugcaauggcaugaucuuggcucaccgcaaccucugccuccuggguucaggugauucuccugccucagacucccgaguagcugggauuacaggcaugcaccaccacgccuggcuaauuuuuuuguauuuuuaguacagacgggguuucuccauguuggucaggcuggucucgaacuucugaccucaagggaucugcccaccucagccucccaaagugcugggauuacaggcgugagccacugcgccuggccaucuuuuaauucuuaaagauaccugaagugguuggcuuggugauggccaguuuccauaggccgcauaaugcugagaaggaagauuucaaaggucuguuuucuuuagguuuuucuguuguccagucuucuuuggcuugcauuucuuugaauuucuucuguuacuuuaugcuccaaaguauuuaguacauacugcucacaguuuugauacacguuucuuuuuguuguucauaaaauuucuguucagccaaauagaacaugcuuuccagucaguucuuccugguaauuuccaaacucuuaaaauuuuucuggguuuagaguuuuaaaaaaugcgaucaaaauaguuuauuuucugauaagguuuauuuguuuauuuuuguuuuuaaacaagggcuuaaaaaauggcacccuuuuauccuuggcaaaacuacuuauagauagcaaagcaauggagauauaaagcaaaauuaagaagucaagaauagggaaauuauuaaguggacuugggauaagcaggguucugaaacaguuaaaauagagaugugucguaauuguuauaaaucucaauguacuuacuaaaaaaacaaaaaaucaaucuucaucuaaaccccuagguguccaaucuuuugguuucccugggccacaguggaagaaagaauuaucuugggccacacauaaaauacacuaacauuagcugaugagcuuaaaaaaaaaaucgcacacaaaaaaaucucauaauguuuuaagaaaguuuacaaauuucuccugggccgcauucaaagcuguccugggcagcaugaggccugugggcagaggguuggauaggcuugcccuaggugauguuaaugaagauaaagaagagguagagaagggaaaauaauuuaaagguaugcuuaaaugcuaaagcuuauauugguuuuuauuuuauucuucacucugacaaauugaguaaaaaagguuaaauaaugguuuuaaaaauuuaauggcaacuauggcugggcgcgguggcucacaccuauaaucccagcacuuugggaggcugaggcggguggaucaugaggucaggagaucgagaccauccuggcuaacauggugaaaccccaucucugcuaaaaaaaaaaaaaaaaaaaaaaugagccgggcgugguggcaggugccuguagucccagcuauucaggaggcugaggcaggaggcggagcuugcagugagccgagauugcgccacugcacucuagccugggcaacagagcaagacuccaucucaaaaaaaaaaaaaaaaauaauggcaacuauuaguaaaauuuaaaaccagucguguaucuucugcaacauuggagaagauggagcaaguaaaacaguucauagagcaaaagaaggaaaacaaagcaacugucaaggaagcuuaaaucagaaaguacauguauaaagugauguaaguaauagcaaauucauuauaauaggaaauguaauuugauuaaacuacccauuuaaagacaagaauacuaagauuggucagaaaucaaaguccaaacaaaagaucuaacaacauuaaugacauuagaaaaaauaaaagaaggcaaagauaacaucagaucaacucaaacaaaaagaaacuuggcauuguauuauuaucagaugagauauggaucagaguaagaaagcacuaagaggaacagaaaaaggugauuuuaugaaucacagugaagaucauucacagaguaaaauuauaucaaacuauguauaguaaaaaaauuggaaauauuagaaaauagaaaagcauuaugaugaguuuaacaaacuacuaucuuuaacaaaccaaagugccaaaaaauaaauaaguucugaaggaucugaaugaaauaauuggcaacaucaauuugauagcaguauuugggacuuuguaugacagaauacuuucuuguuaaaugccuguggggcauuuacaaaaauugacuaaauaucacugugaagaaaaucaaaauaaaauugcccaaagcaccuacauuuucuacuccaaugaaacagaacuagaaauuaauagaaaguaguugucgaaauuggaauucuuuuuaaaaagcgaacuacuacauaucuuggguuuaaaaggaagcaaaaacuguaaauauagguuauuuauaccuuaauggugaucauuuacaguuaaacuuucugaauaugucaaaaacugaauucagagggaaaauaauagacuaaagccuuuuauuuuagacaagaaagagggaaaauaauggacuacuugaguccagaaauuucaaaaacaagcaauaagcgugagaaaucaggaaaauaaacuaauaaagauaaaagcaggaaauaaagaguuagaaaaugggaacacagaagaguuugaaaguauucugagagcauucuuugaaaauaccuauagaagagaccucugguuuaggucucccuugccagcucuuuuuuuuuuuuuuacuuagcaucucucccauaggaauuuuggucucauaagacucuuccuuuucuucuccuguauucccuuccuaaggagugccguuuaugcuucugguuuuaauugcugaucuguaagcuguguugccucccagaucuguaucuccauucagguuuguccucacaacucaaggccucuccaugugucuucuugacguuuuuauguggcugucuugaaggcaucucaaaucuuuuuuuuuuuuuuuuuuuuuuuuuuugagacaaaaucuugcuuugucacccaagcuggaaugcaguggugugaucucggcucacugcaaccucugccuccugggguucaagccauucuccugccucacccuccuagauagcugagacuacaggcaugcaccaccaugccuagcgaauuuuuguauuuuuaguagagucaggguuucacuauguuagccaggcuggucuugaacccaagugagccaccaugccuggccaggcaacuuauaucuuaacauguguaaaauacuacuugucaucuuccacuccccaaaagcucuucuucuuugaguguucccuuucguggggccuggaaucacuauuuuuuuacuugagcaaaccagaaauguaucaguugccuccuuccuacuccauauccaauuaaugaccaagucccauaaauccauagauuguacuuucuucauuagggcaucagugccugcugcucuaucuggaaugcucuucuuccucccacaucaccuucauacagggauuccuaaucuuuuuaugccaugggucccuuucauagacucaugaauaaguuuucacauauauaaaguacauaagauuucaaaggaagucacuuauauugaaauauaauuuaaaaauauuagaaaaguaaauuucugauugaguuauauguguaguaguucccccauuaucugagguuucacuuucugcgguuucaguuacugcuauacacuacacuaaacaguaagauacugugugaggagagagaacuacauucacauaacuuuuauuagauuauguuguuauaauuguucuauuuuuauuucuuauuaaucucuuacugugcauuauuuauaaauuaagcauuaucauagguauguacuuacaggaaaaaauauagcauauauaagguuugguauuaaccacaauuugaggcaucugcugggggucuuggaauguauccccugcagauaagggaggacuacuauacuuuaugaauuuauuaaugguaagaucuaguggcaggucuaauaacuacuuucaaagcaguggugagcguaaacaauauguuaagauaacugcagcaaguauaguacaaaaugaaaaaugucugugguuucuauugugucaggguguuuuuaauuuuaccuauauucauaguuuguugucuacauucauaauuuaaugauaugcuaacuacuuucaaagcaguggugagcauaaauaguauuuugaggccgugcgugguggcuuacgccuguaaucccagcacuuugggaggccaaggcgggugaaucacugagguugggaguucgagaccagccugaccaacauggagaaaccccaucucuacuaaaaauacaaaauuagcugggcaugauggcgcaugccuguaaucccugcuacuugggaggcugaggcaggagaaucguuugaacccgggaggcagagguugcggugagcugagaucgccccguugcaugccagccugggcaacaagagcgaaacucugucucaaaaacaaaaaacaaaaccaaacaaaaaacaaaacuacaauauuuugagguaacugcagcaaauauaguacaaaauaaaaaaaugccugugauuucuauugugucaggguguuuuuaauuuuaccuacauucauaguuuguugucuacauucauaauuuaaagauaugcuaaauuuuagccagagguuaaugaaaaugaagguaacauuuuuuuuuaacccaucgagguucacagaaccacugaaucuauuaguggacaccauuaauuaaacauccaugguacuguugauucuuauuuaucuuuuauauuucauuccaaauguugacuccucagagagucauuuucugauacccagacuagauccaauuucccuguuauacucuucaagcaucucacacuuuucccuugcaggacuuaacucaguugguaaugguacauuugugcauugguugucugccucucuucaccucuuucccugaggaaggaguugguaucuguuagucacuguuguauuaccagcacauaguagaugcucaguaaauauuuguugaguaaauaaagauuaggaaagcuaucaaacuaauuuauuaccuuaguaaguaggaaaagagcuugguaacuugagagacugacugaaggccagugucuauaaucauuuucagggauauguaguuguaaaauacauguagcuauagucaggauguaaaguaggucacaguaaccaaauagcaagggguuuagggaaaauuagggaacuggagaaagggcaaauuguucaugagggaaaagagaagguguaauguuuauggguggacuuguugcuugcucugucaccucuaccccuauuaguccugccauuaccauuuuacuuaaucacuuagccaggccugauacauaguagucuuugcuaacuggauauuauggagguaaagcugaagguuuuuguuugugaaauguuacacuaagauaggagcuugugauagaucuuuaaauaaugcuuuuaaaaugugccuguuuauauuaaucuucaccagaaugucacagguagacuaaugguuggccuacguugguggaaucacauugaugaagauggaaagagccauuggguguuugaaucuagaaagguaaagugccuuuuuuguuuuaaauaauguuaucagcuaaauuauuuguagacuauauuuaaauacuggaagaugaaguauucagaauuaaaaacacuauaccaaaucacuuggcaugucagcacuaaaggagauggccuucuagaauuuaaugcauuuuucugucuaguucagaccagaaacaagcaauauacagaacagaauccuuugagggaagacacugggucugaguucauacagugugcuaagcugccugucagggauugcugauaaaagaucucuguguugccuuuguuagugucuccauaaaucccucuaugcucagcagauaacugcuuuuaacaucuuguucugucuuugcuccuguggucgucuuucauuucugggcaggaaaaaggaggaggagugcagcuggauagaauaucugaucggagcacucuauuccuaagcuucugccuucaggagcccuggggauccuggucuguuuuggguuagccugcuacacuauagugaauauucacuuuccuuguggaaauaaguuuuggaagcagaggaccaaauucuuggcgacaguacaccaaggguauugacaaguuauuuuaagaaaguggcacuguguucaaugagccuguauucuuuuauauuauagaaucuaccuuggaaacaacuuaccacccuuguaacuuccuggguauugcuaagacauuuugauuauuguccagaaucccuugauuccguuuuuuuuuuuuccucuggacccuaauuugaccuuuuagucuccagaaugauuauaacugugauuuccuugaucauugguaggaaagguaucauuuagagcuuccuuaugaauaaauaguacaagugcaagaagaauugaauagaauccuaucagagaccacucuuuacugucaugaguugugguaaaccauccauccugcccugaaaaugcaaaauucuugaguuaauauagaucaguuccuaaaauuacaagagugauagucauguauuuuuggguucuaacuuaggaguugggcuguguguauuaauauuugaacuuguggguaauauguuuuuuauuaaacauguugaacuuuuuauugauaaauuucacaacaugauaauugaauuuauguucuuuuauaggaguccucucaagagaauaaaacugugucagaggcugaaucaagaaucuuuugguugggacuuauugccuguccaguacugugggugauauuugcuuuuagugcacucuucuccuucagaguaaagugguuggugaguaucaguguagaacuuucaaauaauccauuaagaugucugaugguaaucauaggaagcaacaacuacaacugaguccuuaucauuagggaccuaucuugaauaggcagcuucaucauguaauucccaaguuuugcuucccaacuuuaccuuucucuauaauacuggagaagagauccuaaaaaaccccuucccaccaguuuucuagauuauuaguggucuuuucuggaaauaaugguugguaaccuauugcugccuaacaaaucacuccaaaacauaguggcuuagagcaacaacagccauuaucucacaguuucuaugggucaggaucuugggaagggcucugcugggagauucuggcuuggggucuugaguaguuguagucagacaguaguuggaaugauggggguugugagccaucuccucuucaugaggucccauggccucuccacauguuuuucccugugccuucguuugggcuucuucauggcaugguggccucaugguggugggacugcuuacguggcagcccaguacuucacuugugggguguucuagcucgcaagcuuuuacaaucuagcuaagaugucauagcaucgcuucugcugcccacucacauucaaggaaaugggaauuaggcucugcucuugauaaggaauaagaaggugcuagaagacuuuguggaagaggagauauuguugcugcugucuuuggaaaauauaguuugucacuugacccaauuugugagucuuacucuuuuuuauaucucauauuauuuuuucuuauucuaucuuauaucugauaugaauaaauauugugugaauuuucacacaauauuuauugauaucagauauauuuuggccuuaauuauguuuuuccuccuaauuuguaguauuuucuuaguccuauuuugcgauauagauucuuuuuuucuuugugugugcucauacauucauacuuuccuucuuuggauuuggaagcuuauuggaagcuuauugucuuuuuucaguucuucugguaguuaccuuuaauuacuuuauauguuuauaucauuacccucuuucaugaauuaggaaauuuauucaguauuuauggaguuccugcucuggaaaaugggaaacuuuacgcuaauaugguuucuuuaacuucucccuccuccuaccucuagaguuuugcuuauuauagucuuauuuuaguccuucuagugguuuucuuuguaacauuaauuaauguacuuaaaccuguuuauugacuuaauagacucuguuuagaaagggaagaaaauaaacacucauauuccuuccuaugaguuuccuccuuucucucuuguuuguuccaauguuauuuuuguguuaccaaguuuuauaauaguuaucuuuugaaaacauauuucuuacugguuguuuagucuuugaucuguuuuuuaaaaaagucgauucauugccuaucaccagucuuacugcagcuucuccuuuuacuuauugguuggcuacauuuucuuuugacucauguuuaaacauaugagccuauugacuauucuuaaaugaugaccuggcuggauuaauauucuugggucacaguuuguuucuuuuuggaagaugcuauuccaucauuuucuuucacugaauaucuuggagaagucugaggccaggcuuacuuaaccuuuguaaucucuccucauaagguguuuuuuuuuuuaguucauguaacccagauguaucuguauuuaucuuuccauaucaaguuuucuggagucugugccuuucugacaggcagaccaaaguuuugcuuggaaucaggaaaauuuuuucuguuaaaucuuugcauuuauuuauguucuaugguuugaccuuucauuuugaaguaccaguuacguuuauguuggaucauuuuuauuuguucucaucuacuauuuucuuguugcuuuaauuauucaucuuuuccuuauuuauucagcaauuuuaagaguucacucuuaugucagagcugucuggagacacagggggauaaguuaggggacaguaaacaaguugacugcuccaguagagcuuauguucuaguggaagguagacaaacaguaaaaaauacaacaggggauguuaguuaaugauacaaaguaaugggguagagagugcagaggagagaacaguaacuauuuuaagugcucagcuaaggcuucucucuguauuuccuuagcuuugucagcuccguuuucaucuccuguuaucucacccucaugcuuuuugaguucuuuucuuuagguuuuucuguagggugaaauaguccgaggaaugcuuuuauuuuggugggguuuuuuucuuuucgaguagauucuucaccuaucuucuguauacuaugcuucuuuuuucuuuuuucacuauaguuuugcauaaaugcacuucccuuuuuccuuauccauuuugcuuauccuuacagugacaguccuguccagcccuucucuuucugcugguuuagugcgggugaaucccccuugaccaccuucuccugaugucugaggcacguggcugcugcucugagcuggaguugcagugcuggguuugguggccugaagacacaggugugaugugcgauguggagaacuugccaggcucuugcucucuuggcugggcugccugguuuugcguucucuuccuuaguggggcucuugucugcugguuggcugugcacucucuucugguucuucccuucugcuuuggauuguuuguaagaccuuagagcuuuagcauccauccaagagagucagcccagucuuuuucuagcaguguuucuacuuccuuaaaacaaaacagggagagguuaugugaaagccaguuugauccuguguuaaccuacuuaugccuaguguuccauuauuggaacacuaagcauguaggaguuauuuauauccuacugcucaaggucaucaccaaggucugauuuuucacucaugcaaaaauucacaaaauugcagccuacagcauaaauggguuaagaccucggcaugguggcucaugccuguaaucccagcacuuugggagggccaaggcgggcggaucacgaggucaggagaucgagaccauccuggcuaacauggugaaacccugucucuacuaaaaauacaaaaaauuagccgggugugguggcaggcaccuguagucccaguuacucgggaggcugaggcaggagaauggagugaacccaggaggcagaguuugcagugagccaagaucgugccaccgcacuccagccugagcaacagagcgagacuccaucucaaaaaauaaauaaauaaaaauaauaaaaauaaauggguuaagaccacaggacgggaaugggcuucacccagucucuccaugagucucccaccuccucacuucucuuaagaugaucaucucucaugauuaaugauccuucugcgcuuccucuccugccuucuucccacccgguggcaccacuauggccagcugcagggauuuuccugccuguuugggucauuguuaguugggaggaguuucugcugucauggcuguuucugcauuuuuuucucgggucuuuugcuuuucuauaaguuccuggggaugguaauuagugaaauuuuccuuagagcuucuuugcagaguuuggagcuauguagagcugcuccaaccuggcucuuucuuuggccaccagcccuuuuuuauguuuguugguauuaguuuauuuguguuuuuaaaaaugcuguuugcuguuuguaccuuaaggggagggagaucuucaugucugacuucacugcaccaucuuaaaccagaaguuuaacuuacagauuuuaacauuuguugccauugaguaaaucgaugccuuagcaggacccaugauuggucuuugaauugagguguacccuggcauguugauauauacauacccagcagugccccauuugagaagcaugggaaauuaaaaggaaauuuauucaaauaaauacacaguuuuauauuuauuuaggaaacuagcacccucuuauuacacuaacacguuuaauuccaugaaacauaaguuuagaacagaaaguaccaccuccucuucuuuuacuaggaaugugaaaccuguucauuaaucaaacauuuaaaucuauuaauuaaacauuaaaaucagcuauacaucuuguuaaggguaaggagaauaaaucuagauuggaaaacgacauuucauugagcugcuuugcuugucacagauauaaaagaguagaauggucgaugagcuguuuauuccagaacaaggguuggcaaacuauggccugcagaccaaauccagcccgacaccuguuuuuguaaguuuuuauugaaaaacagccuugcccacuuauauauugucuauggcugccuucggauuagaacagcagaguugaguaauugcaacagagaccguauggucugaaauauuuaugauuugacccuuuacaggagaacuuugcugaucccuguauuagagucuuuaaccuugggaaucccucacauugucucaauuuuucuaauuaagauuaauuagaaauuuuuaaagaauggguuuugaguuucuuuuucucacuucucauugauccuagugggaugaccauaggugagaaaaugaaacucaaaggaacaaacagcucugcaaaaguacaguuccccuuggagcugucucccugcucggggaaggcaggcaucgguugauuuaugccuuagggcauugcauccccucuaccagaagccaguugucacguagagcagagauucaccccuaccugcucucaguuuauugaacuugaucuaccucuugacuguucuuuuguaauucuuauaggaauaauuaacauuugaaccuuuccugagucucauuuacuuuuccuaacuuuacucacagaccaaugggaaacagagagcaagaaggcucccccugcacugcauccccagcagcuagcaugaugccuggcacauaagagcaguuguguccaguaaauauuugcugggugaaugacucgugccuugugcagagcgucuaucagaugggucuguucuggcaacugucucuggaaaaucucaacuggcacaaucauggcuuugcagagcuuccucuuccuucucuuucucaugacagucugccuugucucauuuauggcacagagaaaggucaauuucaggccaguaaccauugauuauuuuuucccuugucccaggcggugguuaucauggguguggugcuacaaggugccaaccuguaugguuacaucagguguaaggugcgcagcagaaagcauuuaaccagcauggcuacuucauauuuuggaaagcaguuuuuaagacaaguaaguguuuucuggaugugaucagugacuaaugcaauuauuucuaacuuucauaguuuaauuuuuaugaaacgcuccugaacagaaguuuuaaaggcauauaguuguauaaauauaaugauaaagauguuguaauugcucuuuggggguguucaagacagucuggaaguguauugucaguauccuaaaauuauuuuaaagccaggaaggauaaacuaucauugauaauaacuuauuuuuuaaaaauuacuuuuaaguucaguuguuuuucaucaauuaugggagcuuuaagugaaugcccuugcagaauguauguuguauguuuuuuuuuuuuuuuuuugagacagaguuuugcucugucgcccaggcuggagugcaguggugcaaucuuggcucacugcaaccucugccccccggguucaugugauucuccugccucagccuuaugaguagcugggauuacaggcgcaugccaccacgcccagcuaauuuuuuguguuuucaguagagaugggauuucaucguguuagccaggauggucuccaucucaugaccuugugaucugccuaccucggccucccaaagugcugggauuacaggcgugagccaccgugcccagccuguauguuguaugguuuuagggagaacaguugaaucacaagaagaccauaacauuuguacucagauguuuuuuucccccuagaacauaaggauuuuacuauaauaccccaacaucaggguuuucagcaggaugaguaguagucauagguaaauaauuauugguuaaauuucuugggaaaagugacuaggucuuuuuuuuuuuuuuuuuuuuuuuuucuugagacggagucucgcucugucgcccaggcuggagugcaguggcgcgaucucggcuuacugcaagcuccgccucccggguucacgccauucuucugcaucagccucccgaguagcugggacuacaggcgccgccaccacgccuggcuuuuuuguauuuuuaguagagacgggguuucaccguguuagccaggauggucucgaucuccugaccucaugauccacccuccucggccucccaaagugcugggauuacagguguaagccacggcgcccagccuagcaugucuacuuuuuaaugugauugggccauuguauguaagguaaugcucugcuuagaaauauagaauguuuuccuaggccuaguccccaaguccauggugugugaagugaaauaacuuugauguuaaggaguuuuuuuuuuuugucuuuugcagaacacuggagaugaucagacuuccugaauagagaaagcuuaugugcuuuguuacauuggggaacaacugaagagauucuugacucaaccuuuuagagcuuaguccauguugcaacgaggaguguuggcuuuguuuuuccacuuaaaaacuuuauuuauaaaaaggaaaaguaguuuucauauuaaguuuuuauuuccuuuccagcaguuggggcuagaaaguauguguuggcacuagaaacauugucaagauuuguucugugguguagguaugcacauuccauagguaugcacacggccauguaauaucaguauaucccaaguuaaugaaaguguucauuuacauagguaauggagaccuuugcauuuugauccauagaacauaggaggauguucuuagucugucucaaagcucuauauguuuacauauuauuucuguagauuguuuucaggagaaaguuuugcuucuaugguaagagugagcacuuuggcuuauguauaaguuagaaauaauuguuaguuuuuaauaugcacuucguggggaaauuucuuagacguaugcaagcaagugaaaacaauuagggccagugguauuaacuacuuuauaaaauuuuauuuuuguuuguaagaagucaucuauuuaaggcccaguuaauauaaguggaaucaucauaguuuaaggaauacccagagauugcugcuguucuauuuauuuuacagaaaggauagcuagauugaaagcucuucaguggaccuugagcuaauagaucuuuuaccacuaaaagagcauuauucucaugucauaaugagaauaauaauuuacauacuuggcauaauaaaugccuaaaagacauuuuauuuucugaaucuauuuuuuucuugcuauaauggggauauuguaaauuaugcauuuguauuaaugguauuucuuaaagcaaucuauguaacuguaaauuaaaccaaucuacaaacuauuguaggcaucuguaaauucuguuguagguauuauaaacuuuguugaagucuuaaucagcagauuauguugugaauauauuuguacauuguuaaaauaguuuuuaagauuauuuguuuaauugaauaagugucuuauuggagugauagcuuugaaggugcaaaacuuuauauuuguauaaaauucuacuauuuacaaggc

SEQ ID NO: 192255 - RNA, 5732 nt, Homo sapiens
caggcucuuuguuucaaguuuuaaucaaagcuuguauauaagauuacuuuauuccugcaucuucucaaugguuucuuccuuguauuugcccuuuuccuuuccuacuuggcgagauuuggcuuuccguucgaggaucuuuuugcggucuuuguccaguuuuagccuagugauaaccaccugcagaaaaauaagaaaaaaacacucccaagcuuuaaauaaucacuaaaacacaagggaaagcccaacauucaauaccauuucccaaaccugggguagguggaugccuaauaagaaaagauuuuaacuuuuaaaaaacuccagaaaucacucuuuagccaucaaaccuggcuuauuuacuaauuuccuaccaacaaaggagaaaaggcaagaugguaucaguaauucuuaaagccucuucugugcuucauuauaagauuuguuucuuuuucacugagaaauauaugauucugcucuucucacuacaguuuuacaagcugucauauacaaauauauuuguuuccaaaguaacuucaggcugggugcggugguucaugcccccaaucccagcacuuugggaggcagaggcaggcggaucaccugaggucaggaguuugagaccagucuggccaacacggugaaaccccuucucuacuaaaaauacaaaaauuagcuggguaugguggcacaugccuguaaucccagcuaccugggaggcugaggcaggagaaucucuggaacccugggggggcggaggcugcagugagcugagauggugcuauuauugcacuccagccugggcgaucaaucgagacuccaucucaaaaaacaaacaaguaacaaaacagcaggguguggugaaugccuacucaggaggcuacugcgggagaaucgcuugaacccaggaagcagagguugcagugagcugagaucgcaccauugcacuuccaggcugggcgacaagagcaaaacucuguccaaaacaaaaaaaaccccacccccaaacagaaaaauaauaaaguaacuucagaauuuuaaugcuagaaauuaaagguagcauccacacauaauuccaccugcaaaaucuuuagugagaagaugacaauacgaucuuacuccaacaguuccaauccuaaaagacauccaaauuaugauaaauuuuagucuuaugaaugcgaggaaagggugaaaagaggugcuggaaauacagcaugcagaccaaacaaaaaucuccacagucacugaacucauauucuaguauagggagcccgaaaacauuuacaagugaaucuacaucacuuugauagaguaagaaggcaagugugaggaggccgaggggcuuucuagagugaucaagcaaagcccuacauuugaacagagaccuaaaguggugagcaaucuaucuaugcacagguaucuggaagagaacagcaaguugaaagguucaaaggcaggagauuaucaaguuucauagauguguuucucaaacuugaguaagaaucaacuggagggcuuauuaaaacauacaccugggucauaagcccuaauuuugccucaguaggccugggcucuuagaauuuauaauucuaccaaguugcuaggaggcgagcagacuagaacauauagaauggaaaaagaugucagaaguaagggaagaucaguuaaggucuuuauuuuuuuucuuuuuuuuuuuuugagauggcguuuucacucguugccuaggcugaagugcaauggugcgaucucggcucacugcaaccuccgcccaauauacauaaugggacaggcaugguggcucaugccuguaaucccagcacuuuaggaggcugaggcaggcaaaucaccugaggucaggaguucaagaccagccuggccaacauggugaaacuuuguacuaagaaguacaaaaauuagccggguguaguggugcacgcauguagucacagcuacacucaggaggcugaggcgggagaaucgcuugcacuugggagguggaggcugcagugagccgagauugugccacugcacuccggccugggugaaagagcaagacugucucaaaaacaaacuaacagaaacauaaugaccguuaacacuuugaugucagaaacauuuuaaaugguauuagaauuuucaauacaagugcaguaguauuuacuuuaaaauguuuuuuuccagcacauguaaaaucaaggacuauuucuauggccuugcucuguaaacaaucaugucaacaauaauugccauaauuuccuucucucaagcauucucaaaaacaccuaccuugcuggggugaaugccuacguggacaguugugccauuagccuuuucccgcugcacccguucaauguagauaacauauuucuuccuguaaaccuggacuacuuugccaauuugcugaccuuuauaguguccacguacaaccuaagagcaaauucaaaaguaacaaauauuugaauaaaagauuaaccuuguaaaucaaguaaacaaacucaugcauacaccauucacccuaucauuauauuaaaagguuaaaaaaaagagcccacuucggcaaccuguaagaaguugacaacaaggaaucuguuacuccaucucaaaagcagcaacagaccaagaguauuuaaaucugaacccauuaaugugugcaaccuagugcuagucagagggcagcaacaaaugcuuaacggaacaaaccaauucuuucccaaagguuaguggacaggaaucccagugguccucaguuugugaggacaaguauuucugaacagauucuucuucccaguuugugacuuucuugcauugguauguauugaaaacagagaugacaguuuucaaggucuacuggcaaguuuagcacuacugcagcagggaccaacggcuguucucaacccacacugcuuguuugggaacccauuucaucuuuuugaaauaggcaugaaaaaauauugaugguguguauguaaauggcuuuagagacugccugaauucuuuaaucacuagcugcacuacagauuacaccuaagggucauuuauagaaaccuucaccuaaauagaugcaacaaauuauuuaccuguaagugcaaacgauaacgugacugugcuucaguuacagcuccugaaucuagauugggagcaauucuguuuacugguccucaacugccucuucaaugaccaaacauugaaaccuccuuuccaaaaauugccaacagugagaaaauuacagcaguuaaagagaacugaccuaacucccaucuugcuucuaaccuccaagauguccuuguucauuccugggcauagaccaaacuaacuuugggaggaacuuagucuacagguuaacuuugaaacaaagaugcuaacagugcuuuccugaaacaaacccccuucuugccuggguaccagacugccuuuguaggcuaacaaauuagcugcaagacuagaaauuacaguuuaggcagcuagaggcuuccccaauugcuccuagggauaacacacuguaaagccuaagauuugugugauuuuuuuuuuucagacccugcacugauggauccgcuggugccacccagaucaauaaacuggcucaucugaucuuguggcccccauccaggaaccaacucagagcaagaagacagcuucaacucccuaugccuucaucucugauacgaccugucaacacgccccacucccuggcccccuaccugccaaauuauccuuaaaaaaacucccaucccuaaauuuuccgggagaaugauuugaguaguuaacucuggucucucguucuggcucugcaugaauuaaacucuuucucuauugcaauuccugucuagauaaaucggcucuaucuggacagcaggcaaaaugagccuguuggguagucacaauauauugauaaaaggauuaaucccaaagcaauguucugauuaugucaccuaauuauggucacaucaucugacguuugaggaaacugauuuucgggcaggauccccaggaguuggagaccaaucugggcaguaaagugagaccccucucuacagaaacaaaaaaaagguccuacaugggagcaucacuugagcccacaagagccaugaccacgcaacugcacuccagucuggguaagagugagaccccaucucagccgggcgcgguggcucacgccuguaaucccagcacuuugggaggcugaggcgggcugaucaccugacgccaugaguucgagaccacccugcccaacauggugaaaccccgccucuacuaaaaacacaaaaauuagccgagccgugguggcgggcgcuuguaaucccagcuacucgggaggcugaggcaggagaaucgccugaacccgggaggcgaagguugcagugagcugagauggcaccacugcacuccagccugggggggacaagagcgagacuucaucucaaaaaaaaaaaaaaaaaagauuuucaccaaauaauacaauuaaaaacugaaaagcagcuuacuuacuguuuuuuggucccuggcucaacucaucuugccacucuuugggagcaagagucucagaagcaucuuucucaggaaugcaaucucucuucuaagcuaagugcguaaaauauccaucaagacaacgagaacaaguagggauacacaccugaacuucaucauccuuucggaugggcauggaucgcacguuguacuucugucucagcucuuuggaaagaggggaagacauaaucuuccuucgaaugugggaaggugcauugaaaugccuuuugcgauucuugcuucggucggaagucacaaagggauuaaacuucauuuuggcuaaauaaaaaguuaaaaagacucuuaaaugaccaaaaucucauccagcuuccaaacaaauaaccgcaaugauuuuaucuugauagucuagaaugaucauaggcagugucauguugugcaacuucaacaaaaacuguuugaucggaagggccuaucaaccgaagcucgaaacuuuuuauuuuuuguuuuauucggguguuuucuguauauguuuacggacuaaagacuuuugcaucaaaaacacuuguccuaguuauaagaccuuuuaguuacacucucccaacuccucaaguagugccugaggaaaucaagacuggacuuacaucucugcugagcagaccgacaacgcaauucucuuaacuauaaccucacguuuuagaagguacaaucaacguucaucuucuacaggcuuaagagugaauacguauagccccgccaaaaugaauaaggcccaccaacccgaaccuggaaaagccugcacacgucucggguccuaaaagccucccagugggcaaguguggucuggaaauuccgugaagacuuuaccgagaaguuacuucgagaccauucucuaggaaacgacacuacccagacuccagucuauuuccacaggcucccuucccucagcucguuuucgaguucccaaauccccggucccuccauccaucuccggcccggcggcccuugauuuaagaaagcaacagauaaaaaaccaucccagucucuccuuccuggcugcuacucggccgacaagagacucucgggguccccgcggucggaagccaccaugcccaagaacggauggcugcugauuacacccgcuugcccgccgaauccuuacccgcucccgcuucggugauggccgcaaaagggaagagaacuacacgcugcuuccgguucuguaaguuuaccaaagaucucgcgagaccuau

SEQ ID NO: 192256 - RNA, 23275 nt, Homo sapiens
ccccauccccacccccaagcgagcaccugccccucccgggggcggagcuccggcgcaucauggcggcuggccgggcccaggucccuuccuccgugagugcugcuauuacgucucuuguuccuuuuuucuuguuugucacagauacucuuucucuuccuauuuccucugccuugucucucugggcucgcuggccgcguccggcccaugggugaggggguugugagucgguccgcuccuaccucuuacugguucugcgaauguuuauucccucauucacgcggcgcccgcugugagccuuaaacuggucuccguucacucucuaggguuuaauccuggugggaaaccaggagcagguuaaugggggaacuauggggcuguggguuccuggagaagacccuugacggagcuguaggggaaaagggcaaccauaauaaguaaaagcgucugagacccgaagugcguguagaaggcaaaaagcgccgaaaggggcugggugugguggcucacgcuuguaauccagcacugugggaggcggaggcgggcggauuacuugaggucaggaguucgagaccagccugaccaacauggugaaaccucaucucuacuaaaaauacaaaaauuagccgggcgugguggcgcgcaccuguaauuccagcuacucagaagguugaggcaggagaaucgcuugaaccggguagacggaggcugcagugagcugagauugugccacagcacuccagccugggcaacagagcgagacucugucaaaaaaaaaaaaaaaaaaaaaaaagcgccggaagggguuucaggacggaagcaaacacauauucaaaggcaggaggauagagcaggugucugaaaaacucaaaaguucaguuggguggugguggaggggucagagcugacaguuuuguaccucuugcuaagcagcgacuuuaacaugaggguaauugggugugguggcacacgccgguaaucccagcugcucaggaagcugagcagggaaccacggaaguggagguugcagugagccgagaucgcgccacugcacucuagccuggacgacagagccagacuccaucucaaauaaauaaauaaauaaauaaauaaauaaauaaauaaauaaauaagauguuaagaaaauacaaucuaaaggauugguuugugugcguguguguguguguguguuuugagacggagucuagcuuugucaccaggcuggagugcagugacgcgaucucggcucacugcaaccucugccucccagguucaagcgauucuucugccucagccucccgaguagcuggaauuacaggcauacaggcacgcgccgccaugcccagcucauuuuuguauuuuuuuucuuuuuuuuaaguacagacgguguuucaccauguuagccaggauggucucgaucuccugacgucgugaucugcccgccuuggccuccgaaacugcugggauuacaggcgugagccacugcacccagccaggacugggaccuauguagggaaaggaaggagcuaaggaggacaucuagguuucaggauagaacaacuguuugguuaaggguacuauuugcuaaguuagugaacauaacacuagaagaguucuagaaaaggacaggguuuuguggaaaguucaguguugggcaugugugcugccuguggauuggccauggagagucuggcagauggauaggacuaaagcucaggaaugagaucucagcuaaaguagacauacaggaacaaucaucaucuggccauggcuguuaaacccaugcagugguugagauaauugugggaaagcauauuguguucuuaaacuucagccuguauuaaucuggaucuuccucuuccucccuccuuuuuuuuuuuuuuuuuuuuuuugaaacaaggucuuacucugucacccaggcuagagugcaguggcaccaucauggcucacugcagccucaaccucccugggcucaagcgauccucccaccucagccucccaaguagcugggacuacuggcgugugcuaccacgccaggcuaacccagcuaauuuugaauuguuuuagaguuucaccauguugcccaggcgggucucaaccuucccaggcuaaggugauccucccaccucagccucccaaguagcugggacuacuggcaugugcuaccacgccaggcuaauccagcuaauuuugaauuguuuuagaguuucaccauguugcccaggcgggucucaaccuucccaggcucaggugauccucccaccucagccucccgaguagcugggacuacaggcacgagccaccaugcccagcuaauuuuucuuuuuuguagagacgggucuuugccuuguugcccagacuaguagugaacuacugggcucgagcgauccaccuuggccccccagagugcugggauuacaggcgagagccaccacauccagucugcuccauuuuuacucaguagaugaaaacacgaauuugccuuuuuaacaaaacuuagguaauuuuaccuugaagccaugggaucacuuugagagacagucguauucagugcaccaagcaaaggauaggccauccgagaaacaggaacuacaaaagaauacugggagaggaagacaaaaagcgugagagucggaacuuugcuuauacugguggggcaacucugaauggugauuuggucugccuuccacaacucugaccaugaaugaguguguggcugaagugggcugaaagucagugguagggcuguccacaaggaugcugaagacaucuagaacuugaagacuuuuuuuuccuuuuaacuuuuauuuuagauucagggggacgugcgcagguuuauuauguagguaaccucaugucauggggguuugguauagagauuauuucgucaccccuguacuaagcauaguacuugauggguauuuuuuccaaucucucucuucccacccucaaguaggacccagugucuguuauuucccucuuuguguucacguguucucguuauuuagcucccacuuauaagugggaacaaacaugcaguauuugguuuucuguucuuggauuaguuugcuaaggauaauggucuccaacugcauccauguuguagcagagaacaugaucucauucuuuuuuauggcugcguaguauuccaugguguauauguaccacauuuucuuuauccagucuacuguugaugugcauuuagguugauuccauggaagacuggcuuuucuagcucuuuucgagcuccuuaagauuagaagaaugugaaaggccaggcgugguggcucacguguguaauccuggcacuuugggaggcugaggcgggcggaucacuugaguucaggaguucgaaacuagcuuggccaacauggugaaacuucgucucuacuaaaaauauaaaaaauuagcuggguguggugguggaugccuguaaucccagcuacuugggaggcugagacaggagaaucacuugaacccggaaggcggagguugcggugagccgagauugcgccauugcacuccagccugggcgacaaagcaagacuccgucuccaaaaaaaaaaaaagaggaaugugaaagauugaccaggauguuaauauaugagcauuggaggaccagggaaggagcuguaauggcuuagaaguagcauuaagggagaaggauaaagggccuacugccaaguguguuaaagcugccuagcacugggaguaggccaaacugguccuuuucccuaaaguuaucuacauaucauggcaaguguguguccagaaucugugucagguauacaaagauaguccauauccuccucaggaagcccacaccuuagcugaaaagacaacaggaaacaaaucaagugagguuguaucuugcauauauuuaguuugugggaaaugcauaccuuugaauaaaaaaaggagaugauuaaaaauuauacucugccuauguccuuuuuauguacuguccacuauuaggcacuuauacauaguauggcacuaugucuuacucauuuuugguuuugguuuuuuugagacagugucucacucugucacccaggccagagugcaguggcgccaucuggguucacugaaguuucaaccgccccaggcucaggugauccucccaucucagccucccgaguagcuggaagcacaggcaugugccaccacgccuggcuuuuuguauuuuuguagagacaugauuucgccauguuguccaggcuguacuugaacuccuggacucaagcaauccacccucuuuggccucccaaagugcugggauuacaagcgugagccacugcacccagccuguccuguucuuuaugaacgguuuaaaggauuguucaacaauguuuuuguccauucuuggucuucaacguacugacuuuagaaccagauuccauguaagauggcaugaguacaaguuuguuagagaaaggggcaagaccaaagcuggauggccagcugucuacgguauggcuggacuaagacuuuuaagguuucuucaaguucuaaauuccuuuacuuuugaucuucauuucaugugcccucuggauauucuuuucuuuuuuuuuuuuuugagacggaguuucccucuuguugcccaggcuggagugcaauggcucgaucuuggcucaccacaaccuccgccuccuggguucaagcaauucuccugccucagccucccaaguagcuggaauuauaggugugcaccaccacccccagcuaauuuuguguuuuuaguagagacaggguuucaccauguuggucaggcuggucucgaacucccaaccucaagugauccgccugccucagccucccaaaguguugggauuacaggcgugagccaccgcacccggcccggauauuuuuuucuaguccuuuauucuucccaaguuuccuuggugggccggauagucaagauguuuuaacuaaauucacuuuccucaggaacaagccuggcuugaggaugcucaggucuucauccaaaagacccuguguccagcugucaaggagccuaauguccaguugacuccauugguaauugauugugugaagacugucugguugucccagggaaggaaccaagguucuacacugccccucagcuauagguaaggagagguggcgguugcgggggcugggcaggggcagguauugaauucaggauugaaaaguaagguucuauaauuagaaaaagggcaagugagagagugagcggaggacaagguagucuaaacauaccccuucugcagagcuuuucuaacacuaucaagcuuuccuuuuccuaaaguucuccugaauuggcuuaagauuaaagaaaaagagaggaagaggggaagagagaaagaaaauuuggaaaaagaacucucgaaguggggaaagaggcugguguuaucuuuauuuuguguauugggaaacaaagauacagagaacuguuugacauuaccaagugcagaucauuguguuuaagaugugaguuuuagggcuuccgagaguguguuuauauauauauguguauauauauauauauauauauauauauuuuuuuuuuuuuuuuuuuuucucucuacacuaucauuuccaaaaguguucuaggcaacguuaguaaagcacaagaaaagggguucauagcuaaguaagugugagggacauugaauaugauaaacgucucugggagagucauaggguuuauuaacauauuagaggcuaugacaaguccugcaaaagaaaccuauuuaucuccucauagaaguaaucacuauuggccaggugcaguggcucaugccuguaaucccaacacuuugggaggcuaaggcagguggaucaccugaggucggcaguucgaggucagccugcccaacaugcugaaacaccaucucuacuaaaaaaaauacaaaaauuagccgggcgugguggugggcgccugcaauccccagcuacucagaggcugaggcaggagaaucgcuugaacccgggaggcggagguugcagugagccaagaucgcaccauugcacucuagcugggcaacaagagcgaaacuccauauuuaaaaaaaaauaauaauaauaaucacuaucuuggagaugggauauauuauuccaauaaauauuuuaauaguuuuacuacacaugcaucuauccuuaagcaauauaauguagaguuuugcauaaguguagacuuuaaauaaaugguaccguacccuauguaaauacccuccgugauuugcuuuuuuuuuuuuuuuuuuugagacagggucucacucugucccccaggcucuagugcagugguauaaacauggcucacagccuuuaccuccugggcucaagcaauucuccugccucagccucccacauagcuaggaccacaggugcaugccacacuggucucgaacccucaggcucaagcaguccuccuaccauggccucccaagguguuggcauuauaggcaugagccaccgugccuggccugcuuuuuuuuuuuuuuuuuuugagacggagucucauucuguugcccaggcuggagugcaguggcaugaucucggcccauugcaaccucugccuccuggguucaagugauucuccugccucuugaguagcugggacuaugcgccaccacaccagcuaauuuuuguauuuuuuaguagagaugggguuucaccauuggccguacugguaucgaauuccugaccucaggugaucugccgucucggucuuccagagugcugggauuacaggugugaaccauugcacccagccccugccugcuuuuugugcuuaacauuauacuucuuuuuuuguuuguuuuuugagauggagucuugcucugucacccaggcuggagugcaauggcaucaucucggcucacugcaaguucugccucccagguucaagcgauucuccugucucagccuaccaagaagcugggauuacaggugccugccaccacaccuggcuaguuuuuguauuuuugcagagaugggguuuuaccauguuggccaggcuggucuugaacuccugaccucaggugauccgcccaccucagccucccagagugcugggauuacaggcgugagccaccgcgcccggcccauaguguauaugcauaucuugagccuguguuuaccuugguuaaaaaauuauuuuuauuuauuuuucccuauuugguaggcauuaaaugauauuuuguuacauuaauuccaaaguaauuucuuuuuuuuggagauggaauuucgcucuuguggcccaggcuauagugcaauaucgcgaucucugcucacugcaaccuccgccucccagauucaagcaauuuugccuuagccuccugaauagcugggauuacaggcacucgccaccaugccuggcuacuuuuguauuuuugguagagacgggguuucaccauguuggccaggcuggucucaaacuccugaccucaggugauccucccgccucggccucccaaagugcugggauuacaggcaugagccacugcgcuuggccuaauuccaaaguaauuucugaggguacuuguacacgguuuuguuuuuuuuccuuuuuaucauuuuauuucacuggacuguuuuuccuuucuuuuccuauaauucuuguccacguccauaacacuuaagauuacuuuuuuuggcugggcgcaauggauggcucacgccuguaauccuagcacuuugggaggcugagacggguggaucacggggucaagaguucgagaccagccuggccagcauggugaaacccugucucuacuaaaaauacaaaaaauuagccaggcaugguggcacaugccuguagucccagcuacuugggaggcugagacaggagaauugcuugaacccggcaggcggagguugcagugagccgaguucacgccaaugcacuccagucugggcgacagagcaagacucugucucaaaaaaaaaaaaaaaagagacaguucucucugguugcuuuuuccugggccuucagauaaguaggaaaacacagagaaagaacauggacuuuugaaugaggcacaucuagcuuugccacccaugccucuguguaccugagccucugaguuuccccauuggugguguuuacaggguuuugaggugaagaaaauucagcguugugccugaccagacucaguauaguauagcgugcauggcaggggccaacagguauuaguuucugucuuugccuugugucuucuccaaagcugucagggaaggagagcagaugcagaaggggaauggcuuucuagaacagcauucucucucuuugauacucauuuguguauaauguucuugaguccaacagggaggauuaauugugauguuuuguaacucgauccuuuucauuuccacuuaaaaaaaaucauggggccgggcacaguggcucaugccuguaaucccagcacuuugggaggcugaggcagauggaucaccugaggucaggaguuugagaccagccuggacaacauggugaaaccccaucuggagaggguuccagauuucagucuugauuucacuccagccugggcaaaagagugagacucugucuaaaaaaaaaaaaaaaaaauucaggggaaugcaagcgagaauaaugguauuacaaaaaggugaauuuaucacaacguugauaauuuaaccauuacuuguaucacauccaacacccacaucucagccucagcuuccccccuagucucuaguacugugcuauucuagacuagaaaggagcuugacuggggucauuguaguuggacuguuagaugccuacguggucccauuaaguucucucuggaguuaagagcugagaugcuuucaagagaauugccuuuguuacuuacaaaguguucuccccacacauucauuuccucaggccccucaugcauuccuacuucauuucucuggguccucucccuggcaccaucuuguugaagauacuauucagcacggaauuggacucagaucccauccuuauuuucuuuuuccuuuuuuuuuuuuuuuuuuuuugagacagucucacucuguugcccaagcuggagugcaguggcgugaucucagcucacugcaaccuccaucuccuggguucaagcaauucuucugccucagcaucccaagaaacugggauuacagcugcacaccaccaugcucggcuaauuuuuuguauuuuuaguagagaugggguuucaccauguuggccgggcuggucucaaacuccugaccucaggugauccacccgccuuggccucccaaagugcugggauuacaggugugagccacucgcccggccccauccuuauuuucuuaggccuuuagccccagguuuuaccccuuuaaucaaucaaacucaccucuuaguccauguucccugcaaccuuucccugggcucuugaggguuuaucaggguugaggguugccuuaguaggcuuggaccuggcuuugcaggaccucuguucccuucacucuacagcuucgucucaguacaggaccucaagacucaccagcgucucccaugcugcagccaccugucguggagcaguagugcauaccaggccugggcccaagaggcuggaccaaaugggaacccccugccccgagagcagcuguuacuuuuagggacacuaacagaccuaucggcagacuuggaacaagagugcaggaacggaagccucuaugugagagauaacacuggcguccugagcugugagguaaguggaagguggagaucagaugccucagauccugacaagaaugguguccaaggaucaaggcaauuaagucucugaggaaacaaacggggagguggguggauaggaugcuaagguucugauuaacccuugcucuuggucuuucuuagcucauagaccuggaccuuucuugguugggccaucuuuuucuguucccccguuggaguuaccucccuccugccagguggaauuccucaggggaagggcacuuggagcugugggaugccccugugccaguguuuccuuugaccaucaguccuggccccgucacgccuaucccuguccucuacccagagagugcuuccugccugcucaggcucagguaauuucccccucuaggcauggcaggggcgcuguaaaacugaaggaugaugcugggucaguggagggagagaaagaaaagggcauugauaguaauauagacugaauguuccaaaucaagggaauggugggcuuugaauauuaagaagguaaagagaaggguuguucaagggaucugugccuuaccuaagggaaagagaauuuugaagguuuuuagcauagcuugcuuugggcuauggacauuuuguaucauuaccagguuauucuuuacuguggaagggacagcauuuauagggaaaaagaagagaaauaaagaugacugcugcugcuuuuuuuuuuuuuuuuuuuuuuuuuuuuuuuuuuuuugagacguaguuucacuccugcugcccaggcuggaguccaauggcgggaucucagcuuacugcaaccucugccuuucagguucaagugauucuccucccucagccuccugaguagcugggauuacagggcuuuuucuuccuucuuagaaacaagcucagaggugugcagcgaaaccuggcugggagucuaguucgauugagugcucuggugaaaaguaaacagaaagcuuacuucauccugucucuugguagaucacacccagcugucacccacguguccaucaucgugcaggugaggacuggggucauuucagccauggaagugggggagggugguagaacuuucaguaggaaagauagcaucauaggaggagccauguaggaaaggaggacagcuggggagagcuguuuucuggaauagcgcuguugggagaagauuccgggaaauguuugugcauagaguuagggaguagacuuucccgcugugcaacucacuugagcacacagcuuuuagauuguaugugaccuuuuaaaaaacugccacgcucacuuguggagaugaccaaagaaaucauucaucuuaacaccauugagacauugaauacaggcauuaaaaaaaaaaaaaaaacuugguacuuacuguugacucuuuuugcaucaacugguacaauuuuauuuuuauaauuucaacuuuuagacucaugagguacaugugcaaguuuauuaacuggguauauuuugugauucugagguuugggguaugauugaucucuuuacccagguacugagcauaguacccaagguagaaauuguaaaucauugaucuuuauucuaaccauuguuuuaugacauauaaguuucugaauaauguuucuuuuccuuuuuauagaaauuuuaaaaauauauguauuuuguagaaauagggccuuacuguguuagagaagaacaguuugucauacuucccuugacaucagucacaauacuggauacauauauacucaauacacuuugauuacaugaaugaauguuguuuguguguuauggggcgggauagggcacaguuuucucaguggaauauuuauguauuuugaaggaaguuuuagggaugguuuguauguuggggaagugguuuggaaauauuuggcaucuccugugagagaggagagacgcuaagauuuaguuggcagacauagggaagauggagaggugaguugagacucacagagggcaggucucugaguucaaaucgugagggaaaaggacucuggcagaguggcaguguuggggucucuugugucacauugccugucucugcacaagccaggucccugcccagcugguguggcacagagcccuucggccugguacagccuaugugcugacagaacugcgaguguccaagauccguggucagcgccagcauguuuggaugaccagucaguccucccgucuguugcugcugaaaccagaaugugugcaggagcuggaacuggagcuggaaggaccccucuuagaggcugaccccaagccacuccccaugcccagcaacucggaggacaagaaggauccagaaagucuuguccgguauucuagacuccuauccuauucggugagcacagggagagauccuagagcuugaggggccagaaauguggguuuucaaagaggaagaaaauaguggucaacuggaccucggccuguuugcagggagcagucacuggcguguugaaugagcccgcuggccucuaugagcuggaugggcagcuggggcucugccuugccuaccagcaguuccguggccuuaggcgggugaugcgaccuggagugugucugcagguaugugagaucagggcugauaacaaaaagagaccucugcagcuucucuuaccuucauaggcuccuuuucugcagcagggugguuauauagaaauauagaaauuaaaaguguguguuagggggcacuuuugcuaaggauaacuuggacagaagcuuaaauaaaaaggaguagagucuugggcacugugaggaggaguuguggccagagcaucuccuucacagaagggccuuucagcuggaggaggagauagcugaagcacagaucuggggcuggggugaucucaggcgacccggugagaagccucagccaugucuguucauccaggagccacccagcccacagcaagacugaguggagcucaugggagaugaaggcugaccgcagcgggaguggguuguaauggaaagugaggccagcccacgugggagaaauugcuuuccgucuuccuggaacccaggcaguggcaaagugcgguuaacucugccuggguucauugaguuggggucuucaucucugcuuuuucauuuucucugcuuucccccagcuccaggauguucaccugcuccagucagugggaggggggacaagaaggccagugcucgcccccugccuccguggcgccguucugcuucaaagcuucucucgucagaagccuggggcucacucaucccgucaagccuacggggccucccuguacgagcagcuggugugggaacgucaguuaggacuuccccucuaccugugggcuaccaaggcccuggaggagcuggccugcaagugaggaggcugagggcccagggcggggaggcagugggaguagcacacuuccuuggcaaggagagcaggauucuugaagaggcaggcucuucaggggaagugacugugcugcuuuuccuggccaaggcuguguccccaugugcugagacaccaccaguuccugcaacauuccucuccugggagccccagccugggacugcaacuccuggcuccuacccuggaucuucuagcuccgccaggcagcccuguucggaaugcacacaaugagauccuugaagagccacaucacuguccccuccagaaaguaugaggaugugggggaaggaugguggcagaacacuggaggacaccuggggcccaugggacacacacccgauuucucuucccuccuugacaguacacucggcugcagacucccuccuccuuccccacucuggccacccugaaagaagaaggacagcguaaggccugggccuccuuugacccuaaggcccuucugccccucccggaggccuccuaccugcccagcugccaacucaaucgccgccuggcuugguccuggcucugucugcugcccucugccuucugcccagcccagguaagggggacccuagcagggcucaggugauuucccuuuuugucauccuuauugccacgacucuagucucgguuacuaucuuucuucgucauuuugacuacacuagccuucuaagcagaccacuucaucuguuguuggcccuccaauucauucucucugcagcaacuagaaauggggauaugccaggcacaguggcucaugccuguaaucccaacacuuugggaggcuaaggcaugaggaucacuggagcccaagaguuugagaccagccuggguagagagaccuuguugcuacaaaaaaguugucuuaauuaggugcgguggcaugugccuauggucccagcuacucaggaggcugagguaggauugcuugagccugagagaucaagaguauagugagccaagaucacaccacugcacuccagccggggcaacagagcaagacucaggaaaaaaaaggaaguuuaaaaaaaagugaaacuuguauuacagaacucucuuguuuaaauccuuuuuuucgagacaggaucuugcucuguagcccaggcuagagugcauuggcgcgaucauggcucauugcagucucgaccucccagguuccagugaucuucccaccucagccucccaaguagcugagacuacgggcguucaccaccgucccuggcuaauuuuauuuuuuuauuuuuuugggacagaaucuugcucugucacccaggcuagagugcagaggcacuaucuuggcucacugcaaccuugccuccugggcucaagcaguccucccaccucagccucccgaguagcugggacuguaggcauccaucaccacauccagcuaauuuuuguguuuuuguagagaugggauuuugccauguuucccaggcuggucucgaauuccuggacuugagugaucugccugccucagccucccaaagugcugggauuauaggcaugagccacugcaccuggccuggguuaauuuuuacacuuuuuaauuuuuagagauggggucucacuauguugccaggcugaucuccaccuccugagcucaagugauccuucugccuuggccucccaaagugcuaggauuacaggcgugagccacugcgccccagcuuaaauucuuugcgugccucccagugcauauaaaguaaaaucaaacgucucauuguguccugugagaucccgcauggccucuuaccuguaaccucuauuugugcgcuuucucuucuccuacuaaaugugugaaugcguguguguuuuuuuaugucugucuuccccacuugaauauaaguuuuuugaagccagagacgugucuuuuuuguucauuuuguagcuuuaccauguaauacagcaucuggcaaauaguagaugcucaguauuugcugaauaaacauuugauaacucaaccuucaucuucuugcagguuuuacuugggguucugguggcuucaucucauaaagguugucugcaacuucgggaccaaagugguucccugcccugccugcuccuggccaagcacucucaaccccucagugacccacggcugauagguuuggaguucagauguggaaagaagaugguagugggauggugguucucauagccaggggagccugggaggaaaagccugcugggauuuacuagagaugcagaagugacacaugucaaucaacaacuucugggagacuuguauggcaggcagagaacaggagcaagaggaccccuagccagaauuuccagcaugcauuucuccaccguagcuccuaacaugcacuccaggauuacaacugugucuccuacauucuuaguuuggagagaaggugucaccccucuaaggugggggucaggugugggcuuucaugucaugugagggcagcagcucuggccugggauggguagugaggccgguaggaugguuugccuugcaacccaccccacaggucuccuuucuugucaaaacagaaaacuuucuuccucuaggcugccuggugcgggcagagagguuucaguugaucguagagagggacgugagaagcagcuucccuuccuggaaggagcugagcaugccaggcuucauccagaagcagcaggccagguuggcuccuuggggucaugguugucuugagucuggggggaaggaagggccugguggaaggagugggaugcuggggaccaaaauacccaaugccugcaucacuaagaaauguauuccuugucucucccaacagagucuauguccaguucuuucuggcugaugcccugauccugccugugcccagacccugccuucauucagcaacacccucaacaccucagacagaucccaccggcccagagggaccccaccuaggacagagccggcucuucuugcucugccacaaggaggcccucaugaagcguaauuuuuguguccccccaggagcaaguccagaggugcccaagcccgcccucaguuucuauguguuggggagcuggcuugggggcacccagaggaaggaggguacuggaugggggcugcccgagccccagggaaaugacgacaaugaucagaagguaaacugggacuccagggacccaggaccugaccugcgcccugagccucuggcuaggaucccagcacuuugcucuccauccucccagguucaccucauuuucuuuggcucuucaguccgcugguuugaguucuugcacccgggacagguguaccgacucauagcuccuggccccgcugugaguguccuacuucaucauaccuuuccccagaaagcuuuuuugggguuggggucuaaagagggcaugccagugccuggucauucucuaggccuccuggaagaaggcuggauuuagauacaccagaaagccuguguguguugacacacuuccuucuccaugcuccagaaagaacaaaauugggucagaauguuuugugaaccucccacuggacuagcacacacucacaggcagucgucuucccauuuccgugcagacaccaauguuguuugaaaaggaugguucauccugcauaucucggcguccucuggaguuggcuggcugugcauccugccucacuguccaggacaacuggacucuggagcuugaaagcucccaggauauccaagaugugcuggaugcaaacaagucauugccugaauccucacugaccgaccugcucagugacaaguaaauguccaccaagccccucugguuaauuuggccacucucucuucucccaagcuagcuggguuuggugaagacuucauuuucugcugcaggagguauuucuuuuguuauuguuguuuuuguuuguuuuuuuuugagacggagucucacucuguugccuaagccagagugcaauggccugaucucagcucacugaaaccucuacuucccugguucgaaggauuauccugcaucagccucccaaauagcugggauuauaggggugcacgccaccacacccagcuaguuuuuuuguauuuuuaguagagacaggguuucgucauguuggccaggcuggucuugaguucuugaccuuaagugagccucccaccucagccucccaaagugcugggauuuaggggcgugagccaccuugugcggguuuugaaugaucugccacaacccucuuuuucccauaggcccuguuacucuuagugugcaguguggcagagcucagguuuuuucaggacuuuauauaugaaguucuagcagauacuuuagcuccauuuucugccuugaaucugacugucuccacucugugcuuucuugugccuccauucucaguguauuucccugaccuuccaguuucacagauuccuuggugucuuucuccgcugagauuuugucacggacacuaugugaaccccuuguggcgucucucuggaugaaacuggguaaugacccuuccuuuguggggaagguaugaaauagagugaugggacuuuguggacuucacagauccuacuaacacccaccuuccuucuauagggaacacgggggccaugagaaggugugugaagcuaacagucgcucuugagacugcugaaugugaauuccccccucaccuggauguauauauagaagacccacacuugccucccucacuaggacuacuuccaggagcccggguccacuucagccaguuggagaaaaggguuuccaggugaagauguguagugucaccugccuccucuugcuacugauguggcucucuggaaugugcaccccugcuuaacuuugcugcagcgaccccuucucuuucauacagguuuccauauaucagucugccauuugugcccagccaguacccucacgagguguugcaggcugguccuccuccuagucuuccccuagcuuugguagagccauggcuaggauaugucccucagggggaguggccacucuguggugcuugaucucugagucccagcuucuaccccaauuugccuugucuuccuggucacucacuauuccucuuccacuugcagaucucacaauguuuauuguuguuuccggucauccacuuaugugcagguccugaguuuucccccugagaccaccaucaggucagugcccagaccccaaccccuaaacuuccuggcuucacaucugcaucucccacaugucccugguucugaagauuuugccaucauuacagucuucuccaaucccaacaagauguguugagucagaggagcuucucuacuccaaauaaaaaaugcucugugucuaucauuguacccagaaucauuuaguguucuaggcuuuugaaggcuuuucagucuuaacaugcaaauauuucuuggcuaacaucaugguguucaaaccugaaaaauaaccaaugacuaucagagaucaggaauuaaaauggggcuucuaggagcgcauggaacccacugcuguccccauccugaugcccucuaaguccuucuagacccacccugcuuucagaaccccuuugccuguucuguuaucuugaccccugucucugucucccuguauuuauuuagcauuccccugccccacaucuaccuggcugaacuucugcaggguggucaguccccauuccaggccacugccucuugccauaucgucucugucuucagccuucagcucuucugggugugugcuuauuguaccagcaucugccggcagguaagggagggaaggaacaggcugaacugaguauggagugccagagggaugugaugggaccaagaggacuuuuccaaccacugucuucaucccagggaaagugcacucgccugggcuccacuugcccuacgcagacagcuauaagccaggccaucaucaggugagagcacaaggcgugcacccauugugccauuuacuuaugagaccacuuugucuaucugcaguuucuacauuagcauaauuccuggcucaugagaauugcuuaauauuuuuugaacgaaugaaugaggguaagcuccuaaaucugugagccaaagacugcagacagcggggagggaggcauguuggguccaggguguuggcaaccuggguugcuauaggcguuuuuauuuccuccugcuccccauaggcuccugguggaggaugggacugccgaagccguggugaccuguaggaaucaccauguggcagcagcacuagggcuguguccuagagagugggccucccuccuagauuucguccaagugccaggcagaguggucuugcaguuugcagggccuggagcccaacuugagguguaauguggcugggagggagggacucggauacccaaauuccugggcuuuuggcaaaggguuuaggagccaguuaaccuugaccuucucuuucuagucuucagccaggguugacgagcccaugaccauguuccucuggacacuuuguacuagccccucuguccuccguccuauugugcuuucuuuugagcuggaaaggaaaccgucgaagaucgucccauuagguaagguuggagacggggggaucaugaugauagggggaucauggugauagagauagaugggucccugggaggaagagggaugagggacugauggggaauuucuggaguuagggaggagaauggugggugggaacuaaaagccacaugccugagacguguguuuuuccucucuucccaccucagaaccuccucggcuacagcgauuccaguguggagagcucccuuuccugacucacgugaaccccaggcuccgauuguccugccuuucuauccgagagucagaguacuccagcucucuggggauccuugcuuccuccuguuaacugaacugcaaggauggccugagaguccuuccuugcugaaaaccugaaggccuagguccuggcuccucucccuacuuguucugugauugaaccaaggacuccagauucacaaacugcuacuccacuauaauuucccuucuuugguguucuggugccagccugccuuggcaaaauuguggcaacaggaaaucauggcccuauuaauauguccucugauugggacaaggcaccugcauucacaggcggcccugagcaccuggguucugacuuugucgcaggagcugagggaacaaaagacuugcucgcuguggggugauggugacaggccuauugaccugcaaugaagcccucuggugucauuucucacugguacucaucucuggggucccaggccuccugacuccuaguuguccaccuccuaggaacuccuagucguucaucaucauuucagcccuuugccgccagggccaaagguggaaagugauuuggaagagaagagcuuuucguccagcagaagaaaugguaccaaaaucagucuguaaaggaaguaaauuggggaguuggcggcaaggcagagagcauagcuaugauggucucagucaguaaggcugggcccugcaggaagucaaauaugaaugccuagagguguucacaagcacaaagaagguguagggggaggcaagugccaggcacaagcaggggcaggugaggacucugggugacugugcuauagggccccaggcuacgguuagcccuguagguuucccaagggccuggccuaaggcagauccuugaucgauauaccuugagaccagaaggugcuccgaaaucacaaccguacaauuaggggaucuaggaacaauucuuuggagauaccaaugccuuuggcugguguugcugcauuucuuuacuggggacugauagauggagagguggaaagaugagcugaggcacaucuuucagagcuacugggaggccauuucuuccuggcuguuaggauuuguucguguuugggagaccuuuagagcgugguuaaacccauauguugggauuuaugcugcuuuuaugguagcaauacccuauauuaagauuugaaguagacccggaaaguuaguggccgguuagcucaguugguuagagcguggugcuaauaacgccaaggucgcggguucgaaccccguacgggccaguggguggcuuuuuuuuguguguguuuuguuuucugacccucugcuguuauccggaaguuucuacccggagccaguugccuucugguaacagaauuauauugcaccuacugcuuccuauucccugaaucacuagcgcucccgaaggcuuggagggaggagucucugggcacccgggugaaaggaagguucacgugcaaccgccgcgucuuuuuuucccugaagcgcuuucauggaggcagauguuugucagucaagggaaguaagaaaggcauuggaugaaaacgaagcccuaagccucguagucguggccgagugguuaaggcgauggacuagaaauccauuggggucuccccgcgcagguucgaauccugccgacuacgucauauuuuuuucuucagcauacugaccauauuucucuccaggaugggaugauccagucggcacccuccaaaccucucaucuaggaacucuagaaucgagaauuugauuuagagucuaugauuuugguuugaaaucuaugauuaacgucuuuggacauugaaggaaauccgaggaauggacaagugaugcaagagccaguugaguuaccaaauuaguucuagaaagaucugaaaaagcucgguccggguuccuagcucuauauucuuguagaugaauuucaggaaccuuuauggcagcuucggcgccguggcuuaguugguuaaagcgccugucuaguaaacaggagauccuggguucgaaucccagcggugccuuuauucaauugaaacagcgugauuuugcggcuaaauccacauccuuucauguauuguuuuuauaucagaacgcguaagaguuucuguucugcacucauagcacccacauuuccugcagagucaagcugccacucccaugagaucgccacucuaaaaggugguucucuaacuuaggggcagaaauguugcauaggccuaaggguccuuugcuuaacugaugccacaccccacuggugcagguggacugggucaggcggccgccccacccucgauggaaggggcugcccaccuuccaggccucuuucuccacccuaggacguccccuagaaccugagccacuuuguuuuguuuggcucuucauuauaguucuuuggguuugguggcucauaauguuauauauauaguauauaauauaaaaauauauauuuaaauauacaguauuuaaaauuuggcacagcuuccagaugcgguccucuaacuggucuuucacuugcaguuaccuccaucccucuccaccagcgggaugucaggguaaggaguaagcagggauccggcuggccuggccuggccuggcaccagguuucgugcagcagggugcagaagggcugaggccaugugaacagaguccaagaaagcaucauucgggagucgcuagggauccugguguggaagggcagggcacuuuucuggagcacugaagcuaggcugguuaaggaagaaauaaaugccagagauaaggcaagaaauaggaucugugagcucuuggcaggaccuaaaccuccuuggaagauaggcagaaagcucucgacaccauuccauggcccacgaaccaauguaagaugagcaaauggcuugaaggaauugcuaccuccaggucaagccagggaugcagcacugccgagaccacguuugugccaagcacugggcuggacccugugcagaaccaaaugaacaaggcacguuccccuuucagcacuaacggcacuguaagaacagggagaaguggaaucuaaucuggccugaggguagagggugaucagcuaagucugaaacaccauguagaaacuugccauguauggccgggcgcgguggcucacgccuguaaucccagcgcuuugggaggccaaggugggcggaucacgaggucaggaguuccagaccagcagccuggccaacauagugaaaccugguaacauagugaaaccucgucucuacuaaaaaugcaaaaaauuagccaggcgugguggcaggcgccugcaguccuagcuacuugggaggcugaggcaagagaaucgcuucaaccuuggaggggggaggagguguugucagccgagaucgcgccacugcaucccagccugggcaacaagagugaaacuccgucucaaaaaaaugaaauaaaauaaacgaaugauca

SEQ ID NO: 192257 - RNA, 17796 nt, Homo sapiens
ggauacagaagugaugugagugucugcgagcguggucucgcgggcgggugacgucaucgaggcgagagaggcggagccguggacagugggcgggaggcugccaacgguuuugagcguagggggaggcgugagagggggaucucaggggaggaggucaaucgcuugccccccacuuuggcaaauuggggacugaggacuggaaggguggagaguaggcggaaccagguggucgucggggcagaggaucucgggcuaggcuugagggcggcgugcuucuuagggacgacuuagggcgugacugaggguucacaagguuucuuuugggguggucgggagggagagauucuagggaacaaggaagcucgcuauggcuuucuugccaggaggggucgaagggaaaguacaagggagcuggagcugacccuggguagaacgggugaagggaugggggagcgugagguuccgcccucucuugagacuggaaccaauugagggacuaguagggcagggggacagaaauugggcuccuaguggauuuggguccguuuccguugggacguuuugggugugagaacuuaagagcucaguugaccggggauagccugugccggaguugaucugcagcuuccagcacucguagucgggaagaggagcuucagcagcgcuguugucccacaguaggucuucuguccgcacccgcucugcgcugcacccucuuaacgcuguucccaggagcuggggaaagggaugcuuuugcccacucccauggccccuggaacugguggaaaccuuuccucuaaccagaaagccucgauauccuuaauucaccaaggauccuuggcguggagucuuccucccuucucccaagucuuucuccgugaacuuuuccuccuggacuuugcuaaagcagaaccucccagcucuuugcugucuccgguugucucuucccuguauucauggcaacaucagcugacagccccaguucaccccucggggcggaggaucuccugagugauucaucagaacccccugggcucaaccaagugucgucugaagugaccucccagcucuaugcuucuuugcgccucagccggcaggcggaggccacggcccgagcccagcuguauuuacccuccaccuccccgccucaugaaggguuagacggcuucgcccaagaauugagucgaagcuugucagucggauuggaaaagaacuugaagaaaaaggugagggaagugugucuuggagaccacuguggcacuagacaccagagagucuugggauugggguugguaaaaauaaaaagcuuugaugagauuugaacucuuccuguuggauuucauauuccuuuuaacugcauaggcagccaugcuuauaagggagggagugaccugggacaccauaauuugaaaauuaugaaacuucccaguguuuuuuugugagagacaucucugcuccgaguagauagagcaaaccuaugggguagguuggugagcuauuucccgugcacugggaauggguaagguuucuugaucccaagagggagcuagggacuuaggauagcagcuccgauccuuccagcucaacacuauguugauaguaugguuccaacuuuggcauguacaucauuaagacauagcuuagucaacuacaacauguuacagagaagauaguuauuaguauuguauagaaaaggugucagagucaauuugcagacugguuaggucuuccagaguuugaaaaugauagccauaagccauacaguccuuacauuuguucuugaaucggcaagaaucuccgcaacucuugucuuauaccuccucgauuauuuuauuuacacucucuuucuggcuucuguaguauuugaauuucugauucaaguuuaggacaucccuuauuggauccguuugguuuuucuuguuuuccaaagugcuggagugaaaauucuacccuggcaauagguaggagauagauaacacagacugcaucugauuuccauguggcuuuuuuccaggaugguucuaagcauaucuuugagauggaaaguguucggggucagcuccagaccaugcuccaaaccucacgugauacagccuaucgugaguaagccccuucccuagaacuaugaaggagaaccuagauguaaggggugggagaaaguggacagaggaagcaggcaggaaaaccucugagcaagagauuucaggagaaaagucucccguucuuugggagagggggugaaggagugagggaacuggaaaggaaggccuuuucucuucagguggccccuguuuuugucauuaccugacucuggcuuuggggucccucuggcugccugcaggggauccucucauuccuggcgcuggcucagagagacgggaagaggacuccuuugacagugauagcacagccaccuugcucaagugaguucuccuugugguucuccuagcuuguuugcuuucuuggaaauccagguguuuuguuccuuauuucucccuuuauugcuuuuguaccucuuaagaacccaagaggcuuaucacuugccuuucaguuuucaucuuuuucuacugucuccugcccccuuuacuccuucaggaacacagguaucuguugccuaguaccuggcuuucucuuaaccugcagucauucuuccccucuaaagaguuagcuuguuucugcugaaaccuuuaagugaaucacagaccuguguguuauuuauagcacuaugguuauauagcuuuacgacuuuggacaagucucuugcccucucugggucucaguuuccucauuuguagaauaucacaguuggacaaguggauuccaaaagcuuucccagcccuaacauucucuaccugauuugcucagcacccggccccugcaagacuugucuccaucuagcucagcccaagcccuggaggagcuguuuccccgcuacaccagccuucggccagggccuccacucaaucccccagauuuucaggggcugagagaugcauuggauucagagcauacccgccgcaagguaagaugcaaacgcuuccuuucgaaagcagcaaagauuagaaagaggggacccaaguguugaaaagggcugagggggccuggcgugguggcucacgccuguaaucacagcacuuugggaggcugaggcaggcggaucacgaggucaggagaucgagaccauccuggcuaacacggugaaacccgucucuacuaaaaauagaaaaaauuagccgggcaugguggugggugccuguagucccagcuacucgggaggcugaggcaggagaauggcgugaaccugggaggcggagcuugcagugagccgagaucaugccgcugcacuccagccugggcgacagagcgagacuccgucucaaaaaaaaaaaacuaaaaaagaaaagggcugaggguuaagagccugaaagcugggacuuaaauguuuuucugaggagggcuuuuuugaccauuccaucuaauauggcaccaccuccuuuccaaguagucagaucgccuucuuauuucuuucauguagcuuaucguucugauauaucuuguuuuuuucuccucucuaaaauuugaggguccguaucuuguuugucuuaguacuggcugccuaaggucuagaauauacauaacacagaaacacucuguguuugucgaauggacacaaacucugcuagcuugugcacaggauuuacagcuacuggugauauacugagcuuuaucucugugagccucugccuuagugucugaaggggacagagaaauagacaaaggagaggaaaagucaaaaucacugguugccauuuuuggaagccucucuuucuccauguuaaaccccuuggcaugaaugaaaggcuuuccccuuuauccuugcuguguuuauucauuguguccaaugagcuucugaagguaggaguaacuuugcacauuuugcugugugggcugcugcaucucugccaaaagguuuaugggauuuuuacucaggagauccaggaaaaggaggagccuggaaucuaagcacuuaucuccugaaaagguacagaaacauguuggagaucuugagccucaaggugcuugcuucagaauuuuccugauucucccucuccagaccuauucuguucuugggacccaagcuucuuggcuccagcccacucccccacuagaggagcuggaaaguuuggugcuguggucauaccaaagaugggcaacacccagacuccucacccuuuuccccagcauugugagcgccauauucagagccugcagacccgaguguuagagcuacagcaacaauuagccguggcuguggcugccgaccgcaagaaagauaccaugauugaacaacuggacaagguaccaggguagcaaaaugugggugggucucuccaugaagagcauuaaggaauaauaaauaaguggguggccaaccaauguuucuugguacaugcugagagcugggcaagggguugguuugcugacuguugggagaagauggcuguugacccugccccuguggguagaaagaggcaaaaaaguuauuuugaaauuucaucuuacuugcccuaccuaagacccuggcccgugugguggagggcuggaaccggcaugaggcugagcggacagagguucucaggggacuucaagaggaacaccaggcagcagagcucaccagaagcaagcagcaggaggugagcgcccuggagcauauggcauuagaaccugagucacagaucucaagauggaaaggggcagaaauagcucuggaauuaggguuuccaacagauugaccucagucuuguaguggcuguccugacauuucuucucaucccuccuuucuucuccuuuaaccguuucugcuguccaacuugaaucaucaaugucuuaauuuuucccacaccauguagucuucuaucuggccccuuagucauuuaguuaacugugaaguuucaaguuuacauugucaaugcuuuauaaaauauagcacacacagauuucccacaguuccucugcccuguauuccucucuuccugaaagacaguaacccgccuggaacaaagccuuucugaggccauggaggcccugaaucgugagcaggaaagugccagacugcagcaacgggaaagagagacacuggugagaagauuggacuggguuaauuccacuggaagcuguuaauuacuucuagagagcugugggcuauugguggauugugggagauuauaauuugaguugcaccagagcacuguuucccaaaguguguuccuuagaacacuaauucagcuagauauucuauuaaaaaaaaaggcucugcuaccaagucgguuugagaaacucugcaaauuguaucaucauuagaauauuagugucaucugaagaauuauuuuaaaauauaggcuaggcacgguggcucaccccuguaaucccagcacuuugggaggccaaggcaggcagaucaugaggucaggaguuugagaccagccuggccagcauggugaaaccccgucucuacuaaaaauacaaaaaacuagcuggacaugguggugcaugccuguagucccagcgacuugggaggcugaggcaggagaauugcuugaacccagcaggcagagguugcagugagcugagaucaagccacugcacuccagccugggugacagagugagacuccaucucaaaaaauaaaaauaaaaaauaaaauaaaauaaagauuucugggacucaccugcagagguuuugauucaguagauauaugguggaacucaaaucuuuucagaaauuuccugggugauuuuuuucaaucugguuugggaccucugguguagggcauggccaaaaaagguaugaaauugacuaacucaaguuucuuuucguguuuuuuuuuuuuuuuuuuugagacagggucgcgcucuguuguccaggcuggagugcaguggcacaaucucagcucacugcagccucugcccccuggauucuagcgauucucccaccuuagccucccaaguagcugggacuacaggcguauaccaccacgccuagcuaauuuuuguauuuuuuugguagagacgggguuucgccauguuggccaggcuggucucaaacuccugaccucaagugaucugcccgccuuggccucccaaagugcugggauuacaggcauaagccaccauacccagccacuucacucaagucucuuagagcugaaaugauaaggugauuagccauaugaauuaguagcugggauuggaacuuguugcaugcauaaugcaugcuugcuacaugcaugcugguacuuguagucuuaacaggcuauaucugacaguccugaugaugaugggugaugguucacgauuauaggcuggauauucuagucuuaguggaauuucuuuugacgaugauggugguaacuauuguguauugaguacuuacuaugugccugaugccgugcuaaaugccuuacauaugcuuuuuacuuuaaugcucagaaggcagacccuguuaugaucuccaguuuacagauaagaauguaugccuaagaacacauaguaaauuccagaaccaggauucgaaccugagauuugaacccaggucuaccuggcucuggaacaggaacucuuaucuacuauauuauaauccuaugagcuugucaacuauuguguuuguuuguuuugagauggagucucgcucuguugcccaggcuaggguucaguggcacaaucuuggcucacugcaaccuccgccucccagguucaagcaauucuccugccucagccuccugaguagcugggaauacaggugugcaccaccaugcccagcuaauuuuuauauuuuuaguagagacaugguuucaccauguuggccaggcuggucccaaacuccugaccucagaugaucugccugccucagccucccaaagugcugggauuacaggcaugagccacugcgccugucaacuauugugggguuucuuuugguuuuauuugagauggagucuugcucgaugucgccuaggcuggagugcaguugugugaucccagcucacugcaaccuccaccucccagguuagagcgauucuccugccuuugccucccaaguagcuggaauuacaggcacccaccaccacgccuggcuaauuuuuguauuuuuaguagagaugggguuucaccauguuggaccaggcuggucucaaacuccugaccucagguaaucugccugccuuggccucccaaaaugcugggauuacaggugugagccaccgcacccggccuaauuauuguguuuuuaaugagcauaauucucagcaggcaccuuguaugagggucagagggcagaucgcuggucucugaagagccuacuaaggagcuugguuuucuucugcggcuguaggaggaggaaaggcaagcucugacucugagguuggaggcagaacagcagcggugcuguguccugcaggaagagcgggaugcagcucgggcugggcaacugagugagcaucgagaguuggagacucuucgggcugcccuagaagaagaacggcagaccugggcccagcaagagcaccagcuuaaggaacacuaccaggcgcugcaggaggagagccaggcucagcuggaaagggagaagguaaaaguggcaguuggaagagcugaggaacuagggaguagaugaagggcaaaauaauugaaugggauggaauguuagaauaugggggauacauauaggcaggaauggagaguagagagccaugugugggagacaagguugagaguauagggccagcaggaagggcuggggguaaugaauacgugaaaggccaaagacugaaauucaacagggauggggaaauaaaacaaaugggaggagcugggggaagcuuggauuuuaggguuugggaggaugaacuggggaguguagguaaccaggagauaagaaaugagguauguauauacauuugauuugucuuucauaggagaagagccagagggaagcccaggccgccugggagacccagcaccaguuggcauuggugcagucugaggugcggcggcuggaaggagagcuggauacagcucggagagagagagaugcccugcagcuggaaaugagcuuggugcaggucagaaggcagagguuucuugagguuuuguucugacagaaguagaucugaggcagagggaccucucaggaguuguggcagacacucccaguucagguguuugggguuuaauuccauuaacaguuucuauguaguauggguaguuuucuguccuaaacucagagcuauuucuuacugagugaccauuucccacaauaugucagacugaccuaguguuacuuuuaggauuaaauagauuuaaaucuauuaaagauaccuuauguuauuuuaagagaugacaccacacuuaguggguugacagagcaggugaaagcuuuugucagagacuugauuccaauuguaacagugugcuuuguaauucucauuacuugaauaacuuguauuaauuucucugaguaggucagggacccaggagggcaaugauuuuuuaauuuacuuaugaaacuuccauaacagcacauggccuggcacagaauuguacucaaaaauuguuugucagauauaauuacacuuugaaaaacucuuuccaucuagcuaacacacugaauuuuaaauucaaacuagucggacucuugccauggaauagagcaggaguuggcgaacuuuuucuguaaagggccagacaguaaauauuuuuagcuuuguggguuguauggucucaguugcaacuacccaacucugcuguuauaccacagaaguagcuauaaacuguacguaaacaaaugggcacagcuguguucuaguacaacuuaucuaaacaggcaauggagggcugaauugggcuguaguucgccgaucuccagaauagaggaaaggauuggagagagcuguguuccagcccaugggggagacacagcguugaagaggaaagaguauugcauuaggacuuagggcacuuacgucuacuucuagcuagaauuuugaccuuuaugggccucuguuuuuauguauaaaauguguaaggacaaauugaugaauuuuccaggugcaagccagucugagaggcuauguuccuuauaaaugguuaacuuaaggagguaccagugaggccagcauuugagaaccacaauccuuuggcccgguaugguggcucaugccuguaaucccagcacugugggaggccaaggcggguggaucacuugagcccaggaguuugagaccagcccggccaacauggugaaacccugucucuacuaaaaauacaaaaauuauccagguguauggugcacaccuguagucccggcuacuaagaaggccgaggcaggagaaucgcuugaacccgggagguggagguugcagugagcccagauugaaccaguguacuccagccugggcaacagagugagacuccaucucaaaaaaaaaaaaaaaaaaagaauugaccuagggcuucagguguuacaaugagaucacaugcgauaaagacuaagaaagcauccgggugugguggcucgcaccuggaaucccagcacuuugggaggccgaaacgggcagauugcuugagcccaggaguucaagaccaaccugggcgcaauauggcaguaccuaaacucugcuaaaaauacaaaaacuuagccggguauaguggcaugcaccuguagucccagcuacucgggaggcugaggugggaggaucaacugaacccuggaaguagaggcugcagugacccgugaucacaccacugcacuccagccugggugacaggagcgagaccgagucucaaaaaaaaaaaagacagaaagggccaggugugguggcucacgccuguaaucccagcacuuugggaggcugaagugggaggauugcuugaguccaagaguuugagaccagucugggcaacauaaugagaccccaucucuacaaaaaauaaaaauauuagcuggguguuguggcaccagcuuguagucccagcuacucuggaggcugaggugggaggaucucuugagucugggaggucaagacugcagugagccaugaucacaccacugcacuuuaggcuaagcaacagaacaagacucugucucagaaguaggggcugagaaauaaccacuauuuggauuuagaaauugaguucuuggggccaugcgcgguggcucacaccuguaaucucuuugggagacugaggcggguggaucacgaggucaggagauugagaccauccuggcuaacacggugaaaccccgucucuacuaaaaauacaaaaaauuagcugggcgugguggcacgcaccuguaguugcagcuacuugggaggcugaugcaggagaauugcuugaacccgggaggcagagguugcagugagccgagaucgcgccacugcacuccagccugggugacagagagggacuccaucucaaaaaaaaaaaaaaaaaaaaaaaagagguugaguucuuuauaguaaaauacuauacguggaaaucagauuuuagugaguugaaggacuguggcugagaaaauggagacacuuauagguugacugcuuaaggaggaagaggcacugccauuuauugaaugucuacuggcuuucagguacucuacucaggguauuuuuuuuuuuuuuuuuuuuuuuuuuuuuuuugagacggagucucgcugugucucccagguuggagugcaguggcgcgaucucggcucacugcaagcuccgccucccagguucaugccauucuccugccucagccucccaaguagcugggacuacaggcgcccgccaacacgcccggcuaauuuuuuguauuuuuaguagaaacgggguuucaccguguuagccaagauggucucgaucuccugaccucgugauccgcccgucucggccucccaaagugcuaggauuacaggcgugagccaccgcgcccagccucaggguauguuauaucagacacguagaauggauuugauugcucugucgaacauuuauuuuagcuaagaaauuuaugucuuucacccauagucauuuucacuuugauguauguuuaaagugcgaauaucuuaauaaggaaagggaaccucuuucacuccuugaggcaaaauucuuguucuucaucucauaugaggggaaaguugguacuggauuuugucuacauuauauccuccauccucuucuaagcccaaacagauuugggccguuaucccaccuuccuucacuccaggcccgguaugaaagccagcggauccagcuggagucggagcuggcugugcagcuggagcagcgggugacagagcggcuggcgcaggcucaggagagcagccuacggcaagcagccucccucagggaacaucacagguacgugggacucacugggugucacuucucucagccacagcacguaucguuagugccaggccuguguucccuucaaucccuuugccaugguccagcacugugacucccagggugcgcuaacucccaucagcugggaccugagucucucucgggagggcugccuucacgcguucauggagagccagaagugccugggaauuuucaucccauagggaguagcccuuaaccaagaacugaugggugcagaaugauagaugguccagcucccucacugggacagugcugagguaugaccugugcugucuccagagcugcucugucggacugagccuccucgcagccuggccucacuucuccucacacccauucugcugccgagauuuucuggaacugcuuccgaaauaaauuuauuuaagucucugcuucugaggaacccauccuaagaccccagcuuuguccuugccgcuuccugugccauggccaggcuagcugacuggcuaucugggucacugucaugugcacacaugaugucuuuuucucaguuggucacuucuucugucuccagucucaggccucuucuccuaccugugcccuguaggaagcagcugcaggaccugaguggacagcaccagcaggagcuggccagucagcuagcucaguucaagguggaaauggcagaacgagaggaacggcaacagcagguggcugaggacuacgagcucagguccugguccccagagugccccuuucaggccccagccccuuucccauggguagagcccaaacugggaacggugaagagcugcucccuugauugaucuguccuccucuacaugggccccagcuccuuucagaauaucagauguccaacauuucccuucuggcucuuuuuagcucccaaguaucugcuuccuuaaaggcccugagucacuucuucucucuuugcuucagacuggcccgggagcaagcgcgagugugcgaacugcagagugggaaccagcagcuggaggagcagcggguggagcugguggaaagacugcaggccaugcugcaggcccacugggaugaggccaaccagcugcucagcaccacucucccgccgcccaacccuccaguacgccuuaccccuugagcuaagcuucuccguuauguucuauuuuuauuuuuauuuuugagacagggucucacucuugcccaggcuggaguguacuggugagaucauagcucauugcagccucgaacuccugggcucaagugauccucccaccucuaacucccaaagugcugggauuccaggcauaagcuaccaugcccagcaagaacuguguucuagauuccuucuuuggaaaucuagcucccucccaagggaaguacuaaguucagcuccuaaggccuacaucaggggagaaaaaucgguggacuuuacaaauaauaacugccucagcaaaauaaauccuuuuuuccauggccauagcucacucagacuggccccauuccauugggcauaacucuagucucccagucccaagaggggacaaaugauacgugguacuaguuuuguggagggacagcugaauuaauuaugagggaaagggccaaaaauuguugccaaguccugccccagaguagaguagggagucucacuuccuagcccuucauacguugauacuucccacuuccuucuuuuaauuaugaaauucuagcaggugugguggugcgccuguaaucucagcuauaugggaggcuaaagcagaaggaucacuugagcucaggaguucaagacuagccuaggcaacauagugagaccucaucucaaaaaaagaaaaagaagaaaaaauuaggauauuuuaauuuuaauuuuauuuauuuauauacuuaucauuuauuuauuugagacaaggucucacucuguugcccagagcgcucaagcaaucuuccuuccucagcuuccugaguagcugggacuacacacacgugccauugcccccagcuaauuuuuaaauuuuuuguagagauggcaucucucuauguugccaagccugguucaaacugccagccucaaacgguccucccaaaguguugggauuacaggugugagccacugcauccggaaauuuauaaucuuauuaaaguguuuguaccaugucuuaucucuuuaaaccuacugugcuuugacccuucuuucugccucucuccuggucaggcuccuccugcuggacccuccagccccgggccucaggagcccgagaaggaggagaggagggucuggacuaugccucccauggccguggcccugaagccuguauugcagcagagccgggaagcaagggacgagcuaccuggagcgccuccuguucuuugcaguuccuccucagaucuuagccuccuguugggccccucuuuucagagccagcauucuuuccagccccuggagcccaaaccagaccucacuucauccacagguaacugggggcagaagucacugggguuccccuucugugcaugaauuggcucccucuuucguacccugcuuucugucugauacuugagcauuuaguuucccagaugccuuuagugaucgcaaguugcaaggagcagaaaucugcucacauugguccaaauaaagggauugagaucucauggaaauaugacaucgcuggacuuaaugagaacuggaguugggaacgggguacuaucaggaacugaggcagcuagcuggcccuuuucugugggccugcauagccuccuggguccaccucuccugcacaucugcucuuuuuucuugcuagaccagcauucaagguucucacccuucauaacuucaguuuacacauggguuugaccagcugugauacugacucuagcugagccucuagacauuuauagagacaucggugucucaguuuuuuuagguccaguuuaaagaggccaucugauuggauuggcugaccuugggugugguguccaccccuaguuuaaugucaccugugauuugaguggaugggggcauucugugugguacaaacaugacaaccuaggucgaauuaaaaaugagggauggggccgggugcaguggcucacgccuguaaugcuagcgcguugggaggcugaggugggaggauggcuuggugccaggaguuccagaccagucugacccauauagugagaccucaucucuacacaaaauaaaaaguuagcaggaugugguggcacacacccaaauuuccagcuacccagggaggcugagacagaaggauugcuugagccaaggaguuuggggcuacagugagcuaagaaguugccauuguacucuagccugggcaacacagcaagacucugucucuuaaaaaaaaaaaaaagagauuacagcucacgccuguaaucccaguacuuugggaggccgaggcgggcagaucacaaggucaggauaucgagaccauccuggcuaacacagugaaaccccgucucuacuaaaaauacaaaaaaguuagccgggcgugguggcaggcaucuguagucccagcuacucgggaggcugaggcaggagaauggugugaacccgggaggcggagcuugcagugagccgagaucgcgccgcugcacuucagccugggcgacagagcgagacuccaucucaaaaaaaaaaaaaaaaagagagauuaguuguagcacaauuaaaaauuuuuuaauuaugugagaauaauaaaagaaugaggcauauucgggggaagaggucagaacauguguguuacucauuuccauucuucagggaguuugugaggguauuuauuuguuuagaguuugaguaccacagcuuucuucugucuauauuucugucuuagaauucagcugugccaucucucagucaccuccaacccuucccucuccagcuacuuuaaaccuccaucuucaucuucucuuagcugugauguuccucuuccauuuaauaggccccuuucuucugaguauuaggugaguugauuuguggagaagccccuuccccccugaacacacuugcacccacccauaccuguuucacuuuauagcuggggccuucucugcacuuggggccuuccaucccgaucauagggcagaaaggccauucccugaggaagauccuggaccugacggggagggccuccuaaagcaagggcugccgccugcucagcuggagggccucaagaauuuuuugcaccagguaagagagauuccacccagacuagcucacuuucuucuucccuuucuccuuuccucuuucugcucugggaauccaggacucuggccucauucccuguuuaugacuaacucuuugucccagcuucuucucucagaucccugggcguuuuucucuaucagucccuagggaacuugacaaucuuauucacccacaguugcuggagacagugccccagaacaaugagaacccuucugucgaccuguugcccccuaagucuggugaguuccaacucugaagaagguuggggcuggggccuaggaaagaucggaguugguuaucuaggaugaauuuuuaggagcuggcaaaaguaauaaagccuuauaaaugcuggguggugggacuuccuugguucuaugccccauuuccugauucuuggcauucuuuccuuuugcuagguccucugacugucccaucuugggaggaagccccucaagugccacguauuccaccgccuguccacaaaaccaaaguucccuuagccauggcauccagucuuuuccgggucccugagccucccuccucccauucacaaggcaguggucccagcagugguuccccagagagaggugagcauguucugguuuauuagggaaaaaaggagggacaguccugaguguggauccaguacaggcacuuacaguccuucugaauuccuggggaaaugggcugagggcuggggagacaggcccuaggaugacgccugugauuauugcgaugucugucagguggagaugggcuuacauucccaaggcagcugauggaggugucucaacuguugcgacucuaccaggcucggggcuggggggcucugccugcugaggaucuccugcucuaccugaagaggcuggaacacagcggguacaagccugggaggaaggaggaaggauucuccggguggaagcuggauuauggggaguggaguggguguguuuuacacugaauugaaucguuguccuuuucuggggaggaaagugaaggaugagagguggauccacagaucuucucuaacugccccacacuuuucuuuuaucuccuccuuucuauugcuuuuuucuucuaaacaaaaaaaucuuuuccccgggucucucuaccuucguuuuuuuccucuuuaccccucagcucaaaacucagaauccuagacuuuugacuagcuaguguaacucguuauuuacuuccacuaaugucuccucccaguugaugcccaggucuaucgaguuugaucuuauucuuaagagauagaauuggggaguaguucuuccauccaguauuggguaaccggggggacggagauccccauccucauaccuuugauuuguguagcaggacugauggccgaggggauaauguccccagaaggaacacagacucccgcuugggugagaucccccggaaagaggugagggaaagucaggcagggaccaggggagaaaagggcucucacugaccagcuccuucaccucugcacacuccuggcuggccccuccauuccaccccugcauucuguagcauggccuuuccucccugcagacucaucuggcccucuccacgugcauuuccucagugggguggggaauugagaggaucugacgcugauuucuuccucucucuucccucaacucucagauucccucccaggcugucccucgccgccuugcuacagcccccaagacugaaaaaccucccgcacggaagaaaagugggcacccugccccgaguagcaugaggagccgggggggagucuggagaugagccccccuacccucucuccucuuuguucucucauuguuguuauuuuaauaaaugcucauuagucuguaucagagucucuggcucauaggaauuuggaaaauagagguuuuguagggaaucacuucguaaagaaaccacauuugguugaguacuuuuuuuauauguuacauguuuauaugucauuuccugugggaaaagacaugaaugcuuuggaagacggucuaugacaagauuuggaaaguuggggcggcuaagauucaguggacaaagcuaaaaccugcagagcaaugaacucugggugguaguggaauuaugggugauucuuaguuuuuuaauacguuucuguauuuuccaaauuuucuaaaacaaguauauguuacuuuaauaaucagaacagacccaaacuuua

SEQ ID NO: 192258 - RNA, 23668 nt, Homo sapiens
gccauuuggauuuuuuuauucucuuuuuaaauacuguacagugaaaaauaaauacgccuucucauccaccagacaagguugguccccuccccagggggaccuugucaccccccuucauacacaccccugguucuacuccaaaaccuuccccgugccucccacccacuuaucucuuacuauccccgucuuccacagugaugaggccccagaaaugggggguacaggaugggaggagggauagcaggggaggcccccugaacggucaaaucugggugggucgaggagcaccccccaccaacagguggagaauggggguguucagagagagauuggggcauuagaggauaaaggcacauccagucugauggggaaggagagaggcuccccuuacccuggggguaggguggacaagagggaggggguaugacccuguuacacaccccuccacuagcuccuggagguugggggguacccaagcugcugugccaccccccuccccccuagauaagagcagcuccagcgcaggucaguugggccugugagggccaugguguugggcagcaagcgagauggagaagggaggggugcagguuggagguuuuaugaaaccccauucaccauacuacccaacuccaagggggcggagagcuccccauucuccgaggggcccuuaggaagcuugcugacagagucacccugaggggaaagugggaaagaaaacagaaaagcaagaagcggugaguagaaauucaggugggagacauucccuaccauccaagcccuccuggcauuuggugauccagagguugguucccugaucucaugauccagucucucuuacuugggauccagaaaaugugaaccacacuuucuucucuauccuauucaaaguuuacacuggucuaaacuccaucagacacagcugccucugcaauucaguaggagauuugugaaauuuuuugugcccccugccccagaguaacaacaaaaaagggaugggguaaagcacaucuugccugccuaccuucuguccugaaagagagucuucugaggguuuagugcguuccagggguggccucuggcggcucugagacucugcucgugagauauagucagccacagucacuggggaaggcaggagauuaagacuuucagauggaauucugguagccagccuaagacacccacugaacccgaaccccugauuuucacaggggugagcaucccauucucucagcucugaggaaggauucugguguccagaguuggcugaccuggcuggcggucuccacugauagagccaucaguccgauuaccacgguuacggcggcggcggcugcgauuacgacguugaggucuugauucaucuucuguaggguaggaaaaaaccagagucacacauccaaccucccacccucgauuccuacccaucucuaacuuuccagaccccaggcacacccucacccaggccauucucugucauguugggcccaucugauuccaggccuccauccaugacgguccugucuucaucagugcggcggcggcgggagcggcggcgccuggcacuugcugggggggguuccccagguucugaaucaaccgggggcucugguucagacguguccaauaggcuguagggauuacugucuggauccuucagcacuggucagaggaagaagaggaggaguuggcagucaggugcccaucaucuuuccuuuuggcccauauucaugaacccagcugucugguaccugagcuaauagaugaagaauuguaucucgaagugggccggggggcagguggggguccccuaccccggcccccagucggccgccuccggcuuucuuccccucggguugggggaucccugucgccaggcccagcucgguugggcuccucucucuucucugacucagucucugaagcuguagacacaucugagcuggggccugaagaacacaaugggauuuauucacggccauucaucccaccucaggauccaucacaucccccaaacuggaagaauucuccuucucacucacaagccucccagccaaucaaucacuuuuucaucaucuccauuccagauuuccccaaacuuccauccagaccucugccucuacccacaagcccugccacuccuugccuccuguucccauaacugucucaccauaggcaggaccgccuguccuccggccacggccacggcccccauagcugcccccauagguucgagucgcauggagggaggaggaggagcucucaucagugcuauauccagccuugucgcugccaccgcugccccgcccacucccaggagggcgaaagcccagcccaaucugccgaagcugcucaucaauuuguagccucuccaagcgaagcugcucuaccuccugguuggguaaaagauggaagaaggggaaggagaaauaagaucagugccuugcuucaugcuucugcacccugacugucccucuauaucuaaccucucaggaaugcagggagaaggaagacacuggcuaaacaaggaaaauucugggacccaacccuauagccccaaauuuccacagauguuuucuguucuacacggagagacaaacagagaaccaaaaucccugagcugacccccacagcagucuuaguucccuuuucacacccagcauuuuucucucccggccuggguaccugcagguaggagaggugauacuccagcaaagccugggcauugcugauguucucucgggugccaacaaaaaugaagggaaccauucccuagagaacagagagcagaaacgauggaucagaaaggaaaaugaaauggaaggauuaacgccgcccagucuccuaggggagccugcccagugggaucauucugggcucuaaaucuacuaguguuaaacaacuuuccguacuccacccucucaaagaacaaucccagcccucagaggacaaucccauuuacuucuggaaaccaaucucuaugcccacuugccccguacccauaccuccucccugggguucuucuugucauuaucaccuuccacucgaacccucaccacaccagauuuauccacaaucuccuggaucacuuucccguucuuuccaaucacuuugccuggaauagguaaaugaggaauucagccuuuuauuuuuuuuaaggaaauaagaauaaagcugauacaccgucuuccagccucauuuucuuuauauggauuccauuuacuucauucuccugcuucuagguuucugauguguuuuuacaggacaaaauguuacaaucccuagaaauuuauucuuucauuuuuaucacucccauuacagacuguuucucuguccuugugaaacugggaguccacagggaggugccaauccuggauaaaagcucagaaucacuguagagaaucuugauucugaccucuaacuguauauacacaccaccaacucaccaaccagguuccugggcacuugcacugaguccucagaaaacucaagguagcuucgggccugucggcaagccucgggagucuaaaggaagaacagcagggaguuguuacuaaaacagaagaccagcuggaugugguggcucacgccuguaaucccagcacuuugggaggcuggaggcagguggauaaauugagcucaagaguucaagacuagccugggcaauauggugaaacgccaucucuacuaaaaauacaaaaaucaaaauacaaaaauacuaaaauacuaaaaauacaaaauugguggcucacgucucuaaucccagcuacuccggaggcugaggcaggagauuucuugaacccaggaggcagagguugcaauaagcugagauugugccacugcacucuagcccgggcaacagagugaguuagacuccaucucauaaaaaaaaaaaauuaaacaaauaaauaacuuaaaaaaaaaaacagaggaccuuggccaggcacagcggcucacacccauaaucucaacaguuucggaggcuaagaagggaggauugcuugaggcuaggaguuaacaaccagcuugggcaacagagaucuggucuauuuuuuugauuuuuuggucucacucuauugacuauguugcccagguugguucaguggcaccaucaugguguacugcagccuugacuuuccaggcucaagugauccuccugccuccgccucccaaguagccaaguagcuggggccacagaugcaugccaccacgcucaguuaacguuuuuugguuuuugguuuuuuugggggguaaagacagggucucucuauguuguccagguuguucuccaacucccaggcucaagugauccuccccucuaucuucccauuucagccucccaaguaccugcgacuacagguacgcaccacuacuuccagcuaauuuuuaaauuuuuguagagauugggucucacuauguugcacaggcuggucucaaacuccuaggcucaagugauccucucacuuugaccuccgaaggugcugggauuacaggugugagccacugugcccaguuugaggcuuauuuucuacuucggccucucuucccucuauccccuaagagacccagaagaaagacauccuuugcugaccuccccauagaugcggaaagugcaggucucuucacccaacucaauggcggucaccccagguacuuuucgggccugcuggauguuggcaccgugagucccaauugccagucccaucagguccucucgcacugugaacuccucuuggaaggcugcugccaacugcuugcuugucugaaaggaaaagucacuguaggaaucauggugguagaaucucacagucccaggcacacgacccuuugcauaacuuaaauaaggaaaacugugugauauuaauagaaagcuagaaccacucuggaguccgcggaccacgaggaccuguguggaaaggucaggaacuuuuuguuuuuucuuugagauggcgucucgcucugucgcccaggcuggagugcaguggcgcgaucucagcucacugcaaccuccgccucucgacuucaagugauucucaugccucggccuccugaguagcuacgacuacagguguccaccaccaugccuggcuaauuucuguauuuuuaguagagacaagguuucaccauguuggccaggcuggucucaaacuccugaccucaggugauccgcccgccucagccucccaaagugcugggauuaccggcauaagccaccacgcccggccaaggucaggaacuuuuaauuccacuccuuccaaauaccagugguuugugggggaggaaagguaaagagggcagaguuuggacugggacacaccgaaguucuggauuuggcccuaacaguaucugucccuaagaguaucuaucugugugaucuuaaacaaaacauacucugccucuugugucaucugcuaagugauuauauccaacuuaucuuauucucaagacuagcaagaggauuagacaaggcuggugugaaaguacuucucacaagguacaugcaaguguaaggaacucuuaccuuaaucaaacaaauaucaacucauccccaaauaaaacucaacaacuuaaguaaaaagugagggguaggcugugcgcgguggcucacgccuguaauuccagcacugugggaggcugaggcagguggaucacaaggucaggagaucaagaccauccugccaacauagugaaaccccaucucuauuaaaaauacaaaaauuagcuggccuugguggggugugccuauaaucccagcugcuugggaggcugaggcaggagaauugcuugaaccagggaguuggagguuacagugagccgaggucaugccacugcacuccagccuggugacagagcaaaacucugucucaaaaaaaagugagggguuaagaaaaacagaaaacaugccucuagaacaccaggcuuucacuucauuucucaaucaguccuuagaggaaccccuggguucaggggcaggaagacaggaaagguuuuagaggagugaaucccauguuguaagcaccaaauagaaacaauaccugaaaggagacauuccuagauugaaauacacuacuucccacuuccaaguuggauaggacugaauuauaccaaggauuuauaccaggcaagaagagaaaguuggaaaaauaaacuaaguugaguguucaaaaucacuacauuaggaggggaggggaagagaucuacaaugaccuauaagcgucuucuagauaagcuugcagaacagcuggguuuucuuuuuuuuuuuucuuuuuuuugagauggggucugucacccaggcuagagugcaguggcaugaucucugcucacugcaacuucugccucccuuuuuuuguauuuuuaguagagaagggguuucaccaugcuggccagacuggucucaaacuccuaaccucaggcaauccaccugccucggcuucccaaagugcugggauugcaggcgugagccgcugcacccggccccuuuccgguuuuuagaggcuucacuacuaggcaugacugauuaaaucacugauccucagugauugccuuaaccuuuggccccauuccccucccaggaaguuggugggggugaggcugaaaguuccaacccucuaaucaugaagccaccuagaggggcuagccaugaaucaacucaucagcacacaaaaacacacaucacuggagauuccaaggauuuuagaaguugaaugccaggagccuggucaggagaccaaauauguaucucucaguaucacagagccugucaguccuacugguuuuacucguaaaauuuauccuacauaaaacuacucucucucucuuccuuuagcacuccaguucaaguuucucaccuggacuacugugcucuguuccugcuuccauucuugccccccuuuccaucugucauugaaacaggaguuuaaaacagaaggcacuuucggccgggcacaguggcucucgccuguaaucccagcacuuugggaggccgagguggguggaucacgaggucaggagaucaagaccauccuggcuaacacggugaaaccccaucucuacuaaaaaaaaauacaaaaaaaucagccgggcgugguggcaggcgccuguagucccagcuucucgugaggcugaggcaggagaauggcgugaacuugggagguggagcuugcagugagccgagaucacgccaaugcacuccagccugggugacagagcgagacuccgucucaaaaacaaaacaaaacaaaacaaaacaaaaaaccagaaggcacuguuaacucaauggcuucucaguauacgcacaauaaaauccccccuccucagccuaccguacaugucuuacaugaucuacucucugaccgaauuuuguaucggucucccuuugcucacucugcgcuaacuacacaagcugcagugagcugagaucgcacuacugcacuccagccuggacgacagaaugagacuccgucucaaaaaauuaaaaaacaacaacaaaaauuaggccgggugcaaugggucaugucuauaaucccagcacuuugggaggccaaggcaaguggaucccuugaggccagggguucgcgaccagccuagccaacauggugaaacuccgucucuacuaaaaauacugaaauuagggccagguauaguggcucaugccuguaaucccaguacuuugggaggccaaggcagguggaucaccugcggucgggaguucaaaaccagccugggcaacauggugaaacacuaaaaaagcaaaaauuauccagacgugggggcgcgugccuauuaucccagcuaccugggaggccgaggcacaagaaucgcuugaacccaggagcgagagguugcagggagcggagauugugccauugcacuccagccugggugacagagggaaacugucuccaaaaaaaaaaaaaaaauagccagguaugguggcaugcaccuguaaucccacccacccaaaggcugaggugagaggaucacuugagcucgggggguagagacugcagugagcugagaucgcaccacuacauacacuccagccuggauaacagacugagacuccaucucaaaacaaaaaacaaaaacaaaaaauaaaguuuguaucaucugaagguaauggugaauuuuuaccugccagugcccugagcaggaucccugaagaagucaaagauuaucaugacccagaaauugcacaggcacagaaaaaagccucccaaaaagaucaauucccuugauaaauggaaaugguauucaaacacacacacccuauucacuuagaauaguauaauaccaacgaaagggaaucugacaauuauacgaugucagaauucaaaaagaucucacagaaauacucuagucaggccaggcgugguggcugacaccuguaaucccaacauuuugggaggucgaggugggcggaucaccugagguccauaguuugagaucagccuggccaacauggugaaaccccaucucuacuaaaaaagacaaaaauuagccaggugugauggcacacaccuguaaucccagcuacuugggaggcugaggcaggagaaucgcuucaaucugggagguggagguugcaguaagccaagauagcgccacugcgcucuagccugggcgacagagacgcuaucucaaaaaacaaacaaaaaaacaagaaauauccuuuuuuucuuugagauggaguuucacucuuguugcccaggcuggaguacaauggugugaucucggcucacugcaaccuccgccucccagguucaagcgauucuccugccucagccucccgaguagcugggacaacaggcgccugccaccacgccuggcuaauuuuuguaguuuuaguagagacgggguuucacccauguuggccaggcuggucuugaacucccgaccucaggugaucugcccgccucagccucccaaagugcugggauuacagacgugggccaccgcgcccagucauauccuuuuuuucuuugagacagaguuucacucuugucacccaggcugaagugcaauggcgcaaucuuggcucacugcaaccuccacuucccagguucaagcgauucuccugccucagucucucgaguagcugaaauuacaggcaugugccaccacgcccagcugauuuuugucuucuuaguaaagaugggguuucaccagucucgacucccaaccucggauugaucugccugccucggccucccaaagugcuaaagugcugcgauuaaaggcgugagccaccgcgcccacccuaaaaaauaaauauucuagucuaggcugcaugugguggcucacaccuguaauccuagcacuuugcaaaguacaggcagauggaucucuugagccuagaaguucaagaccaaggccgggcgcagcggcucaugucuguaaucccagcacuuugggaggccgaggcagguggaucaugaggucaggaguuugagaccagccuggucaacauggugaaaccccaucaauacuaaaaauacaaaaaugagcugggugugguggcacaagccuguagucccagcuacucaggaggcugaggcgggagaaucgcuugaacccagaagguggauguugcagucagcugagacuauaccauuacacuacagccugggugacaaagugagacuccgucucaaaaaaaaccauucagccaggugugguggcucacgccuguaaucccagcacuuugggaggcugaggcggguggaucacaugaggccaggaguucgaggccagcuugggcaacauggcaaaaccccaucuuacuaauaauacaaaacuuagccgggugugguggcgcacgccuguaaucccagcuacucagaaggcugaggcaugagaaucgcuuaaacacaggaggcagggguugcagugagccgagaucgugucauugcacuccagccuaggcgacacagcgagacucugucucccaaaaaaaaaaaaaaaaaauuggcuaaaagaaauuugaaaauaauugcacuauaccaugauagagcucugccaucuggaggagucugagauaaaauagcugacccagguuuaauugcccagaaaaagccuuagucuuuguucuguaaacacaagaucauggauggaggacaggguaggaagggaggaagacaauacccuucagcagaaggaaaaggagcuaaaaguuaccucuaggugcuugguagcuucuucauugcgggacauaaguagcaguuuggugcgcaggcuucggaaaugcauaucacccagcagagaugcucgcuucacaggggcuucugugguugacugggaggaaaccagugggaaagucauuaaaacuggcuuggaauaaacacuaagggagagccagggacuagaaaucaggaugccuaagucccgggaaaaggguuaagaaaugaagcuaggagaccgggcgcgguggcucaugccugcaaucccaggacuuugggaggccaaggcaggcggaucacgaggucaugagaucgagaccauccuggccaacguggugaaacccugucuuuacuaaaaauacaaaaauuagcugggcgugguggcacaugccuauaaucccagcuacuccagaggcugaggcaggagaaucgcuugaacccgggagucggagguugcagugagccgagacugcgccacugcacucuagccuggugacagaacaauacucuguuuucaaaaaaaaaagaaaugaagcuaggaaggaggagacucauugucagucccacaaaggcugacuaucaggguacugaaggaaaaugguuuagagagaaagcaaggagcaagcauaaggugagagcuacauacucuauuucugaaaguccaaauaucaagagagggucucuaacccagauggcaacaugauuaucagguuuaaaaaaaaagggucagaggccgggcgugguggcucacgccugugaucccagcacuuugggaggccaaggcgggcggaucacgacgucaggaguucaagaccagccugaccaauauggugaaacccuguuucuacuaaaaauacaaaaauuagccgggcaugucgggcgcgguggcucacgucuguaaucccagcacuuugggaggccgaggcggguggaucaggagaucagcaguucaggaccagccuggccaacauggugaaacccugucucuacuaaaaacacaaaaaaaaauuagccaggcgcaauggcaggcgccuguaaucccagcuacucgggaggcugaggcaggagaaucgcuucaaucugggagguggagguugcagugagccgagaucgcgccacugcacuccagccugggcgacagagugagauuccaucucaaaaaaaaaaaaauuagccggcguggugacgcacaccuguaaucccagcuacucaggaggcugaggcaggagaauugcuugaacccgggagguggagguugcagugagccgagaucgugccauuguucuccagccugggugacaagagugagacuucgucucaaaaaaaagaaaaaaaaaagguagggcuaccugggccuguaggagucaggagcaauaaaguccucuugacaaauaaauauaagcacauuuaagcccuucucuuucugcaaaaggguuaaaaagggaaaaagaaaaaauguucaaaaggcuuaugugaaauucaggcagaauaaacucaccagaaugaagagcucacuguuugugauguugagaaagaugcaguuggcucccagggcuuucuugaacucuuuauggacguuuucauuggagcagcugcagaggaaaaaaguacucagcgggcagaaugcagagaguacagugaagaguucgggggaggcuggacauggugguuugcaccuguaauccuagcacuuugggaggcuagggcaggaugaucacuugaagucaggaguucaagacuagcaugggcaacauagugagacccugucucuauuaaaaaaaaaaaaaaaaauucagagaagcagggcugaguaaauaagaaaagaaaagggacugggccgggugcgguggcucacgccuguaaucccagcacuuugggaggcugaggcaggcggaucacuugaggucaggaguuugagaccagccugaccaacauggagaaacccugucucuacuaaaaauacaaaauuagccgggugugguggugcaugccuguaaucccagcuacucgggaggcugaggcaggagaaucgccugaaccuaggagguggagguugcggugagccgagauugugccacugcacuccagccugggcaacaagagcaaaacucugucuccaaaaaaaaaaaaaaaagaaagaaaggaaaagaaaagaagagggaccacaguuaaagaacaaggaugggaaaauaaagaaacuaagugucuucuuagcaagaagggcucuaguagagggccaggggaacaacagagaaaacugcaaagugggagugaugccugggagaaauaaagccagagauuagggcuguaaagagggcccucauucccaccauccuuaacacucacgcuucucucagauccucgggcacagccaugguaaccuugaagaagcugccuuugguugcaaggggauugggauuaacuggccgaagucgcuccaggguaacaauuucauuguagguggcaucacaggcagcauauucaaugacauagaacuggcacaugguaaaaaaggagaaguuguggaugaccugagcaacuuucuaugaauaacauauuuguuucaguaguucuccaaaggcauucccagucacucacaucucccuucaucauccgcacccgggccagccaccagccacaagguuccuguucauuggcucgagaauaaaccuaaagaaaaguagagaaucaaagagauauugaagaccacccaaaagcaucaagaaagggaugaggaggccgggcaugguggggcucacaccuguaaucucagcgcuuugggaggcugaggcaaaaggacugcuuaugcccaggaguucaagaccagcuugggcaacauaaacaauagaacaaccauuaagauauuuggggcugcugggcacaguggcucaagcuuauaaucccagcacuuuggaaggccaaggugggaggaucucuugagcucaggaguucaagaacgaucugggcaacacagugagaccccacuuccacgaaaaaaaaagaggccaagcgcgguggcuuaugcccauaaucccaggacuuuggcugaggugggcugaucaccugaagucaggaguucaagaccagccuggccaacaugguaaaaccccaccucuacuaaaaauacaaaaauuagccggguguggugccacaugccuguacuccaagcuacacaggaggcugaggcaggagaaucacuugaaccaggagguggagguugcagugagcugagaccgcgccacugcacuccagcuugggcaacagagugagacuucaucucaaaaagaaaaaaaagguauuugggaugcaucuuuuuuuuuuuuuuuuugagacagaguuucgcucuuggugcucaggcuggagugcaauggcacaaucucagcucacugcaaccuccacuuccuggguucaagcgauucuccugccucagccucccaaguagcugggauuauaggcgcccgccaccacgcccagcuaauuuuuuguauuuuuaguagagaugggguuucaucauguuggccaggcuggucuugaacuccugaccucaggugaucugccccacucgaccucucaaagugcugggauuucaggugugagccacugcauccagccugggauguaucuuaaaccaaggauacaagaaaccagaggaaggaacuaauuaaaaucagaggacggcagggcaugguggcucaugccuguaaucccagcacuuugggaagcugaggcggguggaucaccugaagucagaaauucaagacuagccuggccaacauggugaaaccaugucuuuacaaaaaugcaaaaauuacccgagcaugauggcaggugcuuguaaucccagcuacuugggaggcugagguggaagaauugcuugaacccaagaggcggagguugcaguuagcugagaucgcgccacugcacuccagccugggcaacagagcaagacuccaucucaaaacaacaacaacaacaacaacaaaaaaaucagagggcacuggauuuuagauguuguuaccauaaauggaaggcaaaucgccugaaacuggggauguuccugagaguuuggcugaucacaacagugauaaaaggggaacuguugcauuuuacauuuccauaggcuacauggcuggauauggcuuaguuggggaggaaggaacaugaaccaaccagagaaaagccuagaauccuggggaaaagugacauuuagaaagguguacuccacagcccuuaccuccacuucauccccuucugugaucuccuuauuauagucagcuggaggugguagccggacauccccaaaaggaauuugucucucacucugccagcuauaauagaaacaauaauaugaaaaagcuacucugacugauaugguugcccauuucuuuacaaaaggguuauugccucagcugggcgaguuccaccuaucuggauaauuagaggcuaaaccccaggcccugcuccauaguagugucuuccaucucuuucuagacucuaaauacugggucaaaugcccccacccucaccaaauucucagcccuuuccucuccugggauccauaugaguucccacccaaacccucagcucucccaaccuauuacaugccucauaggacucagcugcccccucuucuccacucuccuucuaggaccuaguaugcuggauucucuauucccaaggucuuacuuguuuucaaagaagauggugacagagucuucauggacauccuucacaaagcccuagaauggauuuuagaaaaaagcaaaaaaaauaaaaugaccuuuuacuuccaccuuagccaucaagggaauaagacaccacaaaaccuuaaacuugaguuuuagauagggacacaagugguguaaugagacagccugaaaggcugcacuggggaaagaauaugggcagucaaacagagaaaggaaaugauauugucauggagagguguauguaccaccugcaucagaacagccuggaaaccaaugaucuacucaggcucccacaggggccucccuaucugucugccuccuguugugcuaagcagccugccagaguucaauuaaaauaccaacaacauucagcaaggcuaagaauaucccaugagacagugugaggcuguccuggaacaccuagaggacaugaggaucugucgagagagaagggccuaccuccgcaauacagcaagagaucugagcagacucgcugcccugaugcauggguccuaagacaauaaucggaacacuagacaaguucaaaauugugaugaacacaauuuacagaaggaaaaauuaagacuuaauuuaaaaacaucgguuuuuuaauacuagaauugaaucuagaaugacacugauaauuuauaaaggauaauaaaauuuauggaagacuccaaucuugauauuuugacaagagcaagagggaugacugaacagcugauccaccuccuguggucuguguccucacuaaggaggccaaagccaugcauucaccccuaugcucccaauuuuucuaccuucucccuauuuuucacauacaauuagggauuucuaauuuugaaaaaggucuagcuuaugaauuuauuauuuuaucaacugugcuuuugguuucauaucuaagaaaucuuugcccaggccaggcacaguggcucacgccuauaaucccagcacuuugggaggacgaggcaggcagaucaccugaggucaggaguucgagaccagccugccaacauggugaaaccccgucucuacuaaaaauacaaaaauuagccaggugugguggugcaugucuguaaucccagcuauuugggaggcugaggaaagagaaucacuugaaccugagagucagagguugcagugagccaagaucaugccauugcacuccagccugggcaacaagagcaaaacuccaucucaaaaaaaaaaaaaagaaaaagaaaaagaaaucuuugccuaauccaaggccacaaagguuuucucuuaugucuucuucuuaaacuuuuaguuuuuuguuuuacauuuacaucuauaauccuuuauuuuuagacagagucucacucugucacccaggcuggaguguaauggcgcaaucuuggcccacugcaaccuccaccccccggguucaagcaauucuccugccucagccucacgaguagcugagauuacaggcaaccgccaccacaccaggcuaauuuuuuauauuuuuaguagagacgggguuucaccaucuuggccagguuggucucgaacuccugaccucaggugauccaucugccucagccucccaaagcuggaauuaaagaugugagccacugugcccagccuaugauccauuuugaauuaaauuuuauauauaaggugagguauugaucaauguuuuuuaaauuuuuaaauucuuauuuauuuuuuugagacagaguuucgcucuuguugcccacgcuggagugcaauggugcaaccuuggcucaccgcaaccuccgccucccagguucaagcaauucugccucagccucccaaguagcugggauuacaggcaugggccacgacccuggcuaauucuguauuuuuaagagagacaggguuucuccauguucgucagacuggucucaaacucccgaccucuggugauccacccgccucagccucccaaagugcugggauuacagguaugaaccaucgcaccaggccacuuuuuuuuauuuuuaauauauuuuuaaauuaaaauuuuuuuuuaauagagacaggguuucgcuauguugcccaggcuggucuugaacuccuggacucaagcaaugcacccgccuuagccuccaagaauguuggaauuacaggugugaccacugugcccagcccauuuuuuaccuaaagauaucuuguuccagcacugucuguugaagacuauccuuucuggccaggggcgguagcacacgccuguaaucccaacacugggaggccgaggcuggcagaucagcugaggccaugaguucgagacuagucuggccaauauggcaaaaucccauugcuacuaaaaaaaaaaaaaaauaauaauaauaauaauauauaaauuagccaggcgugguggcacauggcuguaaccucaguuauucaggguggcugaggcaugaaaaucacuugaagccaggaguuagagacugcagucagucaagaucaugccaucgcacugcagccuggacaacagggcaaacucugccucaaaaaaaaaaaaagaagaaaagaagaaaagaaaagacaagacuauccuuucuuagcugaauugaacugccuuuucauuucuaucgaaaaucaggaagggcaauuuaauguauaaugacagaagauugguaguugauggaggacuuuugggagugacagaaauguucauuccuuugauugcagugauggacucaguuacauacaugucaaaacuuaacaaauggcacacuuuaaauaugucuacuuuguuguaugucaauuucagcucaauaaagauguuuuuuaaaaaaauuagagagcccauacaacacagggaaaccucaucucugcaaaaaauuuauaaauuagcaggguaugauggcuugugccuguagucccagcuauuuaggaggcuaaggugggaggaucacuugagccagggaggucgaggcugugaugagcugugauugcaccacugcacuccauagcuugggcaacacagcaagaccgugacucaaaaaacaaaauaaauaaacaaaaauaaaagaauuagagguuucaaaaggcuaauacacaagaacuauucaugagcuuugcugcuagggacaaaggcuaagcuuaggagagaaaacaccaaaaaugcccuuggcaaaugcacagcucccaccucauagaacuaaucaaucacaaacacuuaccagauugcuauuuccuuacgaugggaaaaucuaagccugcauuucacucuucauacaagccaccuuucucgucuuuagggauaugucuugcuauagaggcugcagucagucaagaucauucuugacugaauguucuuucuuagagccuuacuacugcccaaggcuuuaauuacuacugguacuuccuggccucuuuuuuacccaugcuuuuucuuucucugacauucucuucuccagaaauguuuuuucuacucuucauucagauuuuuuuccuuuuucaaaaagaaccugaguuaugagcauguucauucagguuuaaugccaacuccuacuguucuccauucaagucuucugaggcacuuuuacuucuacuugccugggucucucuucccuuuuggguucuucccuuagcuccugcucaaguguccuccccacucccacaaccacuaauauuuuauccauucccucuucuuuucccuguaaucccaacacuuggaggccgaggucgguagaucagcugaggccaggaguucgagaccagucuggccaauauggcaaaaccccauugcuacuauauauauauguauacauauacauauauauacacauacauauauauguauauauacauguauauguauauauauacauguauauguauacauauauauacauguauauguauacauauauauauacauguauauguauacauauauauauacauguauauguauacauguauguauauauauacacacacacacacacacauauauauaaauuagccaggcgugguggcacauggcuguaaccucagcuauucaggguggcugagauaugagaaucacuugaagccaggaggcagaggcugcagggucgucuggauuucuagaauuauuccaaccagccucuuccgcugacuuuauccaguucuuuacccaaaaugucuacuccaagccuuagaaguaguuuaucaaggcaggaguuacacugacagaaagaaguggaaaagagacagagaugagaaucacuaauuuacugcuuuuguggagagauuucuacuccuagauauauucaaaucggcuaugccuaugguguaauccaauucuccuccaccauguuaggcuuggccccagggugagcagcaauauuacccuaguuuucccagcuaccaugacuuccaaggcagaaaugcaaagcucagaauggaguaaucucucacauuacucagcaguucaaccaaaucucacucaacccuuauauuuccagggucuuuuuccuucaauuagucuccaaaacuagcucuguccccaacuucauauuccaauccugucucugcuccuaaauuccacccauucaucccauacuaguuuuuuucuccaaggguaucugugguggaagugagccccaaguucugcucagucuacgcucauugugaaaauaagcaggugaaggcaagagcagguggguggaauguauuagggagccaccuagauccagaggauaacuugauucaguggccauagcaucaccuggcuuuggcuucuggagccuggcaccaagccagcagaggaagagagagccccagguuccuagguacuuugguuuccucaaauuagaagauauaaaauugguccccaccuucaccgucuucuaguucuagacucccaaagcaaaggaggggguucuaggagaagagcaggaacagucugaguaaaaaccaaguacugaagcugaggaugccauguugauuaagaaaggaauggggauuaggauauccagaugagguuuggaguaggaagauugcgcccuggacggugaauacuucauuugggagaguacaacuuaaagaauaaaauacauuaggccauuuuguacgucuuaagccauuuuguacgucuuaagcaugaugacugcgguuucaagcucacggugagguaugccucccucaacccuuguuacggaugccagucugacaugaaaaaaaaaaggacggaaaaaaagaguaaauucugacaaacuuaauuuucagauagcuacaaaauaacuuagaucccagaucuaauauuuuauccuuuaagaaaacugacgggagggcgugguggcucacgccuguaaucccagcaccuugggaggccaaggcgggcgaaucucuugaagucaggagucagaaaccagccuggccaacauagcgaaaccccgucucuacugaaaauacaaaaauuagccaggcaugguguugcacaccuguaaucccagcuacucgggaggcugaggcacaagaaucacuugaaccugggaggcggaggcugcagugagacgacaucacgccacuguacuccagccuggaugacagagggagacccugucucaaauaaaaaaaaaaggaaaagaaagaaaagaaaacugacaacagggcccaauucugagagaggagaaagggaccuucccaaauguacaauuccagaagcaguguaaauacucccugacccaucccaaguuugcugagucaugaauauuaaaucagcagcaaggucaaaacggauaaguaucuguaggguacugagaguggaagauuagccugaauuuagggauuugugguuuuuaacucaggaacagggcagaaaaugcuaaccugcccagauccacauuaccacauuaccuggcuuucagcucaaccccaaacucuacucucugaaucacaguauccugguccccaucuauucaagucuaucacugccacagcacacaggagaaagggaaaagauucagagagacuuucugcuggacacuuauaugugggacagaaaacgugucccuucccagccaucucauacaguucauuugaacuggauaccaaucuuucucagcugugcagggcuccuacgcuuccuagaacaaagcaaacaucauaucuugaucuuggacucaacuuaagaaucacuuuucuuggaacucagaauuugggggugguaaggacccagaugaaggaaaagauaccaagguaaacagggagggccacuuuaggaagcuauuucaacaaagguaaugcaaguuuggggaaaaggauaugagagacaaaugugcucuaucaaaagcagaaaggaauuagagacuuuugccaaagaaaacagaaaugcuauggaggcaggcuagaagaaaaagucccaagaguuaggcaaguaugcacaaaaugacaaaaagagaucagcagggagcuuccuucagcuagacagggaauaaggugauuccuggggauuacacaggaauacagaaauauuaggagaaaaagcuaaaaacuugaauugagaagguaaguuagacauggguacccacagucaccgcagagaaauaaaucugaugagggaaguaaggcaaaaauggguaaguaugaagagugaguaaaaaaugacuacaauggccgggcgcgguggcucacgccuguaaucccagcacuuugggaggccgaagcagguggaucacuaggucaggagaucgagaccauccuggcuaacacagugaaaccccgucucuacuaaaaauacaaaaaaauagccgggcaugguggugggcaccuguagucccagcuacucgggaggcugaggcaggagaauggcgcgaaccagggaggcggagcuugcagugagccaagaucgcaccacugcacuccaagccugggcaacagggcgagacuccaucucaaaaaaaaaaaaaaaaaaaaaaaaaaugacuacaaugcacuuagcaacugaaguacaggcagaaaccacccaagagaaauuacaagacccucugcaguuauagaaaaauaugacuuagagaaggagucaaagaaagacauuuccaagggcaugagaaacuagagaggacuacagugggggaaaaaggccugaggggaacugaaggaaagggggaagggggauccacucuuaacaagugaugccaugggaagguaucucuuccccagcuccccagggugaaaucaaagaaugagacagaaaucaggagagucucuaggacaauuccaggcaucaaauccaagagguucagaauaccaacagucacacaaagaaaaacucuugggaggcaagaaagggcucucucuggcuuaaucuaaaugggaaaaaaauguccuagaaaauagauucagagcagauaaggaaggugguauuauaaggaguucuaaggaaccaaauccugggcaaagggggaggugaaauaaggaagggucuuugaaagaugaucccgucuuccaaaaaagguugucagauucccgaacugggauaguuggccaagagucuucaagaaguggaaaucuuaagauaaacagaagggaaccucauaagcuuccuuucagagauccuuuuagagauuaugacuaugaagcuuacaugccucaagacgaagaaacuauaugaaugaccugaagguaucugaggucuaagugagaccucaaauccauuccugaguagaaugguagagcagugggucuugagaucaaggugugguggggagagagacuugcgaaagaugccaccuuauggcuggcugggaagcaacuugacugauccaacccaggguuccugaggucaaagaugccaaacgucguaaauggaucugaccauuucuccuuggcuugggaaccggaauauaagaugaaaguggggugaguguuccagagccaguaggcagaggccucucugaggaagaugaaaggaucuuuuacgggacagagggccuucccaaagggaccguguggaagaaagacaauucuccaugugcuuggaucguggggaagaugugauuaaggucuaagguaugucuuccaccagacaacggacacagucaauuagaagcuggguaaaggggucucuccugcggagcggggagcgccaagccagggacaauaauggccugaaguucauucucccggagauggggguagaagcaggugcaggugccuuagaggggucaaaaauaagaggaacaggguucacucuaagcggucucccagggaaggcugcggguuggagcaaggguccaagauucuaagggccaggacucagcuccagaagcucgaucccgccccacgcguuccugcuccggccaggggagggggcuaaggaccggcguccccagucggcgcgccgucucaccuuguagaaggccccguuggagccgcgcaccucgacgggcagucccggcuccacaucccccccagaggccaggccgcccauggcgccgccaccgccuccgacucccccggcggcggcugcagcagcagucugagugcgggccgggccaggcccccggcgucuccccggaggaggagccggagggggagccgcggggggcgggagccgggccggccccacggcggcccugccacagccaacgagcagggggccggggccgggccgcuccccguccgccgccgccgccuuggucuccgccaccgugagggaaacggccgccgccgccgcugccuucgucaccucagcuuccgcccgccgccgcccccgcugcugccucagucccgggacccgcugcugccgcugccgcuccacagccuccaccucccccugccaccgccgccuacugc

SEQ ID NO: 192259 - RNA, 4563 nt, Homo sapiens
aagcuuuacaauuccaacagcgcguccaaaacguggucccugacugagacuuauuuuacgccacuagagugaggguggguagcgucagaaagagcggggcacggggcgggccagcuucgccgcgggaaaagaacgggaggcggaguguccgcagcgcgcacgcgcaacgaaagucaauggcggucuggagagacuggcggaagcuagcuuugcaauauggcggccgaggcggacggaccgcuuaaacggcugcucgugccgauucuuuuaccugagaaaugcuacgaccaacuuuucguucagugggacuugcuucacggugaguuuuauucagcauccgauccaaguccuacucgagugaccgugggcccuuaguccaagccuugaucggcgacuaagugacggcagugacugccgccaugccgagcuggacggaagucacuucugagaagggcggaagugucucgggcuccuuagagggaggacaccauauuagugccaguggggaagucaccggguggaauuacuucuuuguggaguuugugcuguagcgacaaugaaaaacgaagagucaacuuuuauaaaacaaaauaaaaauuaagucaaaucaugccaaccuuuauuagaucgcuagcaggguuaaacuuaauucaaagccccugaugaaucgggccuucauugcacccccaaaggcuccgccacccugauugcuuucuuuccagccuccagguuugcucauagucugauuucggaauaauuugccucccuuccuuuuucugauugcgagacagcuccacaagggucaccgucagaccguuuggggagcgucagucugccccugucaguucaugguaccucucuugagcucguggggcacuuuguuuuagccgcauucaugacccgugagagucagacucccacuagaccaaguuccuugaggggaaggcuucaaggcuagagaaguuguggauggccagggcauaaaagcaagccuugaaaggguaagguuuagucccugaguaggggccagggacagucagaguguucaagaaagagugguauggggcgggcacgguggcucacgccuguaaucccagcacuuugggaggccgaagcggguggaucaccugaggucaggcguucgagaccagccuggccaauagggcgaaaccccgccucuacuaaaaauacaaaaaauuagccgggcguuguggcaggcgccuguaaucccagcuacucgggaggcugaggcaggagaaucgcuuaaacccgggagacagagguuacagugagccaagaucgugccauugcacuccagccugggcaacaagagugaaacuccgucucaaaauuaaaauaagaaaaaaaaaaugguaugaagacuugucuuuggagagagaagacaugugaaauggggcacccauuggcccagagaagggaaauaaaggaucagagagcucuugggcauuucucagcuuuauauggggaagcaauggagagccguggaggucaagccaaguuuggguguuaauuuauagggaauggaagauuggauguggggggugguaggcaucggagaaaagcuguuuuggaaaguaacagucuggggcccggugcgguagcucgagcuuauaaucccagcacuuuaaggaggcugaggcagguggaucaucugaggucaggaguucgagaccagccuggccaacauggugaaacccugucucuacuaaaaacacaaaaauuaaccgggcaugguggugugugccuguaauucuagcuacuugggaggcugagacaagagaauugcuugaacccaagaggcagaggcugcagugggcugagauugggccacugcacuccagccugggugacagagcaagacucugucuccaaaaaaaaaaaaaaguguggugguuuggagcaggaaggaccaggacuuucucacugcccuccgccucuccuccccccaagacaaugcaagacccugguguggguaagggggcucggggagagcccacaggagcuucaagcccuggccuggguuucagacaucuccugucugcuuacccuuuuuucucuccucaguccccugccucaagauucuccucagcaaaggccuggggcugggcauuguggcuggcucacuucuagguaugucucuuaucuuucuuuccagcuguuggguugggguggaggugcugagaggccaucaacuguguggguguucguucuauagcuguuguguugcaucccaaagaauggagaguccucaguccuacuuuucucaucuuuccccuaguaaagcugccccagguguuuaaaauccugggagccaagagugcugaaggguugagucuccagucuguaaugcuggagcuaguggcauugacugggaccauggucuacagcaucacuaacaacuucccauucaggugaggggcccacccuuccaccccaaggguaauacccacaacucuaauggggauuaaggugaaggagguuacaaggcagcaaaguggccgggcccaguggcuugcaccuguaaccccagcacuuugggaggccgaggcggguggaucaccugaggucaggaguucgaacuggccaacauggugaaaccccgucucuacuaaaaauacaaaauuagcuggguguggugaugggcaccuguaaucccagcuacuugggaggcugaggcaggagaaucacuugaaccugggaggcagagguugcagugagccaagauugcgccacugcacuccagccugggcaacaagagcgaaacucagucuuaaaaaaaaaaaaaagggacaaggggcuaggaaaguuuuaagcccuuuuagaaaccuaaucaucaccaguggaggugaucuugagaaggggugagcaucccgagaauggccacgauucagaaugagccagucccgugugggggcuguagagaagcgugaucagagcauagugucccuggauggaugggcuauggaggcuuucccugccucuuucuaggcccgccuuucuuccucccaacucuugacucugcagcucuuggggugaagccuuauuccugaugcuccagacgaucaccaucugcuuccuggucaugcacuacagaggacagacugugaaaggugcuggggacuuacccaagagcaggcugugugguuccugggaacccugcugggaacucaggucugggaaagccaaaugauguggagagauugacaaggacuccugucuccccaccccuaggugucgcuuuccucgcuugcuacggccugguccugcuggugcuucucucaccucugacgcccuugacuguagucacccugcuccaggccuccaaugugccugcuguggugguggggaggguggguaccaggagcaagggacaagauguugugggggcagggugggggggaagaguagaagaucaaaguguggggguguuguacuugggggagcaugggaagagcucaggugacagagccaaaggucucaacuccuccccuagcuucuccaggcagccaccaacuaccacaacgggcacacaggccagcucucagccaucacagucuuccugcuguuugggggcucccuggcccgaaucuucacuuccauucaggugagugcaacaucuuccuucuagaaggcacuaaaaccucgucuuacuucucccagcuaagggccaaagcugccccgugaggaaccuuuguccauaagggaaccuuucuugagcuaugcugaaggguaacccuggcucugucucuugcaaccaggaaaccggagauccccugauggcugggaccuuuguggucuccucucucugcaacggccucaucgccgcccagcugcucuucuacuggaaugcaaagccuccccacaagcagaaaaaggcgcaguagagccagcuacuggagucauuccguuuccacucauucacccaaccucaggguucuccccaucugagccagccugcuggugugacuuacucauccuccauuccucugcacuugcagacuuucugagccaggguuuucuuuuaguggaaacaaaugguugauggauccagauccuuagaaaaggagaggauggggguagagucucccaagccaaaauuuugacauuugagugcuuucguaagcccuguacauguacuauuaauucagucauucagccaagccuccuccucuagcagcaauuuccagcuguguaacacuauccugggcaaauguuuuacccuguccuccagccucccugcuucccuucuggcccuggaagacugagucuggacggcagaguggagggacugggaggcuguggcugccucccucccucagcccggcugggacugucucccggaccccagugcuggggugggggaagggggacggagaaugacucaggcagggccccaggguggggugaggagguuccugcucuggcaggucuaggcggaagggaguggagauggggcugguuccugcugcagugaggggaacagaugggacaauaaagacuggagacucaguugaauaauacaaaacuguuuaauacuaccaa

SEQ ID NO: 192260 - RNA, 9979 nt, Homo sapiens
uuacguaucaacaaaggauccuuuauugaccagagcaggaccguggcauuuauauauuuuuauauauauauauauauauauauauauauauauauauauauauauauauauauauauauauauauauauauaaaaguuugaagaucuggcaggcagugauccuauuguccgcccaccacccccagcacugauuuccugcucccugcacggggaagggggaggaugacugcuccacccaggccacagggccacacuccccugcaaacagaggaagaaaggggcuuuucuguagccacccccugcacaucagaaaucaacaaguauucucucaaagaaaaaaaaauacagaaauugaaacauuuaaauaugaaaaaccaaagggaagugagugggaagaggcaagagaggaaaggaacuggaguuucuugggaagggacucccaugucucccuucccauuuaugggcuuggggucugggguacgaggcucacacagugaguuugcagugacacagcuccuuguagaucugccgacgaaguuugggcauguccugcugggugaagcugaauggcugagacagggccagaugcuugcaguacuggguguuaacaaagcaagccaugagaaaccccccgugucaggaccugugcuacacauuucauaugagaugugucuccauccuucagagaacauccccaaagggagccagggucccacagccugggguucaaaaacagccugacucuaaagcuaguguucuuacuugauagaauguuuuagauggagaaaauacacugaguuggagguuagcagggagcucuaugaaggccagaggcccaagacuagagacccagucccaaugugggauggagaaguccagaagagaaccagugaagccaguguuuugguguucuaaaacagauuacuuccugcuccacaacugacuaugagccaaaugaggggaugcauaacagccucccgacccuuuaacccaacugacuucagagcuaggggagguggccccaucaucugcuuaccugcaacacaaaagcaccacagucacugucauuauucugccuggccacauucuagagaagagaaagaaagcaggcccuucacauggagacucccagggguaggacuucaauuucugccuucuaccacuguccccaccaacacccuauaccccucccucaggaaacucaccauuuugaaguaaccuuuccagcccugguggaaauccagucggucuuucuuuaccgccucugccuguagauacuuggcaauaugcuauguggaugggggaaaagaaagugaugcccuaaguuucucaauugaacacaguaugguggguacagugcuggcagacaccaugcccaggucgccccucaaagacccaaagcccacccuucuuccugcaaugccuugccacugcaccgccccacauuuugcccaucucucuccuacccccucaaaccuuagggcagcggcgguuuaggguacgcugcgagucaaaauaggugauggugcgucgccucacaucaacagagaugagggaccaaugcaccuccagguggauggggauuagcaguagcuccuuauugaagauguccaccuaaagagauagugccacaggucagguacaacaaacagaagucuugccuuuugccaugaagguucuagagaggaacagagacacagguaagggaaccaagugaaagaacagaagacccaaggccuagauugugggcaagcucaggaucugcauguuucgguucuucgggguaagggaggaaggucagacaauggaggagacaucagaacgaacacuggagaacccaugaugggcaggcgcuuuucacacuuuaaagggagaagcacuuagcagcuaagaacccaggcccaggauucuggagccugccagaauucaaauacagcuccuccauuuacuggcuuaugacagugggcaaccuacuuaauaaccuucuauaccucaguuuccuuaucugucagagaguguaaauaguaguaccuacaccucauccauuugauaugaggauuaaacuagugacuauccauaauacacuuagaacaagacacagcacaaaguaaacacgcaguuaaugcucauaacaauccuaccgggaaguucucaacauucaaccuaacagaugaggaaauugcagcuuggaaagucgugacuugcacaaggucaugaaagaaagaaauggcagaagugggacucaaacucaguaugaagaaggccaacauguuuuucacuguacgucaccacccuucccucuacugcaagaagaucccugaggguguaagcucuugauuuugaggacugaaauuaaggaaugccggagccaaucauccugccuagcuguagaaauuuccuggccuuugaaugggagggcagggaaaccagaagagaaaagaacucuucauuuuccucccccaaccuguuccucucccacuuuucccguuacauaggccaaaaaccuaggcaucauccuccauuucuuuuucuucauuucccacauccaaccugcggaggaaaaaacaaaucuuuuuuuuuuuuuugagacggagucuugcucuguugcccagacuggagugcaguggcgugaucuugccucacugcaagcuccaccuccuggguucaugccauucuccugccucagccucccaaguagcuuggacuacagacacgugccaccucgcccggcuaauuuuuuguauuuuuaguagagacaggguuucacuguguuagccaggauggucuugaucuccugaccuggugauccgcccgccucagccucccaaagggcugggauuacaggcgugagccaccgcgcccggcaaaaaaacaaaucuucuuuccuacuauacucucacaacacaaaauacuucuguaaccuguggucaccaagaaguguuuguggggcuuucucuccaccaacaaccaagcaagcaauuuugcgguggacacagcuggguaucccccaauucaauuccaacacuaucuaccuggagauaaugugucacagguuuagggcucagucucacaaggcugcccccaauucugaugccaguccuaagccccagguuguuuuaucuguguuucucaccaacugguuagaucagcguucccaugacccccuccuugaauuugauuaauuugcuagagcagcucacagaacucauggaaacacauuuaccaguuuauuaacaaaggguaguacaaagaguacagaugaaaagaugcacagggaaagguaccgggaagaggccuggagaccauccugugggagccuccaugccuucagcuaucuagaaugucuccaaacuccuccucucggguuuuuuuuucuuuuuugagacagaguuucacucugucacccaggguggagugcaguggcacaaucucggcucacugcaaccucugccucccggguucaagcgauucuccugccucagccucccggggacuacaggcgcacgccaccacgcccagcuaauuuucauauuuuuaguagagacaggguuucgccaggucggccaggcuggucucaaucucuugaccuugcgauccaucugccucagccucccaaagugccgggaguacaggcgugagccgccgcacccggccccuuuccgguuuuuagaggcuucacuacuaggcaugacugauuaaaucacugauccucagugauugccuuaaccuuuggccccauuccccucccaggaaguuggugggggugaggcugaaaguuccaacccucuaaucaugaagccaccuagaggggcuagccaugaaucaacucaucagcacacaaaaacacacaucacuggagauuccaaggauuuuagaaguugaaugccaggagccuggucaggagaccaaauauguaucucucaguaucacagagccugucaguccuacugguuuuacucguaaaauuuauccuacauaaaacuacucucucucucuuccuuuagcacuccaguucaaguuucucaccuggacuacugugcucuguuccugcuuccauucuugccccccuuucaaucugucauugaaacaggaguuuaaaacagaaggcacuucucagccugcuuaaaacucaauggcuucucaguauacacgcaauaaaauccccccuccucagccuaccguacaugucuuacaugaucuacucucugaccgaauuuuguauccaucucccuuugcucacucugcgccaacuacacaggucacccccacaagcccucuguuccucagccaugguuuuucacuaugggucuuguguacuugcuauucccaggucugcgcauggcuggcugcucaucauucacgucucagcuaugagaggccuuccuagaucacccaaucuaaaguacccacuucccacgcuaugacauuacugugauuuuuuuuuuuuuuugagacggaguuuugcucuuguugcccaggcuggagugcaauggcggggucucggcucacugcaaccucugccucccagguucaugggauucuccugccuccgccuccaggaauagcugggcuuacaggccaccugccaucacacagggcuaauuuuuguauuuuuaauagagaugggguuucucaauguuggccaggcuagucucgaacuccugaccucaggugauccgcccguguuggccucccaaagugcuggggauuacaggcgugagccacugcgcccagccucacguuacucuguguugaucugcccacagcacuuaucacuagcugcaauuuaacuuuaagggcaaguuuuccuuauuuaacacuguauccuuagugccuacacacacaagagacguuuaaucuuugaaagacugaaugaacacggucagggaaagggcucagagaaaacaagacucucauucuuuagaggcaaggcauuacacaaguggaugugaauucaaaacucacguuuuugguccaccuuuucaccccaucauaacccuuugguacggaguuuaucauagaagaaacuauugaagaaaugcaccugugccaaugacacaaaaaagcucaauggaauuaaaagaccucagacucucccacuaagucuccccuccucaguccacugacaguaaaaacaaauucuggguuuuuucuuuuuuuuuugguagagacagggucucacuauguugcccagguuggucucaaacuccuggccucaaucugucugucugccugccucggccuuccagagcauugagauuauagguaugagucaacaaaccaggcuuuuuuuuuuuuuuuauuugaggcagggccuugcucugucgcccacgcuggagugcaguggcaugauuucgacucgcugcaaccuccgccucccggguucaagcgauucucccgccucagccucccgaguagcugggacuacagguacccgccacuaugcccagcuaacuuuuuuguauuuuuauauuuuuaguugagccaggguuucaccauguuggccaggcuggucuggaacuccugaccucgggugauccacccgccuuggccucccaaagugcugggauuacaggaaugagucaccgcacccagccgaaguuguuuuuugucuuuuuuuuuuuuuuugagacagaauuccgcucuuguugcccaggcgggagugcaauggcguggaucucgacucaccgcaaccuccgccucacggguucaagcaguucuccucccucagccucccgaguaacugggauuauaggcaugcaccaccaugcccggcuaauuuuguauuuuuaguagagacgggauuucuccauauuggucaggcuggucuugaacucccgaccucaggugauccacccgcccuggucucccagagugcugggauuacaggcaugagcuaccaugcccgguggccuuuuucuuuuucuuuuuuuuuuuaaaucuuguuuuacaauaguuacaauaggaacccaucccaauccuuggggcuggccauagcgaaaaacacuaaauacuggcagaaaggaaaacaacugauaaauccagagcccaagauuacggauuugaaauuaauacacuaccacuaccaccucucucccugaaacagagacccucucuguguaaaaugaaagagaugaaaggagcuuaaaaagcugcuuaaaacugcagaaguuccucuggguacugaccuaucugguugggccuaccuuuucagggacuguguccaugaccaggucuccauacauguucaucaccuggggagaagaugggaggcagcuugccauggagggugcggcauggguacagggcucccccaugcagagggccccagacacccugcucccugaauccccucucaggccuguuucucuacccuuucucaccuggucauugagccaguucuguccauacaagguccccaagucauccauggucagcacgugccgcuuauaagccacucggaagccccucaccauggcauugccuggcauccgcugguaagacuggaucagcugcaacaccaggcccuuccugaguaggccaaggguggagucacacaaaagaugaugcagcuggggcacacagaaauaccuacuacucccuggaauacaaauucuaacugacucccuuuuuucuggcucaugauggguccuucugaggaccugcgaaaggcccacuccccagaaagauaaacaugacuacucagguagaacauuucagggucccagguaaagacucucccaucagcuuccaaggauuuggcaccugccugcagaguccuccccuucagcucuagcuuccuccuccccaacuacagcccuauggaagaaaaggcagcaguauucucuccacauccccaaggccccagcccuucuuucaaggagggcuuucaagccucaccuggaagggguggaaaacuccugcuggaaaauguccuccagcuucucuacuaccucaucagugcugagggguaugaggcugccauacguuugaaggaauucguccaagaugccugguggaaagggagagaggagggggugaggccuccagacucuccucuaggagucggagaagggagagaggcuaguugcuuaagggcuccuuacucuguacgcaggucacaugcuccucucgcagggggcugugcuggccggcuuucuccccaggccucucugccucuucugccaugcccaaaucugagcccugaaaaagcuccugggccacaugguccccgaugcugcacacauugcugaugaggaugcuggcaucagggggugccaagcugcgcuccccuucuggcccagauugucccccaaaaccguugggcagaguacaugaaaggaggccuauagggcaggggaaauggaaugggcaugagagacuggccuggggaaagcacaaugggaugcacacaguugacucaugcaugcaaauaagaccgcaagaaggauacacugaagcagaauccaccaaugucaaucccacuccaagaaauggggaccccauaagcaugagauaaacauguccaagagauucuacagggauggagagagaguuccuacucauagacaggaagaaagaaaaaggauuagcauuuagaaaugaaaacuucgggauauuugucaccacuauaugccaaacacccagcauaguacccagcauauuguaaaggcucaaugaauacuagaauauguaauaaagaccuagagagccugaaacuguuuggcuggaguucuccgaaagggaaauauucuuucacaacuguaagaugauguacuccacuacugggagagaucccaucccgucacuuugggaaugguacccucuggagauguauacacggggguucuuauacugagaggccgacaagggauuucguguggacaggauuuuuguaaaccacaucucccuuucucaucugcgcucaagaccacgggauaccuacuuagggcaucuguuuccuagcucugccugggaaacugccaggcucacucccaggcuuacuuucugcucaaaguggggcuuaauggagacauuucgcagcucuucuggagccggcacucuuccauccuacuuuccuuaagcccagcucucaccauggcaacaggcuccuggugcuccaggcucuuaacccucccuaaccccucccccgcaaccccacaccccuuucccaccuuacccgagucaggguccagaggagacuuuggaguccaccugaguccaucuuccuccauggggggcccagagggcacugguggagacccucucaccccauccucagccaugagagcaccuagcagacccagccgggguggagguggcccccggggggagucaaaacgacaacagggggauggcaccuguggcgucgcacccccuugcuggggugaaagaugguucuuggggugugcgaggccccgccgccggccccgguggcgcccccaaagcuuccaguggaaugucagcgaggugcuuuuugaguagagcagcauccggaaggcucucauggcucggcggcggcgcugugagcagguuuuucgaugaguggggcgggaagggcggggccgcugggagguucccagcugacuccaucuugggggcagccuccaagcugccacuuccuccucuucaucuucauccuccuccuccuccucuucuuccuccucuucacuugcugaggcaucaaaagagggucgggggacagggaggcgucuggcuggcacuguggucccugacccaggaucuggcccaaacccuccaccugacuugagucgggguuugggaggugggggccaacgaagacgcucccgccugggacuugaguaagcuggggguaugccggguccaggaggcucaggcccccaggacccggucccuuguauagucucuuucaucuuccaguacccugaaaaacaaaagaucaggguaucaaaaucuaagcaucaccccaccgcagauccugccucucuuccuggccaugccuccucuggauucagaugcaaauaaagaaaagaggaaaaaacgcaaaacuccuaacuuaagaucuucccgguuaacgcgguccacaaggggcccuucagggucugugccaucaucucuccccaguccagagacaagggaaaauggcuaagcagcaggccucagagaucuuauuucuaagaucaccaggccaaacccaauagcacugccagguucuacgucuuuauuuuaauaccaccagggcuguccuuugagggcccaacaagggcaguuucuuuccucagggacaugauaaccgugguacuugaggagaaugcaacuugcacguggaaacuggacuggaaugggagacaguucucuaacacccuggaugaacggggggcaugggaaggcugcggucaucucaagugcagaugccagggauaugguucagggggcagaggcugauaaacggggaagaacuuugaaggaaacuuaaagagaaccgaaucaagacgcugggacagaacggagcgcacaagccaggccggcccagcccccuccuacuucauccucggggaccagaaugcaacccggcaccaguccggucccacgagcuuggauggcucggcgcacacgggccuuaagaagccccuaugcgggccucugggccccgguucggugggagcgaggcccaggaaugggagaggccaaggcagggcuggggggaggggagggggcguccucaccgggagcggggaagccgggcggacgggcccgaaggcgggcgucuccggccucaagcuucccggcucaucucuccggcgacggcggcggccccgccacuccugcugucuuuaggcgcagccgucucaauucaggauuccaacgcuucugggccgcgugccgcgccgccgagcaccccgccgcgccgccucuggcucugcuucagcuucagcuuccaccuccaccuccaccuccgccaccgccgccaccagcgccaccgccgccgccgccacuc

SEQ ID NO: 192261 - RNA, 9979 nt, Homo sapiens
gaguggcggcggcggcgguggcgcugguggcggcgguggcggagguggagguggagguggaagcugaagcugaagcagagccagaggcggcgcggcggggugcucggcggcgcggcacgcggcccagaagcguuggaauccugaauugagacggcugcgccuaaagacagcaggaguggcggggccgccgccgucgccggagagaugagccgggaagcuugaggccggagacgcccgccuucgggcccguccgcccggcuuccccgcucccggugaggacgcccccuccccuccccccagcccugccuuggccucucccauuccugggccucgcucccaccgaaccggggcccagaggcccgcauaggggcuucuuaaggcccgugugcgccgagccauccaagcucgugggaccggacuggugccggguugcauucugguccccgaggaugaaguaggagggggcugggccggccuggcuugugcgcuccguucugucccagcgucuugauucgguucucuuuaaguuuccuucaaaguucuuccccguuuaucagccucugcccccugaaccauaucccuggcaucugcacuugagaugaccgcagccuucccaugccccccguucauccaggguguuagagaacugucucccauuccaguccaguuuccacgugcaaguugcauucuccucaaguaccacgguuaucaugucccugaggaaagaaacugcccuuguugggcccucaaaggacagcccuggugguauuaaaauaaagacguagaaccuggcagugcuauuggguuuggccuggugaucuuagaaauaagaucucugaggccugcugcuuagccauuuucccuugucucuggacuggggagagaugauggcacagacccugaagggccccuuguggaccgcguuaaccgggaagaucuuaaguuaggaguuuugcguuuuuuccucuuuucuuuauuugcaucugaauccagaggaggcauggccaggaagagaggcaggaucugcgguggggugaugcuuagauuuugauacccugaucuuuuguuuuucaggguacuggaagaugaaagagacuauacaagggaccggguccugggggccugagccuccuggacccggcauacccccagcuuacucaagucccaggcgggagcgucuucguuggcccccaccucccaaaccccgacucaagucagguggaggguuugggccagauccugggucagggaccacagugccagccagacgccucccugucccccgacccucuuuugaugccucagcaagugaagaggaggaagaagaggaggaggaggaggaugaagaugaagaggaggaaguggcagcuuggaggcugcccccaagauggagucagcugggaaccucccagcggccccgcccuucccgccccacucaucgaaaaaccugcucacagcgccgccgccgagccaugagagccuuccggaugcugcucuacucaaaaagcaccucgcugacauuccacuggaagcuuugggggcgccaccggggccggcggcggggccucgcacaccccaagaaccaucuuucaccccagcaagggggugcgacgccacaggugccaucccccuguugucguuuugacuccccccgggggccaccuccaccccggcugggucugcuaggugcucucauggcugaggauggggugagagggucuccaccagugcccucugggccccccauggaggaagauggacucagguggacuccaaagucuccucuggacccugacucggguaaggugggaaaggggugugggguugcgggggagggguuagggaggguuaagagccuggagcaccaggagccuguugccauggugagagcugggcuuaaggaaaguaggauggaagagugccggcuccagaagagcugcgaaaugucuccauuaagccccacuuugagcagaaaguaagccugggagugagccuggcaguuucccaggcagagcuaggaaacagaugcccuaaguagguaucccguggucuugagcgcagaugagaaagggagaugugguuuacaaaaauccuguccacacgaaaucccuugucggccucucaguauaagaacccccguguauacaucuccagaggguaccauucccaaagugacgggaugggaucucucccaguaguggaguacaucaucuuacaguugugaaagaauauuucccuuucggagaacuccagccaaacaguuucaggcucucuaggucuuuauuacauauucuaguauucauugagccuuuacaauaugcuggguacuaugcuggguguuuggcauauaguggugacaaauaucccgaaguuuucauuucuaaaugcuaauccuuuuucuuucuuccugucuaugaguaggaacucucucuccaucccuguagaaucucuuggacauguuuaucucaugcuuaugggguccccauuucuuggagugggauugacauugguggauucugcuucaguguauccuucuugcggucuuauuugcaugcaugagucaacugugugcaucccauugugcuuuccccaggccagucucucaugcccauuccauuuccccugcccuauaggccuccuuucauguacucugcccaacgguuuugggggacaaucugggccagaaggggagcgcagcuuggcacccccugaugccagcauccucaucagcaaugugugcagcaucggggaccauguggcccaggagcuuuuucagggcucagauuugggcauggcagaagaggcagagaggccuggggagaaagccggccagcacagcccccugcgagaggagcaugugaccugcguacagaguaaggagcccuuaagcaacuagccucucucccuucuccgacuccuagaggagagucuggaggccucacccccuccucucucccuuuccaccaggcaucuuggacgaauuccuucaaacguauggcagccucauaccccucagcacugaugagguaguagagaagcuggaggacauuuuccagcaggaguuuuccaccccuuccaggugaggcuugaaagcccuccuugaaagaagggcuggggccuuggggauguggagagaauacugcugccuuuucuuccauagggcuguaguuggggaggaggaagcuagagcugaaggggaggacucugcaggcaggugccaaauccuuggaagcugaugggagagucuuuaccugggacccugaaauguucuaccugaguagucauguuuaucuuucuggggagugggccuuucgcagguccucagaaggacccaucaugagccagaaaaaagggagucaguuagaauuuguauuccagggaguaguagguauuucugugugccccagcugcaucaucuuuugugugacuccacccuuggccuacucaggaagggccugguguugcagcugauccagucuuaccagcggaugccaggcaaugccauggugaggggcuuccgaguggcuuauaagcggcacgugcugaccauggaugacuuggggaccuuguauggacagaacuggcucaaugaccaggugagaaaggguagagaaacaggccugagaggggauucagggagcagggugucuggggcccucugcaugggggagcccuguacccaugccgcacccuccauggcaagcugccucccaucuucuccccaggugaugaacauguauggagaccuggucauggacacagucccugaaaagguaggcccaaccagauaggucaguacccagaggaacuucugcaguuuuaagcagcuuuuuaagcuccuuucaucucuuucauuuuacacagagagggucucuguuucagggagagaggugguagugguaguguauuaauuucaaauccguaaucuugggcucuggauuuaucaguuguuuuccuuucugccaguauuuaguguuuuucgcuauggccagccccaaggauugggauggguuccuauuguaacuauuguaaaacaagauuuaaaaaaaaaaagaaaaagaaaaaggccaccgggcaugguagcucaugccuguaaucccagcacucugggagaccagggcggguggaucaccugaggucgggaguucaagaccagccugaccaauauggagaaaucccgucucuacuaaaaauacaaaauuagccgggcaugguggugcaugccuauaaucccaguuacucgggaggcugagggaggagaacugcuugaacccgugaggcggagguugcggugagucgagauccacgccauugcacucccgccugggcaacaagagcggaauucugucucaaaaaaaaaaaaaaagacaaaaaacaacuucggcugggugcggugacucauuccuguaaucccagcacuuugggaggccaaggcggguggaucacccgaggucaggaguuccagaccagccuggccaacauggugaaacccuggcucaacuaaaaauauaaaaauacaaaaaaguuagcugggcauaguggcggguaccuguagucccagcuacucgggaggcugaggcgggagaaucgcuugaacccgggaggcggagguugcagcgagucgaaaucaugccacugcacuccagcgugggcgacagagcaaggcccugccucaaauaaaaaaaaaaaaaaagccugguuuguugacucauaccuauaaucucaaugcucuggaaggccgaggcaggcagacagacagauugaggccaggaguuugagaccaaccugggcaacauagugagacccugucucuaccaaaaaaaaaagaaaaaacccagaauuuguuuuuacugucaguggacugaggaggggagacuuagugggagagucugaggucuuuuaauuccauugagcuuuuuugugucauuggcacaggugcauuucuucaauaguuucuucuaugauaaacuccguaccaaaggguuaugauggggugaaaagguggaccaaaaacgugaguuuugaauucacauccacuuguguaaugccuugccucuaaagaaugagagucuuguuuucucugagcccuuucccugaccguguucauucagucuuucaaagauuaaacgucucuuguguguguaggcacuaaggauacaguguuaaauaaggaaaacuugcccuuaaaguuaaauugcagcuagugauaagugcugugggcagaucaacacagaguaacgugaggcugggcgcaguggcucacgccuguaauccccagcacuuugggaggccaacacgggcggaucaccugaggucaggaguucgagacuagccuggccaacauugagaaaccccaucucuauuaaaaauacaaaaauuagcccugugugauggcagguggccuguaagcccagcuauuccuggaggcggaggcaggagaaucccaugaaccugggaggcagagguugcagugagccgagaccccgccauugcacuccagccugggcaacaagagcaaaacuccgucucaaaaaaaaaaaaaaaucacaguaaugucauagcgugggaaguggguacuuuagauugggugaucuaggaaggccucucauagcugagacgugaaugaugagcagccagccaugcgcagaccugggaauagcaaguacacaagacccauagugaaaaaccauggcugaggaacagagggcuugugggggugaccuguguaguuggcgcagagugagcaaagggagauggauacaaaauucggucagagaguagaucauguaagacauguacgguaggcugaggaggggggauuuuauugcguguauacugagaagccauugaguuuuaagcaggcugagaagugccuucuguuuuaaacuccuguuucaaugacagauugaaaggggggcaagaauggaagcaggaacagagcacaguaguccaggugagaaacuugaacuggagugcuaaaggaagagagagagaguaguuuuauguaggauaaauuuuacgaguaaaaccaguaggacugacaggcucugugauacugagagauacauauuuggucuccugaccaggcuccuggcauucaacuucuaaaauccuuggaaucuccagugauguguguuuuugugugcugaugaguugauucauggcuagccccucuagguggcuucaugauuagaggguuggaacuuucagccucacccccaccaacuuccugggaggggaauggggccaaagguuaaggcaaucacugaggaucagugauuuaaucagucaugccuaguagugaagccucuaaaaaccggaaaggggccgggugcggcggcucacgccuguacucccggcacuuugggaggcugaggcagauggaucgcaaggucaagagauugagaccagccuggccgaccuggcgaaacccugucucuacuaaaaauaugaaaauuagcugggcgugguggcgugcgccuguaguccccgggaggcugaggcaggagaaucgcuugaacccgggaggcagagguugcagugagccgagauugugccacugcacuccacccugggugacagagugaaacucugucucaaaaaagaaaaaaaaacccgagaggaggaguuuggagacauucuagauagcugaaggcauggaggcucccacaggauggucuccaggccucuucccgguaccuuucccugugcaucuuuucaucuguacucuuuguacuacccuuuguuaauaaacugguaaauguguuuccaugaguucugugagcugcucuagcaaauuaaucaaauucaaggagggggucaugggaacgcugaucuaaccaguuggugagaaacacagauaaaacaaccuggggcuuaggacuggcaucagaauugggggcagccuugugagacugagcccuaaaccugugacacauuaucuccagguagauaguguuggaauugaauugggggauacccagcuguguccaccgcaaaauugcuugcuugguuguugguggagagaaagccccacaaacacuucuuggugaccacagguuacagaaguauuuuguguugugagaguauaguaggaaagaagauuuguuuuuuugccgggcgcgguggcucacgccuguaaucccagcccuuugggaggcugaggcgggcggaucaccaggucaggagaucaagaccauccuggcuaacacagugaaacccugucucuacuaaaaauacaaaaaauuagccgggcgagguggcacgugucuguaguccaagcuacuugggaggcugaggcaggagaauggcaugaacccaggagguggagcuugcagugaggcaagaucacgccacugcacuccagucugggcaacagagcaagacuccgucucaaaaaaaaaaaaaagauuuguuuuuuccuccgcagguuggaugugggaaaugaagaaaaagaaauggaggaugaugccuagguuuuuggccuauguaacgggaaaagugggagaggaacagguugggggaggaaaaugaagaguucuuuucucuucugguuucccugcccucccauucaaaggccaggaaauuucuacagcuaggcaggaugauuggcuccggcauuccuuaauuucaguccucaaaaucaagagcuuacacccucagggaucuucuugcaguagagggaaggguggugacguacagugaaaaacauguuggccuucuucauacugaguuugagucccacuucugccauuucuuucuuucaugaccuugugcaagucacgacuuuccaagcugcaauuuccucaucuguuagguugaauguugagaacuucccgguaggauuguuaugagcauuaacugcguguuuacuuugugcugugucuuguucuaaguguauuauggauagucacuaguuuaauccucauaucaaauggaugagguguagguacuacuauuuacacucucugacagauaaggaaacugagguauagaagguuauuaaguagguugcccacugucauaagccaguaaauggaggagcuguauuugaauucuggcaggcuccagaauccugggccuggguucuuagcugcuaagugcuucucccuuuaaagugugaaaagcgccugcccaucauggguucuccaguguucguucugaugucuccuccauugucugaccuuccucccuuaccccgaagaaccgaaacaugcagauccugagcuugcccacaaucuaggccuugggucuucuguucuuucacuugguucccuuaccugugucucuguuccucucuagaaccuucauggcaaaaggcaagacuucuguuuguuguaccugaccuguggcacuaucucuuuagguggacaucuucaauaaggagcuacugcuaauccccauccaccuggaggugcauuggucccucaucucuguugaugugaggcgacgcaccaucaccuauuuugacucgcagcguacccuaaaccgccgcugcccuaagguuugaggggguaggagagagaugggcaaaauguggggcggugcaguggcaaggcauugcaggaagaagggugggcuuugggucuuugaggggcgaccugggcauggugucugccagcacuguacccaccauacuguguucaauugagaaacuuagggcaucacuuucuuuucccccauccacauagcauauugccaaguaucuacaggcagaggcgguaaagaaagaccgacuggauuuccaccagggcuggaaagguuacuucaaaauggugaguuuccugagggagggguauaggguguugguggggacagugguagaaggcagaaauugaaguccuaccccugggagucuccaugugaagggccugcuuucuuucucuucucuagaauguggccaggcagaauaaugacagugacuguggugcuuuuguguugcagguaagcagaugauggggccaccuccccuagcucugaagucaguuggguuaaagggucgggaggcuguuaugcauccccucauuuggcucauagucaguuguggagcaggaaguaaucuguuuuagaacaccaaaacacuggcuucacugguucucuucuggacuucuccaucccacauugggacugggucucuagucuugggccucuggccuucauagagcucccugcuaaccuccaacucaguguauuuucuccaucuaaaacauucuaucaaguaagaacacuagcuuuagagucaggcuguuuuugaaccccaggcugugggacccuggcucccuuuggggauguucucugaaggauggagacacaucucauaugaaauguguagcacagguccugacacgggggguuucucauggcuugcuuuguuaacacccaguacugcaagcaucuggcccugucucagccauucagcuucacccagcaggacaugcccaaacuucgucggcagaucuacaaggagcugugucacugcaaacucacugugugagccucguaccccagaccccaagcccauaaaugggaagggagacaugggagucccuucccaagaaacuccaguuccuuuccucucuugccucuucccacucacuucccuuugguuuuucauauuuaaauguuucaauuucuguauuuuuuuuucuuugagagaauacuuguugauuucugaugugcaggggguggcuacagaaaagccccuuucuuccucuguuugcaggggaguguggcccuguggccuggguggagcagucauccucccccuuccccgugcagggagcaggaaaucagugcuggggguggugggcggacaauaggaucacugccugccagaucuucaaacuuuuauauauauauauauauauauauauauauauauauauauauauauauauauauauauauauauauauauauaaaaauauauaaaugccacgguccugcucuggucaauaaaggauccuuuguugauacguaa

SEQ ID NO: 192262 - RNA, 13490 nt, Homo sapiens
ucccaggccaggaggugccagguuagagcuuggacacucagacccuccagugcaggccuugcccggaccagccccuccuccacucuccucuccccugugagcuccaccugccccaguucuccuggcuuuaaccccuccuuggccaaggccaggguugccugcgggagccagguguccgcucuccacaccuuucacagguaacugaggcuggggaggcaacugggacgaggaugcuugggaacaaggaggccuugguucagggauggggaggaccccaugggaagcuguggguggucggguccaugagcguggggaggggucuccuggccaggucaaggcccaagcggucuccugagaagggaaaggacccagcgggauuucaaaccucaucccaaacgcccugccaaccucagauccuacccaggccaccaccccgaaccccuccgacccugcguuccaucccaccaucaaccuccacgugaaucugcaccucugccccagccccagcccucagagcaaccucagcccagcccagcccagcuccagcuccagcuccagcccgggccccaucauggccaaggacuuucaagauauccagcagcugagcucggaggaaaaugaccauccuuuccaucaaggugaggggccaggcacucgcaggcugaaucccaggagaggaaauccauuuuugaaaggcaagugugcaguuucugcggcuuugcucccccucugucucagcucaugauugcucugucccuuugaggucucugccgcacccacucugugaacagggacugaggagggcccgacacccccgcuuguucccucaccucaccuuccugucuaccccaggaccccaggaaaggcaugugccagagguguggggagaucuggaagauaacugccugcccuucuccucccaacccaagaacacaugugccucguaugugcgugugcacguaugugcauaugaggaaugcagauucagcugggacucugugugugugugugagugaauguuguguguguguauaugugcgcgagagcgugcauauguuguguguguguaugucguguaugugagaggguauguugugugugagaguguguuguguguguauguugugugaguauauguuguguguaucuugugugugaguguauguuguguguuguguguguaucuugugcauguguguauguugugcgaguguauguuguguaugugaguguguguauguuguguguauguuguguguauguauguuguguaugaguguguguauguuguguguguguacguuguguauguuguguguguguuguguguguguauugugugaguguauguauguuuguguguugugugaguguuguguauguugugcguguguguauguugugcgaguguguguguuguguguguauguugugaguguguuauguauguugugugugugaguguguugcgugaguguguguguuaguguguguaugugauuguauguguguguguguguguguguagagguggggugaguugggaugggugggggacgugagcacagagagauccuggaagaucccugcuccucucaucucccaagacccuucccuggauccuucuguaauaaaucuugacugaaggaccuaaguaucuuggacauuuuuuuuuuagagacaggaguguaguggcaggaucauagcucacugcaaccucgaacuccugggcucaagccauccucccaccucagccucccaaguaguuaggacuuacaggugugcaccacugugccuggcaaauuaaaaaaaauuuuuuagagaaauggggucuugcuauguugcccaggcuggugggaaaagauuuuaaggugagagagaucugagcagugcuaggcagaagggcaagagccaggaauggaggagugucaggugugugggugcuggugguggagccggguuccauggaggcaggaggagcaggggcuuggagcuuaggaaggggauugguuagcugggcuggaaugagggacuccucauuccugaggcuggccaaccgagggagggccggugcugggcagggcagggcaggggacaggagggauaggaggucccucccgaggaccacucaggaacaccaguagcaucuccucucucuguagggggcuggcuggacuucccaccaggcgguguccccacaggcagaggcccuguccgccucacucuccucugcaacuccagugcccacacggcacccgguacauagugaacacucagagagaauacgggaugcugcugaaucuucugagggugacagaauuuagaguuugagcaggaggcuuggagagaggccaggauuucugaaauuaaugggagagugagcucacgcgaaugggcugagggacaccagugagggaccgucugaagggauguagcaaagucaccgcauuucccuccagcagcccggguggugggggcugggggaacgucaucaugggagcugacacugaucagcugcucaccggggcccaucuuccacuugucucagcacuugauuuuuuucugcuacccccuuuuucuuuuaaagauuucaauuaugcauguauuaagggucccacagcucacucauucucuuuccauuuuuuaauucuuuuuucucccaguguuucauuuuauagaguuauugcuguucauuaaguuaacuaaaauuuuccccuuccccucccccuccccuccccuccuuuccuucccucgcuuccccuccccucucucucucucaucucacucuguugcccaggcuggaaugcaguagcuugucacaacucacuguggccuccaccuccugggcucaggcgauccuuccacuucagccucccagguagcugggacuauaggcauguggcaccacaccuggcuaauuaaaaauuuuuuuuuguagagacgguuuugccauguagagggguuuugccaugcugcccagacuagucuugagcuccugggcucaagugauuccccccgugucgaccucccaaagugcugggauuacagaugugauccacagugccuggcccuaaauuuuucuuacgcauuucucaucuuccauuauuuccauccaguguguuuuuucuuuucuuucuuuucuuuuuuuuuuuuuuggaggcggagucucgcucuguugcccaggccggagugcaguggcgcgaucuuggcucacugcaagcucugccucccggguucaugccauucuccugccucagccucccgaguagcugggacuacaggcgccugccaccacgucuggcuaauuuuuuguauuuuuaguagagaugggguuucaccauguuagccaggauggugucgaucuccugaccucaugaucugcccgccuuggccucccacagugcugggauuccaggcgugagccacggcgccuggccaguguguuuuuucauuucagacauuguaguuuuuaucucuagaaguucaccuggggacucuuaaauauccuccacaauucuacuuaauuuuuugaacauaaugggauauggcuauaauaucuguuuuaccauccuugccugcuaauucuagcauccgugucaguucuggaucucuuuugauauuuaugaaccuccucguuaugcauuguguuuucccguuucauugcaugccuuguaaucuuugauuggcugccagacauugucaauuucaccuuguugggugcuggauauuuuuguauuccucuaaauguucuugagcuuugcuccgggaugcaguuaagcaacuuagagucaguuugaucguuugaacucuuaauuguuuuggucuccucggacucucagcuccaucuccucaacguggggagucucuugggcucugccuggacuucccuuuccuggccuguaaccugcagacucucuccaaacaguaagcuggggugaucggaggguuccuguuguuugcuucuuaucccucagggaucuuuacuccuccuugccugauguccagagucuugaaagcugccauguucuauaguugucuguuuuuguuuugauuguuucuggggagagaagaacucuucccaucuugggcagacccugucuuuuauguucaaacuuuugccuaagaagcacauuacauauuuuaacucaucuaauuauccgagcaauccaaucggguagcuacgacugugaucuccauuuuacacacgagaaaauggaagcauggagaaauugaaugcuggugcaugaucucagagcuaccuggaggcacagcugggcuacccugugggcagucugguuucaggguggauauacagacacguugcugggcugacccagcauugggaguugauaagucggacugggaagcaggacaggacccucugaguggagggugcugaagacagcagucagggacucagccauggagggccagcuugguggggaacaccguggucauggagcgcuucuggauggagaggaaugcaaaggccuuggaggaaggggugggggcagugagagggaggguggggcugugcucagagcgggagugggcaguggaggugucagaggccucccugggucaaaugggguccugaguguggcugcaguggggaagguggaagucacuggugugaaaaagaugaagaguuauggacagucacuuacaggggcagugucugacucaggacaguggcaggaagugaccuggggaggaagauucugggccccugacugagccuccccaggaugugguccugcugggucggggggugauaggaaugagaagacaaggaaguccacagagucaggguccaaggccuagaagguguucuguuugcagguggaugcugcaaagagaggagcucagggcugggacaacuggagcugcucugggucuggaggcagcagagagggagcccagcucugugugcaggaagacgugggugugugaguguacgugugugggugugucaggugugugugugugggagggaguaugaaugugugcauuagcaugcauaugcacaugugagaguggguacagcagagcguggucaugagugugugcaaauguguguuuuugagugaagugagcaaugugugagugugugagugugugugaguuugugagggcaugugaaugugugugucagugcugucagggugcagauggaucaaggggcaggagagguaccugugagaugaccucgggcugaggggagcaaauuuaguguggaacgagguuucuagggaagcgagggcaaagggcgcuggggaggaggccuugcguggugggggaugaggacaacaggugggaccuggaggguugugcuuggagagugggcuaugguggaaugacccagauuuaaggaucucaauggaauuuuggcaggggagggacuguuccaguauggauuuuaggaagaacacagggcccagcuucuggagucuccaaucugaggggacaggagccuuagaagagcugagacuaaggcccgaggugaucuggaggccucugccacuggcuggaugggaggaaaaccauucacagaucccccuucucaggaugugugccuaggcagggccgggucugcccccccgcccccugugcgucucccagucccccagcuccaggauccgggcuuugcacacagcugaugugaauauccugagucgugugcaugggugugugugcaccagauuagcugcguguguauauuuauacaugguaauaugggugcgaguguguaagaguguguguguaaugcucaaaugcuggggucaaagccuaugaugacccccccccauggccccaaccaauccccccgcccagguuaugccuccucaggcuucggugcccugucuuuacccuccggcuccccacacccaggcugccggcuccugaugccccucucccacagggccaccuccugcccagccccuggcacagcgucucugcuccauggucugcuucagucugcuugcccugagcuucaacauccugcugcugguggucaucugugugacugggucccaaagugagggucacgggggccagcagggaugggcaagggguagggaaagagacaugggcaguggcgggcagcgaucggggcgaugggaggggaagggauggaggcgggguggagcacaagcuggggcaaaugcggggacauugaggggccagucacauggacagugauggggacacggccccucugccucauccugcccccacuaccaccugacaaggugcacagcugcaagccgagcugcggagccugaaggaagcuuucagcaacuucuccucgagcacccugacggagguccaggcaaucagcacccacggugaggggcuggacggcuggguucucauuuauccgcacagguuugcugggcucagugccgagucugcaacagggcuguguggggugccgugggggugcaggcugggcaaggcguccaggggcccugggggauguauaggagggaggcagguggggacggacgagguuagugccagguggagagguuggaucugcgacacccggaggugaggaaggcaccaugucuugggccugugagcaaaucgaguguggcaggcccaucggaggggcaggcagguaagggguggccagagagagguggggaggggcccggccacgcaggugagccgugcugacagagcgaggcuuuauuuugagaaaauggggacccauugaagggacugaagcaggagaguggccugagccacuguggcagugcagggagccugggugugguccaggaagccaggagguggacgccugcaucgcccaggacgaggcgcuggcccccggucccccagcagcaugaggacggagggaggcucagcggggaaacagcuggcuuuccgcuuccaggaggcagcgugggugacaagaucacaucccuaggagccaagcuggagaaacagcagcaggaccugaaagcaggucagagagccuccggggugugugcgcaugugcgugcauguguacgugugcgguguguguaguguguacgugugcgguguguguagugugcacgugugcgugcgugcgugugugugccugcaagcauguguaucugugucucucuccguauguguggugugauaugucauggaucugugugugguguguagugugguguauauguguguguuguguguguaugcaugugugguggugugugugagaugagucugugugugugcgguaugguauauguguguguacgcaugugauguguguggugugucucuugguguguuugugugugugugauggaucugugugugguguggucuaugugugguguacaugucuguggugugugugugguauggugugugguguggucuaugcaugguguacgugucuguggguguauaugcuuccccagccacaggcuggagccuagcagguggggaccacaccugccggcagcacuuucagccugucuguccuagaucacgaugcccugcucuuccaucugaagcacuuccccguggaccugcgcuucguggccugccagauggagcuccuccacagcaacgguagggguggggccgucuccaggcccagugugccugccccuccggcuggaucucaucucccugcccccuguccccucaggcucccaaaggaccugcugccccgucaacuggguggagcaccaaggcagcugcuacugguucucucacuccgggaaggccugggcugaggcggagaaguacugccagcuggagaacgcacaccugguggucaucaacuccugggaggagcaggugaggccacgcuucccacaggcaggaggaagcccuuggaaggccugcucugggaggcuggaucaggcuuauuuuauccauuuuuuuuuuuuuuuugagauggagucucgcucugucgcccaagcuggagugcaguggcacgaucucggcucacugcaagcuccgccuucuggguucacgccauucuccugccucggccucccaaagugcugggauuacaggcacgugccaccaugcccggcuaauuuuuuuguauuuuuaguagagacgggguuucaccgucuuagccaggcuggucuggaacuccugaccucaugauccgcccaccuccgccucccaaaguggugggauuacaggcgugaaccaccgcgucuggcugaacuucaaaguauuuuaaugccacaguaguuaagccauaugauacaggggccagaauauauguauuguuugcauuacaucaggcucuguuaguacuuuacagcauacugugaguacgaacauauuuugcuuuacugaucagguugaacuugccaacauuucaucaguuuugaccuauaaaaaugucaguuucaugcaguucaaccuaagaucucagugcucugugauuuggcacacaauaagcucaugaccacuacaacuucgugguggacggugcuuucgucacuaugaagccaacgugugucccaguuaaugcuuuuugccuugaauuuaucugauauauaaauaccacgguccuugauuuuuuugucacuugcauuugcuugcuguaucucuguccauccuuuuguuucuuaccuuuuugaaucucuguuuuaaauuaaugauucucagucuugacuguacauugcaaucucuucaagaguuaaaaaaaauauaucgacuccuggaucucgcccuuaaaaaugcugauuuaggccgggugcaguggcucacgccuguaaucccagcacuuugggaggccgaggugggcggaucaugaagucaggaguucgagaccagccuggccaaaauggugaaacccuaucuguacuaaacauacaaaaauuagccgggcaugguggcgggugccuguaaucccagcuacucaggaggcugaggcaggagaaucacuugaacccgggaggcagagguuguggugagcugagacugcgccauuauacuccagcccgggugacagugcgagacucugacucaaaaaaaaaaaaaaaugcuaauuuaaauuaaucuuggcuucauccuggaccauucccugaggggcagcacagggcagcuaagcuuaagguauuucuccuauauagguuuuuuguuuuguuuuguuuuugauacaagaucuggcucuaucgcccagguuggagugcaguggcaugaucucagcucacuguaaccugugccucccgggcucaacggauucucccaccucagccucccaaguagcugggacuacaggugcacaccaccauaccuggguaguuuuuugcauuuuuaguagaaaugguguugugccauguugcccaggcuggucuugaaccccuggccucaagcgauucgcccgccugggccucccaaaauauugggauuacaggugucugagccacuguaauccaaaaacugcaccuggcagguuuuguuuuugauguuuaaaaaucuaauaaguaccuuuucuuuuaauaggugagugucucauuuacauucuaauagauauguuuaacccuaguccuuucuuuuuucugcuuuacaugcuucuuaauuuucuuacaauugcuaugugagagguguucuuuuuguuuucuucuuuaugguauuuuggaaacuauguaguuuauuuagaguuauuccagugauuacuuguauaacuuuaaauaauaggcugaaaauuauuggcuuugaaaacuaaaaguuuguauaacuuccauaggaaaggugaggagaccaggauaccucuuauucccaugugucugagucuuuccuuuccuagguuccuuaaguguuguaucugaaaaaaaaaaaaaauuuuuuuuuuuuuugagauggagucuugcucugucgcccaggcuggagugcaauggcgcgaucuuggcucacugcaaccucugccucccagguucaagcaauucuccugucuuaguaucccgaguagcugagauuacaggcacccgccaucgugccuggcuaacuuuuauauuuuuuaguagagacaggguuucaccauguuggucaggcuggucuugaacuccugaccucgugauccgcccgccuuggccuccugaagugcugggauuacaggugugagccaccacgcccggccccucaaguguuuuaucugaaauuuuuuguuuauuuuuauuuuuugaaauggagacuugcucuuucgcccaggcuggagugcagugacacgaucucgacucauugcaagcucugccucccgguucaagcaauucuccugccucagucucccgaguagcuaggauuacaggugccugccaccaugccuggcuaauauuuauauuuuuaguagagacaagguuucaccauguuggccaggcuggucuugaacuccugaccucaggugauccucccgccuggccuucccaaagugcuaggauuacaggcaugagccacuacgccuggcuuuuuuuuuuuuuuuuuuuuuuaagacagaguuuugcucuuuuugaccaggcuggagugcaauggcacgaucuuggcucacuacaaccuccgccucccagguucaagcgauucuccugccucagccucccaaguagcugggauuacaggcaugcgccaacacgccuggcuaauuuuguauuuuuaguggagaugagguuucuccguguuggucaggcuggucuccaauucccgaucucaggugauucaccugccuuggccucccauagugcugggauuacaggcgugagccaccacaccugggcuuuuuuuuuuaguauguagcucaaacuuuucauuuccuuuccuuaucauguucucuuuuuuuuuuauaucuucuuucauguuuuaugucauucuuuuuaaaauuuuugaagcauguaaagaaacuguucuugggagcggggagggagagcauuaggagauauaccuaauguuaaaugacgaguuaaugggugcagcacaccaacauggcacauguauacauauguaacaaaccugcacguugugcacauguacccuaaaacuuaaaguauaauaauaauaaaaaagaaacuguucuccaacauccccucauauuccgaaacaaggcuucuuuucaaagucuauuuuucaccucucuuuuugauaucacaguucauuuuucaucugccucaucuuccucuuucuuuuugggggcauaaguuccaugaugauuuucuccauuacuuuugugaaugggcacagugcuuucuuuccuaugguucacccaggaaagggggaaugaauucucccggacugucuucucugaucaucuggcaugauuugauuccuccucucagucuuuaacacggcgggcuggauacugcuaauuuguagucugcucaguuguucuguuucucguggugaugggagggagggcuggcagcagguagcagcacauaguguguguugucuccaggcacuuucucuccaacuccguugacuccucugaauuuggggagcagccucaccugccucugagggcugccccuucaugcaugggacuuuguccuauuugugggauuccagaauuuagggaugccccaguuucugaugcucaaucggaagaggugaauaacugcaaccuuaguuguuuuucuagagagugagaguagaauuaggcaauuguccuucaaauacuguuggaaggaaaauuccaggcugucaaagggaauuguuaagugugcacguugcucaacggauccaucccucuccacuuucuccacaaaaccaggugaccacaccuuccccuccuacccuaccgaaccacgggaccuagguccccaggaacagcuguauguguaagagaaagccacuuggaggggcuaccgugcugggagugugggugcgcgugggucccggggagcuaucugcaggcucgaaguccacuuucacccaagccccuggcaacuggcuguccgggcugcuuccucacaccccggugucuuccuauuuugccccgauugucagacuccacguagcuagaucauaauggggcccugggcaguggguccaagcuuagaagcucccgggccugacagaucucaggaaaugacagcuacacauagaagcgagagcuaccaggggccaauguacuugagaggccagugaaacugagaucuucagugggucuggggucuggggggcaguaagagcagggaccagggucgggaucccaggaguucgaggcugugggcagaagacagggagagaaccggaacuuggguagagccauaagcugggaaugaagggggacaccggcccagggcugugaacaggggacaguggccacuaacucagguacaggauuggcucucuggcucugcaacucccugcaaaauguggucacugcagugcccaucuuagagagcuucugaggauuaaaugagaucaucuuugcacagacagcacgaagucuagccuagcaaaugugcacugaacaguagcuagagugacggaagaaaaagcuaggaagcagucuugucgggagcuggugcuucagccugagggcagaucaggcuggggaaggcugagaggggccacaguuccaugccugcauggagggaggagaaaggcacaagagacuagaaauuuccuguuugccuguguuuccagaaauucauuguacaacacacgaaccccuucaauaccuggauaggucucacggacagugauggcucuuggaaauggguggauggcacagacuauaggcacaacuacaaguaaguggccucuucccucaucuccuuguuagauuucucuggggacagcccccuggccuuucacuccaagcuacccugacucgucccucagggaccaaauuccccaauccucuccuccccagacuccaaccccuccaaagcugugcucuucugggcugggggugaggguugcugggacugggcauaggaaacaucuuucucugcgguuggguucuccccagacuggguagcagggcacaccccagcuccacucucggccuucaaggaaaauggucaugaagaggaggaggauggguaagucgcuuucucaccaccguggcagaguccgaguuuucucuugccuccuuaggaacugggcugucacucagccagauaauuggcacgggcacgagcuggguggaagugaagacuguguugaaguccagccggauggccgcuggaacgaugacuucugccugcagguguaccgcugggugugugagaaaaggcggaaugccaccggcgagguggccugaccccagcacaccucuggcuaacccauaccccacaccugcccagcucuggcuucucuguugaggauuuugaggaaaggaagaaacacugagacagggguauggggaagagcugagcaaagagagaaaggagguaguuuaagagucccugacccuggaggacugagaucccaccuccuucuguaauucauuguaauuauuauaaucgucagccucuucaauggcguaggaaagaagaaacaaaugcuugaaucuc

SEQ ID NO: 192263 - RNA, 33714 nt, Homo sapiens
auuggccgaaacagugaguggacggccgcggauuggcugugcucagcggcgggcugagcaacuggagugaggggagcaguugggccaagauggcggccgccgagggaccggugggcgacggcgagcuguggcagaccuggcuuccuaaccacgucguguucuugcggcuccgggagggacugaaaaaccagaguccaaccgaagcugagaaaccagcuucuucgucguugccuucgucgccgccgccgcaguugcugacgagaaacguggucuuuggccucggcggagagcuuuuccugugggacggagaagacagcuccuucuuagucguucgccuucggggccccagcggcggcggcgaagagcccgcccugucccaguaccagguaaugccaggccgaucuuggaagugacccucaccgggaucggaaccagucuuuuuuguuccuugcuccucuuggcuguuuuucaucuuguggcaggcguuccagcggauugacuccgacgcugccauacgcggucgcggggacucaggcucucucgaugcuuacggccuggaggccugggaggaaggaaagggucauugaauauucaauaaaaauacuagugacggaugagugcucuggagaaaaacaaagcgggcuaaagggguugagaacgagugggcggaguugcuauuuuuaguuucgucgagagaaaccuguuuccugaugugacgcuuauaauagguuagaucguaacuuucucuugcguugugcacagcaagucagguugcagguuucaaagcaccacgcuucaugcuugacauggaggaggaagucucuguuaauucuuacccccguaacgcccgcuuuagaaaauaaagccauacccaaaauggggauuuuuguuuuugauuagccgacagcaugugaaaaugggugugauccagaaaguauuacacacuugccguggucaaauauugguuuauggaaauguuuauuuguaauacacagauucucuuaaagaugaaaaagagcuugguacucauucuaagguaugacaucuguugugugcccgguccaauucuuguuaccgagaagugauuuaauuuuaauaagacgcuagcaaugcuucugcaguuuugaaaauagggcaggagucuacagucuacuuauuuacccaauuucaguuaaaaagaauuaugaaggccgggcgcgguggcucacgccugcagucccaacacugggaggcagaggcagguggaucaccugaagucaggaauucgagaccagccuggccaacauggugaaaccccgucucuacuaaaaauacaaaaauuagccagguguaguggcgcgcccuuguaaucccagcuacucaggugccugaggcaggagaaucgcuugaaccugggaggaggagguugcagugagcugagaucacgccccugcacuacagccugggcaacagagcaagacugugucucaaaaaauaauaauaauuaccaaaugugcagcacgcaguauucuaauaacauucuauacugcuguguagcauuugacauaaucauaacuuaauuauuuauaauuauuuugugucuuuuuuuuuuuuuugagauggaguuucgcucuuguugcccaggcuggagugcaauggcgccaucucggcucaccgcaaccuccaccuuccaguuucaagcgauucuucugccucagccccccccgcgaguagcugggauuacagguaucugccaccacgcccgacuaauuuuuguguuuuuaguagagacgggguuucgccauguuggccaggcuggucuugaacuccugaccucgugaucugcuggcuuuggccucccaaaguguugggauuacaggcgugagccacugcgcccggcuguuuuuguuuuguuuuguuuugaggcaggaucucgcucuguugcccaggcuggagugcaguggugcaaucucagcuaacugcaaccuccaccucauggauucaagcgauucuccugccucagccucuugaguaguugggauuacaggcccacuccaccguacccggcuacuuuuuguauuuuuaguggagacgggguuucaccauguuaaccaggcugaucuggaacuccuggccucaggugauccacccgucuuggccucccaaagugcuggcauuucagccgugagccauggcacucugccucugucuucuuuucuagacuguaagcuccaaggcaggggcugggucugcccuugucauuuuuuaaaaacguauuuuauuuuuuauuuuugaaauggggucuuucucuguugcccaggcuggagugcaguggugugaucacggcucauuggagccucuacugucaggggucgagugauccucccaccucagcgccuggaaguagcugggacuacaggcaugugccaccacgccuggcuauuuacuuauuuuuguauguccagcauacagaaaugcuggagugcccagaauuuauaagcuuucaguaaauauuggugacuaucucaauaaccuucacuccuccaaaaucucaaaaccuuagagauggggaagaaagcagcuuaucaugaguuguaacuuuggauguuaaaagcaagcaugaguaagcugggugugguagcuguagccuauaaucagcacuuuaggaggccaagguggaggcagguggaucuugugagcacgggaacagguguucagaccagccugggcaacaugacgaaacccccaucucuacaaaaaaaaccuuuuuaauuagcugggagugauggugcacaccuguagucccagcuccucuggaagcugagguggggaggacacuugaacccccauaguaaagucugcagugggcugccacugcacuccagccugggugacagcaagacucugucucaaaaaaaaaaaaaaaaauuugugaguuaaugguacaagugugaguacuuauccagaguuuuauuauccuauaauuguaguaaacuaaguauuacugugauuucaaguaacugccaccuauauuuaaauuaaaauuaacuauguugacugguuugcucuaauuuucagagauugcuuugcauaaauccaccccuguuugaaaucuaucaagucuuguuaagcccaacacaacaucauguagcacuuauaggaauaaaaggacuuaugguauuagaauuaccuaaaagaugggggaagaauucugaauuugaagguggaaaaucaacagugaauuguagguaaguuguauacuauuuaucuguauaauuuauuauauauacagaaaauuguucaagacuagugguucuuaagcauguuuaguauacuacucuuaaaacauuaaaacacuccucguggucugcagacuggcuucuguguuaucaauguucauaguauauguguaauugauuguacuuuauucugccugaaguaccacguugcugucucauuugaggcuaggccauucuuucgauuagguagaaguaagauuuuguaaaaccaguuaucugucagccagaaguuugccagaaguguaaguauuuuauguguguguguguguguguauguguguauauauauauauacuuuuuuuuuuuuuuuuuuuuuugagauggagucuugcucugucacccaggcuggagugcaguggcacaaucucggcucacugcaagcuccgccuccuggauucaagcgauucuucugccucagccucccgaguaacugggauuacaggcaagcgcuaccaugcccagcuaauuuuuguauuuuuaguagagacgggguuucaccauguugaccaagcuggucuugaacuccugaccucaagugauccacccaccuuagccucccaaagugccgggguuauaggugugagccaccgcaccuggccuauuuuuauauaauuucuuuuucaacaaauccagaaaagugaaucugaaagaucuacugaaaagaguacagaugcuuuucaacuuacgauuggguuaugucccgauaaacccaguguaaguugaaaauggauuuauugcugacaacacagcagaggauccccgauuuaggaugguucaacguaggauuuuucaacauuaugauggguaaccccaucauaagucguaaggagcuccucaguuuauguuggcuuauguacugguaaacccauuguaaaguuggggaucaucuguauaagguagaaacugcuuuuagcuccgcaacuuauaaguugaguccccuuaaacuguuuaccuucuaaaucuguuuccucauuuuaaaaauaggauugauaauaucugcccuuguaauuuccuuacaggguuaguaaaaagaucaaaugagauacuauaucugaaaacacuuguacuguauaaauauguaucaauccuaagucaaaccauccuaaaauguauauauacguaugaaauaugcuauaauuuggagccaggcacgauggcucacaccuguaaucccagcacuuugggaggccgaggcagguggaucaccugagcucaggagcuugagaccacccugggcaacauggugaaaccucauuucuacuaaaauacaaaaaauaaguggggugugguggcacacgccuguagucccagcuacucaggagguuaaggcacaaguauugauuaaauccaggaggcggagguugcagugagcaaagaucacgccacugcacuccagcuugggccacagagugagacuucaucucaaauaaauaaacaaauaaaauuuaaauaaauaauuuaaauuauuaaaauaaauaaauuauuuauuuauuuugagacagagucuggcucuguagcccaagcuggagugcaguggcgugaucucagcucacugcaaccuccucagcccgggcuggagugcaguggcacaagcucagcucacugcagccuccaccuccuggguuccagcgauucuucugccucagccucacggguaacggguuacaggcaugugccaccacacuugccuaauucuuguauuuuuaguggagacgggguuuuaccauguuggccaggcuggucucaaacuccugaccucaggugauccaccugccuuggccucccaaagugcuaagauaggcgugagccauugcgcccagccagugugcuauaauuuagaagauauuuuuauuucaauucuuugauauugauugaauagaugccuugaauguccucucagcaugauuucagggaaauaaaucugaaggaaagagaaucaaagaguguuaaaauagaaauuucuucagggccuggcgugguggcucaugccuguaaucccagcacuuugcgaggccgaggugggcagaucaccugaggucgggaguuugagaccagccugaccaacauggagaaacccccucucuacugaaaauacaaaguucgcugggcgagguggcaggugccuguaaucccagcuacuugaaagacugaggcaggagaaucacuugaaccugggaggcggagguugcagugagccgagauugugccguuacacuccagccugggcaacaagagagaaacuccaucugcaaaaaaaagaaguuccuuuagaagauuuucauccaaguuguacaaaauguuuuggaaaauuauuaucuuuauuuuaguaccacuccaguugcggagagauuuuucaccaguuccaccucucugacucuaaagcaugcugcaugguauccaagugaaauccuggauccccacguagugcuguuaacaucagacaacguaaucagguaaauuuuauuucucucucuugaagccuugcgagugggaaagcucuguuucuguuugccaauuaacagcucaacauagaacgaagugagucauugaaugagucagugcuuuuauuggauggcuguuguaacccauucucaaucauaagaauugccuaacugcucuaacuuaccacuauuccuucucaacuagucuuccugccuccagguaucuccucuccuaaucugacaccuuagaauaaucuuuccaaaacucuuucaucauugucacccuuuugguaauaauguagcauaaaggaaagagaauguaaguguaaauuuagagauuugaauuauugucccaccuccuuuucuguuaucuuugagaucuugagcuuuuuagggguuggggggcucaguuuccaaucuuuuaaauugagcagguuugauucaauaguuucuaacgccccuuccaagcuuugcacucuaugauuaaaugcccuaaugcuacguagauuucuacucuauuaucagcuaacuuucuggaucggccuuauguaaaaaguuauuggggggacucagcagagguacagauaccuucaguuuuauuuuucguaaucacugcuuuuaacugugcucuacuaaaucuuccuucacugcugaaugacucaccccuuaaugaugucuuauacagauccccauagcuuucucguuacuucuaguuaugaaaacaguguguccaguuuaaaacucaucuuggcugguugcaguggcucacaccuguaaucccagcacuuugggaggccgaggugggaggaucauuugagccccugaguucgagaccaaugugggcaauacagugagauccugucucugcaaaaaaaauuagcugggcauaauggcaugugccgguagucccagcuacucaggagacugagguaggaagauugcagccugggugacagaguaaaacccugucuaaagaaaauaagaaugucgaaagcuauuugaucucaaaucuuucacaacuauguccuggcccuuuuguaggucagaccuguguuuugugggaucagaagugauuggagagugugcggucugcucuuucacucuuccuguuaucccagcacuuuggaacauagggugaaguguaaggaaugggcugcccccuccuuccuccaaaucuaacuccuucagugugggguaggggagugggacaggugagguagagaucuuaccgaacugguagccugugagugauggggaaguaugccugaucuuguuugaaucucguuccaucugucacuagugaacucuguugaugugguagucucugcauagaugguguguuuguguguguguauguggggggguggggugguguuggagggcaguguugaacuuccagcuccccccaucacugaggagcucuggcucccauuggcuccugucaguucucuaugcccugaaucuucucucaagaugggguacaguauacuuuaucugcaggguguguguuccaagaccccccagugaaugccugaaacuguagauaguacugaacgugauacguguguauugcuauguuuuuucgaucuuauaacugagacagcuacuaagugacuaaggggcauucagcuaggaaaugcaccagucucccuuauuacagguaccuccacaucuggcuguuuccuagagccuucccugcccacccauuuggcuuuagaguucagggcagagaaagaggagagggaaaaucuucccauuacaaacauuauacuguacuccuaaggaaucuuugacauccucucuucuuagucuuccuuuuauaugcuaugauggaaaaggagauggugggaagauagcauagguacaguucuuaagccccaaaggaaguaucuggccccaaauauugaagguucuuuuuuaaaauaugugguauuuaacacuucuguuuuccuaagcuuuggagauuuugggcaguuucagagcaaaaggaaauuuucaccgaaugcccuguugcaccuucuuuuucuuucacuguuccccaguacaacauuauugccuaguauuuauguguauuuugaaguuaguaacgcuuguaggaaccuaggaagacuguaauaaauguguauucaaauggaucaaguuaucauuaaaaauuuauuaaauacuuaauguggcauuuuauugauauuggaagaaaccaaguuaaaaaauucuuaguggcgucagacaaaauaagugauuauaagggacacuggauuucuaaaaugacauuacuggccuuuugaaaauucccuuuuucacaauagccuuauaugcugugaaauguagguuacuuuaaauuaaaauaauuuugguuaaaaaaauucaguauuauacuuucccuugaaaauagagaugauacgauacuggguuuguuuguuugguuuuuuuuuuuuuuuuugaaauggagucucgcucugucgcccaggcuggagugcaguggcgugaucuuggcucacuccagccuccagcucaccgcaaccuccaccucccagguucaagugauucuccugccucagccucccgaguagcugggauuacaggugugugccaccacacccaaauaauuuuuguauuuuuaguagagacgggguuucaucauguuggccaggcuggucacgaacuccugaccucaagugaucugcucaccucggccucccaaagugcuaggauuacaggugugagccaccgugcuuggccaauauuggguuuuuauauaacaaacacauaaguagauuugcaggcuaaauaucacucacucugucagccaguuggcauauaaagaauaagauacaguucuuucucuggugggauuugguguccaauaggcagagauagauguguguaguugaaggaaaacuggcaagcuuaggggcaauagugagaugacuggacaaggcgaguauagcuaagggcucaggacggaagugacagaggugcgauguuauggaauaggcuguuaaaggguauugguaaggauagagaacauuucuucaggccccaaugaaacucccuuauguaguuaaagaauaaaugaacuagacuacuuugcaacagcaagauuuuugcaaagaaauaguugugauaaguguuagaaaauucucaagaacugacuagauggagaggaaagugcaguuuugggaaaugaaaacagaauuuuaagugcugguuuucuucucuuuugguugcuagaauuuacucacuacgugagccgcagacacccacuaacgugauaauacuuucagaagccgaagaggaaagucuaguacucaauaaaggguaaguuuuuauuugagucuugaaaugguuuuuuaauuagcuuauugggauuauaaaugcaauuuuaacagguugcaagguuuuucagaggugacuagcaugcuuuugguaaugugagaaguaaguguauuuuuaguagaacagggauucgucguguuggccaggcuggucuggaacuccuaggcucaagugauccugcucgucucagccuccccaaagugcuggaauuacaggccugagccaccauucauuucuuuaucaccuuucuaugugauaaagaaacuaagauaauaucuugcauugauguuugcucucucaacuauaugaaauugugauuucauuuuaaccauauuuguuaacuuuguauugaacuagaaucuuccugaauaacuacaguaaauuuuaaauauaaaaacagcaugguuuuaugauuugccuucuugauauacauguaauguauauuugcuguagaaaauugagaaaaauagaucaaaguauuaggaagaaaaugaaaaucuuuguaaucuccuauagcuauagccuguuucaauacagcacccaaaguuuaaucacaucauucuacuuuaaucuaaguuuaaucagaucaguuuaaucagaucauucuacuucccugcucuccauaccccauugauuucccagagucuuuaccuauaaaggguccacagguaugccaccugauugccuuuccagcuucauuccucccucugugcccuggcucucugggcuccaggcaccuuggccuccuugccauuccacagacauuaagcacuucuaccuuagagcauuugcucuccaccucaacugcuccuucccuaguuaaccacagacuugcucucuuacuuccuucagaucuuugcucaaauaucuuaucagagucuuuccuauaccaaguagucuaaaguagcaccuccaucaauacccucuuacccuacuuuauuuuucaugauauuuucugaguuuauguuccaucuuuauuucuucucuuuuugugguauuucucucucuagagggcaggacauuuguuuaauucacugacauauucccagacccuagaaaaguaccuggcacagaguaggugcuuugcgaguauuuguagaacuuacggauccugcugcucagagacaacuguugauguuuucauguguuuuccuguuuccuuuuugcauuuauguguguguauauaauaaauuuuugcuauuuguauaucuguguauuuaaacuauuuaagaugagaguagaaccaaauaauuuuauggccagcuuuuuucacuuaauuucaugagaauuuuuuuuuuuuuuuuuuuuuugagacggaguuucgcucuugucgcccaggcuggagugcaauggcacaaucucggcucacugcaaccuccgccucccagguucaagcaauucuccugccuuagccucccaaguagcugggacuacaggcaccugccaccacgcccaacuaauuuuuguauuuuuaguagaaacgggguuucaccauguuggccaggcuggucucgaacuccugaccucaggugauccacccaccucggccucccaaauugcugggauuacaggcaugagccacugcacccagcugagaauuuuuaaauguuaacauucuucauaaucauuuuuugucuuuucaguccauugccuacaaauuccauacauacccaccuccuguuauuagacauuuuguguuuuuguuuuguuuuguuuuucuuuuuacuuuuuguuguuuuuguuuuuaacaaguugguuuuuacaucucuuuccagaagggcguauaccgcaucucuaggagagacagcaguugcauuugacuuugggccauuggcagcagucccaaagacucuauuuggacaaaacggcaaagaugaaguaguggcauacccacuguacaucuuauaugaaaauggagagacuuuccugacauacaucagucuguuacacagguaaguugagguggucacccaccugaaaugaaaacucaguuugggcuccaguagauaucauugaggcuggacuugggagccauguuuuugagucuguggaaauguugcagccuucacaugcuuggcuugcauauuuuugagaaagaguuaguacaggucauuuggccuuucauuucuucauauuauuuggguaaguucuauagaauucuuggauaaucacuuaugauaggccuggauuuguguucacaaauucuaguuauccgaacaagugcuuauuguuuaucuuauaugaacaagacaccacguaggcgugguaaucugguaucuuaugucccaguuguggggagaaagauacauacacaugaaaaaauacuauccauaccacaguauugguacacagacaguaagaaccccgaggaaggagagaucauucugacugggagguuaaggaaauuuucguagagaaggaguggugucaugugugacuuaaaggucucauucaggauuaaaugaaguaucaaggaagagugagaccauuucugucaagggcagcauaaaguagcgucugaaaauaagcaagugcaagugucauucaagcuuaauuuauuagacauucugggcuagagcugaggauucauguagggagcauuaagugauaaagcuggaguaucugucccgagaaaauuugcuggaauuaaaaauaccucguuaaaagagugaguguggguuuuuuuucuguaggaauaggguaguaggaagccagugaugguuucugaacagaaggacaaaacaauugguuagggaggggacugggacagagacuuuuaaagaagcuuuugcaaaauugagcuugucauuuaugagaguuugaacuugggugguaauagaacagagggaaaaaugaaacacaguagauaacaacaaaggaaggauaaauaagacuuaguuacuguuuggauaagggaguaugccaugaacagaaacaggucaguaaaggcugcuaauugggggagaagauuuauuucuaaguaaaucaguguaagauaguauuggaccaauaaaauggaaauauuccauggacaguuggaaauacaggaugaugacagacaagaagaauuaaaauagagguaugagaaucaucuuucauggugagagagucuauacaggauaagaauuugagggaaaacugcagaggcauaaggcuaagggcugagcauuagaguuuauucgcuuguaaaucgacuuaacagauacuuauucaggacccacucuggcagaagauggaaauacaagauugaaggcaagguuccugccaugugguuccuuaacuaccagaagggcauacaacuaaaccaguaacuauaguacagugucaugugcucagggcaucaccggguucuucaggagugugauggaguaaaugaguaggccugcucaucuuggaagacuuuaaggaaaugcuauuacaaaagcuugaacuugaaggauucacuagacagaaucagaaguggguacaggagagagaagagaguacgcaaaaccauaaagauuagaaagaugaaagagcucgguagguuacagaauggugaggauucacuguugagugcauucuccuuggcagaaauguucucugccuuucacacaugaucucaggaggauuuugugguaacuuuaguaccuucccuuacccuuucuccucuugcugcugagcccucauuuguccaaaccaugaucugccuaguaacguuagcccaaaacccaaaaguuuucuucauccuuacauuucaucagucccaaauuucuauugauuuugugauuuaaauuuuucgaaaguauacaccaagcuuguccaacccacgggcugcgcgcagcccaggacagccuugaaugcagcccaacgcaaauuuguaaacuuucuuagaacauuaugauauuuguuugcgauuuucuuuucuuuucuuuuuuuuuuaaagcucaucacguauuguuaguguauuuucuguguggcccaaaacaauuguuccaguguggcccagggaagccaaaagauuggacaccccugauuauacacccuucucugcauuccucugucccugcuucagaacugcaucaucugccuacuucaccaucugccuggcuuauuuucuuaaauaguuuccccaaaucccauuuuggacccuuccaugucuuccucccuaauaccagacugauuuguaaagugaggcuccaucgcuugauuuaaaccucuagugauauacuguuacccggcagauagauuucaaauaguuuaacauagcacacaagacuguguacuucauaagccaguccuggaugucugucuagcuauuuugccguugccuuccaccuuguacuuugccucccaucauacuaaauaaguuuucuuguucuuaguucuuugucuuucauguuuccaggacuuugcauaaacugaucucuagcuuggaaugcucaacaauccccuucccagaaaucauucuuucucauuuuucucauuuauuuuuuauagcuuucuucauuaucuuuguaucuuuuugucauuccuuuguacaccauaaauccuucuguuguugcacuuaucacaugguauaguaauucugguuaaaugucugccucaucaacuaaaccaucauucacugggaguaucaucuagcacucaauaauaaguauuugucaaaucaaauuuaauauggggauccaaagccuugaagagaagcuacauuuuagaagaaaggauuugguagucuuugaauauagaugguaguuaaaacgaggcauaguuuaacaggcucucauuuaaguguguauuuugaaaaaagucaaagcauacaacagaauccuggagaacaccaauauuuaagagacagaaauuagaaaaggacguuagaaaauuguguuuaaagagguaggaagagagaacuacaagaaagaauuguuacagcuguugaguagcaguagucguuaaccagugauaaaugcagcagaagguuaagugcauuuuggauuuagcaaaucucacaggugaccuuugccacaguagcuucaguggaguggugaaagcauaaaccauaguaaauuuagggcaaggguuuucaaccuuuguacuauugacauuuuggucugaauuauuguuuguuuuagaggugcugugcugugcgggaauguuuagcggcuucugucuagccucuaaccacuagaugcuaauaccuccccccacauugugacaaccaguugugacaagccaaaaugucuucagacauugccacuguccgcuagggcaaaauuaucucugguugagaaacacagaguggugggaucugagugggaaagcgagaagauggaguauugggaauacacuacauuuauaaugaagguaugauagcuggaggaaaacaaagucaaagaaugguuuuaugggaugagcaugcauacugucaacauuucccaaauauguuuuuacuccuucuuuagcccuggaaauauuggaaagcuguuggguccauugcccaugcauccugcggcugaagauaacuaugguuaugaugcgugugcuguacucugcuuacccuguguccccaauaucuuagugaucgcuacugaaucaggaaugcuguaucacugugucgugcuagaaggggaagaagaagaugaccacacgguaagugcaggcugcugugguuguuuguaucuucaacaccuggcauaguuccugacccaauaugaaugcuuaauauaugagaaggaauuuuaacuuacuuauggaacuucugauauuuuggaaauuaaacaguuaaaaaaguagcugaagcacacuuagcagucuaaguggaaagaaguuagaagguugcccaacuuacuugguccaccagucugcauguuacuuucuggucucuauauugcaaucuucagggacagauacaaagagccuuggaaucacugaauuggcuuuuuucacaaacaucuuccuaaaggaagagagacguuuugucuucagaauaacagugcacuguuaggauagagguggaauuaagaauuugaaaguacuguuugacccagcuuuuuuuucaauuuuuuuauuuauuuuuuauuauuauuuuuuggagacagaguuucgcucuuggugcccaggcuggagugcaauggugugaucucggcucacugcaaccucugccuccugaguucaagcgauucucuugcgucagccuccccaguagcugggauuacaggcacccaccaccacgcccggcugauuucuuguacuuuuaguagagacaggguuucaguauguuggccaggcuggucucgaacuccugaccucagaugauccaccugccucggccucccaaagugcugggauuacaggcaagaacagccgcacccggcccugacccagcuuuuugccuguuuuuaauuguguacauuuucaaauuaacaugcaagaucaaaauuacaacacuuuuuuuuacagucagaaaaguccugggauuccaggauugaccucauuccuucucuguauguguuugaauguguugaguuggagcuugcuuugaaacuggcaucuggagaggaugacccuuuugauucugacuuuucuuguccagucaaacuucauagagguaagcucuucaauaaauguagugcuuuuuucccaugauuuuuauacuaagacuaucauagacuguuccuauguaauguauuuguucugugguuccagccuuuaaaaaguugacuggguuuuuuuuagcuuuuuagucacuauaguacacuuuuugucuaaggcagacugagcaaauuucccaaguuuuaaaauaguggucuuugguccagaucaccagauuccuaauagugaauuuuuccugguccuuucaaaaguagaacuaccauguuauucaguaguuccacuacuggguaugucaaaaggaaaggaaauaauagguugaagggauaccuacacucccaugcccauugcaguguuauucacaacagcuaagaugcugaaucaaccuguguccaucgacagaccaaauggauuuuguuguuguuguuguuguuguugagauggugucuggcucugucacccaggcuggagucuaauggcgcaaucucgacucacugcaaccuccaucucccagguucaagcgauuauuuugccucagccucccaaguagcuggauugcagguacccaccaccaugccuggcuaauuuuuauauuuuuauuucauuuauucauuuauuuugagauggagucucgcucuguugcccaggcugaagugcaguggcaccaucucagcucacugcaaccuccgccuccuggguucaagcaauucuucugccucagccucccuaguagcugggacuacaggcaugugccaccacgcccugcuaauuuuuguauuuuuaguagagacgggggucucaccauauuggccaggcugguaucgaacuccugaccuugugauccgcccaccucgaccucacaaagugcugggauuccaggcgugagccacuacgccuggcaauuuuuguauuuuuaguagaggugggauuucaccauguuggccaggcuggucucaaacuccuggccucaagcaguccaccugccucggccuuccagaaguacugggauaacagaugugagccaccgcgcaccuggccccaaauggauuuuuaaaauguggcauuguauacacaguggaauaccauuuggcuuuugugugugugugugugauaugaucucacugugucaucuaggcuggaguacaguggcgugaucuuggcucacugcuuugccucccaggcucaagcaauccucucaccucagccucuggaguagcugggacuacaggugugcaccaccacgccuaauuuuuguauuuuugguagauacgggauuuugccaugucguccaagcugaaaguccugagcuccagugauccuucugccucagccucucaaagugcugguccacaggugugaaccaccaugcccagcccuauuuggcuuuaaaaaagaaugaaaucgugucauucacugcaacauaggaggauuucaaucuuguagcaguuugaccuacucuccuuacaguucuuguuagccaguuugccuaguucugguaauaacggccucaacucuguacuaaaguauaggcaaaacauuuaagggggcagaauuccuuacauaacaaaccagcaaagaguguacauuggguuugucuaauuaagguauuuugagauuuauauugucuaagaauuuuauagaugaggaaacagaccaaaugaaguaaagugacauaaacuaauugguuuccucauauagauacguauaucuuugggaaaucuuaaguguagacguggacguuuuguucuuggguuuuguuuuuuguauuuuguuuuuuguuuuuuuuuuugagauggaguuuugcuccuguugcccaagcuggagugcaauggcacgaucuuggcucacuucaaccuccgcccccuggguucaagcgauucuccugccucagccucccaaauagcugggauuauagucaugcgccaccaggccuggcuaauuuuuguauuuuuaguacagaugggguuucaccauguuggucaggcuggucucgaacuccuuaucuguccaccuuggccucccacagugcugggauuuuaggcauaaaccaccaugcccagccuuuucuugguucuucuaaugagaguaacauuuucauaugugaaacuaagaaauuuuugacuuguuccuaauugugcugaacaaggcauauuauaaucacugaggcacaccagauuucuuagugacaaagugaaauggcuacaguauagcauagggugguaucuaacaaauuuccuguuaaguaaauguuggcucuuuuuaguaaucaauuuguuuuacaccccaguguuaagacuuuucuguugauguuagcacuacagguuuugaaaagccauuuuaacaauguuagauuuaaugagaugauuugagccuuaagucuuaaaacauacgcaaaugaaaagaaaauuuucaauauuuuaauuaugcaaacagaugauucccauagaugaggguuuuuuaaacuuuuuauagcagaaugcuguuuucuaagauguuuuauggaaccucaauauauaagacagaaaaauaauauaucagcuuuagaauauuaauuuaugauaaagucacuaaccacaaagugagacuguuagauuaaaggaaaauuuaauuuagggguuuuauggguuauuguugccauuuuaucagcuuuaauauauaccuuaucucuguauuuuguuuuaguuuaauaacauuauuauuuuguguuuuuuuuugagacggaguuucgcucuuguugcccaggcuggagugcagugguacaacucggcucaccgcaaccuccaccucccagguucgagcgauucuucugccucagccucccgaguagcugggauugcaggcaugugccgccacgccuggcuaauuuuguauuuuuaguagagacgggguuucuccauguuggucagguuggucuugaacuccuggccugaggugauccgcccaccuuggccucccaaagggcugggauuacaggcgugagccaccacacccggccaauaagauuauuauuaauauuaauaauaaaaauauugaguuacagagauaaauauuuauacauaauaauagguauucaguaguuuaucuuuuagucucaggauugucuuacugauacuggggcucaaaggagguacagaaauuuuuguuucaaaaucaguuaauuaaaauuguauaacaacuacucauacuucuuaguuauaaaugauugucaaacaaaaagagcauccaaaacugaaaauaaccuuugaaacuaucuguaagucaacauuaugaagacauacgaaacuucacuucucauuucacaccuuacuacacugauagaacuguucccugagccguuguguuaaagucuuuugugauaacuaugcuguagaagugcauuugcuucaacaauuuuauuuaagucgauguaugcaagcauaagcauagguuuucuacagagcugcuauuuuaaccaccauuuucuuuugaagaacuaaauaaaugcacagagaaaagcauaaaugaguuacuugccagcaaguauuuauguuuuggugaaccucauuguguucauauuuagaaaauaacauuuggauugaguuuuuuuuuuuuuuuuuuuuuuuugagacggaguuucacucucgcccacgcuggauugcaguggcgcaaucucggcucacugcaaccuccaccucccggguucaagugauucuccugccucagccucccgaguagcugggaucacaggugcaugccaccacggccagcuaauuuuuguauuuuaguagagacggguuuucaccauguugaucaggcuggucucgaacuccugaccuugugauccucccaccucggccucccaaagugcugggauuacagacgugagccaccacacccagccauuuuuuauacuuuuuaaaacauaggcauaccuccucauuuuauugugguucacagugcuuuuuuuuuuuuuuuuuaacaaaugaaagauguggcaacccugcaucaagcaagucuaucggcaccauuuuucaaacagcacgugcugucucugugucagcauuuuuuagcaauaaaaaaugguuaagguauguacauauuuuuugacguaacacuauugcguaccuacuaguauaaacauaacuuucugcauaguguaaacauaacguucuuauguacugggagaccaaaagauuugugugacucacuuuauuucuguauucgcuuuauugcaauggucuggaaccaaacccacaguaucucugagguauaucuguacuuaaaauauauuugaaauuugaauucaaauuuuaaaauuucaaaaccccuaacaauaugaaagucuuuuauaaaaccuuccaucaacaaaugcguuuguaggcuaauguggaguagccaacaaauuugagguaaauuuuuuuaguuauccacuggcuaccuuuguaucauuaaucauuccauuugcagaucccaaguguccuucaagauaucacuguacucaugaagcugguguacauaguguugggcuaacuuggauucauaaacuucacaaauuucuuggaucaggugaguuuacuaacucucugcacuuuuaauagauuucagaggaaaaauagauuuaauagauuucagaaaaguaguuuggaauagaaaaaugauagagaaaaucagugaaaccgaaagguucuuugaaaagaucaaccacauuucacaagccuuuagcuagacuaacuauaaucaagaauaaaagcagggauauuacuauugaccuuacagaaauaaaagauuauaaaggaauauuaugaacaaauguaugccauuuacauaaucuagauggaauggacaaauuccaagaaaaaaaaaaacuaccaaaacugacucaaucagggucugggauaauuugcuuuaaaaaaaaaaaaaaaaaaaaggccgggugcgguggcucacgccuguagucgcagcacuuugggaggccgagguggguggaucacaaaaucaggagauugagaccauccuggcuaacauggugaaaccccaucucuacuaaaaauacaaaaauaaauucuccgggcgugguggcgggcgccuguagucccagcuacucgggagacugaggcaggagaauggugugaaccugggaggcggagcuugcagugagccaagaucacgccacugcacuccagccugggcaacagagcgagacuccgucucaaaaaaaaaaaaaaaaggcugggugcaguggcucaugccuuuaaucccagcacuuugggaggccaaggcgggcggaucaugaggucaagagauugagaccauccuggccaaccaacauggugaaacccugucucuacuuaaaauacaaaaauuagcugggugugguggcacacaccuguagucccagcuacucggaaggcugagguaggagagucgcuugaaccagggauggagguugcagugagccgaggucaugccacugcacuccagcccaggcgacagagcgagacucugucucaaaaaaaaaaaaaaguuaggccaggcacaguggcucacgccuguaaucccagcacuuugggaggccaaggcuuguggaucacccgaggucaggggaguuugcgaacagucuagucaacauggcgaaaccccgucucuacuaaaaauacaaaaauuagccaggcaugguggugugcgccuauaaucccugcuacucuggaggcugaggcaggagaaucgcuugaacccaggaggcggaguugcagugagccgauaucgugccacagcacuccagccugggugacagagcaagacuccgucucaaaacaaacaaacaaaaacugacacaaagagauugauuaguaaucaaaacuauccaaaaagaaaagcugaggaccacauggauucacauuuaaagaauuaauaccggucaggugcaguggccuacgccuauaaucccagcacuuuggaggccgaggcacuugagguuaggacuucaagaccaaccuggucaaaauggugaaacccugucucuacuaaaaaaaaaaauacaaaaauuagccaggcauaguggcggaugccuguaaucccagcuacucgggaggcugagacaggagaaucgcuugaaccugggagguagagacugcuguauucgagucgagaucacaccacugcacuccagccugggugacagagcaagacuccaucucaaaaaugaaaauaaaaaauaaauuaaaaaaaagaauuaauaccaauuauucacagagugagagcaguuaaaaaaaaucuagcagccuuucauguuaaaaauacucaacaaacuuaauagaaaggaacuuccucaaacuagugaggaaacuuuucaucuacaaaaaacuuggaaccaacacaaugcuuaaugguaaaaagacugaauccguuauuggcuuucuacugcuacuguuguaaaucaucacagacuuaguggcuuaaaacaugacaaauuuguuaucuuauaguuuuguagguuagaaguccugcaugguucucacugggcuuaaguuggcacagcaguuuuccuuucugaaagcucuaggguagaaugcauuuccuacccuuuuucagcuccugccacauuccuuggcuuguagucucuuccucuaucuucaaaggcagccagcaacagugggcuggguugaguccucauguuguaucacucuguuucacuuuuaaagaaacuugugguaacauuaagucugcccggauaauccaagguaaugucccuauuuaaaaaaaaaaaauucuuuuaagagacagagggucucacucuguugucugggugggagugcaguggugcagucauugguugcugcagucucgaacuccugggcucaagcagugcuccugccucagcccccaaaguaucugggacuacaggagugagccaccaugcccagcuaauuuuuguguuuuuuguagagaugggguuuuaccguguugcccaggcuggucucaaacucgugggcucaaaugauccacccaccucagccucccaaagugcuaggauuacaggugugauccaccgcaccuggccaucaaaauuuaaaucuuuuuucuucaagaauacuauuacaaaagggaaaacagcccacaaaaugagagaaaauauuugugugauaauggacucguauggagaacaauauaaagaacccuuagcauuugauacaguugggcaaauagcauauauauaaaaagauguacaacauuauuagucauuauggaaauaagauaccacaaaaccacaaugagguaucacgucauauccacuaguauagcuaaaaugaaaaagauggacauuaacaaguguugaggaugugggaaaaaauggggacuuuuauacagugcuuauagaaauguaaaaugguacagucuuuggaaaacaaucuggcaguuccucaaaugauuauucauagaguuaccauguaccugauaguccaguccugaguauauuuccaagagaaaugaagaccuguauccacacaaauacugguacaugaguguucacagcagcauuauucaucauagcccagaagccacauacccaaguguccauaagcugaugaauggauagauaaaauguggugugucuauacaacagaguauuauucaacaaugaaaaggaaugaaguacugauacaugcuccaauauggaugaacugugaacagaugcuaagugaaagaagccaguuacaaacaacuguauggcuguuuauaugagauguccagaauagacaaauguacagagacagaaaguagauuaguugccuaggucugggaaguuugguagaaacugaggagugauugcuaaugguuauguggguuucuuuuggggaaaugaaaauauuccaaauuguuaaugauagguauacaauuuuuuuuuuagacggaguuucacucuuguugcccaggcuggggugcaauggcaugaucuuggcucaccacaaccuccaccuccuggguucaagcgauucaccugccucagccucucgaguagcugggauuacaggugcccaccaccacguccagcuaauuuuuguguuuuuaguagagacggcgucucgcuauguuggccaggcuggucuugaacuccugaccucgggugauccacccaccuuggccuccgaaagugcugggaauuacaggcaugagccaccgcacccugccagguauacaauucuuacacuaaaaacuuacugaauuguauacuuuaauggguauacuuuaaauggaugacuuguaugguacugugaauuacguuucaaaaagcuguuacaggccaggcguggugguucacaccuguaaucccagcacuuugggaggcugaggcagguagaucaccugaguucaggaguucgagaccagucuggccaauaccgugaaacccugucuacuacuaaaaccugggcgugguggcguccaccuguagucccagcuacucaggaggcugacgcaggagaaucacuuaaacccagaagccggagguugcauugagcagagauugggccacugcgcuccagccugggcaacagagggagacuccauccaaaaaaaaauaaagcuguuauaaauugaguaucccuacucugaaaaauuugaaauccaaaacuuuucuuuuuuccauccuugaaccugagugagcuacaaaaguuuuugagugcugucaugacaacagaaaugcucauuggagcauuuaggauuuuagauuuucagauaagagauguucaacuacuaaguauaaugcacauauuccaaaauccaaaaaaaaaaugugaaauccaaaacacuucugaucccaagcauuuuggauaaaggauacucaaccuuuaugaaaauaaaaucaguguggguaagcagcacccuagaagagaaugauuucacuguucuuagugaaacauuuuugcauucagagacauuacgaaggaaaauccuacuucuuggggcggaaaucuagacccccugggaaagcguaugccuaugucagaaaagcauaguacuugagaagcaauguuuucagacaagaaccucacugcauuuaacccaauaucauuagcauuuuaauuuggagacuugucuaagcaucauuucauuuauguaaugucuuccaugguagaugaagaagauaaggauaguuuacaggaacucucuacagaacagaaaugcuuuguugaacacauccuuuguacgaagccauugcccugcagguaaggacucucccucccuuguauaucagaaaacaauuguucauuucagcaguucagauacguuuguauccguuacacucacauccacaguauucacugcugagucauuugaaaguugcagacgugauacuucuccccuaagaguguccugcucaucagaagcuuucuccucuccagggccacucgacauacuguuuccugacuggaagguccuuccccagccccagccccagccccagcuugcugucuucucuuggcuaacuccuacccuucuuucugaucuuaaugucacuucuucacagagaacacccuugacuccccagucuaacuuggggcucuccuauucucuuauccauuguagcacauauuacacuauuuauauuugcauuuuuuuaaugucugucgccacuaccggaauguauauguuucaugagagcagagacugugucugcccuucacugcauugcuguguuuauuugaugugguugcccaugucuccucuuugaaacacauucuccuuggcauccuugacgucugucccuccagguucuccuucagucccgccagcagcccuuuucucaaguuuccuucuugggcggguuccucugccucuacucacugcuuauaaguaaugcucacaacucuuuccuugggucuucucuauucuuucuagguccuuuccugaguaacuucugccguaaucauggcuucagugcugacaguucccgcauccauaucgcccuagcccagaccacucugaacuccagauucacauacccagcugccuacugggcuccuccacuuggauauccuauaggaacauaaaacuccagauguccccuuaacucaucuucugucuuuccaaaucugcucucucuccugugucccauuuuucugaagggugccauaucaccccaguuauccccaguagaaaccuggaagguauucuagauaccucccuuuauucuguucaucaauuacuagauaucucauaagcacucuguuagacauggaguauacacagacaugagacaaauagcauacacuaagaaauagacauaaucuagguuuggcaauacagaggaccacagggaaaacgcuugguggggaaugagaaggauagcaaacuguaccagcuugaaaagugaacagugaaaccaggcacuguggcuuacgccuauaaucccagcauuuugggagaucgagguggguggaucacacggucaggagugcaagaccagccuggccaagauggugaaaccccaucucugcuaaaaacuacaaaaauuagccaggcaugguggcagacaccugcaaucccagcuacucgggaggcugaggcaggagaauugcuugaacccgggcagcacagguugcagugagcugagaucaugccacugcacuccagucugggugacagagugagacuccaucucaaaaaaaaaaaaaaaaaaagaaaagugaacaaggaaaauacauaauaaaaucccauguaggcugggcaugguggcuuacaccuauaaucccagcacuuugucaggugaggcaggaggaucacuugaggccaggaguuugagaccagccugggcaacauagugagacccuuuacaaaaaaauuuaaaaauuagcuaggugaggccaggcgugguggcucacgccuguaaucccagcacuuugggaggcugaggcaggcgaauuacuaggucaggaguucgagaccagccuggccaacguggugaaaccccgucucuacuaaaauacaaaaaaaaaauuagcuggguguaguggcgggcaccuguaaucccagcuacucaggaggcugaggcaggagaaucguaugacccugggagguggaggcugcagugagccaagaucaugucacugcacuccagccugggcaacagagugagacuccgucucaaacaaaaaaaaaaauuagccacugugguagcauguaccuguggucccagcuacucaggaggcugagaaggaaggauuguuugagcccacgaggucaaggcugcagugagucgugaucgcacuauugcacuccagccucggcaacagagugagacccuaucucaaaaaaaccccaaaaucccauuuauaucaauuucagaaacagguaaaauuaaacagucuugccuaggagugaauacauagauaggaaaacuauaaagcaaagcaaagacaugauauuaugaaugucagaguagcggcuacuucucuggggagugaaaggcuaugaccagggaaggucgcaugggaacccugaggcccccugcaguguccugauucuugaccuggauacugguuacauaguguauagcccaguaguguguagauuucacacugauaauaaaaaguuaaaguuuacaaccuuccagauaucgucuccaugucuuguccaaaaagguaaaugggagcuauggaaggggaacuaguguuuucaacugcuguuuaaagacugcugguucuaaagggauggcgagaaagaauagguuaaggggaacuggacauuauauugaaaugagaguauuuuaaauggaagagacaugaguuugcaagcugaggggaaguagauaauagggagauuuugaaacgacacaguugaugguacaauuuucagaaggugugagaggaggcggcauccacauucgggggcagauguguguuguaggcaugcaggugggaugggcaugggagccgcuaggagagcauguuggcagaaugacaguucccaucugaggucucaguuuccagugucuucacugaagugggaaggaagacugagagagauacacgcugugcgugccaagugauuuccugugacauugacauugggccucauugagagagacucgguaguucuguucauucaacaguuucuaagcacuuaauuuguuagcacugggcuaggcaaacaaagauagcuggggcuuaugugcaaguuggagagaucuucaguguaacguguaacuuuugagauuacagucagcagcacgcuacaguuagggauuccugagugacuuagucacaugggcucuagacuuuaguguggagcugcauuaaagguuuccaagccaccacuuuugagguuaugguacugauaggaugucccaagcaacuucagcccaggccugagaaggccgcggaccugucaugucuuugcucuugguuccauugcauuugcugcuuuguaauuuaacuaugacuguguuuuuccaggcagccagcuccaauucgaggauuuuggauuguaccugacauucugggacccacgaugaucugcaucaccaguaccuaugaaugccucauauggccguuauuguacgucccauuuuauauucuccacacagcucuuguuaauucugcaauaucuaaguugggaaaaugcacucaguaaccaacuugaagcuauacaugugugguuuauacuuuggcuucugacuugaggguuggaaggauggauauuucuguuccugccaucaucucuauaagguuucauuguagguauaguuucuggcauccccugcaccuagcugagagucaggagcuuuucuucagaguguggagaaaaaauacuaaaauugaauaccaaauuccauuaucgauaugaguaauaauuaucaagcugugaccauacgccaagcucagaaguaagccacguacccgcacugccuccuggaaucaucagggcagcccuguaaggaaggcacugucauuuccauuuuauaaaaguggaaacggggaucgagagguuaguaaaugcugaagucacagguaacaaauagagcugggauacagaugcaggucucauugacucagaaguccauacucauacucuuuaauuucuccaucucugccagccugagggacacuguagacuauguaaacuggaauaaagcugaacucaggcugggugcaguggugguucaugccuguaaucccaaugcuuugggaggcccagaguucgagaucagccugggcaaaacagugagacccccaucucuacaaaaaacaaaaaaauuagccaggcauggugguacacaucuguaguccuagcugcucaggugagaggauugcuuaagcccaggaguuuuaggcugcagugaaccaugaucaugccacugcacuacagccuggguaacagagcaagacccugugucuuuuaaaaaaaaaaacaaaaaagcugaacucuuagucuuugcuccuuuaaggaacucagauaauuaagcuguaaucacuauguuccuuuuccaacagcccuggaagaucauucugaguuacauaaauguaggaauaugaguaccaaaaacaaaagucacuggagcuucaaacacuagacaacacccccaccccuuguccguucaaagcuugcaccucuggaugcugacauaaauuccuaauacuggcaguaguuuacuguccuuagaggaucuuccauagucuuugaagcuugauuaaguuguacuaucuggauguaaaaauaaauauaaauuuuguguuauuuacacugaaggcacuaaaagcuagcaagaccaaacaaaaauaauaaaaucacuggagaaaaaauuaccuguaaguuaccucagcauacuuuuuaaacacccacaguacauuuaguaaaauaaaaccuagucacacuagcuuacuucagaauaaauaugaaucccaaaggggaaaaauaaacauuaauugucuggauauuuuuuuuuuuuuuuuuugagacggaguuugcuguguugcccaagcuggagggcaguggcacgaucucagcucacugcaaccucugccucccggguucaagugauucuccugccucagccucccuaguagcugggauuacaggcgcacaccacaugcccagcuaauuuuuauauuuuuaguagagaugagguuuugccauguuggccaggcugguccugaacuccugaccucaggugauccacccaccucggccucccaaagugcugggauuacaggcaugagccaccgugccaggccaauuaucuggauacuuucagaucauauuucugccaacucccugaaauacaaguugucuauaaaguuaugcuauuucaugaacuuucacuuuuuuuuuuuuuuuuuuuugagacagagucuugcucugucacccaggcuggagugcaguggugugaucucagcucacugcaaccuccgccuccuggguucaggcgauucucaugccucagccacccaaguagcugggauuacagaugugugccaccacacccagcugauuuuuauauuuuuaguagagacaguuuuaccacguuggccaggcuugucuugaacgccugaccucaagugauccaccugccucggccucccaaagugcugggauuacaggcgugagccaccacgcccaaccaaacauucacguuagaauuguugccuucagaguaagucacuugccaugcugccgaagucugugagaucuuuuaagcucuuuuugaaguuugaguauuugcacuugacugaauaguuuuuagaaaugaaauuauauagaaccaauaugguauauacagcaguuucuuggcuuaauauugguuuugaucaacucuaaaccuaacaaauaaguaauuuauguuuguggcuccggcuuauaaacuggcuuucaaguccuuugccaagaauccaugcuagguguuugugcugccuugaucuuuuagaaaagaacuggaaauggcagucagaaaugcuuucacaaaucaggggcauuggaauaauaaggguguagcuucccaaagugaccuuuucaagguggaaaacaugcauucuugcacuuuuacaaaaguuacacuuuauuuuauauucugaaaguucuggauuaaugugguuucugcuuuccuguaauacaguaaaucacuccaugguagaauucaauuuacuuacuuauuuugcagaaguacaguccauccagcgucuccuccccugcuuuguacucgagaagauguugaaguggcagagucuccccuccguguucuggcugaaaccccagauuccuuugaaaagcauauuagaagcauuuugcaacguaguguugccaauccagcauuuuugaaguaugcaaccuugggcauagcgguuuuaugaauggguucucuucugucuucagaauuacugugcauccuuucuguccucaucuguuucauauacuuuuuacugugauaaauuuggaagaaacuggauauauuugaucagcuagugaauggggagcaggagggaaguggcaccugagaaugauaaacaggaaguguuuaaaaagaaguuaggcuaggccgggcgugguggcucacaccuguaaucucagcacuuugggagaccaagacgggugaaucgcgaggucaggagaucgagaccauccuggcuaacacagcaaaaccccaucucuacuaaaaauacaaaaaaaaauuagcugggugugguggcagaugccuguaaucccagcuacuugggaggcugaggcaggagaaccgcuugaaccugggaggcagagguugcagugagcugagaucccaccacugcacuccagccugggcgacagugagacucgucucaaguuaggcugggcacgguggcuuacagcuguaaucccagcacuuugggaggcccaggcaggcggaucaccuaaggucaggaguucaaaaccagcccggccaacauggugaaacccugucucuacuaaaaaugcaauaauuagccaggcgugguggugggcaccuguaaucccagcuacucgagaggcugaggcagaagaauugcucgaaccugggagguggagguugcagugagccgagauagcaccaaugcacuccagccugggugacagagcgagacugcaucucaaauaaauaaauuaaaaauauaaaaaguuuaaaaagcaccugugacuugagucuauuuauuuucaguuguuuuacucagcuaaggaaaauaaagguagaaacuuuguuuuuaagagcuucugaaaaggacauagccccuccuccugaagaaugccuucagcuccucagcagagccacccagguguucagagagcaguacauucucaaacaggacuuggcaaaggaggagauucagcggagguaugauguccuguguucacaaaccaucgaucccuggcugguagcugaugcuguaugguagccuagaccuggcuucugaauaaacucuauuucuuuuuguuuuuaaagggucaaauuauuaugugaccaaaaaaagaaacaacuagaagaucucaguuauugucgagaagagagguaagugucaaaaauaagaagaauacaauaggucaguaagacuggaaccauauucucacccuaagaugcugagccacauuaggugguuucagcaucaagggguggaccucaagagucucuugugucuuacaucauuaggaaaagucugcgggaaauggcugagcguuuagcugacaaauaugaggaagcuaaagaaaaacaagaggauaucaugaacaggucagugggcuguauaacauuuaguuaccuagucagguacuaacaacgauauuuaagaaaaugggcauuggcaggugcuuacauaccuacggaacugaacugaucccccugccucuccucugaaguauauguuggggaaaacaugaggcucuccccuaacccuuccuauggggccuacuucagaaacaccagauucaugaauuaugagcuugugauuauguuucuccuaauuaguagagaccuuaaauugagauguuugcuugccuuuucuaaaggaugaaaaaacuacuucacaguuuucacucugagcucccaguucucucugauagugagcgagacaugaagaaagaauuacagcugauaccugaucaacuucgacauuugggcaaugccaucaaacagguaggaauagauccaaacuagcuaaauuugguaauuuuucuuaaagcacuuauucuacagaaaauuuuacaaaaauguaaaaagaacagauucaaauagauacugugaaaauguguggcaaaccacugccaaaauaucuauuauuuuaauacuuaagguuacuaugaaaaaggauuaucaacagcaaaagauggagaagguguugagucuuccaaaacccaccauuauucucagugccuaccagcgaaagugcauucaguccauccugaaagaggaguaaguaaauacuuccaaucagcuauuaucgugagauaguuuuuccuuuacaguaugccagaaucaaccugucuuaauagaaaccugaaucuugguauuugcaugucaaguaauuacugggaugagagccacaugauacauagggacuuaagaaaugacuauggugggaggauugaaagggaugaccuucuaguaacaugauuuuguuguguggccaaagguauuuuacaguaauuauguucaaaaauauuuccaguacuugcaccguuugccaccuuaaaugaauagugaacacuauugcuauccaccugaaaccuucagcuguuaauuuuagcaaagcaguucuuagauguuucaacauuaccaguuuaaauucuuaagaauccauauaaaugguuuauuauaauuccaaaagugagugacuuuacaauuuuacaggggugaacauauaagggaaauggugaagcaaaucaaugauauccgcaaucauguaaacuucugacaccaccaggagcugacucacaccugaacugaacaccauugaaggcuuaaacccauauuguaaaacagguagaauuaucuaauuuauaaaaagguguuuugaugaccuuuggugugguucaucuuuuuaaauauguuguuuuauaauaauugaguaaaugcuuuuauuuaaaauuuggaa

SEQ ID NO: 192264 - RNA, 3884 nt, Homo sapiens
uuaaaacacauauauuuaauguacagaauuggaaaaaggacuucuugauaauaaacauauuucauguaaacacaagcuuucaauaucuaugaauauuucauugcaaauacacccuaaguuacuucuucucuacauaaaggagaaacuccaaguucugcucuuuaggaagacauggagggcaagcaauaccuuaggaacaaccauugcuauuucuccccuuuccuugggugaccuaacauuuuacagggacuaacgacauaaagaaauauuagauuccauugaguuuaaacacaaauuucccacugagggcauuaaauauuugaugcuuaugagugugaauaaauaaauauuagguauaaggcagauuccaaaaccaacugaaguaugaaaacaaauuggcauagauaccuaacagucaguaaaauuaaauuucacuacugaguauaugcuacaugcuuccuuuucuacuccaguggguucugcuuuuuuugucuaaggucuucugcuggacucuaagacagucaauugcuuaacaucaccagguuuuuugucaggggauuuauuuuggaaauaaaccaacuucuuuuuuauuaaagaucaagguugucuuuuuugcuacaugcuucuuuccacuacauauugacucccucaugaaagaaaauucacaggacgagagcaaguacucuauguuggcuguuccgcaguguaaugacugguuaauaaaagagccacucagccuggacaauauagugaggccucguuucugcaaaaaaauuagccaagcauggugacacgcaccugugguccuagcuacuugggaggcugaggcaggaggaucacuugagcccaggacacagagguugcagugagccaagauugugccacugaaaucuacucuaaccugggugacagaaagggaccuugucucaaaaacaauaauaauaauauuaaaggagccacccguuuaauccuuuucuugucuggucucauccaaagaguaagccaaaauaaucaaggucacaaaggacuuaugaccaagguguaacucugcaaauaucuuuaacuggucauggcuucuuuguuggaucccuucccacuuauuagaagacucagaugcuucagccuaguucaaaguaguacacuucauaccucagcaaaguggaccaaaaaagaggaaaacacagaauacaagaaagaguugacaaagcaaaucuaauaaaaaguaugguugguuugaacagucacugguaugauuugaacaguccuuaugguuugaacaguccuuaugauucuacuuuuugacaggcuccuccuuuugacuacugagcaauuaagauauuuucagucguuucgauuccuuuuccacauugucucuaauguucuguaguuuucuggaguucugaaccagggauacuaaacucucccuaaaaucacuagucccaugaucucugccaacauuaugaagcucaucaaagaaagucaacgucuguuugaguuuggccugaacaauuuuuugcucuucuaauucugcaagaagggccugcuuaguacauaauucagucuuguacuucuccuguaacuguucaauuucuuucuggagaugcugaaaaucuuccucacuauaaggugucuccuuacauuuaucuucaggaagcaagauguuugagggaauacguaaaaucagcugcaaaaacaguugcuccauuuugcuaaaaagguuaucaaaauguccuuucaugaagcaaagaaacuucucugugcauuugcgaaucugcacugggcuaaugucacagucugggaugccauccagcuucuucagaauaaccuguucaacggccugcaucacuucaaauagguagucuugaaaugcaauguagauccgaagcaugcacguuuguggcgugaagccaaagaacugggccucguaggucauuggauccacagacaucuuggcuuauuuugcuauguuguuuucagucgugaaaaaccugcaaauguaaaaaggaaauaauucauuuggaaaaaaaaaaucuucugcaggaaguaaccaaucacauuacagauagcaaacaaagaagcaaaucaauaaaaaauaaggaguuuguguuccuuuauaccugaugccacucccacaacaggauauaaacucuuugccucucugaggcuccuuccaucagccuauacccucccuuuuccccuccucguuguucacuucccuuaccugugacuuuggcacagaucagucuucugaauuaucauccuagacaacuuugaagucuagacagaugacuuaaccaaugcccuagagacucaguuucuugagcuucaaugaccuauagcuccaccuuuuagccaccuggcucuugauauuuguaacuacucuuccaaacugcuucuacuuuuugacuacugccuccuacacaauucuuccaauucuuacccauauacucauauuauacccuaaucuucaagauuuacagccccuccacccucucuuucuguucucagccucugccacuucucuucuuuccuuauucauuuuaggccucaugaucuaucauuuugaucacuccguugccaauguccucaauuugcuuguccuccagccaagccaucugaaaaaaacccaauuagaagaugaguaagucccuugucagcuuuauaacccugacauguuuuuucaagggucugcgaguaauuccucucaaauauaaacaucuaggaaaauaaaaccccuaucuccuugucauugugggaauucaaccuaggcaucuuuuucugagaugaaaugauauugcuugucauagaaauaagagaaauuuuauuauuccuucagauaaaggcaauuagcuaaaacaaacugcuacuucaauuaucaggugaauuuaggacgcacuuuaugaaauaauuugcaauaagcaguacagucaaaucuuaugggaagauaagaugcagccaaucuuaagaauuuauguuuguaggcugagcacgauagcucaugccuguaaucucagcacuuuaggaggccggauggacgaaucaccugaggucaggaguucgagaccagccuggccaacauggcgaaacccuaucucuccuagaaauacaaaaauuacccaggcgugaugguggauacuugcaaucccagcuacucgggaggcugaggcaggagaaucacuggaacccgagaggcgaagguugcggugagccgagauugugccacugcaccccagccugggcaacagagcgagacucugucucaaaaaauaaaauaaaauaaaaauuuacguuuguaaugguuaaauauggagugguuauaacuguuuggcuguauauguaagguaggauuucuuucuguuuuucuuuuuuucuuuugagacauguugucgcucugucgcccaggcuggaaugcaguggcacgaucacagaucacugcagccucaaccucccgcgcccaagcaauccucccaccucagucucccaaguagccgggacaacaggugcaggccaccaugccuggcuaauuuucuuguuguuguuguuguuugagacaaagugucacucuuucgcccaggcuggaguacagugguaugaucucggcucgcuacaaccucugccuccuaaguucaagugauccucuuagcucagccucccaaguagcugggauuacaggugggcgccaucucaaacaacaacaaaaaaauacacuuccuugauuaacuccuuucuucgaauucccauuaggaccucucuucgggcacugacugaugaacuucuaccgccucaucuucucugcuagacuuagaguuccugagagcagaauaaaugcggcuugaucaguauuugccgauucaacgcagaggugcccaggucaucucggcgag

SEQ ID NO: 192265 - RNA, 97458 nt, Homo sapiens
gucucagcgcgccugcgccgagcggcccugcgcgcagugaggcaguggcgggggaaggcaccgguggggccgacgggcggguugaaggagggaagcgggcgagcgaagucccagugcgcgccgcggcagcccgggcacccuccccuuccgggcgugagucgcugugaaaagagcugaagcgagcggacucgcaccggcagcgaggcgccgcucccgccgccucagcccggccuuccucggcuccggcgcuccggucgcggggcccggguuccucggcacaccccgcuccagccgcccccagagccuguccccagcccuucggaagccccggcgccagcccgggcccucggcagggaggaugacggagcugcagucggcacugcuacugcgaagacagcuggcaggugagcaggcgggcggcggggcgccgggcccggccgcgaucgcggacagccgcagcccagucccucuucuccucccgggccagcggccguacugccgaaggggcccgggccugcgaggguggggaccucgaggcuccggucccggccgggcccagccguucucgcccggcucuuggagggcacugggggcggggacgcgacccagcuccggcccagggacugggccuggcgcccggggggucggagaggaggagguccccucccccaccguucuguaggacguugcgggggaggggcugugugcggguccccaggccggggccgccagcuuggaggggcgggucccggguucaggugcugccggggccgccggaccuucggggccggcuggagcguccggacccagugcggcugcgaguccccggcucggugucugagggcgggcggaagggaccggcccuggcgggauaggugaggcgcacaaaacuucuccccgggcggcgcuggguccgcggaguuggggccgacaacaaaagcgcuggccucggcggccuccacgcgggcgcgagggugccggagacccuggcggagugcggaucgccgccucgccugccuccgccuggcacgggcuccggcugcgccgcccggcugggggaggguaggagcgggccgcggggagagccgcucgcuggccggcuccgggcuuugugcucgccgcgauuccggcugcugcgcaggccugcaaaccccggagcugcgcccgcaggcucuggcccggggcggcggccgggucggccuccccgaggagccugcggccccccucccccauugucccggccuccggccguuugcggcuuccagguugacuuuuuaggggguuggcuccuacucugcuaggacugugugcgcggagcaugcgcaguggagacguccgugugcggaguggaaggggggaggcggguugguggcuucacaaugcagccccacgugcugccagauuuaaagagaaaugaaccagcacuuaccccugcuguacaacacccggcgugugucauucucaguucaagcgaucuucccccuacccacucuaaaaccaguagccucuagcccucagcagaagccaaagacuggagugaugaaaucuguuuuugaaauacauuuacuaagaguuugagguguucguuaaaucaccuuuauggcuucuuaaggaaaagguugucagggguucuuacagauuguauaauuggguuuauuauuagaccaugagcaagcagguuuggacaaguauuaaaguucuagaugcucagggggaguuagcuugcaguaaauggagaaguucuaaugauacuacaggauacucauaaaaauuaugugcuggaaaagcacugaggccgggcgcgcuggcucacgccuguaaucccagcacuucgggaggccgaggcuggcggaucaccuuaggacaggaguucagggccagccuggccaaaguggugaaacccccgucacuacuaaaaauacaaaaaauuauucgggcguggcggagggcgccuguaaucccagcuacucaggaggcugaggcgggagaauugcuugaacgcgggaggcaucguugcagugagcugagaucgcgccauugcuuuccagccugggcaacagagcgagacucuguucaaaaaaaagaagggccgggcgcgguggcucacaccuguaaucccagcacuuugggaggccgaggcgggcggaucacgaggucaggagaucgagaccauccuggcuaacacggggaaacccuuucucuacuaaaaauccaaaaauuagccgggcgugguggcgggcgccuguagucccagcuaaucgggaggcugaggcaggagaauggcgugaacccgggaggcggaugugcagugagccgagauggcgccacugcacuccagccugggcgacagagcgagacugugucucaaaaaaaaaaaaaaagaacuuuauugcauuuuuuuuuuuuuuuuugaggcagagucucacucuauugcccaggcuggaguggaguugcgcgaucucggcucacugcaaccucugccuccuggguucaagugauucuccugccucagccucccgaguagcugggauuacaggcgcgcggcaccaagcuuggcuaauuuuuuguauuuuuaguagagaugggauuuuaccgugcuggcuaggcuggucuugaacuccugaccuggugauccgccugccugggccucccaaaguauugggauuacaggcgugagccaccgugcccgucugcaucuuuuuuuuuuuuuuuuuuuuuuuuuuugagacggagucuuacucuguugcccagcuggagugcaguggcgcaaucucggcucacugcaagcuccgccucccggguucacgccauuccccugccugagcuucccgaguagcugggacuacaggcgcccgccaccacgcccggcuaauuuuuuguauuuucaguagagacgggguuucacuguguuagccaggauggucuugaucuccugaccucgugauccgcccgucucagccucccaaagugcugggauuacagacgugagccaccgggcccggccucucugaauucuuacauaauggaaaagauaaacauuuaaaaggugugaaagaaguuaugcauuacuaagaaaguaaaauaagauaacaaugucagcagcagcaaugugugaaaggauuuccuauccguuugugaaccagcucuagauuuugauggucaucugguuccguuuugcacuuuuuuuugacaauguauauagcaaauauuaauaaaacgucccaaagcucuuucuuaaugauugacuuucugauggggcauacuaaaauacacuuuaagauagaggagagaacaauuuaauuuguauuuuuucaggccucauuguaaaguuacuuagcugcagauuuaaguuuuccugccuucuugaucagaaacaaugggauuguuuuuaauuuuuuuuuaaaauuugaagcauguuaauuaacaugcucaaaauguacaaaguaguagggcaaggcaaaugaauuuuaauugaaauguaaacauaucaaauuuauuggaaagauucgauaacuacacacagugaaauaaaagccuuguuuuauuuuauuuuugagacagaguuuuacuuuguugcccaaacuggggugcaguggcgagaucuuggcugacgacaacuucugccucuggguucaagugauucuccugccucggccucagaguugcugggauuacagaagcccuccacugugucuggccaauuuuuguauuuuuaguagagacaggguuucaccauguuggccaggcuggucucgaacuccugacuucaggugauccacccaccucggccucccaaagugcuggaauuacaagugugagccaccaccaccuuucacccagacuggagcgcagugacauaaucucaguucacugcaaccuccgccucccagguucaagcgauucugcugcccccugcggcccccaguagcugagauuacaggcauguacuaccacgccaggcuaauuuuuguauaaaauuuccaaaaacuuaaaacaacaauggcuacauuuauugaaccucuagucugucaauccuuaaggauuuaaauuaauuacuugguagaauauaucggguauguuuuguugauaacauaaugaagaaucugguuacuuucagaauugaacaaaaugguuccuuggguuguggagugucucagucuuggcgcuacugacguuuuggguugaguauuguuguagggccuauucugugcauuauagauagaauguucagcagcauucguggccuucacccacuagaugccaguagcauacucccuuaguugugacaaccauaaaugucuccauugccaaaugucuccugagggacaaaaucaucccagauugaagauuacugaguuaaaauguuucagagaagaccauuauggcuaauuguuaagcaaauaaagacaccuaacagauucaugaaaucagauagguuguguauuucucuguggauauuauuagacuaugacuuacuccuuugcaaauugagcgguggcaauucaaguuuugcagugccuuauguuaaacacuaaaaaaucccucagcacaggagauacuuuuaaaacauuuuaucuuuugaaaagguauuauaagcauugguuaaaaaugcaaagaguacaaaaaaacauagucuuuucacccuggccauaaguucuuuuuguggaagcaacccaucauugacaaauaugucuuuuuuuuuuuuuuuuuuuuuugagacagucuugcucugucgcccaggcuggauugcaguggcccaggcuggaaugcaguggcacgaucuccgcuaagugcaaccuccgccucgcggguucaagcguuucuugugccucagccucccaaguagcugggauuacaggugugugccacgaugcccaggcuuauuuuuuguauuuuuaguagagacaggguuuuugccauguuggccaggcuggucuugaacuccugaucucaggugauucacccgccucagcuuacgaaagugcuggaauuacaggcaugagccaucaugccuggcugacaaaugugucuuuucagagagguucuuguauguauguuuauauaggcuaacguuuacugaggacuaacauguaccaggcacugugcugaguacuuuauauauuuauuuuauuuuauuuuuauuuuuuugagacggagucucacucugucacccaggcuggagugcagugguauaaucucagcucacugcaaucucucccuccuggauucaagggauuaucuugccucagucucuguaguagcugggcuuacaggugcuggccaccaugcccagcuaauuuuuguauuuuuaguagagaugggguuucaccauguuggccaggcuggucuugaacuccugaccucaagugaucugcccaccuuggccucccaaagugcugggauuacuggcgugagccaccaccccuggccucuauugcauuuuuuuuuucccaacacagagucuuguucugucacccagucuggagugcaguggugcgaucuugguucacugcaaccuccgccuccugaguucaagugauucuccugcuuuagccucccaaguagcugagauuacagguguccaccaccacgcccagcuaauuuuuguaguuuuaguugagacaggguuucgccgugguggccaggccgaucuugaacuccugaccucaggugaucugcccaccuuggccuuccaaaguggugggauuuacaggcaggagccacugcgcccagcccgucuauugcauagauguauauuuuuugagacggagcuucacucuuguugcccaggcuguagugcaauggcaugaucuaggcucaccacaaccuccgccuccccagguucaagugauucuccuaccucagccuccccaguagcugggauuacaggcaugugccacuacaccuggcuaauuuuguauuuuuaguagagaugggguuucuccauguuggucaggcuggucuugaacucccggucuuaggcgaucugcccgccucagccucccaaagugcugggauuacaggcgugagccacugcgccgggccaguuuuauuauauaguuuguuaauacacauuauauguugugauauuuccauauauaguugugaaauuaggugcauuuaucauuauuuaauagaguggaucuaggguggaaaaucugauaauccagugacuaucauuauauuguugccuuuugacuuccuuuucucaggugaagaauguuugauugcacugucaagaugaguuucaauccuucgccucuuuuggucuuggguacuucaguacaauuuuuuuguuggcaggaggguacagugugggcauuccuuugcuuuaagcaaguaaaguauuaauuaagcacucuuuuaaugagaucaguuugauuuaggauaaauaauuuggcauuucuuaauuauugaaaccuuuuuuuuagauuuaaauuuuuguuagaauuuagaugaccucuaagggugugucuaauguuaccuuucauugguuuguaggaaauaacuuuucagagaaggaagugugggcuuauggaaacaaaucuggcaagguaaacauaguguaguuuuauaugguuaauagcauuucagguacagaaaaguacaaaucagaaaaagcaaacauuuuccaaauuuugguaaugaauaugaauuauugguauaaacagauaaaugauaaagaauaaaauguaguuucaggaaauaagauauuuaaauguuacaauaaaacauucuaaacuuuuucccccuagugcaagauaguauugggcuaauuugaguuaaucagcaguuuuuuuuuguuuguuuuuuuuuuuuuuuugagauggagccuuguucugucgcccaggcuggaguauaguggcgagaucuuggcucacugcagccucugccucccggguucaagugauucuccugccucagccuucugaguagcugggacuacaggcacacgccaccaccccuggaucauuuuuguauuuuuaguagagauggaguuucaccauguuggccaggauggucuccuuggccugccuuggccucccaaaguguugggauuacaggcgugagccaucgcgcccggucuaaucagaaguuuuuaucagugcuguuccauugauagauucuggcccucauagaaacuucuggaagaaauacuguacuguauugcuguugcuguagagauguauaccucuuuuuauaaaguuauguucuagauuugcaacaaguuaauuuuuguaagcggaaauauuuuauuuuaccuuuuauuuaaccuuuauacccauguccagugacuuagaaaaacugcuauugcuguaucuuugcuuuuuuuccuuuagcuauucuuauuuacucuucuauuggcuagggauauguuaaaaauacaaaaaacaaagaccuuaaauuuuuaccuggcagcuguuuguuguuuguuugcuuuaaucuuguaaaacaagacugcuuuuaaguaaguuuaucaaauaggaauuuuuaaaaaaguucuuuaugucaggagacacuuuuccuuuuaucaaauaggaauuuuuaaaaaaguucuuuaugucaggagacacuuuuccuuugcuuuugaauguacaugcauuuuaauuacauuaucauauucuuauguaagguauauauuuucuaggguuucuauguuaagacagaguaaugcuaggcaaagaguucuuuuuccuuuuuuuuuuuuaauuuuauuuuuuugagauggaguuucgcucuuguugcccaggcuuaagugcaguggcacgaucucggcucaccgcaacuucuugccaccuggguucaagcgauucucccacugcagccucccgaguagcugagauuacaggcaugggccaccacacccagcuaauuuuguauuuuuaauagagacaggguuucucuauauuagucaggcuggucuugaacuccugaccucaggugauccaccugcuucagccucccaaagugcugggauuacaggcgugagccacgcgcccagccaaguucuuuuucaacuugaugccaaaagcaugagccauaaaaggaaauauuaguaaacuggacaucaugaaaauuaagaauuuuuaccugauuaaagacuguuaagaggaugcaaagacaagcuacaaacuggaagaacauuugcaaaucacauaucuggcaacugauuguaucuagaauauuuaaagaacccucaacaguuuaaaaaaaaaaagucaauucaaaaaaaugggcaaaauuagacaggugugguggcucucaucuguaguuucagcuacuagggaggcuugaauaggagcaucgcuugagauggggauuuugaggcggcagugagcugugacuucaccaccgcuacacuccagccugggccacagagcaaggcccugccuaaaaaauaagggcaaaagacaccaagaaacauuucacugaagaggacauacaaauagcaaacaagugacaacauguucaacauuauuagacaucagggaaaugcaaauugaaaucaccguaagauaucacuacuuaccuguuagaauaguuaaaauuaaaaaaacuguaacacuaaaugcugccagggacuuggagaaacuugaacuuuuauacauugcuggugggaauguauaauuguauauccacuauagauagaaaacagcuugcuuuuuuuuuucuuuuuuaagagacagggucucucucucuuugugucuacauauaucuuuuaaaaauuuuuuauaaaaauagagauggggucuugcuguguugcccaggcugguuuugaacuccugggcucaagcaguccuccugucuuggccucccagaauguugggauuacaggugugagccaccacauccagucuauuuuuuuuguuuuuuuugagacagaguuccgcucuuguugcccaggcuggagugcaguggugggaucuuggcuagauuguccuucuuuauggguggucuuggcaccuuuguauaaaauucuugaaaugacagaauuacagugauggagaauagugguguucagggauuuagggacaugagggauaugugguauacaguaacaugagggaucuuuguggugaugaacagucuuguaucuugauagugauuacacacaucugcaaaugugauaaaauugcauagaguuauacacccaccccccccccccacacacacacacacacaaccgagugaugacaucugaauacaguaguccucccuuaucugcaugggauaaauacuuuccaagaccuccaggggaugccugaaaccacugauaguccugaaccuugugcuuucuccuauauaugcauaccuaugauaggauuuaauuuauguuagucuaacaacaauaauaacacagagcaaugauaacaauaugccggcauuacuacucuugcacucuggggccauuauuaaguaaaauaaggguuacuugaaaccaggcacugcuaagugauaggcaggagggacagugugagauuucaucaugcuacuuagaacaacacaaaauuuacaacuuaggaauuguuuauuuuuucuguuauuuuccauuuaauauuuucagacugggcuugaccacaaguaauugaaaaugccgauggggcagggguggggggacuauaaaguauauggauugcaccacugucgauuucuuggguuugauauugugcuagaguuauacaggguguuagcauuugggagaaacuggguaaagguuacaggaaaccuuucuguacaguucccccuuguccuaugggacuguauuucagaauaagaaguuuuuaaaaaaagucaccuguaaccaugcauuauuaucaauccuuuuucaaauaaagaacuuaauauuuguaguuauaaauacaacuacaugguugcucuauuaacauguucaaggaacaggaaguugaaauagagaaaccuguaguuuaagacagaaauuccgucuuaauuuuauuuuuuuguuauuauuuuugagacaaagucuugcuguguugcucaggcuggucuugaacuccuggacucaagcaauccucuuggcuuggccucccagagugcugggauuacaggcaugagccaccacgcacagcuaccauccuaauuuuaaauagcagucuucauuuaaacuugugugguugcuuggaaaauggaauaaaggaucagcauaaaaguuuauuuauugagcccuuauaugccguuguauugagaugcugcgggaacgcaaagguaauugaugugauaucccuaccuugaggugcuacauuuaguagcacuauguaaacaacguuuuuuauuuauuuauuuauuuaauuuuuuuuuugagacaguuucgcucuugucgcccaggcugaagugcaguagcaccaucucggcucacugcaaccucugccuccuggguucaagcgauucuccugccucagccucccgaguagcugggguuacaggcgugugccaccaggcacagcuaguuuuuuguauuuuuuaguagagacgggguuucuccacguuggucaggcuguucucgaacuccugaccucaggugaucugcccgcuucagccucccaaagugcugggauuacaggcguaagccaccgugccuggccuuuuuuuuuuuuuuuuuuuuuuuuaaagugaaacaaguuuauuaagaaaguaaaggaauaaagacuggcuacucugccaggugcaguggcucucgucuguaaucccaguacuuugggaggccgaggcgggcggaucaccugagguugggaguuugagaccagccugaccaacauggagaaaccccaucucuacuagaaauacaaaauuagcugggugugguggugcacaccuguaaucccagcuacucaggaggcugaggcgggagaaucgcuugaacccgcgagguggagguugcagcgagcugagaucaugccacugcacuccagccuggggaacaagaaauuccgucucagaaaaaaaaaaaaagaauggcuacuccauaggcagagcagccaguaguaaaugaauuuuuuuuuucuuuuuuuuuuuugagauggaguuucacucuuguugcccaggcuggaguguaguggcacgaucucagcccaccgcaaccucggccucccagguucaagcgauucucccgccucagccucagaaguagcugggacuacaggcgugugccaccacaaccggcuaauuuuuguauuuuuaguagaaauguuguuucaccaugcuggccauggcuagucuuaaacuccugaccucaggugauacacccgccucggccucccaaagugcugggauuauaggcuugagccaucgcucccagccaguaaaugaauuucuaaggaaauagucuggcaggccgggcuuagugacucaugccuguaaucccagagugacucacgccuguaaucccagaacuuugggaggccgaggcagguggaucaccugaggucaggaguuugagauaagccauggccaacauggugaaaccccauuucuacuaagaauacaaaaauuagcuggucgugguugcacaugccuguagucccaguugcuugugaggcaaaucacaucaaaucuuuguuuuguuuugagacagggucuugcucuguuguccggacuagagugcaguggcaacaucaaggcccgcugcacccuccacuuccucggcucaagcaauccuccucccucccucccuauagcugggacuauaggcaugcaccaccacaccuggcuaauuuuuccuuuugauaaagucuugcucugucacccaggcuggagugcagggaugugaugauggccuacugcagccucaaucucccagacccaagugaaccucccaccuuaucugccuccguagcugggacuacaggcacgcgccaccaugcucagcaaauuaaaaaaaauuuuuuuuugguagagacaggguuuugccacguugcccaggcuggucuugaacuacuggguucaagcaauccucccaccuugaaccaugugucaaaucuuugccccagccaaauauuugaagaaaauaaagaaauuggguaauuucuccaaucuaacccuccuaaaugcugauggagcuggcuaguagaaacaguuuuauuuucugauaaaacucgagcccuuuccuucucagccuucucagaguuuauuuuuuuucuuuugggaguucuuaguuuccuuugagaaucuagcaagaguuaaaagaccuccugagaaaagcacacaugcauaauuugguauguaauuucggaggguucuuugaucuguggagugaagcucauuuaugcagaucuaaugcugucucuuaaaucagcaaguuugaugcccauuuuguguacuauugggaugcuguuuugguguuucaggaacuuguagucuguagaaaaauaaaaguuccauaauacagcugcuuuaggguuguuauuacagaaaaagucaagagaagcuggcuucuaccagucugguucauggagggcuuugaggaggaguucauggcacuugugcuugaccuuuaaaagaucugucaaauuugacacacagaaaaaggaaaauauuuaaggcugagggaaaagaacaagcaagacaaaguuuaugcugaaagaaguuguguaguuggaguauaugauaaacugaacuagugggaaaacuaucuggaaagguugacguuuguggaagaccuuaaaaaugcugggguaggccaggugcagugacucacaccuguaaucccagcacuuugggaggccaaggcaggagaaucucuugaacccagaaggcagagguugcagugagcugagaucacgccacugcauuccagccugggugacugagugagacucugucucaaaaaaaaaaaaaaaaaaaaaaauuugaccgggcacgguggcucacgccuguauucccagcacuuugggaggccgaggcagguggaucacgaggucaggagaucgagaccauccuggccaacacagugaaacccgucucuacuaaaaauacaaaaauuagccgggugugguggcacgugccuguagugccagcuacucgggaggcugaggcaagagaaucgcuugaacccagguguucaagaaccucuugaaccgagguugcagugagccaagaucgccacuacacuccagccuggugacagaacaagacucugucuaaaaaaaaaaaaaugcuggggugugacauuauauguguguguguguguguguguguauauauauauauaucaacgaaacucuauauauauaugggguuucguugaucgacacuaguuuauauuaguugguaauacaauauagcuacuucaccacaauauuauacacauucuucccccuucuuacauauuuuucuuuuccauuuacuuguuuaagcaagugacacuuguugagacaccuucagugucucaucaagguccuuauuuuucuuucaaaguuuuuguuguuguuguuguuguuuucgagauggagucucacucugucgcccaggcuggagugcaguggcgugaucucggcucaccgcagccuccgccuccuggguucaagcaauucuccugccucaaccuccuggguacgugggacuacaggcgcccgccaccacaccuggcuaauuuuuuguauuuuuaguagagacgggguuucacuguguuggccaggauggucucgaucuccugaccucgugauccguccgucucacccuccuaaagugcugggauuacaggcgugagccaguguacccggccacacccggcugauuuuuguauuuuaguagagacgggguuucuccguguugcccaggcugaucuugaacuccugagcucaggcagucugcccgccucggccucccaaagugcugggauuacaggggugagccaccaugcccggccucauacaaaauauuuuugaaugagcuggauucaaacauuuucucuguaggaauggugaaaaugucauuaucaggaaaaugaucuagcuguauuaucuauaauacagccaccacgcccaccccugaaguauuuucuuuaaugaacaacucugucaugacuauagcuuuucuguauaauuuaaaaaauuacuacaaaaauuaacauuguuuucuucuuggcuuuuccucccacaucucugaaguuccugucugguccucugcccuagcagccuuaaauuuccuacccagcuuucugaccguaguuuccaaaagagaauacuaaguuucacuuauuugcaauagcagaaccaagacagcuagacuucauuaaucuucaaacuugucauuuaacaaaguuuaggccuggugcaguggcucacgccuguaaucccagcacuuugggagacuaagacaggaggaucgcuugagcccgggaguuggaggcugcagugagccaugagugcaucacugcccuccagccugguugacacagcaagacccccucuuagaaaaacaauguuuaaauuagaucuacauagagaaugaauauaaaauuaauguugauacgaugaucccuuuucuacuuagguccuggggagccuguggggucauaugauccuuugauuuugucacuuuuuuugaggaugugucaaauauauuuaaaagacggaguuucaccauguuggccaggcuggucucuaacuccucaccucacccgccucagccuuucgaagugcugggauugcaggcgugagccacugcaccuggccaagaccaccgcauuuuauaccacugcacacugucuguuaaacucugaagucuuuguaacuuuuggaaggggaacuaauaacuauuggugauggccgcaucugguauuuugagucuguuugccaucuuuugggcuuuaggauucuaaaacuaaauuacuuauuuaagguuuauauagagagaggaguguuauuccgaggucuuccuugauacucuuucacccuagguaaacagaggauuguauuucccuauuuuuuuguauuuagcagugcguaagguuuauauuauccucauuaguacuuuaggcugugcuaauuucuuuuuucuguucauucuuuuuucuucuuuuacuuggcacugacaaagcucagaauaauuucugauuuucagacugcugugaacauuuaugguaugauaguuccccuaggaaaauacuguauuuuugcuaucuucucugguuauuucuacaucucucccuuaggaugacaccuuugcucuucuucugcccugagcauuugccaaauggauacaacaaaauucucguuauccaguuugguuuauauuuaacucuugcaggugcagcaguggcacagacgaggguauuguguugccugcuacccucuucagccucuaagccauauggcauggcuauuggggaagcaauaugacugugauaggauuuuuguuuuuaaauaaaccuuuuuagaagaguuucagauacacagaagaacugugagaauaguacagugaguucuuacauacccugcauucaguuucucuuauuuuuaaccuuucccccaccccccagcccccgugagacagucucccucugucagccaggcucacugcaaccucugccuccugggcagaggugauucuccugucucagagucccgaguagcugggauuacaggcacgcaccacuacaccuggcuaaauuuuuuuuuuuuuuuuuugacgaagucuugcucugucgcccaggcuggagugcaguggugagaucucgggucacugcaagcucugccucccgaguucacgccauucuccugccucagccucccgaguagcugggacuacaggcgccugccaccaugcccggcuaguuuuuuuguauuuuuaguagaggcgggguuucaccauguuagccaggauggucucgaccuccugaccucgugaucugcccuccucggccucccaaagugcugggauuacagacgugagccaacacguccagccucauacuauuuuuaaaugagcuggauucaaacauuuucucuguuggaauggcgaagacaucauuaucaggaaaaugauauagcugcaucaucuaagagugauuuaaauagauaaauuauaaccuaaauaauuacgucuaaguugcugggugcacauuuuuacaauuaguuuaauuuggagacugacacuguucagagccagauguucucugaauucuuuauuauuuauuuugaaauguucaaggugauacuuaguuuuaacugccuugacaguguucuuuuuuguuuuuuuugagacagggucuugcucuguugcccaggcuggagugcaguggcacaaucucagcuuacugcagccucugccucccagguucaagcaauucucccaccucagccaccugaguagcugggauuacaggcgcaccaccaugcucagcuaauuuuuguauuuuugguagagacgagguuucaccauguuggccaggcugguccuaaacuccugaccucaggugauccacccuucucagccucccaaagugcugggaauacaggugugaguuaccacgccuggccaacaauguucuaaguuaguuacauuagccauaauauguaagauagaaauuugcucauuuguauauaagaagauucugaaaaaguuuuaagcgcugggugcagugacuuaacuucuguaaucccaacauuuugggaggccgaggcaggaggauugcuugaguccaggaguuuugagaccagccugagcaagauggugagguccccucucucccacuuugaauagguaugcuauaaguaacaggccuuugaaacucauuuuggguauugugaagauguuauauuacaguguccuuuuauuuauuuaauuugagguuaaauguaauuuuuuuuuuuuuugagacggaaucucgcucugucgccgagacuggaguguaguggcgcaaucucggcucacugcaagcuccgccucccggguucaugccauucuucugccucagccucccgaguagcugggacuacuggugcaugccaccacgcccggcuaauuuuuuguauuuuuaguagagacgggguuucaccguguuagccaggauggucucaaucuccugaccucgugauccgcccaccucggccucccaagcugcugggauuacaggcgugagccacagcgccuggccaauuaaauguauuuuauuuuuagacaacuaugugacguguuuuuuuuuuaaaaacaaugccuccauuccaaaucaaaauaaaugaagaguucaagaugacaucaguuccauuuguuuuaaguucugguguugugugaaugacaagcagcagccaguuaugacggcaggugauccaaaguaauugccaaauuuguuaacauuuuuccaucucuaaaccauccuuaaagaaaaacauauauggugucacaccauucucaugguaguccuaggcuggagugcaguggugcaaauuuggcucacugcaaccucugccucccggguucaagcaauucuccugccucagcauccugaguagcugggacuacacgcaugcgccacgacaucuggcuaauuuuuguauuuuaguagagacaggguuucaccauguuggucaggcuguuuucaaacuccugaccucgugaucugcccaccucggccucccaaagugcugagauuacaggcgugagccaccucgcccagccuaauuuuuguauucuuaguagagacuggguuucaccauguuggccaggcuggucuugaacucuugaccucgugaucugccugccuuggccucccaaagugcugggauuacaggugugagcgaccgugcccggcccuauuauuauuaauuaauuaauuuuuauuuuuauuuuuauuuuuuugagacggagucuuguugugucucccaggcuggagugcaguggcauaaucucagcugacugcaaccucugccucccagguucaagugauucuugugccucagccuccugaguaccuggaauuauaggcacaugccaccaugccuaguuaauuuuuguauuuuaguagugguggggugucaccauguuggccaggcuggucuugaacugcugaucucaugaucuacccacuucagccucccaaagugcugggauuacaggcaugagccauugcccccggccuguucuuuaauuuuuuuuuuuuuuuuuuugagacggagucucgcucugucgcccaggcuggagugcaguggcgggaucucggcucacugcaagcucugccucccggauucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuauuuuuuucuuuacagacagggucuugcucugucaccuagacuggagugcaguggugugguuauagcucacugcagccucagccuccugggcuuaggugauccuccugccucagccucccaaguaguugggacuacaggugcacgccauugcgccuggcuaacuuuuaaaauuucuuggccagguguccacuaaucuuaaucguuucuagcguuugauuuaaagugagaccacuugaacauuuagaggccauucuaggguuauuauuugacuuaauuucaguauuguugugucucaggauaauugggaguccugagaaucagggagacagacaggaacuggcaguugguggagcagucagaacacacacaacguuuauuaagcuugcuuucucauaugggcacaauucguggugccccaaaacaauuauaauagaaaaaccaaagaucacugaucacagaucaccauaacaaauauaguaauaaugaaaaaaacuggccaggcgcgguggcucacgccuuuauccugucacuuugggaggcugagauggguggaucacuugaggucaggaguuugagaccagccugguccacguggugaaaaccuguaucuacuaaaagaauacaaaaauuagccagacaugguggcauuugccuguaguugcagcuauuugggaggcugaggcaugagaaucucucaaaccuaggagguggagguugcagugagcugagauugugccacugcacuccagucugggugacagagcgagacucuauguccaaaaaaaaaaaaaaaaaaaaaagaagaaauacugugagaauuaccgaaauaugacacagagacaucaagugagcacaugauguuggaaaaauggcacugauagacuugcuugaugaaccuucaauuuguuaaaaacacaguaacugaagugcauuaaaacaagaugugccugugaaugaaacauaaauaaauuuuguguuuaauagacuuggguuacauuuccaggaugucucauuauguguaugcaaauauuccaaaaucugaaauccagaauguuuuuggucccaagcauuuuagauaagggauacucaaccugugguacauuuauuauuauuuuuuugagcuggaguaacucuguugcccagggcuggagugcaguggcaugaucuuggcucacugcaaccuccgccuccugggcucaagcgauccuccugccuccgccuccugaguggcugagauuacaagcauacaccaccaugcccggcuaauuuuuguauuuuuaguagagacgggguuucacuguguuggccagguuggucuccaacuccugaccucaagugauccgcccgccuuggucucccaaagugcugggauuacaggcaugagccaccgcgucugauccugugcuacauuauaucacuagcacauaacacaauacugggcauauauagauacucagcaaauauauuuugaaugaaucacagaguuuaaguuuccucugucuuccuuucuugacuucuauugaaaauguaagcuggagcuggacgcgguggcucacaccuguaaucacagcacuuugggaggccgaggcggguggaucacgaggucaggaguucaagaccagccuggccaacauagugaaaccccgucucuacuaaaaauacaaaaauuagccgggcaugguggugcacaccuauagucccagccacuugggaggcugaggcaagaagaaucgcuugaacccaggaggcagagguugcagugagccgagaucgcgccacugcacuccagccugggcaacagcgcgagacucugucucaaaaaaaaaaaaaaaaaaaaagaagaagaaaauguaagcuguauagaugagacugcaguaacucaucuacugugaaggaccauacaaaacaaguguauuagcuaucuaauacauauuuaggauuauuucgguauaagucuggauaaggagcaacaaaggguguggaggggagucugugugguuuuuacagguaaggauuuaggcuuuuagucugagugaggcauucaugguuauuguugguuaguacuaacauuugauguuuauuuaauuaguguaaaaggcuuucagaagguagaaaguaugaguuaaaauuggucuucagauuacugguuguaaaucagacuguauuuuaagguuagucauuuuuauaaagaggaaguuguuuagcaauucugaauccuauauuguugcaauaucaauagcagaugcuagaauccuauuaguaaucccaagguaaaaugaauucuaaaagugcaaucuugaauuauucaacacuugguauccaaauuauaugaaauauaaucauccauuuuaugauuuugaauagaacuguagguuguuuucuuaaauaagaguuguucuuccuccgccuucucauuuugagucccuggaaucuguucuauuuuuacuuggggaucuacauacuaaagcugucucugauuucaugcucugaagaucaacaagagaccuucccuuguaagaugagaauuguguaguaggugacuauuagaagaguaaacaagucuuaagucuguaaacauuuuuucaguaaaugcaauggaguaccagauaucucucguuacuaugacuaaagaaaguucaaugguaaauucaguagcuguuuauuugccuugauaaguaauugcuagaaguaauaguaauuguuuuuauaguguuaccgaagguuuauuuacuguaugugugauuuuuaaaguuuuaaagggaucaaugaaaguuauguauagggaauauuuguaaguuacuggaaauaagccaggaauugaauuuuuaaaagugccuuucagaguaaauuauauuuucauuuucuuuauagaaugaaaguggaacaauauuguuuaaaauucaaauugagcaucauuuguacuuuucaggccauuagaaucugcucgaggcuugugugggaaagauuauuugauuauuuauuagauuaccuuuggcuaaacauugcagagaaaaguuguugacaccuuuuccccucaaacaaaguaauaacccccugaaucuaaaauaaaaguuggaaaaaagucaugaaaacuaaguugcucaugaggggcuuggacuuccuuguauuucuggcugcccauuuggugcugucacucugcuugucccuucugggcuucuugcuuuaaugugacaucauaucagacuuuuaguucugaauuaauguauuugcaaagcucauuuaaaauuuucaguaauucuguuuguaauuugaaguuugauucuucauuucuuagccacauaaacauuuuugaauuuugaauugugggaaauuucugaaggcagguaaaauacuuauuuuuuaauaccuuaacucucaucccuuuuauuuuuuauuuauuuuuuauauauuuagggacagagucucuguagcccaggcugcaaugagguggcacagugauagcucacugcagccucaaaccccugggcucaagugauccuccugucucagccucccauguagcuaggacuauaccaccacaugguacaccaccacacccagcuaaguuuuauguuuauuuuuuguagagauggggguuucucauuguguugcccaggccggucucaaaccucuggccucagccucccaaagugcuaggauuacaggugugagucaccgcaccuggcugagagcuuuuuccuuuccuuuuuuuuuuuugagagcuuucuucauauggcguuucacucuugucguccaggcuggagugcaguggcgcaaucucggcucauugcagccuccgccucccggguucaagagauucuccugccucagccucccgaguagcuggcacuacaggcccccaucaccacacccagcuaauuuuuuguaguuuuaguagagacgggguuucacuguguuagucaggaugguuucaauguccugaccucgugauccgccugccucggccucccaaagugcugggauuacaggcgcgagccaccgcgcccggccgggcuucuugauuguagauucuuugagguacagacuuacuuuguauaacacucaguguuaacagcucuaaguacuuaacucuugauugcuuuuuuucuugguaugcaauuuauuccuccuaugaacuugcuuuacgauugauugagaauaaccuuggcuccuccuucaauaaaugaaggacuuagugcuguuuuagaagccuguuggaguaccauuguauuuguuugccuguuuuugucuuuuggcuaauagucauugcuauuuuuuuccagaaacauccccagagcuuuagucuccagaguuuguaucuguugcaacugaggagaaaucuaccaguauaaauguuucugcuccucuugaaaaaagguuugaggcugggcgcgguggcucacgccuguaaucccagcacuuugggagaaugaggcgggcggaucaugaggucaggagaucgagaccauccuggcaaacaagugaaacccugugucuaauuaaaguacaaaaaauuagccgggcgugguggugggcgccaguagucccagcuacucagaaggcugaggcaggagaauggcgugaacccaggaggcggagcuugcagugagccgagauugcgccaccacacuccagccugggcgacagagcgagacuccgucucaaaaaaaaaaagaaaaaagguuugaagaagaguauagugaaaugccacccaaaccaaccuucauauauaugaaaagagggcuuggacauaaaauuuuuuuuugagauggagucucacucuuuucauccaggcuggaguccagugucaugauuuuggcucacugcaaccuccgccuccuggguuaaagcaauucuucugccucagccucccuuguagcugggacuacaccucaggugacccacccaccugggccucccaaagugcugggauuacaggcgugagcuaccgcgccuggccuggacuuguuauuaauauaaacuuuuagagccuuuaagccauaggaucauguaaaaauuaccuuauguugguacuuugaauuuaaagugcuggcagaucacacauaaucuucaaauugaauucuacauuuaacaaauauuugagugccuacuuuuguaaacauagcaguacauuaaagaacaggacaugaaaguuuugcugguacaaaguuuugcaguuauugugggaagacagaugguaaacuagauaauuaaauuaaaaaugugguguauuagguagugauaagugcccuggagagaaaauaaagcggggaaagggaaugaaaaguugaggguggaguacugaugucuugaagagcuuuccaggccaagagaagaacaguacaggggcgcugcagugggagagaggccuggcaaugucagaggagcagcaaaggguguggaggggaggcugugugauuuuuuacagguaaggauuuaggcuuuuacucagagugagguacccgugagguuuuucagcacuggagugauaugaccugauuuacauuuuaaugagaucauucuuggcuugcuaugcugagaauauagacugcacggagagucagaugagacaugaugcuagcuuggaccuguauuggagccgagaacaaagugguuuaauucuuggguguauuuccuaaauagagcuguuggaauuugcugguggaauagaauucuuuucuuuuucuuugaggcaggaucucgauuuguugcccagcaggaguucaguggcacaaacauggcucaccacagccucgaaccccugggcucaagccucagcuuccccaguagcugggaccauaggcaugcaccacugcgccugacuaauguuuaacauuuuuuguagaaauggggucucacuuuguuguccagccuggccuccuaaaaugcugggauuacagguaugagcuacugcgccuggccuagaaggaacacaauauuugaaggguagagugugugagagaaugugucaaggaugauuucaggguuuuuggccugaacaucugaaaggauggaguugacauuaacugaaauggaaaagaaagacgcaggacaaggagagauaaucaggggcuugguuuugaauaugcuacuuuugauuugucuauuagacacugaaguagagaagucacauaggcagcuuacuauauuugaucuggaauucagugaggagguuuagcuuagagauauaaagugggaaauuguuagcauauggauugcauauaaacuaugaaguuggaugggcucaauaagggaguaacuguagauaggugaagaagauugaggacuaagucuugggacacacuggcauuaagaagccagauaaguaaccagaagcuagugaaggagugugagcggcgucagugaggugucagaggaggcaaaccagaaugcuguggccuuuaagccaagugaagaaagcuucaagggaagagagaucagcugugucaaaaaagaguuuggguaagauaaggacugaugagugaccacuagaggugaaugguacuuugagaaaggcaguugcacuggacggauugguaugagccugagagaauggaaggagagcagcaaguggagauaaggaaugaagacaacucuuaaaguuguaccgugaagggguguugagaaauggugcaguaacuggagggcuugugggcuucauuuguguaugugucugcaugcguguguguguaaaguuggagaauugcuaguggcaugcuugaugcugaugggauugaauuuaguagagagaagaaccgaugacacaggagaggguaggaauuucuggagcagugucuuugaggacaucugagugggaagaaugagaucagaucuaauuacuggccaguuuggaagccuuauuaggagcaagggcaguugauccagaguaacaugagagaagguagagaaguaaauacaucggcagagauucagguuagacgauaugucuggguaaaauggggaacauuuucauacuuaucucaugauuuuugugaguauuaaguuuaauacuuuauaaagggaugauuacagaacauaguacccaguaagcguugacugaaauuguuaaguuuguaauauuuauaaaguuacaaugugauuugcaugaccagcuucuuucagugugugacuaauacucugaaaauacuggcuuuucauuugagccagauggcucagucaguaauuucuaguuaugccaucuuuuuuuuuuuuuuuuuuuguaaagacacugggcaccaaaggugcuacucacacagaauaucaacuuaaaacucacccuggaaagacaagauuuucauaguucuaaucagaaacauuguaauuuuguuauauucauguuaugguuuugaagguuuuguuuuuuuuuuuuuuuuuuaaauacgugaauuaaggggccggguguggaaggccgaaaugggagggucacuugagaccaggaguucaagaccagccuggucaacauugugagaccccaucucuauuuaagaaaaaauaaaaaaaaauaguauguuggguauuaguuuguucucaugcuacuauaaagaacugcccgagacuggauaauuuauaaaggaaagagguuuaauucacaguucugcauggcuggggaggccucuggaaacuuacaaucauggcagaaagggaagcaaacauccuucuucaacauggcggcaggagagagaagugcagugcgaagcggggaaaagcaccuuauaaaaccaucagaucucgugagaacucacuaucacgagaacagcaugggugaaugcccccaugaucuaaucacagcccaugaggucccucccucaacauguaauuguaguuuuaggaccaguuguaaaguuagugcagauaaagugggaacauuagaaggagaguuggaaccgggagaugcuuggaaaaucuacucaaacucucacuggauuuaaguauauuccuauuuugaaaauucaguagcuauguucucuaagaacaucagaaccucaguaucaguuuagggcaagacggaggaugcaaggaugaaagaggggauauaaauaaguuuuauuagguugggcaugguagcucaugccuguuaccccaacauuuugggaggccaagguaggaggaucacuugagcccaggaauuugagaccagccugggcaacauaggggagacccugucucuacaaacaguuaaaaaaagccauaugcaccuguguucccagcuaaucaggaagcugaggugagaggauagcuugagcccacagccagggcugcagugagcuaugacugcaccacugcacuccagcccgugcagccccaggcugagagaagugagacuccaucaaaagaaggaaaagaaaagaaaaaggaaaagagagaaggaauacguuuuauuguuauuuuaggaaaauuuggcuuugacuuuuuuuuuuuuugagaugcaguuuugcucuuguugcccaggcuggagcgcaauggcaugaucucggcucaccgcaaccuccaccucccggguucaagugauucuguggccucagccucccgaguagcuggcauuacaggcaugugccaccaccugccuaauuuuguauuuuuaauagaggcaugguuuuuccauguuggucaggcuggucucgaacucccaaccucaggugauccgcccaaaagaguuaagagcuugagccaggcgcgguggcucacgccuguaaucccagcacuuugggaggccaaggcagguggaucaucugaggguaaggaguuuaagaccagccuggucaacaugcugaaaccccgucucuacuaaauacaaaaaauuagccgaucguggucgugggugccuguaaucccagcuacuugggaggcugaggcaggagaauugcuugaagccgggagucgaagguugcagggagccaagaucgcaccacugcacuccagccugggcaacaagagugaaauuccgucucaaaaaaaaaaaauagagaagcgcuugggucugaacccacacauugaggcuccagcaauuaggcacuuaaccucuaugcuauguggccuuucuaaaauaaaauaauaguaaauauaacccaagaagaaacuuaaaaggugucaaucuuccacaaacucagguuuaaucucuugaucuaacaugauguuaaugucgaaaagaaaaagcguucguuguuacuguuguugaaaaauuuucauaaaauguaauauacauuccugauauuaaaaggaaagaauaccuguaaaauagagguggauaauaccauuacuaugguauugugacugacugagaacuacucccgagcgguaccagucccagacauuuccccugagcagggaguagugcucggucaguaggcacuagcaccgucauuguacaggucguuaagauacuugccccuuccuugguuaucuagccgcugaagggauaauuauguuuggcacaaagaggauggugcugcagcagagccuagcucuggcauuuuuucugauugaucggcaucuauucuauaccugcuguuaaauauuuugacucucacuccagaucaucaaauuguuuugagaguaaaugaguugaagcaugcauacugccuagcuagaccagugucugagauaaauauaauacagaguuugcuauuauaauuuagaauuuuuauugaguauacucugcugucuauacacaguuggcuuaggaaaugaauugggaagcuuuucuguuucauaggauaguuuaauaaaagaauuaccuuugaaauuaccuuuacuuacuaugaaaaugucugggacugguauuuggaguugaggggggagcuaacuguguaacuuaugcgaaucuucggaaguuauuggaguguuuucuaauucuguuagaugcuuuugacaauuuauauuuucccagaaaaucauccauuguaucuguguuuaaaauuuagcagcuuaggauuuacuggaaacauauuuuauacuuauuuuuauuucuucucuauuaucuuacuuccuuuucagucccuaauuucauauaauuguuuuuuuaguccagcuaauaguuugucuguuuuuuuuccccucccaucaaaauauagcgccuaaguuguuuucguuuuuuuuuuuuugagauggagucucgcucugucgccuaggcugcagugcaguagcgcgaucugagcucacugcaaccucugccucccagguucaagcaguucuccugccucagccuccccaguagcugggacuacaggcacgugccagcaugccuggcuaauuuuuuguauuuuuaguagagauggguuuucaccauguuagccaggauggucuugaucuccugaccucgugauccaaccgccucagccucccaaagugcuggaauuacaggcaugagccaccguuccuggcugcuccuagguuuuagaauuaauucugcaggcuucuguuaucuuacuugaguaacuuugaauucccuuguucuuauuuuuaaauguuuauuuucuaaccuugaguugaaugcucauuuaauucuugcucaguugaagguguuuaggcuguggcucucuuccucugaguauagcuuuauuaguguaccaaagauuuuuuucucuucuuuuuauuuuuucuuuucuuuuuuuuuuuuugagaccgaguuucgcucuuguugcccaggcuggagugcaguggcgugauuucagcucauugcaaccuccaccucccggguucaagugauccuccugccucagccuuccgaguagcugggauuacaggcaugcgccaccgcaccuggcuaacauuuguauuuuuaguagagucaggguuucaccguguuggccaggcugguuucgaaccccugaccucaggugauccaccugccucgaccucccaaagugcugggauuacaggcgugagccacugcccccagccuucuuuuuccuuuucuuucuuucuuucuuuucuuuucuuuuuuuuuuuuuuacacagauuagaguguaguggcaugaacacgacucauugcauccuugaccuccugggcucaagggauccucccaccucaaccucucaaauagcuaggacuucaggcacgcgccaggaugcccggcuaacuuuuuuuauugugugagccgcuaggcccagucguaccagagauuuuuauaugggcaguuuuuaucauuguuauuuucuagguaaucucuauugauuuugauuuacauuacuccauucaauuacuugaaguaauuuaaggagagagaguacauaaaugucaagucuacugcauuaaggggaguagcuuaauuguuucauugucagauuguauagacuauuucuacuuuccugaaauuuuugagguguuaauggccuaaauugaugaucaguuuuuauaacuguugcauagagacuugaucucauucuuucacauguucagccauuuugucguuuauguauuugaucuuucaggaaaugauacucuuauauucuuacuucugccuaaaaguuuuucuuagauuucuuugaaauuuuuguucuggcugggugcgguggcucacauguaaucccagccuggccaaaaugaugaaaccuccccucuacuaaaaauacaaaaauuagcugggugugguggugcaugccuguaaucccagcuacuuuggaggcugaggcaggagaaucacuugaaccugggagguggagguugcagugagccuugcaccauuguacuugagccugggcaacagagcaagacccugucucaaaaaaaaaaguuuuuguuguaacuauauauuaugaaaauuuugguauauauaguuuuauaacauaucuuuauagauuguaaucuugaucauuauaaaaaaugacccuuuucugccuccuuuaauauucuuucaguuugaauucagcugguuuugaaaggguguugaugcuugcuauguaugcuuuuaucuaaccuuuuacuuuaacuucucaaagucucuauuuuagauuugucucuuguagacccuuguaguuggauaaagguuagucuugacucaauuugagaugcuuuuaaucauuuacauuaauguuauauauuuugcuuugcuuauauaauauuaguguauuuguuuuguugucaucuauauguuugcuuuugguuuucuuucuuuucuuuucuuuuugagacagucuagcucugucgcccaggcuggagugcaguggcaugaucucgggcucacugcaaccuccaccucccggguucaagcgauucuccugccucagccucccgaguagcuggaauuacaggcgccugccaccaugcccggcuaauuuuuguauuuuuaguagagaugggauuucaccauguuggccaggcuggucucgaacuccugaccucaagugauccucccgccuuggccucccaaagugcugggauuauaggugagagcuacagugucuggcuugguuuucuuccuuuaaacuacaugguuuguuuucuuuauuugcuaucccuucugucucauuuuguaaguuauauacuguauuucguuaugucuaagauaccguuggugguugugugcuucguuauuuuguauaccauuaauacaguuaaaugcugucaaagaaacuaugacguaccauugauugaaauaugcaugcugauuucagauagacaaaaaugugaaaaagguacaucuuagaauagauuaaacaugguaguuuguaguucuauggguauuauaaagcuauagcuuuaauauauuuaaaucuauuauguuuaucaaauaguuuuuucaggagugguuguuugagugcucuuauguucaaaaaugucuguuaguggcuuucacaagcaacgugauguuuuggcugguuacagaauuuuuggguuacguuucccuuucucuuaauacccagcagacacuauuccauuaucuucuggcaucuaggguuacucuagagaagucuggggccagccugacuguuuuuuucccuuuguaggugaccuacuucugccugaguauugcuagaauucuuucuuuauccuugaaguucaguaacuucaucaggauauaacucggucuuggugugauucucuuacauuuuccuguuaaaugguaagccauucaaacugcagauucaggaauauuuucuuauacaccuuuuaauaugcauucauuuuuauuuuucuuuacucaagaaacaucaguuuuaugauuguuuaucuucauuuccugucuuccauuucauuacuuuucuaaaugcuuccuuuguucuuuucugcugugcucgaugugauuuucuugagauuuuguuugauaucauguuuguuuucaucaguaucagguugacuacuuccuauauaugaugggguuuucauuuugccaguggcuucaguacuucauucaauuuuauauauuuaugucugugaguugcucuuucaacuugucucauuuauuuccucuuuuaaaaaaaacuuuuacuuaacaguaaaaacagguaaaaccaccuguaaucccagcacuuugggaugcugaggcggguggaucaguugaggucaggaguuugagaccagccuggccaacauggugaaagcugucucuacuaaaaauacaaaaauuagcccggcguguuggugggcgccuguaauccuagcuacucgggaggcugaggcaggagaauccguuugaacuggggaggcagaaguugcagugagcugagauugugccacugcacuccagcuugggcgacagagacucccucucaaaaacaaacaaacaaacagguaaaaccacauuguuuuugagaagauggguuaaaaccaguuacaagugacuaauauuaaaauuuacucucuaagaagugaugaguaaaaugguuuuaucaagucuuguguuuuauuaauggcaugaaauauagaaaagcaggcuuagagauacuauuuuuuacaguuggauaaacuuuuguacacaguagaaaucugauuuugccauguguuuuuuuguuuaugagggagaaguguucaaugacuuuuucccaaagauuuuuuuuuuucauucagugaauuacaaaaugugcuagaaaaauauaauggaaauguaccuugcaugguggcuuaugccuguaaucccagcacuuuagaaggccaaagcagguggauggcuugagccuaggagccuaggcugcagugagccaugaucaugccauugcacuccagccugggcaacagagugagacccugucaaaaaaaaaaaaccauggaaauuauaacugacauguucugccauucacgugccacaauucaagaccugcuaugugauuuucuccugaaugccagucuuuguuuucuucugaggaaaugaaggugaucagugauaagcccccuggucuucauucaggguugaagggaauagugaaaacugugaacguguacaacuugugguuacuaagagugagacuuugacugcgaauuaggcaaaagguguaagucuuuuacuuuuuuuuuuugagacggagucucacugugucacccaggcuggagugcaguggugcaaucucggcucacugcaaccucugccuccuggguucgagauuccccugccucagccuccccaguagcugggacuacaggugcgugccaccacacccaucuaauuuuuuguauuuuuaguagagacgggguuucacuguguuagacaggauggucucgaucuccugacccugugauccacccgccucagccucccaaagugcugggauuacaggugugagccaccacaccuggccagcgcccagcuaauuuuuguauuuuuaguagagaugggguuucuccauguuggccaggcuggugucgaauuucugaccucaggugaucugccugccucgaccucccaagugcugggaucacagacagagccaccgugcccggcccgucuuuuacauuuuacauauuuuagcuguuuagggaacagcuucgcccguaaguuuuuuucuucucuucuuuuaaaaugauggcugagauacacacauucuuuacauuacuuuugaugugaacgaaggucauuucaguagacuugcacauuuagaguaugccagcaacuuacucaauauugcgauagguggaauuuacggucuggcgucugaauuguagcuuauccucaaccaucaaaauuccuacccaaauuucuuguguuccaaacuuaagaauuguuguguuucauugccaauaacauggcuuuuuccuaaagugauacauauuuuuaaguaauucauuucuugggcaaauauuuacugccagagacugucacagguccuggggcuauaucaguaaauaaacaaaaacccuuguucuuauagagcuugcuuuguaguuaggguaggggagagaagaauuaauagaaaguguagagugcuguguggaaacuagaacagggaaagaggauaaaauaaggaguguguaagggggugggguuucauuaaaaauagggugacaguggaccgaggaacucaggugaaugagugaaucaugcagagguuaggugaggcaagcacaagggcccugaaauggggcugaccugaacgcuggagggagguggcagagcgguuagcugaagguuggagagagaugcugguuaaagccccugaacgcuggagggagguggcacagcacuuagcugaagguuggagagagaugcugguuaaagccccugcgguggcagagcgguuagcugaagguuggagagagaugcugguuaauucugaaggacccuauaggccaucacacaggccauugcucugagugagaaugggaagcuguugguauagugacaugaugugacucacauuuuuccaggauuacuucugccugcuggguugagaguagauacaauagggaagguauuuuccauaguaccccagcacaugcauuuuuauuaaacauuuguggcugaaaugaaagcuucaccaacaauaacccuauuuuauuuuuuguuucuguuaggaaaaaugagugcugguuauguuccacuagaucuauuucaugacugugugacuuacgguugaaaaacacugccaaauagaauauagccucugacuuaguggacaagaaguaaaauugagguuuguguaugaaagcaaagugaacacaauguaaaauaaaaaaagaauaaaaacuuaaaaaucaacauuauguauauguauauauacuuagcuuuaaaaaacccaaauaaucaaauaccagugauucaagaggccuaauagugaacaaugcauucagugaaggauaaugaagaauuccccagaggcaacugcuuuuuaaaaccuuuuagguucagaucuccugggggcuuaacuccaugcuucuaaauaauauauuuauaguguuuauguuuugguuuaucaacuuuagacauucucuguugacuucuugcuaugacagauguuuucagucccacuucucacuacugaucucccucguacgacggucacugaacuggcgccucucugggguucugcccagaagauuagccuuccuccuucgcugcagcuccucugugaguauucugcucucugcucccuccacucugcuuacucaguucacguucuuccauccguuuucaucuuucagagccaugggcaauccaccuggucuuuuuaauauacuuuaaauuaaaaaguuauuuuuuaauuucuuuagaaaaauuuauuuaacuucuuaggagggaagaggagauaagcacaugugcccgcacugacaccuugaacuagaagacacgauuaggccaaagcuuuuuguugucaaaaguguguaguguauguguuuuaagaguuagauauauucagaauaucuuaucuuuuaaaaauuguaaauauuuccccauguccugaaauauucuuguaaaguauuuuaaauagaugcauagcauuccuucauaugcugcuacuaucauauuccccacaucuugacuucuggguuuucaaauuauaguuguaaaccacuuaaauuauaauuagugcuucuguggauuuuccuuaugaaaacauuuauacauaauccuugauuauuucucuucggauaaauuucuggucauuucuuaguuaaggaaaauaaauauuuuugagguucuucauaaauauuacugauugccuucuagaaaggcuuugcuaauuuguauuuccacuauuaacuguaucaaagugccacuuuuuauuguguucuucauaccaccaggaacuuuaaaaaauguuugauucugcuagguaaaaagaaaauuauuuuaaaaauucccaagaaaggugaacaccuugacaguuuggaaugugugugugugugugugugugugugugugugguuuuaaagguuuauaagaguaauuauuugccuuuuaauuuuuuauggcuauuuuggcauuuagaaauuuuauuuuucuggccagggcacaguggcucaucaugccuguaaucccagcacuuugggaggccaagguggguagaucuguugaggucaggaguuugaaaccagccuggccaacauggugaaaccccgucucuaauuaauaaauaaauaaauaaaauauauuuuauuuauuugagauggaguuucacucuuguuguccaggcuggagcgcaauggugcgaucuuggcucaccgcaaccuccgccuccuggguucaagcaauucuccugccucagccucccaagcagcugggauuacaggcaugugccaccaugccuggcuaauuuuguauuuuuacuagagacaggguuucuccauguuggucagguuagccucgaacuccugaccucaggugauccgcccaccuuggccucccaaagugcugggauuacaggcaugagccaccgcgacuggcugaaauuuuauuuuuuuaaaaucauccagcuaaguaggcuuucccauuuauuuauuuuuugacacuuagaguaauguuucccauuccuaaaaucaaauaagaguaugcaaaaugugaagauagcuuugaauuuggaguggcguauggaaaagugccugggagaaacuuggcggcaguugauuuagaaacaauuaggcuuuggcuuguguuaaaaaucuguggaucauuuagauuuucgauuguugcuguccccaugucuccuguugccccauacuauagaugguguuaaauuguuagacacuuccaugaauguacuucauacauguaaaacuucguagaugcaugacucauggcucuggguggucuagcuaaacuagucuuuuacgucauacguguaaaacuuuguagaugcaauaacucauggcucuggguagucuagcuaagcuagucuuuccacucaaagagcacgauacuuaagcuuucuccuggugagucaugaauugucaucagggaauuucucacuguuuggcuuaauucgauuaggaacugcuacuggugauaguuuaguccuuauuuaguuuuagucuaagagaaccuuacugacguuacuauaaaucuaaaaaaaaaaagcauaccuuuaaaaaagccuaauggcaauggacuagucaggauaguaagaaaaaguuauacuggaaagagagagaugguuuaugaauugguuacaaaaaauacaucaguauuauuuugaagacaacccugauuucagucaugguugaaauccuuaaccaaccacaaaaaugucuuacauuuuaaauauauuaaaguccuuaaauuauggaaauagugucuucuaagaaguuguuuaauaguggaaagaagagucucagucucuuuuuuuuuuuugagacagagucucauucacccaggcuggagugcaguggugccaucucagcucacugcaaccucuaccuccugggaucaagcgauccuccugccucagccuccccaguaguugagaccacagacacaugccaccaugcccggcuaauuuuuuuuuugagacagaaucucgcucugucacccaggcuggagugcaauggugcgaucucugcucacugcaaccuccgccucccagguucaagcaguucuccugccucagccucuggaguagcugagacuacaggcacacuccaccacgccugacucauuuuuuguauuuuuguagagacgggguuucaccauguugcccaggcuggucuugaacuccugagcucaggcaauccgccugccucggccuuccaaagugcuaggauuacagaagugucuuuuuuuuuuuuuuuuuuuuuucuuuuugagacggagucucucucugucacccaggcuggagugcauggcgcgaucucugcucacugaagcuccaccucccggguucacgccauucuccugccucagccuccugaguagcugggacuacaggcguccgccaccacgccuggcuaauuuuuuguauccuuggcuaauucuuuguauuuuuaguagagacggaguuucaccauguuagccaggauggucuugaucuccugaccucgugaucugcccgccccggccucccaaagugcggggauuacaggcgugagccaccgcgccccgcccaccauugucauguuguuagugcagcacagaagcccaucaaguggcagucaauaauuuccuaauuuguuuuugaaaaaaacuuagcuacauuccaauuuucuacgugcuuagguuucuuuuauaaguuugaauaaauguauaaauaacuucaggguuguuuuauggguucuugguaccucacacagauaaacuuguaaauggaauaagauguagaggaaugcaaaagaagcuaaggagcaagcaugacagcauccucuuauuuuaucgccuucuccucugcaguagucaggguacagggcacugaauucagaucaaaaucauagacuuuacuguaucucuugcuggcgaaaauauuuaaguuaucugacauuuacuaggucuauuaaaucacccaagggaagaacuuuuuuuguaugcauacgguaguaaagggcuuuugcaaaaccaguauguugauauuuuggacaacauaaaacaauauacaccuuguacauuuacuuuaaaaauuaacuugugaaaagcauuucucauuuuguuuacuuaguuuuuaaauaaagccagacuaguuuagcuuaauauauggguucucagcugggagaaccagauuaaccaucauucuagucaaggcuuugaguuuccauucucugaaaugaugacuugcaacuugguggaauuugauauucuuuccaaaacuaagaaauuuuggugauccauucggaguuauuucugcucucuuucuuuaacagugagacugagaguaucggucuacuugcacugcacaugggccaaaaugggccuuucacaggagaagcucuacacaaaggaaaggagaaaggguuccugcagaaggaagagaagggcagauuuguucucagaggucacuuauguuaaggcaaggauggcagaugucucaucauggauuuauuuggcggguguggcugcugaguacuguauugggaggaauccuaaguacgugauagguuauuaauggugcugucuuugggugugggccacgucgaaggcuugagggugauucagaguaaugacacaguccgucuguauuuuaggaccugccacacaaggagguaggaauaugcuuggcuuccauuugaugugucccacacuucugauauguauauuggacuuuuuaacuacuccauucuacucuucccccuucucacuacuguacuuaacuaagucuuaauaaacaaacacacaaaccgguaacuccucaucccucuuuauccugagccccuggcaacccccauucuauuuucucucucugaguuugacuucucaagguauuuucuuuucuuuuucuguuucuuuuauuugugacagucucgcucuguugcccaggcuggggugcaguggugugaucuuggcucaguacaaccucugcuucccgguuccaagcgaaucuccugccucggccucccaaguagcuggauuaggggugcccgccacuacgccacuacggcuauuuuuguauuuuuguauuuuuuuugagacagagucuugcucugucacccaggcuggagugcaguggcgcgaucucggcucacugcaaccucugccucccagguugaagcgauucuuccugccucagccucccgaguagcugggauuaacaggcaugagccaccaugccuggcuaauuuuguauuuuugguagagacgggguuuugccauguuggucaggcuggccucgaacuucugaacucaggugauccaccugccucggccucccaaaguacugggauuacaggcgugagccaccgugccuggccaauuuuuguauuuuaguagagacgugguuuugccauguuggccuggcugguuucaaacuccugaccucaggugaucugcccaccuuggccucccaagugcugggauuacaggugugagccacugcaccuggcugcaagguauuuucauguaaguggacucauacaauauuuauccuuuuguaucuggcuuauugcacuuggcauaauauuuucaaguucauucauguuguagaauguaucauaauuucauuccuuuuuaaagcugaguaacauccuguuguauguauauacugcacauuuuguuuauccauucaucuguugguugacaauuggguuguuuccacguuuugacuguugugaauaaugcugcuuugaacauugguguacaaacaucuguuugacccccugcuuuaauucuuuugcauauauaaccagaagugaaauugcuggaucauaugguaauucuaaguuuaauauuuugaggacaugccaugccgccuuucacaaugguugcauccucuuacauucccauuagcaaugcaugggguucuaauuucucuacauucuugucaacacuugucauuuucuguguguguguuuaauagcaauucuaauuggugugaagugguaucucauugugguuuugaauuucuucuauuauuagugauauugagcaucuuugcauugugcuuguugaccagacaucuuuuuaucuuuggagaaaugccuauucaagucauuugcccauuuuugcauugguuuucuuguuguuauugaguuguaugaguucuuuuuguauucuggauauuaauccuuuaucagauaggugauuuacaauauuuuucccauuuuuuuggggguugcuuuugaugaacuaaaguuuuaaauuuugauccagaucauuuauuuuuucuuuugucucuauugcucuuggugucauguccaagaguuuguugcuaaauccaaugucuugaagauuuucucuuauuuuuucgccugagaguuuuaaaguuuuagcucuuacguuuaaguuuucaguucauuuagaguuauuuuuugcauaucauguaaggaaagaauccaccuucauucuuuugcuuauggauacccaguuucccuaguguuguuuauugaaagauuuucuuuccucauugagcggucuagucaaccuuguugaaaaucaguuggccauauaugcaaggguuuuauuucuaggcucuuauuuuguuucauugguguauauuaugucugucuuuuugccaauaccacaguguuuugauuauugucguuuuguaguaagccuuggaaucaggacaugugaguucuccaacuuuguucuuguuuucaagaauguuucggcaauuuggggugugaauuuuaggauggguuuuccaaaaguuguugggauuuugauacagggauuacauuguauuuguaaauugcuuuggguggauuuuuuuguguuugaggaaaagauucaguuguuuagaagucucuuaagcucucuuuauuuuacuuuugucuuuccagcauaugucucuuucauauauucacuuauacagaauaguguacauaugugugauacaugcaauguaaauauguacaauuuuaagaguuauuuaaaaacaaaaaccauguaacugcuagcaggugaagaaauaguugguugaaguuuuaaaacuacugaaauagaguuaugacugauggacuacauugacacgucaucacccacaaucccaucauuuauaucaggguucacuuuugguauuguacauucuauggguuuagagaaauauuugacguguaucuuaccauuauaguaucauacagaauacuuugauggcccuaagaauccucuucagauugaauuuuugaagauuuuaaacuacuuuuuuuuuuuguuuuuuguuuuuuuuguuuguuugguugguuuuuuugagacggagucucgcucugucccccaggcuggagugcaguggcgcgaucuuggcucacugcaagcuuugccuccuggguucacgccguucuccugccucagccucccgaguagcugggacuacagaagccugccaccacgcccggcuaauuuuuuguauuuucaguagagacgugguuucacuguguuagccaggauggucucgaucuccugaccucgugauccgcccaucuuggccucccaaaaugcugggauuacgggcgugagccaccgcgcccggccuuaaacuaguuguuaaauagaguauccuauucaacauuguggauuuuucuaauuauuuucucaagaaaucauuuaacuggcuggacaugguggcucaugccugugaucccagcauuuugggaggcugaguugggaggaucacuugaauccagcaguuugagaccagccuggacaauauagugagaccccuaucucacuuuauaaauaaagcaauuguuucacuuauuuccacauccccuagauuuccugcaaacuguagcaguacuaucuaauagaaacaugggaaccacacaugaaagccuaaugugugauuuuaaaauuguaaccacauuuagaaauguaaaaagauagguaaaauucauuuuaauaauucauuuaacucaauauacccaaaauauaauuucaagauggaaucagcauaacuuuuuucucacaaagucuucaaaaauccaguuuauauuuuacauuugcagcacauguuaaguaagacuagccacuucuuaggugcucaguagccacaugcgacuaguggcuauuauauuagaaagugcaggucuaaccuaagaagcuugauuugauucaguguaaacauuuugggggaggggcaagaguaugucauagaugaagcuuguguauaccauuuugcaucaaauaagaagauacacauucuuggguuaaugguucuaaauucgaacaauuauuuggugauugccagauuucuccguugcgaagaugcauuaucucuuuuuacuggugaguaaucuguggggugaugcuugggcaucauauucuguucuccagugaccuuuucacuuaaugguuuuagcauccauugaucauccuugccuggauuauuacauuaaggguugcaaaugaaaugcucuaaauauaucuauguaacaaauuuccaccccuuucuuccauuauauaaagcauuaaaaauacuaguuacuggccaggugcaguggcucacaccuguaaucccaggacuuugggaggccgaggugggcagauugcuugagcccacuucgagaccaugaugcccauggugaaacccugccucuacaaaaaauauaaaaaugaauugggcauggugccauguaccuauagacccagcuacucaggaggcucgggaggauugccugaguccaggaggucaaggcuuuagugaacugugauugugccacugcacuccagccugggcgacaaagcuguucucucagcccagucuccuuaguaagaucuaauaauuuuuccuuugggagaugacuuucucuaaacuuuggaggucagcaauaaauugaaagggacuaguuucuuaucugauuaauucauuuucauuuugaugaauucguaugccuucuuagguucuuccuuaaaauccuuaauuaaaggaguuuugucuucaucaucauccugcaucagaaacggcaucaguaauugauauuuaaucucauagguugugaugaguccuuacuuuuguuuuacagguugcucuuaaguauuguuggguuuucagaguauaucagcaaaggcuuuagcuuaacaucgcucaauuuuuuaaauauaaaagcaauguuagccugacacguuuucuuuuuaaauuucuuaccaaagcacaagauggcauucuuuaagaaaggucuauuuuugucaguuauaaauuugcuuuccaauauuucuccuuuauuaauaguuuucugcaauucauugggggaaaguuuguugcagucucgcuaucagcagaagcuaauuuauuuaucagugauauuuaauguuaugcauuuauguacuguucuuaaaccucucaaacaauucagggcuugcuuugcaacugagcugcucaccaaauucuccuguuucucuccuuucaccuccaucacuucggagauaugaaaugcacauugcuguugccacagugcucggugguuccaugcugcuggugguuauacauuuuuguaugaaguauuaccguaacuguuagacaucaacauugccuuccauuuguauuucuguugcauagaaacagucuuaugugugauacaggggauauacuuaaagucaggggcucagcuuuugguucccuugccuuuaaauaaaugcauuacuuccaauuuuuucuuucaguguuuguacuuuccuaggccucuuacauagguucaccuguauuuucccaggacaccccauuuucuuagaagccauuuuuacuuaauguggagaagaucauguacaagaugccuuucaguagaaguuauauuucaugcacaacauuucugaucaugcagcagggcucucuucuuuugcuaaugugauuauaaggagaagaagcacauacaaauaaauaguuauuugaauuagagaaauauaaucuccuaaugccaucuuagggaagaguuugaggaggaguucaaggcaugauaggaagauacaacagagggugaguuagugucagcagaucacagcuacuuugacauaaucacaccuguuguuccccuuuggaagaaaucuuggauuggaccuggcauggucugcugcuuacauuauucuuucuuucuuaugucaagaaguggguggagacuacuuagaggaaugaggaaucaacaccaucuuaauauguguuugugaguagaacaucuuguauuuguauuaccuguuccaguuuuuaacuuugugcauuuuaugugaauccacuucuuauacuuccauuaaaaguaguuuaauacuuggucauauguuagaaaccugucauucagauuguugcauuucaaaauguagacaaagcugucauucugacuuguuuggcuuuugaguuucauaccacacuuaguccaaucaaaauauaaaaaagaaaaauuauguugcuaauuuucaaauuucaaacuuuugcuuuaauuauaauaaacuuuauagacacacauuugaaucgcacacuaauagccuaggaaaauuagggguuuaaauguaaauauugccuucaucccuuagacucuaaguaauagcaacaaacauugggcaaauuggcuggguucaccuguaaucccggcacuugggugggcaggguuggggggcgagcucaggaguucaagaccagucugggcaacguaggaagaccuugucucuaccaaaaauacaaaaaaaagacagacauggugguuugugccuguggucccagcuacucaggaggcugaggugggaggauugcuugagcccaggaggcggagguugcagugagccaugaacacacuacugcgcuccagccugggccacagagugaaacucugucuccaaaaaaagaaagaaggccacaaugcuuaaaaagcccauccaaauaaucagaaaaaagagaaucacucaauguaaaaaaaacggggugggggaauaaaaauauguaaaugcaccaaagauaaauugccaguggcagaaggaugcccaguguuagccagcaguaaaaguacccaguguuagcaaggcuguagggaaauaguugccuacaguguuucugggauaauacauugaaguaaacauuuuguggcuugauauauauguuccuuugacuuacaguucaguuuauaguuuauauucuagauauacuuccacagauguacaaggagagugcaaaguauucuuuuuaaauuaauuuuuuuuuaagauggggucuuccucuauuguucaggcuggagugccauggugcgaucauagcucacugcagccucagacucuccugggcucaagagauuuucccucuucaucccccagaacaguuggggcuacagguucacaccgccuggcaauggcagcauuguuuuuucuuuuuauuuauuuuuaaaaagacuuuuaaauauucauaauuucuuuuuuuuacuuuuuguuuuuuucacuccucucagcucauaccuaggcagcauuauuuauauuugagggggaaaacgaaaagagguaugguggugggaacgaguuaucuaguguucagacuaugcuaaguggccaucaguuauacaaggaugauuccauuucuguauaguauauggugguguagccuaagucugaaagaauacacagcaaauuguuagcagugguugucuuuggagagcaagaagguagugucuaaugccuucuauuuuauuuuccuauguuacuuuaggauacauggccuuuuuucauaauuuaaaaaaucaaaguacauaaaagaaaguugaaaauauucuacuacuuaguaauaacaaccaccaccuacagaugucucccaacguugggcauccuugcauccaccuuucagugcaugcaugcgggcugaaaucugagguuguaauagaugugccauuuauauacuuuaaguugcaaguugcauaugaaugacaacccagcuaagguaauauugaagaaauuauugaccuauagauagacauuuaucgcaagaagagauuaauuucuaaaagaguccuaaaguugagagaagaaaaucuauaaaaaccucuaaauaguuuugagacucuugauagaacccacugacuuccugauguccaggaugagggaauaaacacauauguauuccuuaguaccucucucccuuucccuccauucccuucccauuuucuaaucauaaauauagauauauuuaguaauugguuauucuuuuuuaacauagaaauccugauaauguaaaauuacgacaauacagaaaauaacaauguaaaauccugacaauguaaauuuauauauaaauccugauaauguaaaaauaggaccaauggcaacaagaaaauaauacacacacacacacacgugugccacuuggcaaugacagcauauauuauuaaauauauauauauaaaagcuuauagcauucauggugguuugguuuuauuuaugcauuuacaugggguugguaacuacacuggucccuuucaccugcguuuuucuguuacugaauucuuuauuuugauugauuucgcagcauuuaauucaaaaaguaccauuucuuaaguccuuaaaguuuacaauacauguaaauguguauuaccaucuuauuuggacuuccuguuugggcuucucucucucucuuuuuuuuuuuucgacacaggugccuaggcuggagugcagcagcaugcuuacagcucacugcagccucgaccuccugggcucaagugaucugcccaccuuagccuccugaguggcuggcaccacaggcgcuugccgccauguccagcuaauuuuuguauuuuuuguagagguggugucucccuguguuguccaggcuggucuugaacuccuggguucaagcaucuacuugccugggccucccaaagugcugagauuacaggcaugagccaccaugccuggcugcauuucucauucuuuuuaucacauucuucuucaggauuccguauuucuucacgucacuguuacuuaccuacaaugaguauuguggagaaaucugaggcuaaccugguugguuccacccacccaccuauacuggacuuguuuuuucccuuccugaauauccuugauauuauuuaacuuuaaaguucagugccucauuugacagauguuuuauuguuuauucuguaccaguuuuuucugaguugugggauauguuuucaaucuguauauuuauuauuauagaaagcuuuauagauuuaugacauuuuaauauucugaucucuucaggaaugccaguuuaacuuauguaaaucuccuuuguuuauuaucuuuacucuuuaaaaauaacuauuuaucuuuucauuagaaguaugauuucugaaaguuaugaccaugauuuguuuuuagucuguuuuucacuuuccuuuaaggucuccuguugcuuuauaauguuuucuuucuggucuucuuuaaaaauauguuucuguaauuucuuugagacuguuuuucugaagucuuucugguuuuuuauauguauuauuuggugguugaaaugaacuuaaagugaauuggaaauucaagaaucucaugacugugcuugcuuccuucagcagcagcaugcuuacgacucacugcagccugagaaucacuuuuuugccccguauaauguggggaagguaaaaggacaguugagaaccacugguguauucgaggggaaacugauuagggaccaacugggaugugaacuuaaaaauagggcuuuacacaugaagaagguggcauucuuaguuggaagugacaggaauucaacuaaaauaaauuuagacaaaaaggaaaacugacuucuaacuaaguuuauagaagggcaggaguaguaccagguguaagaaaucaaagaucuguuuggauuucuuguugcuuauucuucguuuuggcuucauucuccuugagacuugaauugcggcuauuggcagcucucaggccuuuauggcacagcuucccaacucugaaaaaccacucccuccuguggccuugggguaccgggggccuuguuuggcaguccuacuagaaacauaguugggcgugagguuugaagcuggguaguauuuuccaaaagaaauaauucagguaugggcuuguucucaggauucugaagaauacagacguauuccuuuuauguccuguagccuaauuaaugagcaauuuuaaaggaagaaaauggacaacuaacauuuauuguaccuuaagcugggucagacuuucgcauauacaauaucuucuccguguugcaacguuaccaagggcuuuaccauccuuuacugauaaggaaaaugagacucaaaaaauagaaaugaucuguuuaaguugcccaggcuaguaauacauaauaucauaugcugugcccaaauuuuccauugugaagugacauucagaaauccucaggaaucaucuuuaucaaauuuauuucuauaaaauaggcgagaucaaaguaagcuguuugugugacacuauaaacuaguguuagggcauaauuucgguauugugaggaguuccugcugcgacaaaucuuggcagagaugcaugcuuaugcuauuguguauaauuuaugcacaagcaacaacguacuuaggacuuaauauugaagaacccugacgccugugauugaagaagcugugauaagcagggugaaauauuacagguagcagaaugucaguaaguguuauuuuaggaaugugguccagaauucugccaagcaaaucccuuugggaagcauauugacaaauucuuuuuaagggaucaucucugaucuguuuggcuugucuguuucauuuuccuuauguuuuugaagcacaguaaaauaaauuggguggaauauuuuuuguuuuguuguuuuuugagacagggucucacucuguauuucccaggcuggagugcauuggugugguuuuggcucacugcacuuucuacuucccaggcucaagcaguccucccaccucagccuuccgaguaacugggacuauauaggcacaugccaccauguccggcuaauuuuuuuuuuucuuuuugagacgaagucucgcucuugucgccuaggcuguagugcagugacacgaucucagcucauugcaaccuccuucucccagguucaagcgauucuccugccucagccuccugaauagcugggauuagaggcacccgcuaccacgccuggcuaauuuuuguauuuuuaguggagaugggguuucaccauucuggccaggcuugucuuaaacuccugaccucagguuaucucccugccucagccuuccaaaguacugggauuacaggcgugagccaccacaccuggacaggguaucacuauagugccaagccuggucucaaauuucuagguucaagcgauccuccugccucggccucccaaaguguucggauuagaggccaccgagccuggccuugauuuuuuuuuuuuuuuuuuuuauucaagagacauggucuugcuccaagcuggagugcauuggcaccuucuuagguuacugcagccucaaacuuccgggcccaaacaguccuccugacucagcguccccaguagcuaggacugggucucucuauguugcuguugccuaggcuggucuugaacuccugcccuuaagcgauccucccaccuugaccucccaaagcacugagauuacagguaugagccacugugccuggccaaaaauguuuuugauuaggaaaucagcuagccgguagcccgugucgugguacaaauaaaaaauucuaauuuuaagcaaauuuuuaaaguuuaccagaaauuuguaaaauuuauuaacuugaugcaucuugaaaucuaaagaggaaauacaccuuugugauugcuaugcuugacuuuuuucaguauuaauuaauggaagguugaaggacgggaacguuuuugcaguuacuuuuggugacuugguuuguggcauuuuuauguuuuaagguaacagcaguuuauuccucugauaauaaggucaaaauuauuuugacaaauuaucucaauaguuaggaguaauuauguacuguuuggguaaaggggucugucuaucuaugaucucagaaguucaaagugaagcugcaguaaaaauaguuacuuuacagacauauaccuugcagccaacuguguuguauaaauaaacuugacaggaacucacauucccggagcaggagaccacagucacccagacacaaaggaaaaucguuacuaggcuguaaaccucaguuuguauuuggcuuuguagaaguuagacuuagccaacaauuggucuuggcaaaguacacuuaggcgguggcucacgcuuguaaucccagcacuuugagaggccgaggugggcggaucacgagaucaggagaucgagaccacggugaaaccccgucucuacuaaaaacauauauauauaaaaaauuagccgggcgugguggugggcgccuguagucccagcuacucggagaggcugaggcaggagaauggcgugaacccaggagguggagcuuguagugagcugagaucgcgccacugcacuccagccugggcuacagagcgagacuccgucucagggaggaaaaaaaaaaaaaaaaaggagccucuuuucuucuguuuuuuuguuuguuuguuuuuguuuuuuguuuuuuguuuuuuugagauggagucucgcucuuucgcccaggcuggagugcaguggcgcgaucucggcucacugcaagcuccgccucccggguucacgccauucuccugccucagccucccgaguagcugggacuacaggcgcccgccaccacgcccggcuauuuuuuuguauuuuugguagagacgggguuucacgguguuagccaagauggucuccaucuccugaccucaugauccgcccgucucagccuccgaaagugcugggauuacaggcgcgagccacagcgcccggccaaaaguagcuuauuuucuuaguagucaaguacaaaaugacgucuaguugggucuuggaauguuauucugagaauuuguauuuugcugaggugcagugaaguuuuacuuuuacauaaugaucgacaauacugaaaacauuauuuuaggcuauauuaaacuuauuuuuagauuaaaaaaaucuuuugaggaaaauuuuaaaugcccaauaauaccaaaguagacagauagguauaaugggccuccauguacucccccagccccugaagugauuaggucauggaucagccucguuucaccuaucuuagcccucucccuaaugacugugaaguacauucuaaacaugaucauuugucuguaaauauuucaguauguaucucuaaaaaugguaagaaaacccccagcacaacaccacugccaaacucaaaaaggaaacaacaauuucuggauauugucuaaugucucauuacucuucacauuuucauuugugucauaaucgucauaaauuuaaaaaaaguuugaauucauuucucucuuuugugcuccuugcaguauauuugcugaagauucuaggucuuguucuuuagaauauccugcagaguagaucuugcuaauugugucccagggauguccuugaacauguuucucuguuucuguucuuugugaauuaguuauuguacuuaggggcucaaacagguuagguuugugaggugagauuacuucauauguggugguuuguucauuuuucaggagacuguaauaucugguugucuuuuaaaaugccuggauuaaaugauaaaauggccaauguuucaguuauuuuucauuuuuuagcuggaguauuuuuauagagagaaaccucauuugaucaaauaguaauuacuauuuugauuacuuggcaauauaauuuguguaauaaaaaaggaucacacuaaauguugauucuuuugcuuuuuaaaauugguuuucagaauaacaaaaugguuucccagcauccuguaguggugauaaauuuguuucuuguuuuugauuucacaguuauaaacucauggauuuaaacuugcauauuucaagcauucguuguuacuaacuuuauugacacucaaauugucccauauuugaccaguggaggccucuucaagcuggcucuugaguccuuuccacaauaccauaguauuacucgauagcuuccuuuuugucugcuaugugugagaugaaccuaacauuucuugcucuagaccuggagucagccauuucucugaagagcccugguccguuuuagugauaaauucauauuuagaaaccauauucugggcacuacugggcuguucauuuuuucuagaccuuuucaguggauagaucugagaacuauauauuugaaagcaaugucauuuuauauucaucuaauuccgauucagaaaugcagcguuuuuacuuuucauaugcucuuucuguucuuuuuuagucuuauucuugguaaugacucuaucuuagcaagucugcucaugcauuauuuuccaugacuuaacacauagaagucauuacucucaaggacacuaccuugucccuggguuuccuuuuuauucauggcuuguagaccacucuggcccacagugauuuccagauucauagcaugcaagcauaacucccauuuaacagucacuggauacuccaggauuuacugaguuuuaaaaauugaaguauaacauugacaggaaaguacgcacauauuacggacggcaugccucuaccaguacaccagaaguccguuccaugccucuucccagauacuacucucacuuccugcuccaaaagacagagagagagagagagagaaauacuaucguccugauuuguaauacuguugguuaguuuugccuccuuuagaacuauaaacuuuuguguuuuagcagucaugacuuuugugagaaagagaggucuuucuagcccuuuccaacucuuaauuuuaucucuagauagcauucagaaaagauguuaucuucaucuuuggcauucucaaaacuccuaauaccuuaggaauauaaguagaaggucaagcauggucacuuuuggguuuuaguuucccuuuugauuuacagaagcucuguuuguauuaggaauuuuaaacuucucccuauuuugcaaauauucuuucccagucauuuguauuuagacuuuauugcuguacuaaccuuaaaguauuuuguguagcauuauuugacuguugaguuuuguguccugcauaggaggaccaccuccacucaaauugaugugaaaaaacacuauucuauguuuucuuuuaguuagguuuuauaccucuuuguuuauaucuguaaucugucuggauuuggauguagugugagguauccguaucaacauuuaaacacagauaggauguuuuaacaucuuucagccuuuuccauuaaaauaaaacuugcuugaauuucauuuacccgugacuacuacacuuuuccaucuaccgucaaacuuuuagaaaaaauuuccacuuggguuuuuccacuucaucuucucuuuguccacucagcguugccugcauggauuccaccuuaccuucacacugacacugcuuaugccgagggcaacuguggccuuuuuuuuuuaauugaauccaguggacugaauauagaccccuucuucccugagcuguauguguuuaucaucauuggauaguuucuccuuuaaaugcaucuccuuuagcuuuaauaaaauguuuucuuggcuuuuguuuuuuuuuuuuuuuuuuuugagauggagucuugcucuaucgcccaggcuggagugcaguggcgcgaucucggcucauugcaagcuccgccucccagguucacgccauuuuccugccucagccucccgaguagcugggacuacaggugcccgccaccacgcccggcuaauuuuuugcauuuuuaguagagacgggguuucaccguguuagccaggauggucucgaucucuugaccucgugauccgccugccucggccucccuauuucacuggcuuaccuuucucaguuuaccuugugccgccuccuguuuuuuguuucucaguuguuaauauuuucuagaauucauucgguuacauccccugcaguuuauauuaaugcuuauccuugggugaugcaucaacuuacaaccucagugaucagccauauucugauaacccugaagucucuaucgucagcucagauuuuuuuuucuuucuuuuuuuugagucggaguuucacucuauugcccaggcuggagugcaguggcaugaucucggugaccuccgccuccuggguucaagcgauucuccugccucccaaguagcugggacuacaggcgcccaccaccacccggcuaauuuuuguauuuuuaguggagaugagguuucacuguguuagccaggcuggucucgaacucccucaccucagaugauccacccgccuuggcaucccaaagugucgggauuacaggcgggagccaccgugcccaguagauuucuuuuuaaagcaauguauuuuuugucccuaacaaaaggcauuuaauaccaagcccaucaccauuuccuccccucucuugacaaaccuccuccuauguuucucauuucagugaaugaacagauuucuacccuugcacagaaaucuggugucagaaaaacagggagggaggaauugacauuauagguaaugguguuaaaguguaccacucagugguguuucguguauucacgauguugugcagccagccaccagcucgaucuagcuuucagacguucucaucacaccauuaaaucgccaucccuauaccccuuaaguaauuacgcccccuuucucccuucccucauugucuaaucuacuuucugucucuggauuugccucuucuggauauaucauauagaauaagucauauaacaugugacuuuauaugucugcuucuuuaacuuagccugauguuacugagcuucauauauuaguacuucauuucuuucuguggcugaauaguauuucauuguauguauauacugcaguuuauucauuugucgauggacacuugaguuucugccuuuugauuauuacagcaaaugcuacuacagacauucauguacaacuugcuguguggacagauguuaggguauauaccuagaaguggaauugcugggucauaugguaacucugcucaacuuuuuaaucauaugucauuuuacuuuuuuuaaaaaaaauuauuuuuuaaacugagacaaggucuggcucuguugcccaggcuggagugcccuggugucaucugaggucacugcaaccuccgccuccugggcucaagucaucuucccaccucagccuccccgaguagcugggacuguaggugcacaucacugugccuggcuaauuuuuguacucuuuuguuucuuuuuuuugguagagacagggguuugccauguugcccaggcuggcaucaaacuccugggcucaaacgaucugcccaccucagccucccaaaguuuugggauuacagcggugagccaccaugcccagcucaugucauuuuugacuuacuacuuuaagccccacuucuuuaacaucaccagguuagguugauugauucucuucuaaauagccuuguuuucuucauuguuucgacuacuauauacucgagguacacuuuucaagauuacuugaauugcuugcuuuuuguuucuuuguucucaucaugccuuuuuaaacaaucuucuacauacuacaagauugguuuuugcaaauguaaaucucaugaggucacuccauuguuuaaaagaaaaagaaaaaaagaaccacccuucaaaggcuuaucauugcccucuggauaaaguccaagcaugcagggcuuacaaaggcccuuugcuguccagcuuuugacauucuguuuaguuucagcugcuccccugccccccgccguuccagucacauacugauugcccuauuucaaguuuuuguacaugcuccucuaccuaaaguaggguucagauucuaaaccuugaauucccucacccaaauccuuuauuucuuuucuuuuuagaagccuuuucuuauucuucaugauuauguuaugugcccuucuuuuuugugugcccucaaauucuuguacuguuguuggagcacauuguaauugccuguuuacuucucuggggaucaggagccgauguuggucaagugccagaagauguagauagacugaaaguacaauuaauaggaauuuagcagaagccaaaagauuauuugauaaauuauuuagggaagacuucauggagggggcuaguauugauagagaccuugaaggaagcauucaugaaggcaugguaagguucuaucacuuuaaauggauuaagccuguuaaauauucaugcaucuagaccuaggaagauucaugcugggggcugaagccaugacaaaagugagacauuggacauuuuucaacauugcuuuuguauuacuuacauggaacaagcaaaggacacaauuaugccuguagaagaaaugcauggaaagaaugggcaaaagauuucaagaacuuggggguuuugacaagaguaagaagcaaugauaugcuuuauggaaaguguaaggaaauuuucaaggguaauuuugaccauguauacuaauuucagagcuuacucaccuauguuuauaaacccuggacuucugguggaaaaugcaacaacuaggugauuucuggauauauuauagaaucuuucacaagacucuuguguacaguguuguagaaaaugguccgaguaauguaaugguguuucucuagaaaaagguuggaaaugagaucagucauguagaaaauaacuccucacagugcauuugugugugcugcacucuguuccucaguugacaggaaagugggacuuucuguuuuuuaauagaaugucugcaacauaguuggcgcucaguacacauaugcgugcauaaacaaaauaacagugaaaaugcuguucccuucuuaauguguuugcacuuucaauaucuuuaaaaaguauuuuagauuagccacuuuaaaguaaaaguacauuucuuguguuuugaaauacagagcugauuuuaacuauuuguaaaagucuaguuugccuguuaugcaaaaauguuagacuuauaaaaaucuccccucacauuucaagaaaagaagcacuucauguuuaaacauaaauuuuuuauuuuuauuuuugagacggagucucgcauugucacccaggcuggaauacaguggcauggucuuggcucacugcagccucugccuuccaguucaagugauccuccugucucagccuucugaguagcugggauuacagauguccgccuccaugcccggccaauuuuuguauuuuuacuaaagacaggguuucaccauguuggccaggcuggucuugaacuccugaccucaagugauccacccaucuuggcuuccugaaagcguugagauuacaggugugagccaccacgcccugccuaaauauaaauuuucacuauuggcuuucuccuauuuugcuggcauguuguuaaaucguaguuguugaaauaauaccaucucuugauuuccccaaaaauuaauaucuccucaguuaccuaaacauugguucaguccuuuguagcacucugaguuauauuauacugccuuucaucauuagacaaagcugccugagaaugauggcagguaguauacgagaauuacacaccuguugagacucccagcaaguccuuuucaaaccacucuacuccuguguguucuuuguccacacuuuccaauuugagccaaugaguacucaguuccacuggccgguaaaaugugauaauugugugggugauugauacaugcauucacuauugugauuguuguuguguugguuccucugguguauaucaguacuuauuaaauuguguguguguguuuuuuuucuuuuugagauggagucuugcucuguuacccaggcuggagugcaauggcgugaucuuggcuugaugcaacauuugccucccggguucaagcaguucuccugccuuagccuucugaguaacugggauuacaggcacacaccaccaugcccagcuaauuuauuuauuuauauauuuuuugagacagaguuuugcccuuguugcccgggcuggagugcaauggcgcgaucuuggcucaccacaaccucugccuccuggguucaaucaguuuuucugccucagccucccgaguaacugggauuacaggcaugugccacuacgcccagcuaauuuuguauuuuuaauagagacggcguuucuccauguuggucagucuggucucaaacucucgaccucaggugguccaccugccucggccucccaaagugcugggauuacaggugugagccaccacgcccggccaaauuguauaauuuaaguaugugcaguucacugaaugucaguuauaccucauuaaaguuguuuaaaaauuucucacaugaucugcucaccaucaggaggccaguacuuuauuaagucuggugucucuggaaacauucugggcucuguaccgcugcucaccugcuccuuaaggucccugucuuggccugugugcccccaccuugccaguuccucgccucucuuguuucccacccugucauccuuucuccaugccacagcacucucuuuagaggaggagaaccucacgaugcugcagccauucuguaugcuccagguguuacucuuaagcugcuccucugucccagaagcuguggcucucagagggucgacauauacagacaagacauauggggccccugcucuccuugugcucagagauggaugggcacacaggagcacccacuguagaagcagguccccaagacuacagggacaagucaaauagguguacaaauguuaguauaaaugaaaguuauuaagcgcaguacauuccaaugaaaagguaugauuagacacucugaaaguauacccugaagacagcagcauaagaauugccaacaugauuugauuuccagggcucccucucaaugagaaucucugggggacgggccuggauaucugcauuuuaacaagcuuccuuaaaagaccacuguagggccacuuagaaugacaagagccuggcuggauaccaguagaaguugaucuucuggauaguuugcuuuacccagggcuuucuuacaguauaggcaugaaaauguuuuggccaucaaguagcauuuugccuggcaagguauaucuauuuaaugguuuaaaacuuacauaaaacauguacgcucaaguucuguaauuuaucuacuggaugcaaauuaugugcuuaaauguauugauuaaacuuuucuuuuuccacagaacucaacaaaaauccaguggaaggcuuuucugcagguuuaauagaugacaaugaucucuaccgaugggaaguccuuauuauuggcccuccagauacacuuuaguaaguauaauggaacugacaucuucaaaauggagcucuuuuaauacacugaauuaaaaacuauuuuggcaggcugggcacgguggcucacaccuguaaucccagcacuuugggaggccaaggcgggccgaucaugaggucaggaguucgagaccagccuggccaauguagugaaaccccaucucuacuaaaaauacaaaaauuagcugggugugguggcaugcaccuguagucccagcuacucaggaggcugaggcaggagaaucacuugaacucaggaggcagagauugcagugagcugagaccacgccauugcacuccagccugggugacagagugagacuccaucucaaaacaaaacaaagcaaaaccacaaauauuuuggcaaacugacaugaaauuauuuuuuaaggagcaggagaaauggcuguauucaauauccuuuguacugaauuugaucauggaagaguuuuuguguuuugcuugaagcucuaaugucuaagaccuauugcuauuaaaaauaauaguuucaggccgggcgcgguggcucaugccugcaaucccagcacuuuaggaggcugagguggguggaucaccugagaggucaggaguuugauaccagcuuggccaacauggugaaaccccaucucuacuaagaauacgaaaauuagcugggcaugguggcaugccuguaaucccagcuacccgggaggcugaggcaggagaaucacuugaacucaggaggcagaagaguuauauaauuuuuggacauuuuaauugagaauguauuacacacaucaguguuuuaagaaggcuaaggagaacuuucaagaucgucucuuuucaugguucucuacuugaguccccaccgaauacugguuagaaucuagguguucuuaucccaaacuaaacuaauggucacuuucuccuaguuuauugaaaguuauuguuaugcucuaugauaaucuauuaacugacuauuaauuguuaaaccaauggcuuaaggauagacaacaauguaguggugugaaagagcaguagaagaagagaaauagaguuuaaaaauauuucaugucguacauuucuagaugcaaagaccacagucuucuuuucugcucugaguguuugcagacuaacuuaaauuuacuaguauguauuguuuuguaagaugcaucugcuggcuuggugcguuggcucacgccuguaaucccagcacuuugggaggcugaggcguguggaucaccuguggucaggaguucaagaccagccuggccaacauggugaaacccugucucuacuaaaaauacaaaaauuagcugggcaugguggcgggcgccuguagucccagcugcucaggaggcugaggcaggagaaucgcuugaauccgggagguggagguugcagugagccaaaauuacgcuacugcacuccagccuggugacagagcgagacuccgucucaaaaaagaaaacaaaaccgucucuggucuuugguguacauuuuuaaaaguguuggcuguugaauugagaugugaaucacagcaauauuucuggcagcucugcuggaguguguauaugcugcugagaauacugguggucacuucuggacugugccuuccugagaucacuagccuuugcucaggaaagagagagcauauuccuagggcaggaccugagaaaggcaaaggaagguacaggggaaugaagaaagguuuguuagaaguaagccuuuuagaaugcuaccaagaaccauguacuucauagaaugcuuaaaaaauauuuguugucggccgggcguaguggcucacgaggccgaggugggcaggaucaccugaggucgagaguuggagaccagccugaccaacauggagaaacccugucucuacuaaaaauacaaaaaauuuagccaggugagguggcauaugccuguaaucccagcuacucgggaggcugaggcaggagaaucgcuugaauccaggaggcagagguugcagugagccgggaucgugucacccacuccagccugggcaacaagagcagaacucuaucuaaaaaaaaaaaaaaaaaaguucuuaaaaaacuucuuagcagaaaguagugagguucuuguaauuauuucaguggaauggagagaguagaggccaucuuggaauuguuugaagagcacuauuggaagugaauauauacaccuuacguuuaaauaacugccugugaagggaaguagaggcuugugcuggggggagggguguuauaggauugaaaauaaauuaguauaggcucagaugguacccagaccuaagugauuaauucaccacuuuauaauuagauaauagaaauacuguaccaaaauucuguaaaagcugcugugauuaucucucugugccaucauuagcccucauguagucacuagagggcgcuccacucucuuuucagucuaugugauugauaaccgguaccguucaaggauuacuuugagacuccuauaguugccacaagucuuaauucagucauacucauauuuauauagcauuacauuuuuauuuuuauuaaugagucuuuccagugcaguagucccuaaggccuuucuaugaaauguacauucugaaacuggugugguauaccaacuguuuucagacugauuaucaaacaguauggauaaccacucauauccacagaaauuaaaauuucagguagaaguggcaauagguuuguaguacggaaguuuaggguggauacaguggcucacgucuauaaucccuacacuuugggaggccaaggguggaucgcuugagcucagacguuggagaccagcuucggcuacauggcaaaacccugucucuacaaaaaaaaauacaaaaauaagucaagcauggugaugcaugccugcagucaggaggcugagcccaggagguggaggcugcagugagccaagauuacgcuacugcacucuagcuugggcaacagagcuagacccugucuuaaacaaacaaacaaaaccagaaagucuaagaaaccuggauaucacuguaucauuauaacauuuuauaaauuauuaaugaaugaugacuguauaacuuuuaucucucuuuuccuuucaucaccaguggcuggucuguucaaggaguaugucuuauuuauuuauuuuguuuuuaagcacuggcaaugauaugaaaaaucuggagaaucuuaagauuauguguuuuguaguauugccuuggguagauauagaaaaugaagaaucaguuaaccaaaacucugaauuacauucuuuuacaguugcaaaauucuauuccaguuauaaauuauuuuccaguccugugugagacauagaggcagaagccaucucuucuguaaugaaguucuggagggaaugaaccuagugccuacauugcuuggaaauggaaugaucagugguaaugccaugcgguuuaucacguaguguucaagaacauggacuuuggggacugccuuugguuagcucucuaacucuaccacucuucuuaguugagugacuuugaacaauuacuuaaauuuggucuuagcaguuucauuucuaggguaaaaacccuaugcuuaggaaauguuucaaauguuccauguucuauugcuuauaauagcaaaaaaaaaauuauuuuuuccccuuuugcaguuuuauuauuuauuuuuguaaaugucaauuauaauucgaaggacacuuuguaguuacuaauuagacuauaugaaaaacuguacagacuguuuguacuauaauuugugucccuaagagauuaggggacucaguaacagaaaaaucaacucagaagggucacugcucagcaguccacauaaccacauaguagagcccaagcuacugguugugaguagaaagagacuucauacaaauaucuucacaugucuucuagcauuaugccccuaccaggaaagggaaugucugucacaauuuuuuuuuuuucugcuguaagauaaagaaaaggcuguaucccuuagacacauacuuaaugaagacaaucucaaaagaagcuccuguguuuuucuguuuucacuguucuuuucugaaguucaccuggauguuccagagcaguuuucuaaaccuuucauuguugguuggccuuuuguagaauucuucagcaacacacaauacagaagacacaggcuaaaauaguucucacaaauacacuuugaaauagguguauuuggauauaaauacaacuugccauuccauuauuuuuuuucucaugacuaaacucuaaauuuuuaaaaauggagauuuucaaaccagugaugugcaaaagcccauucucaugacacagucauuuaaacuuauuaaguaugggaaaauuuuauuucuucccuuugucuuguggaauaauuuagguucucacccugggcaugauucacaaaauagaguaagaccacagauaaaagucacauagaaucacaggcaaugaagaaaacuucuaaaaacaaauaucccccaguguccaguaucauccaucccagcagugauggaaaugauggccaccccaagauucugaauggagugcgugaagccauaugcaguucccaguugauguucaggaacuacagaugccacuguuggccaaaaugcacaggcaagcgaugaauaggagauucccagaagacacagcaacccaagggcuccacaucauaaaggccagcaucaugugggacacaagaguggcugcaaccacacgcagaacccagaugcuguucuuccccgugucauccacugggagcccaaauacuggggugugggagcugauaacgacauauacaacacuguucauugcacuugcugccuggaaagaaaauccaaauuugucuguaaagaaaacuuucccaaguccaauaaaagggaacauggcaacacaauagcagacacagaugauaaauaugagccacagggguaaggagaaauccuuuacaucaguuaauguaaaaacuuccccccccuuuuuuuguuguuguuguucuuuaugaaggauucucucugcucucgcaucuaaguaagcaagagccaaggaaggcacagauuagugaaagaauacauuuuauacccccaaucuuaagugugaccccagggguugugugaccagcagaaccccacgaagcuucaaucuuagaauacagccaacucacgaaguucauguuuaccguacuuccaauucuagccaugcuaaauuguuggaguccagacaccagguuuaauucuuugucuuuaaaccagcugacagcauauguccugggcaacugcugagcacuccccaccaauccaaacacaagucuuucaaauuccaucagccaaaaaacauuaaauauuccacccagaacaaaacaaccuguccagugcaaauaaaacagcuaaaaguaauugugccccaucauauuccaaauacucggucuuuuaaaaagccaccaaagaaacacaaaacuacauugggccaagaauaccaggcauauagcagcaugaauuucaugguguucaccugccuguuccguuuauccugagucugaagggcagcaggauuauuauagcaaaaauagcugcugaagccaaggaaacacaucaauaacagcaucaaaagucauagccaggugacuggaggccacagaagggccagcagcacccaugcuuucucauccuucuccuccauugcgcccgugggaggcugagaggcaaaaggggugacaacuccaggaccuggcagaaaagcagugcccacggagcacagccaagucagugaucacaugacuaugugauucugacuaucauagaauaauagugaacuguggcggauagaaugaauggacaagagacagcuacaacaggacuauagauuaauagaacaauguugagcaaauugcagacggcagcauacagcacauuauuuacauaaaauaaauauggcaguaugguaggauuugauccuuguaagauuuuuauaauuuaacucaaaaacaguaauggaggccucauggaaaaaaauugaacuaggccuggguuuuuaaacacuuucaaaugugaaacugcugguuacauaucucucucucucuuuuuuuuuuguuugaaaacagagucugacucuguugcucacugcaaccuccgccgccuggguucaagugauucuccuaccucagcuuccugaguagcugggauuaugggcaccugucaccaugccuggcuaauuuuuguaguuuuuaguagagaugggauuucaccaucucggccaugcuggucuugaacuccugaccucaugaucuacccgccucagccucccaaagugcugggauuacaggugugagccaccgugcccggccuacauaccucuuuuuaauaucaugauaguacuuauacuauagcaucugugaugaagauaauauguaaugaaagauauuuugaauuaauuggugccuuuuuaaauuuuauuuuauuuauuuauuuauuauuauuauuuuuggagacagagucuugcuuuguggcccaggcuggagugcaguggcacaaucuuggcucauugcaaccucugccucccaggcucaagccauucuccugcuucagccuccugaguagaugggauuacaggcaccugccaccacgccuggcuaauuuuugcauuuuuaguagagacggcguuucaccauauuggucagguuguuuucgaacuccugaccucaagugauccgcccgccucagccucccaaagugcugggauuacaggcgugagccaccuugccuggccacagucacaucuuucuauauuugaaaaauaguggauaugugacauguuaauguguagucuacaguguuauucuacucuauggguuuugggcuuucucuuugcuaacuuggcugcucgguagaaguuugcacgcacaaguuggguacuaguuaguuaagcaucaaaaaaaaaaagcagguaggccaggugcgguggcucagaaggucaggaguucaagaccagccuggccaacauagugaaaccccgucucuacuaaagauacaaaaauuagcgggacgugguggugugcgcuuguaauccuagguacuugggaggcugaggcaggagaaucucuucaacccgggaggcagagcuugcagugagccgagaucacgccacugcacuccagccugggcgacagagcaagacuccaucuccaaaaaaaaaaaaaaaacuaaaaaaaggaaaagaggggaggggcagguagaauuuccacagguaaaauagaagaagagggguccacagauaggagaaaaacucagaaaugcuaugguugcuucagagugggcaaggccauuuucagauagagugaaaauugugugcuuuaaauuuuuagggcuacucuuuuaguugaauuugguugacauuuuagagauugaaaacaauuuagagggucuaagucaguuuuucaugaugaggauuccagucagcuauuaugaagcuuuuuagugaauguaaccaaucaaaaguaagugacgugggaaagcugacuuaauguugucaaggaaucaaguggcaaguggcugccaguagaaucaagugcaggggcuuuguggcaguggcuuugauguccuuuuacauugacucuuuuuuuguuguuguugagacagagucucacucuggcacccacgcuggagugcaguggcacaaucuuggcucacugcacccuccaccucccagguuccaacaauucuccuaccucagccucccaaguagcugggauuacaggugcacgccaccauguuuggcuguuuucuguaauuguggcuuucaaacccauaauuagaaauacuuuacaucaugacgcagugcauacauauguauauauagauuagugaauaaaacacauacauagauuauauaacugaaacuacuugugauaaacucuguuuucuauuuuuguuaacaaaaaaacuuugauagugacucauuaaauugcuuuugcagcccuguuugaaaaacuaguccauguaaucaguauauccuaagacccauuuuggcacuaacuuacacagagcaacaggaucaguagauaaagacuuaacucuuuuugguguaaugcacucuucacaacagcuauuccagucucuauucccucaagcccucaugcuucuuccuuucaauagauaaccucaucaguugugaaaaguaaggcgcuauggugggccuuacuucauuucuacauuucuucgaauaucucuuuuaaagcgcuuguuuuguacaguuuccccaucuaguuacuaucuucaacuguuaaauuuuuuguauaaauuguccuguuuauuaugcuuaaguacuuuacuacccuguucuuuaacccuuuacagcuuuuuuuccuauugcuuuuuacuaaaaaaauuguauuaucaaggucacugacuuuauacucugaguccuguggcauuuccuaauuauucagaaauguuugguguuaaugaucugucucuuuuuuuaaacuuaaucugcaccuuccccaugucuuaugaucagaaaaagcaauaaaaauucauacuugcuugugaacaguucaagcuauauuaaaaagagcagagaguaaaagaucucguaacacuaacuauuguuaguuaacuauuguuauguauugauguccuguuucuggacauuuuucuauguguauacaaacacacccccaauuuuucacuuguucuuuccuuucuuuucuuuuuucuuuucccaggcuggagugcagugcaguggugcaaucacagcucucugaagccucaacuucuugggcugaagggauccuuccccccucagccucucaaguagcuagaauuacaggcaugagccacuguguccggccucccacuuuuucuuuaaagacaaauuagcuuguuuuagaaauaccugcuuuuaaaaauguaacaauagauuccucauaucauuccaugacaacacuuacuacugauauuuuucuugguagauauuuuccuucugccacuaaaaugauaagcuccacagugcucuuuaaugcuuuguucucuguuguauccuuuuacguagaccaaugguuagaguaacuggguaaucaauguauauuuguucagugaaugaaaaccauuuaaugagcugagaauuucauuucucacugaucugaaacaaccacaaucaugauucuaaugguuggacacauugaacaacagaagaaucagaugugcaaaugguacugcaauaaagaaauuuaaagaggucaauguacuagaagggaccugguggcuaguuuagauuuuagucaaauaaaaucuuucuagagguaacguuuaagcugaguaccgaaugauaaucagaagacaaagggagaaaaguauuuccaacagaggaaauauuuaguaccaaggccgcaagacagaaauuuaguauuuuugcccuuuaaggcugacuugaucucugugguuuuaguuaauguauacaacucauuguauuguucuuuugaugauuccuuaagaaugacugcugauuaagugucagugaucuggagguguauugucuaaaauagcagucacagggcauauuucaagugguugguggcuacauuauuggacagcacaaauacagaacaucuccagcauuacaguuugguuuuacagugcuguucuggaaagucacucuugagauuuuuuuugcugcuauaccccuggaguuugacacauaaaugccgaguaaauacuuguuaaaugaugaaaugaauaaauggauagauggaggcaauauaucuauuccuagauaaggaaaaagaaaauguccauaaguuuugagaugagaaaggguuugauguguuugaggaauagaaagacgacuggcuaguuucaaaucaacauagagaaauuggugauguuaaaccuucugaauuuuguuuuaagugcacugggaagugauggaaggguuuguagcauagcaguaauaugaucugaucugaucuggugugaaugucuuuuuagcagaugauuucauuuuaccagcucucuugaaaguuuaaucaaugugauagccaugacaguuuauuaaacuacuuauuugagaaaguaacugccugugggaauccagauuauuuguuuacuucauuuuugauguuagugcuagcacccuuguuuuauauuuguuuuaacacuucuauacuuaaaagcaggaacuuauaggcaagaacuucuuuuuguucuuuuuuccagugaaggugguguuuuuaaggcucaucuuacuuucccaaaagauuauccccuccgaccuccuaaaaugaaauucauuacagaaaucuggcacccaaaugguaaguuuaucuaguuuuacuuuuacauuugcagauuugauggccuguuauugaaguguucaaggucaauaagaaagaucuguuucucagugaaauugcuuuggcauuuuuguacuguucauugugcacauggcuguguacuaaaaccuuuaaaaggaggagaggccaggugcaguggcucacaccuguaaucccagcaggccaggcaggcggaucacuugaggucaagaguuggagaccagccuggcaaacauggugaaaccccaucucuacucaaaauacaaaaauuaguuaggcaugguggcacacaccuguaaucccagcuacuucggaggcugaggcacaagaaucgcuugaacccgggaggugcagguugcagugagccaagaucacaccacugcacuccagccugggcagcagagugagaccgugucccaaaaaagagaaggagaaacagagaucauguggaaaaaguuauuuuuuauuuauuuacuuaguuuucaguuugguuugagacucguguuuuaaaccagagggcaugguuacugagggauaacaucaauagaacuccuauaauugaggggauaauuaucaagguauuagaugauucacuggcuauuacaaagaacacagaaauuaugaaaccugguucuguaacuuauaguuuuucauauuauuuuuauaccauggacaacucuucuauguguauucauagguguaagauuacuggcagugucauaugaaacaacguauuacauuuuuuaagccuggaaagcaucuaguauggcugugcacguagugaugacauugacuuuuuuuacuuaaagaagagcuaccacuucaaauccacacgguggcaguucuccugccuagccagcugccacuggacucucuccccuguauauaagcccccaauaacuacgucuuauuuaaaaauuaaaaaaaaaauucucuauaaaguaaaauaaaguccccaaaguuuaggccagauaagcuauauuuauaaaacagucucucugaacuuuuggcuuuguuuuguaugauagaacuugcagagauuucuuuucuaauuauuuugacuauguaaucagaguugucucuuuaggcuauuauacuaauuugcauuuggcuucgcaucaucaagacuucugggugcagggaauagaaacauauagauuaguuuaagcuggaaucagcgagacaggaaugaaugauugaaugaaguuaaacaaggauuuaucggaaggauauggaauacguaauagaagccaaggcuugaaaaccagaugggcauuaggagagacuggaacuggcaaauggagaacuacugggagccaagggacuuagcguauuuuauugcaucuaaggcagcagugaucguaaaagauagugauuuuuccuaccaguaagaagaggaaaauaucucuaacaguugauggcagaaugcauuaaccguauuccugcaugaugcgggcaugcaugaaugggugacgcuugccucuugugcuuuggcuuuucuuuuaucucuuccuaggcuuucgacaguuucuucuaccuucacuugcauuacuugauuauaauaggcaaucguuuugcaccuauuucgaagauguaacagauucugaauguuggcuucaccacagacuagcuguguaacucuaggcaaacccuguuggagccuuaagcuagcuagcuugccuuccucccucccuccgucucuccuucccccacucugccccuccuuuuccccuucucucccucucucgcucccucccucccucacguacguuucucccauuccguccuuuuuuucuaagacagggucucacucugccacccaggcugcagugcaauggcaugaucacagcucacugcagccuugaccuccugggcucaagugauccucccaaguagcugggaugacagggacacgccaccacacccagcuaauuuuuguuuuuuuuuguaaagacgggguuucaccauguuguuggccaggcagguccugaacuccugggcacaagugaucugcccacuuuguccucccaaaguacugggauuacaggcauuagcuaccacgccaggccuauguuuucuaucugugaaaauuagaugaaaacauacauguaagcaaauacaugggagacuucccuucugguaaaaagaaagagagcaaucaccuagguaguuuaagaggacagcugauaaaauggugguguguuuuguuuuaagguugaagagacuuuuuuuucuuuucuuuucuuuucguuucuuucuuuuuuuuuuuuuuuuuuuuuuuuugagacggagucucacugucucgcccaggcuggaaugcagugggacuaucuuggcucacugcaaccucugccuccuggguucaaacgauucucuugccucagccuccugaguagcugggauuacagguguccacuaccacgccuggcuaauuuuuguauuuuuaguagagucgggguuucaccauguuggacaggcuggucuugaacuccugaccucaugugaucugucugccucagccucccaaagugcugggauuauaggcgugagccacgcgccuggucuuagauggaauuuugaaugaagaugaugcuuggcuugaacuucauucuuuaggcugugaggacucauuuaauucaugacauuuaaagcuguacauauugucaugacaaaaagagaaaaugacaaaaaauaaaaaagcuauguaauagguuucucuuauauuuuccuucuugaaagauuacacucauagaagauuggaaggggaagucagagagauagcagggagguagagcauuuuagcaauaauuugaguaaaaaacaauaaaaacuugaacuaagaauaguguugcaggaaggguaauuuaguuucuuugacuugacugccagaggugaaugguaaaggagaaguaagaguuuaggauugacuggccauuuacaaaaauaauuauagagugaaaaccauaaugaaauaccacuuuuuacccacuaggauuccuauaaucaaaaagauaauaacaaaugucaaugaggaaguagagaaauuagaacucccaugcacuacuggcaagaagguaaauggugcggguguuuggagaagagccuggcaguccucaaaagguuaagcauaguuaccauaggacccugcacuuccauccuaggaaccuaaccaagaaaacugaaacacauguccagaaaaacucgaacacgaguguucacagcagcauuuauuauucauaacagccaaaaaguagaaacagcccaaaugucuaucagcugauaaauagaaaaacaaaauguggacccauauaacggaauauuauuuggcaauaaaaagaaaugaauuacaugauauuguuuucuaaagaaaagaaagaaaugaaguagugauacuugcuacaacauagaugaaccuuggaaacauuauauuaagugaacaaagucagucguaaaaggugacauaguguacgauucccuuuauaugaaaugucaagaauagacaaauccauagagaccgaaaguagguuagugguucccuacugcuggaggggaggugggggggauugaggaaugguugcuaacugguacugcguuucauuguagggugaaaaaauacucuaaaauugauugugguauugauuguacaacucuguagacauacuagacagaaaccauuaaaucgugcuuuucaaauaggugaauuguauaguaggugaguuauagagauguuauaaaauuauuauaggggaauaguuuuaugugacugaccuuacauauauucagcuuuucuugagguauacuugcuacacccaguuagauaauuaguuaaaccaguccaggguucagcaaugagcuuaagggccuuggaaguuacuguaucaggaugauagauaacaugauaaugaauggguuaguuuuccuacggaaaauauaguuaauguuggagauuaggauaacaucaaaagucaaauuaaggaaaaugaaaacuagaaagugacugagagaauguucaagaaccaggggaaaacaagaguaccacagaugccaggggaggaaaauguauccagcaaaguguugucacaguauuaguugucuuggcccagaggggugacuucagguagcugaaaguacccaggagaauaaauaugcuauccagaccacuuguggacacaguuguagcauccugcuagggagaagccaguuucuaggagaauaaaggaauaccugaguaguaaguaaauagagaagaugaggguaaaucaguuuuucagaauuuuaggugcauggccucaagaaaaaggagguagcuagaaguauaugcauuguuuaggcagcuuaguuuuguuuguuugguuuugguuuggguuuuuuuuuuuuuuuuuuugagacagagucucacucugucgcccaggcuggagugcaguggcucacugcaaccuccgccucccagguucaagcaauucaccugccucagccucccgaguagcugggauuacaggugcgugccaccaagcccggcuaauucuuguauuuuuauuagagauggguucaccauguuggccaggcuggucucgaccucaggugauccgcccgccucagccucccaaagugcugggauuacaggccagccauacauuacagugggccgagccacugugcccggcccagguagcuuaguuucaucucuaaugaacacugaaaugaaagaaaaaaguaacaagcaaaaauuauauggggaaaacuaagaaacaccguggcaagaggaaaguaaacauuaaguacauaacuggcuaaaggauaagaacagacauuucacaaaagaggaaggacauacagguuauauccauggaaaguugucaccccaaaagcauuuagaaaagugaauuaaaccagauguuauauaugaaauuuaaacagcaucaauaaaggaaaauguucauccugaggaggcaaugaaauggccaucucagauugcugauggcaguauaaauugauacaauccuuuaaaauaugguuugauaauagguauuaagccuaaaaaucuucucauucuaaaauaaaugguauguuuaaaaugacaugagaagguuaaaaauguaaagauccuggauuagugauaacuugauuuuuuuuaaaaaggaaaauggaucuuauauaguggugguagaauucuguacacauauuuaauagcauguuuuuaaagaaaaaugacuuggaaaaaauccuuauuacacaguaaguacagaaaacauuguaaaauaguaauacucuaugaaauuuuuaugcugaauuuuguaguguuacaaguuuugauguuauuccuuuuuuuuuuuuuuuuuugagauggaguuucgcccguugcccaggcuagacugcaguggugugauguuggcucauggcaaccucugccucccggcuucaagcaauucuccugccccagccucccaaguagcugggauuacaggcaugugccacaacagccagcuaauuuuguauuuuuaguagagaugggauuucuccauguuggccaggcuggccucaaacuccugaccgcaggugaucugcccuccucggccucccaaacuguugggauuacaggcgugagccaccacgcccggcccucgguguuauucuggcccugauucuauuuuaguaaauagauuuuacuagcagauagggauggguugggaagaggaaccuuaauuauagaaaaccucauacauaaaacauugaaggcacgggccuugccugucauauauucacugcuguacuucucugucagaugugugccuggcaugcaguaggcauugaaaaaguauuugucggccagcgcaggggcuguuuccuguaaucccaguuugggaccagccugggcaauauaguaagacuauaucucuaccaaaaaaaaaaaaaaaaaaagccaggaauggugccaugugccuauggucccaacuacuugggaggcugaggugggaggaucacuagagcccaggaguuugagaccagccugggcaacauagugagacccccaucucuaccaaaaaaaaaaaaaaagucagguuagccaggcaucaugccaugugcccauggucccagcuacuuggagggcugaggcaggaggaucguuugagccugggaggucaaggcugcauagagcugugaucauaccacuacacuccagccugggugacaaagugaggcccugucucaaaaaaccaaaacagcaacaacagacaacaccaaaaaauaagaauuuguugaauuaagagagcaaugauauugauugguagauacaaacuuugauucugauuacccagaguucauaacagcagaaauacugauguuaugaaacgaaaaauaagauuuagcauuauauuuauucacaaauuuguuagacuauauaggauaaguuaggaaugaaauauacauaaacauugucacuacucaaauuccuuucuaaaauuucuuccucaaaguaugauuuuuaaaaaaauuuacgguggguaaauguuaccauaaaagauuaguuucacaauagggauuauuuauaugauguauaaaugaauuaguggauuaggaccuuuuuuuaaugaauaaguaauauuuuacuuuuuugcuaaacugcuuaaauaguuaugucaauacaugucuccuaaaaauaaggauguuuucuuauuaaauguguuuauagaaaggaggccucuugagugucguauauguugaugaguuuucauuggcaguauggcauguuuguuuugugaauuugaauauacuccuuucucagaaaauacaauuuuggcuuuauaugauuguaaaaauauauuucuuaggaauagucucugggccuuugacuauuaccaauuuaagucgguaaguuaguggggaaacuaggaggccauuacauagaaacucaguugcuaguuuuuggaaaaauaugcuuucugcaaaugaagaacacauccaauaguugcuauuuauucauuuauuauauuauacuuaagacauguaaauguuaggcaccaucuacgugcuagauaucuucauguuuuacauaaaugaaaaagauagcuuguauuccuauuggguuugucagauggauccuguguauguaguacaaucuauacuauagucuucuuaaaaagucaacacauugcauuuuggacauuaacuucugcguaugugucauguuugauaaagguacugugugaaucaggaucacauuuguaauugauauuucauguauaaccaaauuaguaauauaugaaacaagccucuucuugaauuuugcaguugauaaaaauggugaugugugcauuucuauucuucaugagccuggggaagauaaguaugguuaugaaaagccagaggaacgcuggcucccuauccacacuguggaaaccaucaugauuagugucauuucuaugcuggcagacccuaauggagacucaccugcuaauguugaugcugcgguaagguggucacacgucuucccuucccuucacuuucccuuguaauaaaaccugaacuauaguuaguauguauguaaguaugcaugaauguaugcaugcguguguguguguguguguguguguaucucuucccauaguucuuauuuuugacaaaauaaauauauuuauuuacguauuuauuuuauuuuuuuugagacagggucucucugucaccuaggcuggagugcaguggcacaaucauaggucacugcaaccucaaacuccugggcccaagugguccuccagccuuggcuucccaaauuguuccgauuacaugugugagccaccaugccugaccaaaagugcauauuuauuguauacaacauguuguuuugaaauauggauauguuguggaauggcuaauuugagcuaauucacauaugcauuaccucacauacuuacuaauuuuauugugagaacacuuaaauucuccucucagcaguuuucaagaauacuauacgucguuauuaggauguaaacugugacaccaaauuuagaauuggggguggaaugggcagagcagaaguguaguuuuucaaugcaaucagauuuuuaucagcuuaaaauggcuugucguaacugugaaauuuuuuuguaagccucauuuuaaccacagagcaaaguccuacaguaguuaacacaaaagauaaaaaguaaggaaucggggcugggcacgguggcucacaacuguaaucccagcacuuugggaggccgaggcggguggaucacgaggucaggagauugagaccauccuggcuaacacggugaaaccccgucuccauuaaaaauacgaaaaauuagccgggcgugguggcgggcgccuauagucccagcuacucgggaggcugaggcaggagaaucacuucaaccugggaggcagagguugcagugagccgagaucuggacucuaaaaacaaaagcgauugucauaccuaagacaauuuaaugccuggucugaaguucauauuauuauccccaaguuuucaauuuucaaaaguuucacaucuauagaaaaaaauguauuaguuaaaugaacaccagcauaccuuucaccuagguucaccaguuguagaaauuuugcaacuuuuuuuccuaaacaguuugagaguaguuuauagauaccauaacccuucaccccaaaauguuucaggaucuguucccuaagaacaaggcugucuuuccauauacacaguacaagucugucguuaauguaguacuauuauuguuuaugcauauauaaucuauauucacauuggauuggauuguccaguauucuuuauagcugccacgccccuauccugcaguuuuuuuuuucuuuuuaaauccagaggcuagucuaggaaccucuguuuuauuuguauucaaguuuuauuagucggcuuuaaucuagaauaguuccuaguuccuuagccuucucuccuucuuugaaaagccuuuuuuucuuauucuuagaaccuuuguuaguacuauauaccaaagccagggcauaaaauuuaccuuuuuucuuagguuaauaacaacuuggguggaaucuuauauacagacugagacacuauagauaacucccuuugaaagcuaugacugaaauuaauaauagaauugaacuaaaaacuggcagaaaacuaucuauuuaaucaaguauuagucuaaacaauguaagacaugauaagggagaaggggugauagcugcauuaaaagaaauccuaggaaaucauuuugagagagaccugaugaauguuuauaugguucaugcucaacuaucagcaauuuuaauaauaagaucagaguuggccaggcgugguggcucacaccuguaaucccagccguuugggaggccgaggugggcagaucacaaggucaggaguucgagaccagccuggccaaagugaaaccccgucuuaacuaaaaauacaaaaaaauuagccaggcgugguggcaggcgccuguaaucccagcugcuugggagacugaggcacggagaauuguuugaaccugggaggcagugcuugcagugagcccagauugcgccucugcacuccagccaggguaacagugcaagacuccaucuaaaaaaaaaaaaaaaaaaaaucagagcugacaaguugcccuuuuuauuuuauguauguauuuauuuauuuuugagacagagucuugcucugaugcccaggcuggagugcaguggcgugaucucaccucacugcaaccacaaccucugcccucuguguucaaucgauucuccugccuuagccucccaaguagcugguauuacagacgugcggaaccacgcccagcaauuuuuuuguguguuuuuaguagagaugggguuucaccauguuggccaggcuggucucaaacuccugaccucaaaugaucugcccgccuuggccuccugaggugcugggauuacaggcaugagcuacugcaccuggcccuuuuaucuuaaagaagaguaaauuaauagccaauaaccaagaccaugaauaugcaaaaauuacuuuauuaacccuucaaaauagcugaaucuaaaaagagccaaauguacugccagaguaaagucauucucuugaugcuaaacauuuuccuaaguguugaaauaggccuuaaugugagguugaaauaugcaaauaugaguucuaguccaaauaccacaaauugugcaaaaucuauuccuuuuuuuucuugaaucccacugguucuuccuucugauuuaacuaguuaguugucucauauuaaaaccaaaaaccaugacuuauaaacaguuuaccauucuuuuuuuuuuuuuuuuugagacagagucucacucuguuacucaggcuggggugcaguggcacaaucucagcucacugcaaccuccaccucccggguucaagugauucuccugccucagccucccgaguagcugggauuacaggcaucugccaccacgccuggcuaauuuuuguaguuuuaguagagacaggguuuugccauguuggccaggcuggucucaaacuccugaccucaggugauccacucaccucggcuucccaaaguguugggauuacaggugugagccacccggcccaguuuacuauucuuacuugcuuuuucuucucucauauuacaccuuugaucauauuuucauaguauugauuuucugaccucucagucugcaguaccuauuccaggaaacccgcauuuuucuuagccaccucucuccugggucccuuucuucuuuggcuccaauuuuuuuuuuuuuuuaaagauguagucucgcucugucgccaggcuggagugcaguggugcaaucucagcucacugcaaccuccaccucccaaguucaagcgauccuccugccucagccuccugaauaguuggaacuacaggugcgugccaccaugcccagcuauuuuuuuguauuuuuaguagagaugggguuucaccauguuggccaggauggucuugauuacuugaugucgugauccgccugccucggccucccaaagugcugggauuacaggcaugagccaccucgcccggccgcuuuggccccagauuugauugacucucucagccuggggcuuaguugauuugcucagauuaccccuucacugcucuucucaauugaaucuuuuguuucauggaucccauuucuucuuuuucuucuugguugauuucuuccuucauccuagaguaauguuuuaggguauguggcaauuaaauccuuagucuauuuaugauguaaggugcuuuuauuuuucccuuauacuugauugauacuuuguuucuaauauuauagggagaaaaucaaauuuauauagaauuuauauuuuacuauuucuuauugcugaugugaaaauugguacuaggcugauucuuuuccauuuuuaggugacuuguucuuuuuuccuuuucuuuuuuuccccauuguacuuagguucuuuucuuuaugauuggucuuuggaaauuucacagaguugugugaacucuuuuugauuugccaaauuaaaauuugcuuuaauuuuaaagauaccagcccugggaaauuuucguuuuaaauuauuuugaggcugggcaugguggcuuacgccuguaaucccagcacuuugggaggccgaggcaggugaguuacuuaaggcuaggaguuugagaccagccuaggcgacaugguaaaaccccaucuacaaaaaauacaaaaaucagcuggguguggugaugugcacauguuguccuagacgcuucggaggcugaggugggggauugauugcaugagcccagguguucaagccugcagugagcuaugaucaccacugcacuucagcccaggcaacagagugagacccuaucuccaaaaaaaaaaaaaaaaaaaaaaagaaagaaaagaaaagaaaagaaaaagaaaaagaaaugacagucucggggggaaaaaaacaaaugguauuuaugucacucaaagcuauauggcuauuuggaugacaaagcuacuaaacugaagguaaggguaaggguuggaggaagaggugucuuuuaaauuccaaaaugaaggaguaauuguuuuuggcaccaauacccacacuagcaguucuuuuauuuauuuuuuguuuuuuuuuugagacagauucucgcucugucgcccaggcuggaaugcaguggcaugaucucggcucacugcaaccuuugccucccgaguucaagugauucucucaccucagccuccugaguaacagggauuauaggcacgugccaccaugccuggcuaaauuuuuuguauuuuuaguagagaugggguuucaccauguuggccagucuggucuuaaacucuugaccucaggugauccaccugccucugccucccaaagugcugagauuacagaugugagccaccacacccagccuagcgguucuaauuauaguauucuucaguauauuuauauaaaguuuauauauuauuauuuugggaaaguuaaaauuuuggauauaggugagggaaaauguugaguauacagacuuucaauuaaucucuauuuucaggcccucuuuuuuuuuuuuuuuugagagacggagucucgcucugucgcucaggcuggagugcagugucacgauauugccucacugcaacgucugccucucagguucaagcgauucucccaccucagcuucccaaguagcugggacuacaggcaugcaccaccacguccagcuaauuuuuguaucuuuuaguugagaugggguuucaucauguuggccaggcuggucuugaaguccugaccucaggugauccugagguccugccucggccucccaaagugcugagauuauaggcgugagccacugugcauggccucagccccacuuuuuauucaggcucuucucagauuugccauuuccaaauuuuagcuucucuaggccucuguuuaauagacccuuuucccuuuguuuccucucuccuccaacuccucucucuccugcucuucccuuucccuccccucccuucauuaccccacuguucuguuccauuuuuguaugucaggcagugacagugauaauugucauauauuuuccucuacaguagaaaugguacuuaguaucaucucaauaugaugcaucccaccuaucuaccuuauguugcagacacuuuuauguuuauuuucugguuguuuccaauagggagaguugguaauccuucagauuaccaacugaaugucuuuuuuugagauggagucucgcucugucguccaggcugcagugcaguggcaccaucucaggucacagcaagcuccacuuccccaguucaagcgauuuuccugccucagccuccugaguagcugggauuacaggcaugugccaccacgccuggcuaauuuuuguacuuuuauucucaccauauuggucaggcuggucucaaacucccgaccucgugauccgcccaccucggccucccagcuugcugggauuauggacgugcgccacggccccuggccugaaugucuuauugguauauuuuagcuuucuauuucaguguaauacaaaacuguaaauguucuuuugugaccuuuuucuuuuuuaaagauaauuuuuaauguagagguaauuugcauaggagauuucugccuguauauccugguagugucuugaaaaaguaugucuaacugcuuucuaccuuuucaacucuauaauguuucugaaguguacaaaucaccaagggauuacauucaaaauuaaaauaaauauuugagauuauaaaggggaguuugcaugaaaucacuugauacugcuuuuuuaaucuacagaaagaauggagggaagauagaaauggagaauuuaaaagaaaaguugcccgcuguguaagaaaaagccaagagacugcuuuugagugacauuuauuuagcagcuaguaacuucacuuauuucaggguaaguuuauuuuaaauaucauacuuuuguuuuuuuguaaguauccuauuaguuuuuggaaauugugugauuuggguauuugaauuacauuuuuucauugacuucauuuuuuaaugguauuauccuguagucucguucucaaaacuacuguauaaucugcuugcuuuucuccuaagacacccagcuguuuuugacuagauauucugcauucauaugguuaguaugcuggucuguuucuuuucacugaugguaaaguuucuaaugauaagguuguuauuucaguuuaguuucuuuguuugacuuuuugaucuagcauccugaucacuugggcacuaauguaucuucauauacuguauuauguaggguauaggcaagacuauuagucaucuaccuauuccuuuaagguuggucuucuggccaggcgugguggcucaugccuguaaucccagcacuuugggaagccgaggcggguggaacaccugagaucagggguuugagacuagccuggacaacauggugaaaccuccccucuacuaaaaauacaaaaauuagccaggccugguggcgugugccuguaaucccagcuacucaggagguugagggaggagaaucgcuugaaccugggagacggagguugcagugagccaagauugcaccguggcacuacagccuggacaacagagcaagacucuaucucagaaaaaaacaaaaaacaaacaaacaaaaaguuggucuucuaucuccuuggucuuuacagauagggccaguaguuaaaaacuucccuuuuauuguauaacaucuguccacaguuuuauguuaggucuagaaaggagucaaagauggaaggcacccauccaccuuagaagaggaaauaauauagauuaauugcucacauguggguuauuuggucucuucuuuuaaaauuaaauauugaaaugauagaaacugaagugaagacuauccuuucagggaucauuucuauaguuuguuacuauagaaguuuucugaagguguagagcaccaaaggauacaacauugagcugguuucaaauucagcugcuuugauucagcaagcugcaacaguuaaaaacauagcagaaaauuguuauugaauaucuaugucucugaaaacggaauaguucugcaaguuggugaauaaagucuaagaguuguccagcuacagaaacaagaugccagaugauucguaagaccuauucgugauauuuaaauuacucaauaaaagaccuauugauuuguggggguugagggagaaaccgaaauacacugucugaaaaaucacaauccauggcacaucuugagucuaccuauuuuaagaaaaugaacauuaccauuaucuucuguccccuacacuccgcugcuuucuucugucccuuucucauauuccuaacucuggguuuacuauugcuuuucuucauaauuuuaccaaauuugcauguuuaaacaauguauuucaugauuuugaacuguuuauauguggaaugauaaugaaugcauucuucuguuacuuuuauugcucaauauucuucaaauugaucuguguugcaaauagguacauuucaccugugugcuauuacacuggguaaauuaccgcucuacuccuuauucucauugcaguuauuuucugaauugguguagggguguuuguucuuuuucuguuauagaggguggcuauccuuguuuccugauuugcauguacuguaagagguucucuaggguauauacuugggguggaauucuuaaaucaaggguacgcguauuucauuuugaguagauaaugccaaauuguuuucuaaaguguuccuucuuuucauagucccauuggcaaggauaaagauccccuuuguggccaggugcgguggcucacaccuguaaucccagcacuuugggaggccgaggcggguggaucacaaggucaggaguucaagaccagccuggccaauauggugaaaccccaucucuacuaaaaauauaaaaaauuagccaggcacaguggcgugcgccuguugucccaguuaggaggcugaggcaggagaaucgcuugaacccgggaggcggagguugcggugagccgagaucacaccacugcacuccagccugugcaacaagaacaaaacuccguuccaaaaaaaaaaaagauucccagccgggcaugguggcucaugccuguaacccagcauuuugggagguugagaugggcagaucacuuacaagaccagccugguccauguggcugaaaccccaucucuaccaaaaaauauaaaaauuaccaagguguaguggugcacuccuauagucccagcuacucaggaggcugagaugggagaaucacuugaacccaggaggcggagguugcagugagcugagauugcaucauugcacuccagccugggcaacagagcgagacuccaucucaaaaaaaaaaaaaaaaaaaaaaaaaaaagcccaggugccgcggcucacacuuguaauccuagcacuugugggagcugaggcagguggauuaccugaugaugggaguucaagaccagccuggccaacauggugaaaccucgucucuaccagauauacaaaaaauuagccaugugcaguggugcacaccuguaauccuagcuacucuggaagcugaggcaggagaaucacuugaacccaggaggcggaggcugcgaugagccgagaucacgccacugcacucuagccugggcuacagagugagacuucaucucaaaaaaaaaaaaaaaagucuaucuaucuaaaucuggauauuguggacuuaauaugaauugcccuaguuaccagugaaauugcauaucguuucauguguuugaccauugagguuuucucugugaauugcguguucagguuuuuagauuacuuuuucaguuuguugauuuguguacuuguccuuuuauuuucuuugugguauccuuuggacaaacugagguucauauauauauauauauauauauauauauauauauauauauauauauaacuuuuuuuugggggcagaguuucgcugugucgcucgggcuggauugcaguggugcaaucucggcucacugcaaucuccgucuccuggguucaagcaguucuagugccucagcgucccagagugcugggauuacgggcaugagccaccgcaccuggccugagguucuuaauuuuaaugcaggugaauugauuagucuuuuccuuuauggauuuuacuuuucguuucuuggcuagagagccuguucuuuuuuaaccaccaaaaaucuguuuuguuucgcuuuucauauuuguguugaauccauugaaauugauuuuuguguaugguaugagguagagguugaacuucacucaccccacuuuccccugauguguaacuguugacuguaccauuuauugacaaguccuugcuuucaccacugguacacagugccuguuauguucuacaaucagauuuccaacacaucagccaguacguguugaucuguuuugggcauuuuuuuuuuuuuuuuugagauggaguuucacucucauugcccaggcuggagugcaauggcgugaucucagcucacugcaaccuccgccucccagguucaagcaauuauccugccucagccucccaaguagcugggauuacaggugugugccaccacuccuggcuuauuuuguauuuuuuaguagagaugggauuucaccauguuggucaggcuggccucgaacuccugaccucaagugauccaccugccuuggccucucacagugcugggaugacaggcaugagccacuguggcuggccaugggcuuuuguauuuuucaaugguuggcuuguuuaucuuaauuuuaauuuauuuuugugauuaaauguaucaaaugcaaagguuuaaguccgaaguaaagcuaaagucuguccaccauuuauccuguuuucauguuugauaucucugguuucuagaaaaaauuuagaugugcuuucagaucuccuuauuauaaccagaagugcuccccuuuacuaccagauauaccaugcagucuaaaaauuauuccuauuuucaccaucuuuuaaaaaucugcuuaggaaguaaaugccucaguaaguaccuaaaccaaucauuaguugaacuaaaaguguaaucauuuaaaaauugaauuaaauauacaucacaccaaaaucacuaauguguucuaacaaugggucuauauuucacucaucugucugauauucagaguauaguaugcuagcuuguccagccugcagccugcgggccacauguaucccaggacagcuuugaaugcagcccaacacaaauugguagaauuucguaaaacaucaagauuuuuuuuuauuuuuucuuuuuuaaguucaucagcugugguuaguguuaguguauuuuguguggcccaagacaauuugucuuccagugugguucagagaagccaaaagacugggcaccccugcuguagacaaucaaaugcuuaaauaaaugagucagucuucuuuuuauugagaugugcaccuaauuuuuaaaugucauugccauuacacaauuuuuuuguauuaaggcuuuauaccauggaaaccuguuuccuuaggccgggcgcgguggcgcaugcauguaagcccagcacuuugggaggccaagauggguggaucacuugaggucaggaguucaagaccagccuggccaacauggugaaaccccgucuccacuaaaaauacaaaaaguagcugggcguagugguaggcgccuguaauuccagcuacuugggaggcugacgcaggagaaucacuugaaucccggaggcagaggcugcaggaggcagaggcagugagccaagagagugagacuccaucucaaacaaaaaaaaaaaaauguaaaagauaccuguuuccccaaggccggcuuuguagacugaauagucagcagccucaccugucucuucuugaaggcuggcuuuucucacggcuuuaucaccaugcacuuucugaguauuuuuuguguuuucagucaugugauaggacauagacgugaacgaaaacucacuauaaacacuugaaaaauguauugucugucugggcugaacugaaagugaaaucaauuuaagauuauuugaaaauacauauuuaucuacauucaaguccaugacccacacauauuuucucaaaaugcacggauuacugugggugccacuuggcccaggcuuuaucucacauuuuguuaguguuuauaccuuguccuauauagagauuauuaguacccuuauguucuaauucagcugugggguaggaagaauagagaggaaaaggaaacaaauucuccccuugccacagaugagaaccauggcuacuuuguguaccacuggacaggaggacuccguucugcaccaaggcuagagggacuguauugguucuuuauugcuacguaacaaauuacuaaaacuuaguggcuugaaacaacauuuauuaucucaugauuuccauggccaugggaucuggguguggcuugguugacuccgggucucucauaaggcuguggucaagguguugacucaacuggggugcaucugguuccaggcacgacugaguuccuccucacugccuguuggcuggaguucucccucaguucugucuacugaagaccucuccauaagucaauucacaacauggcaguuggcuucaucagaggcagcaagugagagagggugagccagguguggguagacugccuugagggaggcagucauucccaagcuucgggaaccuugucugcuguaaagcacagcugaguuccccuguaggaaucgcuggugcuuaccugcauucagugacuaguggauuagacggguggaguuggguugguacaaaggcuuggucaacuggcucuuuugucuuguuugggaauucucgggaaggucauucuaacauaguauugacugaggccuuuguuucaacugccuugaguuaguucaucuucucccuuugucuaagcuugcaucccucacucuuguuuuugagagcaccuccugacaaaccucaaaucucugccucagaauccguuuccuagggaacuugacccagaauaaguacuacggauugcguaacucagcacaguaagguagaaggcugccugccugccuuacuuaguugcagauguggggcaugaaucuauaguuauuucuaacacauuugcaaaggcacuguccucuuggggaaagaaggaacacauagaaugcgauagauacacuauacugaccuguaaagacuguuugccuagccagguagaccaagcauaaaacaaaguaagguuaaaccacauuaaaaacuucaguggaggccaggggcaguggcucacgccuguaaucccagcacuuugggaggcgaagaucggugggugggaguuugagaccaacauggcaaaaccgcuuccuacuaaaaauacaaaaaaaaaaauuagccaguacgguggugugcgacuguaaucccagcuacucgggaggcugaggcaggagaaucacuucaaccugggaggcggagauugcaccacugcacuccagccugggcgacagaggguaacucugucuccaaaaaaaagggcgggggggcuucagugggaguagaagcagaccaugacucaauuugaggugguuaggauagagguuagaaguagggcugcuggugacauugcaagucuccagaguagagaugaagaucuguuugguguagagagcaguacuuaccagggcaaggacaacuuggagacugcacaauuaggguacagaaggaagagacagagacuggcuugguaacaugcaggagaguuaggagagugaguucucacagagagcucagaaaggaaguugguguuagagcuacucaccaaucucaugguagaagacgacgagcagcacggucccagugugggggaaaaagucagcggauuggugacggagcaggaguacacuggguggcuguguagggugauuuggaacuuuuggaagcauuuuuuugugaaggguaauggggaaaacuuaauugguauuggcuguuuucacuuacaagaucauugaaacacuuaagaucauugaaauacuucccuaugauugaagaauuacuuuuauuuuugucauuaacaucaaaaaguggcuucuauuugggagcacauuggucuguuuuauauuuuuuuagaucuuuuuaaaagauuagguuuuguagccauauggaaaauuaaagacgacucuaguuuuagaaauauuaauaaauggaauaagacacucaaguucuuuggagguaaaccaucuccagauuuuuagguuaaaaagcaggcauaauucugagaagauaugaggcaaaugacaggugcaauugauauaauuucaauuaauauugaaacauaaauucugcgaaauggauaugcuuaaaauguaaaugacuguugcaagucagcaccauuuauuugcaguguugugcugguuaauucaguuucacauuuaucuuucuggagaaaagaaugacaaaaccugccuuuucuguacugaggccuugucucuauuuagaauuuaguauaacuuuuauuaaaagggaagagggauagauuuucuuuuuccucugcugaaaaggguaaugcuguuuaaaacuggaucuuugcuauuaaaaggcuaggucgccugauuuuaguguuguuuuuuuuuaagacgggagucuugcucuguugccuaggcuggagugcaguggcguccuccccugcccuguucuguuccuuuuuugagacaaggucucacucuuacugucacucaggcuucagugcagugguacacucaugucucacugcagccuugaacuccuagcuucaaguuguccucccacaggcaugugccaccguggcuggcuaauuauauuauuuauuguacagacaagggucuccuguugcccaggcuggucucgaacuccuggugucuaacaaucuucccaccuuggccucccaaagugcugggacuacaggcaggagccacugugccuggccaucucuuggguuucaguguaugucuuuugauuuucuaauaaaaauauguaugugcauacguguaucuggugaaggugauauauuuguuacuuaguacauuucaugcuuugcuaagggccauuuacauugauugguacaugucuuuuggaaagacauauagcagucguucuaccucucaggaucuuguagggagguugucuaaauggcuuucuuucuccccacaacagagcuuuugguaugguugcauuugagugauuguaagauagaucaauuuggccaggcgugguggcucacgccucuaaucccagcacuuugggaggccgagguaggcagaucacgaggucagaagaucgagaccauccuggcuaacacagugaaaccccgucucuacuaaaaauacaaaaaauuagccgggcaugguggcaggcgccuguauucccagcuacucgggaggcugaggcaggagaauggcgcgaacccgggagguggagcuugcagugagccgagaucgcgccacugcacuccagccugggcgacagagcaagacucugucucaaaaaaaaaaaaaaaagaccauccuggcuaacaggaugaaaccccaucuguacuaaaaauacaauaaauuagccgggugugguggcgggugccuguagauccagcuacucgggaggcugaggcaggagaauggcgugaaccagggaggcggagcuugcagugagccgagaucgcgccacugcagccugggugacagagcaagacuccgucucaaaaaaaaaaauugguaaguucauauugggcuuuagaaggcaugcugaauuuugaacaugucuggugugaguuaaaauuugucauaacucuuuagguauauuuggcuucucugugaggaauuuaaaauuauaucccuugauuucuuagucaucuucuguuucuuuugcccaaaauugugcauggcaauggauucagaguuucugaguucuuuggaacacuugaccuaaagaugcaguccuaauagguguuuccuuuucugcuguccuuggcgcccccacccaccccccuuucaaagcacauauuaauauaauaaagacucugaaaagucuaauagucaaaugagacuuuuaaagcuuuaaccacugggugcaguagcacaugccuguaaucccaacacuuugggaggccgagguggcagcguugcuugagccuguaguucaagaccagccugggugacguggugaggacccuguuucuacaaaaaaaaauuaaaaauuaucugggcaugguggugugugccuguggucccagcugcuugggaggcugaggugugaagaucacuugagcccagaggcugcagugagccauguucaugccacuacacuccagcaugagggacagagugggacccugucucaaauaaauaacaaacaaaaacuucaaccuaguguuuuucuaacuuuuugaacaggaaacucagccauuuauuggcuaugugaacuugucucagcuuuagaggggagacuccuucauaaugaugauugugagcauucaggaaaugaguuuguaaagcgcuuagcaugcugcuuggcacaucagaacucgaugaggcggugcugcuuuuuauguagauguguucuugacuuacagucuaacuggaugauacgaggccaacagauuugaaacacuuagaaacugugguugggauggagggucauuuguggcaggcuuuguggagaaaauggguuugaagggagcuauagugaguuagauagaauuuagcaaguugggaaguguggcaaucuuaaguuguuucucugaacauccucaaauguuuguaaauuuccaaaucacuuggcuuuuaaaucuucucuuauggauucuagauuuaauauaaguugaaagacauuugaaguauugaaaaaucuaaauuagcgcuguccaguagaacguucugugaugauaaggauacagcugugcuguucagcuugccagucacuagccacaugugacuacugagcacgugaaaugugcuuagcaugacucaggaacuaaauuguaaauuguacuuaauggcaauuaauuuacauuuaaaauuaaauauacccacguggcugugagcuaccauaauagauagaaacaaagugagcucagaaugaaauuaaggauuuguugucaaauaaaucuaauauggauaaaaccuacuuacaguuaauucuuuuguaauugaugaauugacuauauaauguuguuuuuguuguuguaggucuccaauugagaaacauggcacuguuuuuccugcacucuacccaccuauugcuggacuucuguuguacaaguuggcaaacacuggcuggaacugggcugcaauaaaacaugccaguuaucaaugcugacaagagccuaacaagugccaacuuacagaugauuacgcauuuugaauucuaaugaacuguuuuaaccuucaggaagaauuguaaagaccuguacauagcacaacaugauccggauaauauauauacuguucauguacauccacaaauacaccuuguaccaaauaaugcuuucuuguaguagaauaagaaucguguaaauucuaagagauuuuagcagguuuucuuuccuauucauuguuucuuaucaguuuaaaaggauuccuuuaagcaugucagaugaaaagcaauuaggauuaaaaguuuccauuuaauuucccuuaaacccuugaggcuucauuaaacucuuuucacuuacuaaacuuuuguaucuucuuuguuuugacacacuccccuuugcuuuuaucucuuaccugccagaauguucucaaaugauuuaguucaaauacugaaauacuuaaugagcaauuacuugauuuuuaaugaugacuucgaaggagucaucacuaggugcuuuguccuuuuuguauucuaguugcacccaccucuuggauuggauauagcaauaacauuuauuggccguugugagcucuugaucccagucauuaccccugagaacuaaaaauagaugguucuuaauucaacuuacugaaaauuuccccaaacaauagcaaaucugacuuuucccucuucaguugccugguauuaagguuggauaaaugaagcaugcacagcuacaggcuuucuacuuaacuucuggguuugcuauuacaaauccuauuuacucucauacccuucuccuuaguccuucauauuucucugccucuauucuucuauacugcagauuuuucucaccuauuguacaaagaaauugcgauguauauuuucauguaauuugauuuuggaauucugucaccuuauguagugaguucuuccaaaauauaauuuuuuuucaauaauugucaaguuguuggcuuuuauuguauugaaugaaggcuauaauacugagugccagagaagugguuuaggaaaaucucagguugauuccuuaugcaaaugaacuuuuaauacuugaaaaucacauggccauggcaguauauguauuugguucuaucuagauucuucugugaaucuaaaagcauuacagggguaaaugcuuugcuauuugacguauagaucccgucacuaacaauaguacacuuggaugugauuaauguuugagcuucaauauauuucauaucauacaguuuucuaaaacaacuucagcaaaugguaaaaugaacaugugcaguguuaaaggcaggccuuaggcuccuucauguuuguugugagguugugugugggaaguagucuuuggcuuauaagggauagaacuugagacaguagcagaugggacaugguguuugauugugagaaucagugagaauucgugcaucucugcucugugggguuuggagaaaugcuuuggcagaagagugaaagaacuccugccaagagcccagaccucuacaaacguuguauguccuuuuuuaagcagaaauaaaaugguugaggauguagucacaguagagagugauuuuuuucuaagucccuguccucuacucugaagcguuauaaaaaccuguaaacauuauacaaacccacaaaccuuauagaaacucguaaguguguugugacuggaaauugauucauuagaacccaguuuucuuuaagaacuuugugacuugguuuuuuuuuuccuuuuccaaagacuguaaaaauaguugccccaaaaugucagcacugcacacccuccagggacuuggaauacaauccuuuuuacuuuuuuuuuuuuuuuuuuaagaaacugggucucucugucacccaggcuggagugcaguggcaacgaucauagcuaacugcagcuuugaccuccugggcucaagugauccuccugccucagccuccugaguagcuaggacuacagguguaugccaccaugccuggcuaauacaaaaaaauucuuuuaagagaugggaucccucccuuuuaaaaucagaacuuguucacauggugguugcuuguggcaaaacggaguucaaauuuugcucuccuauugcuauaauucugcuagcaaucuguugaggugaaacuugggaucugacucuucagcaagcagcaaaugaccuaguaacucagggacaacuauuuuugaacuuuaagugccacuuuaaugcaguuaguuugauaaaaccauguggguuuuuuuuuuagggcuagcucuacgggaguggaagugagagccaggcaugagugcgucuccacaugcuuuuccaccugcccugaguguguuacauacugaaacaggccuacauagauguuacaacuucccuuccucugucggagaugucaucugugccuuucucaguguucaucugauaauguaaauuuaaaugccucuacauuugauacgaaacccacauucaggugacacugaacgagguggcuuuugucccaccagugccucaucagugugaggcgauuccucucugcuuuaggaaaaugauuuuucccccuaaacuugugccaaccaucaacaacaucuccauagaucuuauggauuguagaacuguuggcuguuuccuaaauuuauuccaaguucucguagaggcauauagauuucagucugugcuuguaugggauagaugaucugaguggcuuucuggccucuuuuuugaguuuaaaauccauaugagguugacgugucauacuaagguaacauguuugugagguuauuccacuaguacugugaucacgugggugucaguaucuuuaacggccuucauucuugguugugagauuuuauuugauaugcccacucacccucgacgaaucugcccgcuuugggcuguggugccuguguaucuuugcccgucuggucuccaguugguggaauuaccuuuuuuguacugccacuucucagcaucuuugaaauuugacauaauguugcuucauuucaguuuuuuuaguucuguaauuuguugauuguauuuaacuaugugaguucuguugugauguuuacuguauuguaaagcaccucauucaugugaugagugcucuauaaaucaauaaaugaugacuuagaggcuguaucacgagcuauuuugguuuuaggaugcaggucucaaaagcaa

SEQ ID NO: 192266 - RNA, 35081 nt, Homo sapiens
aguggugcggccggcaggcagcgauggcggccguacggggccugcgggugucggugaaggcggaggccccggcggggccggcccuggggcucccguccccugaggcggaguccgguguugaccguggcgagccggagcccauggagguggaggagggcgagcuggaaaucgugccugugcggcgcucgcucaaggaacugaucccgguacgggcgggggucgggggguaaggaagaggucgcggggcuagugucuagcgccggagggggccggaaggggcgguggccggagccccagccggggaagucaagggagcgggagaggagggagccagcguccugggaacgggaacgccgggcuggaggagggacgcggagcgggagaaaggacgccggggcgccggaaauggguguugagggggcuggggggugguggcggagagcugggagggaguugaggaccccccuccgcugcccccucugagccgcgcugugcaaggaggugagugaggaggggcuggaaggaugagauaaagggggagcccugggcgggaacagaaccaggggcagcccagaaggagcuguuggguggcgccagcaaccaggucuccuugugggucuugccccggaggaauuuguaucugggaaacauggcacucgcucuuugucuugagagggcugcacuugucagcagcagaaacucacuguuucugucgugacuucggggucaucuugccccccccgcagcuccagugacaccuacaccguggccccagcaucugacucuuaaugaaagcaaacuagcagacgaccaauagacauccuuggucccuccuuuaccgcgcuggggauggugagagguguuuugcuugugacuugguggcuguauauccaguucucagagcugguuucaggccuggaugacuccucuuaauuucucaccuaacaugaauuacuuuugaccacaugucaacauauuuagacugaaguuauggagaaagguuaaaguaugaucgcuagagauggcaaacguuauaauuaugauuaacaacagcuaauauaguagcauuuaccauucacuauauugugucacuuaaauauacuggccgugcacgccuuuagugccagcuauucaggagucuaaguuccagaccagccucagcaauauagcaagaccccuuugagguccccccuuuccccucuccccaucucaaaaacaaaaccaaaauaaauaaauauuacugcaguugugaagcagguguuaucaucccuuuagucauucaguucaacaugguuuuuguuuuguuuuguuuugagacggaguucgcucuuguugcccaggcuggaacgcaauggcgcgaucucggcucaccgcaacuuccgccucccggguucaagccauucuccugccucagccuccugaguagccaaguacaauggccugaucuuggcucaccgcaaccuccgccuccuggguucaagcuacucuucugccucagccucccaaguaguugagauuacagggaugugccaccgugcccggcuaauuuuguauuuuuaguagagacgggguuucuccauguuggccaggcuggucucgaacaccugaccucaggugauccgcccgccucugccucccaaagugcugggauuacaggccugagccauugcguccggccaacauguauuuauugcaucccccgcuauguaccaaggcacagcccuaggugcuugaucaagcucaaccucccuccuggaguuuauguuccauauaaacucuaaaugacaaaaagccaaucuugugaagauugaaaaggaguucccccagcagggccaguaacaagcacagaggcucugggauggguccaggauuguuggaaacuucuguaguacuaauggaagggcaguaaaagaggucaggaaggcagguagauaccacagaggaaacugagacccagagaggucaagaaaacuauacaguguccuguaauuagugacugucagagcugaggcuucaguccucgcuugguuuccaaaucccauccccuuugcauugcacugugcuguauuugccucaggaguucuaggugaggcuggaccuucugcguugagguggaggguugugcuccaccugguggcugggcaugaggaauucguucagacuggguuggggagcuaagugacugugccuuaucuuuugacauuuuccacaaaagccuuuagauuuucuuuacauggauacuuggaguugauggaaucacuucaguuuuuggacaggcucugaucuucuuauuggagugguugauugauaccauggaaucacuaggauggggcuucuuaauaaaagguugucagggguggggaaggguuuugaaaagaguggcuauucaaaaagaaccagacuugccaggugugguggcucaugccuguaucccagcacuuugggaggcugagacagacggaucaccgaggucaggaguuugagaccaguaugccaacauggugaaaccucgucucuacuaaaaauaaaaaaauuagcuggcggugguggcacaugccuguaaucccagcuacucaggaggcugagacaggagaaucgcuugaacccaggagguagagguugcagugagccgaguuugugccacugcacucccgccuaggcgauaagagugagacuccaucucaaaaaacaaacagaaaaacagaaagaaccagacugguugugaugacucacacaugugauccuaacacuuugggagacugaggcaggaggacugcuuuagcccaggaguuggugaccagccugggcaacauagggagacccugucucuacaaaauaaaaaaaaaauuagcugggcaugguggcauaugccugagggcccagcugagggggaggauggcgugagccuggggagucgaggcugcggugagcugugaucauucuacugcacuccggccugggcaacagagcaagacacugucaccaacaaaaaaaaaaaaaaaaggaaaaaagaaccugcagaugucaggccgacuuuuauuauagguuuuuccucaauugcugucugaauuucucacccuuccccuuuguguuaggacacgagcagaagauaugaaaacaaggcuggcagcuucaucacuggaauugaugucaccuccaagguaagacaggcuaugauuuauuuauucagcuugauaagcaagugaacuuaaugaauuugaucccuaggacauaacaguaaauauuuccucuuuuauuuuguugcuggauuuaaauuuuuuuucuaaaaaaaauuguguuauuggccaggcacgcuggcucaugccuguaauccuagcauuuugagaggccaagcaaguggaucguuuaagcccaggaguucgagaccagccugggcaacauagugagacccgucucuacgaaagauacaaaaauuagucgggugugguagcacaggucuguagucccaacuacucaagaggcugaggugggaggaucgcuggagccugagagguugaggcugcacugagcugaaaucgugccacugcacuccagugggggcaacaaaaaaaaauuuuguguuauacaacgaugucuucaugcauccugaaacgguacaggcagcauuuguguguucuuacagccaugaaaggauaaaaucacucuacuuagauaccuguguugaaccguuuccaagaaaauguccaagacgggggaugcuuuuuuaaaugguauguccauuucuaaaaaaauguguacuguuuccacuugaaaugaaacaaaacaugaaaagugccuggcagaugguaggccccccauauuuagguggagucucgcuccguugcccaggcuggagugcaguggugcgaucucggcucacugcagccuccaccuccuggguuccagcgauucuucugccucagccuccugaguagguaggacuacaggcgcccgccaccacgccuggcuaauuuuuguaauuuuaguagagacaggguuucauuguauuggucaggcuggucuugaauuccugacuucaggugauccaccugccucagccucccgaagugcugggauuccagguguaagccaccgugucggcauaauaggcccuuaauaagacuauugccuuguaucugaugauugcuauuaccagauuaccaccuucauuguaacaccucauagagucaagccuauuauuuuccuuauauguagucaauacauguaaguugcuuuaaucagugauguuccguuuuagacauuuuuucugauuuuaauguuuacaguuaaguuuggaacagaauuuuguauuacauuucugaauaauaguauauauugcuguauugaauacauaaaagcaaaaauaaaaauauauuucgugccuuccuuuuuauaguguuuuuuuuuuuuuuuugagacagagucucacucugucacccaggcuggaguucaggggugcgaucacggcucacugcaaccucugccuccuggauucaauugaucccucugccucagccucccgaguagcugggacuacagguggaugcuaucaugcccagcuaaccuuuuuaugguuuaucugugucucuuguguuuccaaucacuuaaaggccccccauccccgcaaaaaaaaaaaaaaaaaaagagagagaauuggucaucuuuuagacaagaaaagagaauaaagugaaaaucuuuucuuacuguaauugaaaaaguaaacuauucauaaucuuacacuguuugccauuauaugacacagguauaugggaaaagggugauagucucagaguuaguacuuuguuucuaaaggaagguaaauuguuguuuguacuaggaagacuucagugaagaaaaugagcguuaacuauugggaaagaacagaaguguugcaacuuuaccaauccccacaagcucucuguagucagaccuucaauuaguguggcaaagucaauauacaauuagugaaggggacugggcgcgguggcucacaucuguaauccuggcacuuugggaggccgaggcaggcagaucacgaggucaagagaucgagaccauccuggccaacauggugaaaccccgucucuacuaaaaauacaaaaauuagcugggcgugguggugugcaccugcagucccagcuacucaggaggcuaaggcaggagaaucucuugaacccgggaggcggagguugcugugagcugagaucguggcagccuggcgacagagugagaguccgucucaaaaacaaaaacaaacaaaaccaauuagugaaggguuccuaagagccaucagaaacccacaguuggaccuggguuuauuuuagcucuuagaagaaacuuacaaagcugauuauuuuuucaguaaagugucaaugguucuuaucacuuagagaugaaaacuggugauuccguggacacgaggcuggaagaggagggagaguuucuuugcuucgguguuauuuuuaaacagacuagcuuuagggaguggacugcucaggcaguuauaauguggaagagcgugauaggugugauuaccauugcucagacaaugugaagugguuguaggugggcuccuagaaauagcacuggaaucagaucugcuugcuuaauagcugaaguaucuccagcaaaccuuuuugcuuuuuugugccuccauuucugcaccuggaaaauugggauguugaaauuguuuaguuguaauuuguuggcauaauugauaauaacaaaugaagugucauauaacuuuauaaacuuuaaaggacuauucauucagucagcagauacucacugaguuccuacuaugucccaggcacagugauaggcuguguuaugucggagaugguugcaaauuacagcgauauuaacauauccccccagucauugagugugaauauccaggucucugccagacugauucaagguguaguguugcuuauuucuucuuuuuuaguucagguuugucacugaugcaucaugaugcaugugugauuuaacucgccuucuccauauuuuacuacuuucacuuuuucuguacuuucuaggaagcaauugaaaagaaagagcagcgagccaagcgcuuccauuuucgaucggaaguaaaucuugcccaaagaaauguagccuuggaccgagacaugaugaagaaagguacaggguguuuugugggaaauuuguccacauuuccccagagagugccuuuucccugccaucaccucaugcuucuggccuugccuugcguguccacuccuuauccaagcacucuugugagaagggaccugugaagucuccauuucugaggucaccuguuuaaaguucagaugcugucagcuggcucagauguuagagcugggaaauaagagauugucuuuucugaggaggcccagaaaaaguuaccaguuaguggcagagcugagauucgaaccugugcuucuaaggacccuuacucauuuucuccuuuuaucguagagguguuaacuuuucuuugccuuuaaacguagugaaaguguaucacagugagaccuucuuuucggggaguuagagcaauuuugagauugguggggaaaagccauuaacacuuuuguugauaaucugaaucuauuggccaggugugguggcucaugccuguaaucccagcacuuugggaggccaaggcagguggaucacuugaggucaggaguuugagaccaaccuggccaacauggugaaaccccaucucuacuaaaacuacaaaaaucagcugggagugauggcuggcgccuguaaucucagcuacucgggaggcugaggcgugagaaucgcuugaaccugggaggcagagguugccgugauccgagauugcaccacugcacuccagccugggcgacagagcgagacucugucuuaaaaaaaaaaauucugaaucuauugauaaucugaauaucugauauauguaaaccacucaguaacauccuguugucagagaaagcuaaacuaauccugcccugaguuuuaagccugcgcuuacaguuggacuugugauuugauuugaucuuuguguuuuuuugggguauuuugcucccuagaacucaccccgaauuauuguauauaguaaucugccgcaguuuucuaaagcaauuuauaaauaaaaggaaaaauuacuacuuuuuuagugagucuauguucuuauuuauuauucuacuauaauauaaauccaugaaugcagaaggcuucccucuguguuauuugcaaauuuggguguucauaaaggguuuaguaggcagccuucugaaugcauguuaaaggccugugcuguauuguaugagcuucucuagccuuguuugguugauaaaagcaaaagcucuguaaauauauugaaugaaugaaagaauagcugcuauuuguugugaacuugcuuuuuuacuagacucguuaagcacauuauauauuucuuucuuuuuuguugcucacaacaacuguaugaggaauuuauuuuuaucccuauuuuauaaagaggaagcaggcucaaagaaguuuaauaaauugcccagggucauguagcuaguaaagguggagucaggauucacacccaguuucuuugacucuagagccuugcccuuaacuccuuugcucuguugcuguguaauguaggauguggugcuaucgacugauauugcgucccuccucagucaguccuaaugggcccagcaguguggaugcagagcugaacucuggaagcugcuucacucuuuauccugcaugaccaguucaagucagaaacacgcccuugcuucccucaugggcgggguuucuguuugaggagaaguccugugaaggccagguguggcuugaccuucaugugccugcacagccgggcgcaagcauaccugugagucucucucacaacucuaccgcgagggcgucauagcuuuaucacaccugucgaccucuggucccgagagcauuccuugaggcggcuugccucugauacggcucaugccuuucauucugugcauuugcccuuccuugucccaugcuuuaucucuggucaggugucacuucccccguggagcaucucugcucacccacuugaaguguuuucucacaucuguuggagcucuuuagggcgcaaaagccucguagaaucuagucucaguuccuuugugacugaggacaaguucuugagccuuguuaguuucagucuccuugucuguaaaauggaaauaugauacuuaccuuaauaggaucacuuuugggguuaacuuuuaauuuaaaaaaauuuuuuuuuuuaacguacaacuccagucucacgguucuaaagauauuccuaaaaaaggcaguaaggucggccgugggaugucagcuggggaagcuugcuuauuucagucgauucuuuguccaggaggcagcauggccuaggauaguguuccugagcccuggggaacccugcugcccaucucagaccacuuuauauuaguuggaguuggauaggucccagggauaguuacugguuuucuuuucuuuuuuuuuuuuuuuuugagacagaggcuugcucugucacccaggcuggagugcaguggcgcaaucucggcucacugcaaccuccacuuccuggguucaagcgauucuccugccccagccucccgaguagcugggacuacaggugcaugccaccacacccagcuaauuuuuuguauuuuuuaguagagacaggguuucaagcuccugaccuccugaccucgugauccacccaccuuggccacugcccagcauuuuuuuuuuccucucuuucuguagcccaggcuggagugcaguggcgcgaucucggcucacugcaaccucugccgcccggguucaagcgauucuccugcuucagccuccugaguagcuaggauuacaggcaccugccaccgugcccagcuaauuuuuguaguuuuaguagagaugggguuucaccaucuuggccaggcuggucuugaacuccugaccuugugauccacccgccucggccucccaaagugcugggauuacaggugugagccacugcgcccggcugauaguuauucuuuuuauaucuucucagguaauuuuuauuuauuuauuuuuauuuuuuauuuuuuuuuugagaaggagucuugcucugucacccaggcuggagugcaguggcacgaucucagcugacugcaaccucugccucccagauucaagugauuccccugccucagccucccgaguagcugggacuacagacgcacaccaccaugcccaacuaauuuuuuguauuuaauagagacgaguuuucaccauguugaccaggguggucucgaucuccugaccuugugauccacccgccucggccucccaaagcgcuggcguuguaggugugagccauugcgccaggccaucuuuucagguacuuuuaaugugcagacaggauugaggaccauugguuucaugguuaugagcaugagcucugaagccuaguuaccuggauucaaaucuuaaucuguuacuuucuagcucuauggccucgggcaaguuauuuagccucuaaaaaucucaguuuccuuaucuggaaaggcagaugacaggaauucuuuuuuuuuuuuuuuuuuuugagagacggagucucacucuguugccuaggcuggagugcaguggcgcaaucuuggcucacuauaaccuccgccuccuggguucaaaugauucuccugccucagcuuccugaguagcugggauuacaggcaccugccaccacggccagccaauuuuuauauuuuuaguagagacgggguuucaccauguuagccaggcuggucuugaacuccugaccuugugauccacccgccucagccucccaaagugcugggauuacaggcgugagccacugcgcccggccaaugacaggaauucuuauagggcugcugggagacucuaacaaaauguuacaguccauagaguggcgcuuggcacauggcaggugcccaguuaauguggcuuauuaucaucaucugguauucuccaucuucccagccgucauuuaagugaccuagcuucuugggcaagugaggaaauuggaauaaccauguugacuccugcauccacacuaggcgucaaguucaaguuauuuguuauuaauaccaacaacaauaauaaaagauaacguguguuaagugcuuacuaugugccagucgcucugcugugucauuaacugauccuuucaacagcccugugaggagaagguguugauuauuuccguuucacuggggagaaaaugaaggugcugagggguugggaaacuugcucauagucccacagcuauguaaguagcaaggcugagguucaaagacugaucugacugaaacguguguuccuaacugcucugccagcauucagacaguuugggcuguggcacacuggacuguccugcaucaagagugacucgcuacauuugaacgauucagugucaaaaagguucagucucuuuaugcccaagauucaaacucucaugguuggaagagaccucagaggucaucuagguuaaccuugugcccaacccugcaggccuuuuggcaaacuuccuacuggucuuuuggcggcugccugaauguuucuuaagugacagugugagaacuauuuaugagacaggcaacuuuauuuuuggguacuuacuuguguugagcauugccuucuaguaauuucuguccgucaguuacugugugacugugaaguccuuucauacaguagcccuucgggugcuggaagcacaggcuugcugcccauucgcucaacuuugcuucaugugucgcaacuuucuggucucccuucucuaaacgcuuugccguuucugaauguucuuucugaggugagauauggguuccaguuaugguuggauucacagagagaacggcaggacuguuccucaccguugucucugucucagccauuucaguguugcacucauccuauaugcagccaaagcacuuaggucuuuuccccaggaauugugcccaucagaacagucuuucucaucauguacuugaggcacuuuuuuaaaaaaauuacuuuuaaauguaguccuauuaaauuacaucuuguugauuucaaaccucugcuuucagucugcugagugcauuuucaucguaacucuaccuuucagcuccuagcucuacuccucagcuucuugcucuccauuguguacacguggcuucuguuucuucauccagugguuggugaagggugggcagugucuuccaguaucauaagucuuauucuauuaccauaaggcccacaguuccuuuuacugucaugaggaacuggauuacguggcuuaaugaacuugaaauagagcaccgucuauguauucucugaauuucuugaucugguaauccuaucaaaaaagaaaugagguuaguguggcuuucuucuuuuuuuuuuuuguuucauccacagucuuggagcuugcuucuuauggaacuguugucauuuccugugggaaagauuugguuauuuauuuauuuauuuuuuagagauggggucucacuguguugcccaggguggucuugaacuucuggauucaagugauccucccgccuuagcuucccaaaguacugggauuacaggcaugagccacaacgccuggcuaauuuuguauuuuuaguagagaugagguuucuccauguuggucaggcuggucuugaacucccaaccucaggugaucugcccgccucggccuuccaaaguguugggauuacaggcgugagccaccgcgccuagccugcugucagcauuuuugaugagccuguucacucuggacucuaaucuuuucuucauuagcucuuuuacaaacaguucaugcucaccaaagaaaauuuguaacauagaacaggaagaaaaguugcccacggucuaccauccaaaccccgucauugucaacagucuguguguuuccuucuaaucucuuauggcagugaacuuuuguuuuucuccuuugcagucacacugcuuuuuuccauucccuggacagucuauggucagcauuuccauguuacuguguagacuggcauuagucguucagauuugugccauucucauuguaauccgucucucuccuacaugugugccuuggucaguugugcucaccuaaaauucgcuaccuucucuuuucuagggaaccccaggaaauccuuauuagugaccggcagugcaauagugaacagaggccuaaaugcggauaagguuuauugaguccaagggccuucucgguucuuggaauuaaaagccaugacuuuggaacagaaacagccuaagggaaguaaagagaugguuuccuagaaugcagcagaaagcaaggagaguccugagugauaguagagggaacagacugaggauuagggagaaaacauuagggagacuuauugaucugacaaaaaauuuaauuuuaaaugagacuagcauagaaaacaaagaccaaaaaaugacaaaaauaauuaucaagagcaucauaacauuguucuaacauuacaacauuaaaaaaaccuacauacaggugaagaaauaccuuaaaagcaaacaggaaagaguguaaggaacaaaauuucuggccucagaugucuuuuuuuuuaaaaaaaauagagaaggucucacugugucacccaggcuggucucaaacucuugggcucaagcaauccucucaucucggccucccaaggugcugggauuaugggcaugagccacugcacccagccucacaugucuauuuuaauuuagggaaagucguacacaucaaaacuugggcaauggauaauccuguucaaaagaagcagguaaagauacaaagaacaaaaaaagagagagaugcaggcgcugggugcaguggugcacaccuguaauccaacacuuugggagaccaagacagaucacuugaggucaggaauucaagaccagccugggcaacaugguaaaaccccaucucugcaaaaaauaaaaaaauuagcugagcauggugguuuuuucuuuugaaacaaagucuuacucuguugcccaggcuggagugcaguugugugaucauggcucauugcagccucaaccuccugggcucaggcgaucauaccaccucagccuccugaguaccugggacuauagcuguacaccaccacacucagcuaauuuuuaaaauuuuuuguagagauggggucucccuguguuacccaggcuggccucucgaacuccuggacucaagcaguccucccaccucagccucccaaagugcugggauuacacgcaugagccaccaugcccaccuggauucauaaaucuucauggugucuuuaucuuuuuaaaucugggaugucaggaaagcacucaacugaauuagucuggccacacuuacaugggcucauguuaaacccaucucuuaacucuuugagauuuaaaauuauuauguguuuaaaauuauuaaaugcauuuuuuuguuuguaaauuuuuuuuguuuuaaauggaaguaauagcauauaucugcagaagaaggaugggcuaaaaaauuuuuaaauuuuguuaauagcauguaaaaacaugcuugguaguaauagacauuaaauccuuuuuuuauuuuuauuuuuuauuuuauuuuauuuuuuuuugagauggccucucgcucugucacccaggcuggagugcagucgugcgaucucggcucacugcaaccuccgccucccggguucaagugauucuccugccucagccucccgaguagcugggacuacaggugccugccaccacaccuggcuaauuguuuuguauuuuuaguagagacgggguuucaccguguuggccaggauggucucgaucugaccuugugaucugcccgccccggccucccaaagugcugggauuacaggcgugagccaccgcgccugcccauuaaauucuuuuuuacauuauuauuuuauuuauuuuaauuuuuguggguacauaguagguggguauauuuaugggguacaugagauguuuugauacaggcaugugacaugaaauaagcgcaucauggagaaugggguauccauccucuuuuuuuuuuuuuuuuuuuugcgacggagucuugcccugucgcccagucuggagugcaauggcacaaucucggcuuacugcaaccucugccucccagguucgagugauuauccugccucagccucccaaguagcugggauuacaggcacaugccaccacacauggcuaauuuuuguauuuuuaguagagacaggguuucaucauguuguccaggcugaucucgaacuccugacaucaagugauccacccgccuuggccucccaaagugcugggauuacagguguaagccacugugcccagcccccucaagcuuuuauugaguuacaaacaauccaauuacacucuuuauguuauuuuaaaauuuacaauuaaauuauuauugacuguagucacccuacugugcuguuaaacaguagaucuuguucuuucuauuuucuuauggacccaugaaccacccccuugacagaauugcuucagagaaggaagggaaagaagggauguggagagguacugugggccccaguuucauauguaauguuuugugugccugagaucuuauaacgaauuaagcauaaagcuagguaguagauauauagauauuuuaaauuuacuuuuucuuucccuuuuuuuuugagacagagucuugcuccgucgcuaggcuggagugcaguggcgcgauuuuggcucacugcaagcuccgccucccggguucacgccauucuccugccucggccucccaaguagcugggacuacaggcaccugccaccacacccagcuaauuuucuuguauuuuuaguagagaugggguuucaccauguuggccagauggucucgaccucuugaccucgugaucugccugccucugccucccaaagugcugggauuacaggcuugagcgaccgcgcccgaccuuaaguuuauuuauugauauauuuacaaauuuugcaauugagauuaaaggagauaauguacuuaaaauauguaguaaaaaaagccgggugugguggcucaugccuguaaucccagcacuuugggaggccgaggcaggcggaucaccugaggucgggaguucgagaccagccugaccaccauggagaaacgucgucucuacuaaaaauacaaaauuagcauggcgugguggcgcaugccuguaaucccagcuacuugggaggcuuagacgggagaauagcuugaaccugggaggcagagguugcagugagccgagauugcaccauugcauuccagccugggcaacaagagugaaacuccaucucaaaaaaaaagaaaaaaaaaaaaagguaguuaaaaaaguacgcaauuggcugggcgccguggcucacaccuguaaucccagcacuuuaggaggccaaggcggguggaucacgagggcaagggauggagaccaugcugaccaacauggugaaaccccaucucuuaaaaauacaaaauuagccggguguggugguacgcuccuauagucccagcuacuggggaggcugaggcaggagaaucgcuugaacccagaaggcggagguugcagugagccgagaucgugccacugcacuccagccuggcgacagagcgagacuccaucucaaaaaauaaaaaguaugcaguccugauaaggcuaaguuucuuuuuugaccauagccuucaaccuuucugccuccucagaaguaacagcaguuaucagugugacucauauuggccuuuucugggugucuguguacauaaauauguacccuuaguaaauguaugguauuguuuaaugucaucaccuugcauguaauuuuuuacaacuuguuuuuucacucugugauacaucuuagaaucuuucugugguauauaauuaucucauuuuuuaccacauaauauuuuauaauguggauaaagcauaauuuauuacccugguaacuacuggguuauuagaaaucgugccuuagcaaacaucuucgugugagcuacuucgugagcccacauguauguguuuguugaggggcgauacugaggacuggaguuccuagguccguagggcacgugcaaaaucacguuuucugcagacccuuccauuugcccuccgcagugacgaugcccaccagccggggaaguaagccuuuccccuacuuacugccagcacuucacacuaaaagauguaagauaucucgauucaaggaccagagacgcaggaaaaauaagguguaaaaucugguccgugaaaacuggugucuucuuguuuucaugugcauguuaaugauugguagugaggucaacccaucuccucauauauuuauuggccuuuuguauuuccuuuuauguaaauugcuuacucauguccuuugcccauuuuuauuuuggguugucuuuuucuucuuaauugacuuguagcaucucuuuaguuucaugcuuugacauagucacgggcagcaucucuucucuuucagaauugucuccacuacugcgcguuucucuuuaacauacauuuaaaaauuuuagaagcagcuggcuaacuucaacaaauacuccuguugagcuugauagugcucugauugcuacagauuaauguggggagagguaucguguauuuuaucaacacccuuuguuuaaucuuucugagccugauaggccuguucugaauuaaugcugucguugagugauaaaaauuaagauaguuuaccuuacuguuaugucucgugcucuuuugaaauaauuauaguuucucucagcauguuucuuucuaaacucguguugucugaacuauuaggaaggaguguggaugggaugugcaguugcggacaggaaaauucuaucaucuuuucugugucuugucuuucuagcaauccccaaggugagacuggagacaaucuauauuugcggaguagaugagaugagcacccaagaugucuuuuccuauuuuaaagaauauccuccagcucacaucgaaugguuggaugauaccuccuguaaguacacccgaguuuccugugaauaugcuuuuguugaugauuuuucaagaguucuugccaucagagauggugaaugguucuggcccauacuacuuguuuaugccgaacuucugcuguuaguccaggagagaaaaaauugucgagcagugaaacgcagcaugcccuugccagucugccagcucauaccccauagugucccacgucagcugagaggugguggccagggcucuaggagguggguuacuggccucugaaucugccguaguugauugaggccucuuuaacacucaccuuuucccaacaaaggagaggauccaacugcguagacuuggggcugcauuuucagagccuuggacuuugucauuacugccuucuguacuguuacucagagggcugacucugccugugucucugaccuagagauagaccagaauagacacuggacagagugucauucugaauagacagaaugaccuagagcuaaacacucuacuagacuucucauuucugcuugccuugaacuguguguucuagaaugucaccugcuugcccugacccaugagcuuuccaacuugugggccaacuguaauuuuuaacuugccugcuuacuguaagucuggccugaccucuuguuacugcuuugcuggcuucuugucuugacuuacuucuagucuggcuuuacuugcugccagcuggcugaccugcuggguagcacccuagauggcagccgguuuucuuagcugcucucguaggaagauguuuucauugaaagacaaacaugacugagugaaacauuuuucuccuguuuucuuucuguuuaacuuacacuauccaaaucgggaauuggcagaccuuuuucuguaaagggcuggaaugcagauacuugaggcuuuguaggcuuaacggucucugucacaucugcucagcucugcugugguagcaugaaagcaacuauaaauaauacagaagcuaugagucuggcuguuuuccaguagaacuuuauuuacaaaaacaggcgguaggccaggcacgguggcucaggccuguaaucccagcacuuugggaggccagggcgggaggaucacuugagaucaggaguucaagaccagccuggccaacguggcaaaaccccgucucuacuaaaaauacaaaaauuagccucauguggcgaugcacaccuguaaucccagcuauucaggaggcugaggcaggagaauugcuugaaucugggaggcagaggcagcagugagccaagauagugccacuacacuccagccugggcaacagagugagacuccaucucaaaaagaaagaaaaaacaaaaacaaaagcaggugguagauguguguaguuuauuguacauuaauuaaaccuaaauaaagcugguacaaauguaaauaaacaacagguggugggcuagauuuugcuugaggguuauaguuuacuaacccugauuuaagucauuaaaacugugacuaagguauauuagaauuggagggacucucagaauuacauaguucaccuaccuuguauuauuuaucagaaccugagaaacagaggaaggaacauauuugccucaggccacauggcacauuaguaacagaagugagagccucagagcuucauuucccaaacugagauauaggggacgcauaguuuugagaaauacucuuuuaaguuuauuuuccguaagauuucucaaagcucuuuucuugcuaaauuaucuuccuuaaagaggcacauuaaauuaguugcuacaaagccaacuggcugucaugccuccauucuacauaucccagggauaccuucaucauccacguuuuccaaugggaaugaugaagggggaauucguuuagcauguccugacaaggagcagcaaagggcuucccuguagggggcgguaguguaaaggacaauccaaacuuacuugacaguuaucaagaacugcuaauacuuacauauugaguguuuaacuaccuguguucuguuccaaguaguuuaaauauacacaacucuuuuucauggaauacuuaaguuauuuuguggaacccaguuuggaaacgcagcucuaggcuaauuucaucagagagauuuuacuacccuuuucuuucuuuucccuccccuucccuuccaucuuuucccuucccccuuccccuuucccccuacccuucccccuucccuuuuccuuuccguuccguuccauucuguuccauuccuuuuguuuuuucuugacagagucucgcucugucgcccaggcuggagugcaguguggcaucaucucggcucacugcaagcucugccucccggguucacgccauucugccucagccucccgaguagcugggaccacaggcgcccgccaccacgcccggcuaauuuuuuguauuuuuaguagagacgggguuucaccguguuagccaggauggucucgaucuccugaccucgugauccgccuggcucggccucccaaagugcuuucucucucucucuuuuucuuucuuucaucucucucucuccuuccuuccuuccuuccuuccuuccuucucuuucugucucucuuucucuuucuuucuuucuuuuuuauuuauuuuuaacuuuucauuucuuuugagacaaagucucacccuguuacccaggcuggagugcaguggugugaccuuggcauacugcagccucaauauccuaggcucaauccauucucccaccucggccucccaaguagcugggacuaccggcucaugccaccaugacuuuuguauuuuuuuguagagacagggugucacuauguugcccaggaugaucucacuccaagcgagucuccugccuuggccucccaaaguacugggguuauaggugugagucaccaugccuggucuauauuucucuucauuaguugguuuguauauuuacugaugauaaucuguugcuagaugaggcuguagugaugaaugcgaugcagaaucugcucucaagaagcuuaccauuuccaugcuguguaaugucuuauuuuacauuuuauuuuagguaauguaguuuggcuggaugaaaugacagccacacgagcacuuaucaauaugagcucccugccugcacaggauaagaucagaagcagggaugccagugaggacaagucagcugagaaaaggaaaaaagguaacaacacaaaggagggaacuggggucugaaaguccucuucuuuacacaguccuguuucugagcagagcucuauauagcaucucaucaccaaguguuucugaacuaaucuaugaugcuugagaucaucaggaaauaggagaaaauacuggacuuuuaaaauuauaugagauaguucaucuuguaucucauuauaugaaauauuuuaucuuguuucaucuuguccuucacauuccauuuuagacaagcaggaagacaguucagaugaugaugaagcugaagaaggagagguugaagaugagaacucaagugauguagagguuaguaauaggggaaagauagauguaaaguuauuguaaaaaauugcucacugucuuuuuaacuuaagccuuaaagacuuaguuacguuuuuucucuagcuuucaccauuagaccuucugagggugcaccaggcucuuguccuuuaaguuaguguggauauagcgauucaccuugaaaucuuagaauagugcuuaugcuucuacaaaaaaagaaaauaguuuuauugagaaauacuuugaaguguuaucuaauuaguaaaaugaagaaacagcaaguaauggcauacuuccuaauggauuauguacuguuguuaaaaauauuaacaugcauucauuuaaaaaauauuuacugaguaccuauuauauaccauauucuaagugcuagggauauagcuucaagcaaaacaaaguccuggcccucucggagccugcauucuaguggggagugcagaggauacacugaugcacagauaucucauacugugucagguggcaaugaguguugugaaaagaguaggggauagagaaugauggagacuguucuuuuagacaaggugggcaggggaaaucucugaguuagaaauucuacagcggaacuagugcuauaaugcuuguaaguauuaaagguagaaugcuuuucuuaaugguagcuuuacuacugaagaaauaucaaaaggacuuuaauuuuuauauuaaaaauacucuucuuucuuaaguuggauacguugucucagguagaagaggagucuuuguuaagaaacgaucuucguccagcuaacaaacuugcuaaaggaaauagguuauucaugagauuugcuacaaaagguaaauguaauauuugguauuguuuuauauuuucaaucaaaaugauuuauuauggagugacauccuucuuuuuugaauagaaguuagaucaaguaaucucaaaguucccuucaaacuauaauauucugcgcuuaugaaauaauugcuugccaccugaguuggaauuucugacuuuaaaagugaauauuaacuauuuguauauuucugugacuucuggcuaaaguuauuuucuguugaaacugguuugccucauauauuuucagccaguuaccaucugaauuaugaaaacuuucaaaugaaacuuuauuuauuacagcaacguccuccugaacauugccaguguaccauucgguucuaauucccuucucauaagauuguuuacacauggugacuuuuggugggcauuuaaaaauguguguguauguguauauauguauguguauguauguguauauauguauauguauguauguaucgcguguauguguguauguaugcauguguauguauguauauguauguauguguauguguauauauguauguguguguauguauauguguguguauguguauguguguguguauguguguguguauguauguauguauguauauguauuauacacauauacacauauugguuuuuuuaaucauuugagaguuaguugaagauaaaaacccaucaccccuaaauguauuccaaagaauaagaacauuguuuuauacauagcacacuuaacaaaaucaagaaauuuaacauuaauacaguacuguuaccuaauccguagucgauuuucaaauuuugucaguuguuccaauaauguccuuuauauauuccccgcccagccccaggucuaggauccauccaggacugaguguguaaguauguaauguuuccuuagucccccuuaagcugaaacuacuucuauccucccauguuuuccaagaauauagguuuacuauuuuauacaaugucccucaguuuggguuugucugaugauuccuccugauugaauuuggguugugcauuugagacaggcgugccacagaagcgaugucaugucauuuccagagcaucaugucaggaggcccuggauacuuacucgucccaguccuagggacguucacuuuauucacuugguuaagguaaucaucacuagguuuuuccacuguaaaguugcuauucuuccauuuguaauuuaaaaauuggugggcuggcugguuacaguggcucgugccuguaauugcaacacuuugggaugcugaggcagaaggaucacuugagcccaggaguucgagaccaggcuaggcaacauagcaagaccucaucccuauuuuaaaaaauaaaaaaaugauuaaaauaaaaaauuggugggcagauacuuugagaucacguaaauagccucuugcucaucagagcuucaugccuuucugacuaugucauuucuuuaccaguagacaggugcucuaaggaagagccuucuguuuuuaccuguuuguuuauuuacaucaguuuagaaucauggauucuuuauucaguggguuaucauccauggauaucaguauuuaauuuuauuuauuuuuuuguuuguuuugagacggaguguugcucugucaccaggcuggagugcaguggcgcgaucuuggcucacugcaaccgcugccucccugcaaccucugccucccugcaaccucugccuccuggguucaagcaauucuccugucucagcuucccuaguagcugggacuacaggugcaugccaccaugcccagcuaauuuuuguauuuuuaguagagaugggguucaccauguuggccaggauggucucgaucucuugaccuugugauccgcccgccucagccucccaaaguacugggauuacaggcgugagccaucgcgcccagccuaauaucaguauuuuaauuuacaaauugucuuggauuuggccaguagagccccuucaagcuguuuugacauacuccaugauucuuuaagcacuuucuuucuuuauggcacaacaaaacaucuugcuuuuccagacucauuuugcaucuuaccugcuccacaucuggaaucagccauuucuccaaggagcuggugggcaugguuugagggguucggggguugggggcuauacauacugguuuguguugucacguuuaccuacagcccuggauauauuuacagugguguuuguucuuuacagucagaguguccaagaacuguggaaggucuuuguauuacuacuuuugacaaaaauuuaugaugacugaccaccuuucuuuccuguuaacugacauuucaacuugacaaaugugaucuuuaccacauuuacucauuugaguggcugaguacauucuacauguauaguauuaugcuguuuucuuuaagccauuuugaggagcacaauaaacuggaaaaaugauuuaccaaauauauggaauuauauguagucuguuuccuuaauccugaugcuguguuguuggcaugugauccuucagaagugaauaucaucuuucaugggguggcaaaaaugccacuauuuugagaaagucuuuuugauuccuggguaccuguaaugaccuaaagcucuuuuaugccuuuuggaaccuuguaucuuguauuguuuauuuuuguuuucuccauuaagucaucuggcuccaaacagcaguuuuaaccucauucgucucuguauuuugcuuuauccccucuacacugcauugcuguagugggcacucagagugugaauguugguaguggauuuuuacuuuuuguuggcaaauugcgcugaucugauuccagcuauggaaaacauuaaaaaaaaaauucaacauugucuuuacacucacaggaaauccuagguaacuauugucauuaauuuuuagaugacaaaaaggaacuuggagcagccagaagaagucaguauuacaugaaauaugggaauccaaauuauggaggcaugaaaggaauucuuagcaauucauggugaguccaaaaccuucaaaugcaauaguauuugaguuuuucuuaauccuucaguugguauuccguggugaaaugucuaaacccuguguaaacuggaaggaaaacaagagggaagaauucaagauucuuagaugugguaaaugauggggaaugcugaauuguaguuacauuuaaaauaucuguguuaguaccuaacauugugucaacguguaguugaaaugaauuagcgagcccagacaugguggcucacgccuguaaucccagcacuuugggaggccgaggccagcagaucaccugaggucaggaguucgagaccagccuggccaacauggugaaaccccgucucuacuaaaaauacaaaaauuagccaugcaugguggugggcgccuguaaucccaccuacucgggaggcugaggcaggagaauugcuugaacccaagaggcaaagguugcagugagcugagauggugccauugcacuucagccugggagagagauugagacuccaucacaaaaaaaaaagaaaagagaaagaaauaguggauuucaagguccuuccuaucaguuuuugauugugugcuuauuuuggcauucuugcaggaagcgaagauaucauucccgucguauucagcgggacgugaucaagaagagagcccugauuggggaugacguuggcuugacgucguauaaacaucgacauucugguaguugccugcucagcucuuggguagacacauguuuggcuccugaaaucauauuuuuauucuuaaugcaaucuuuuaagguuccaaacuuuaucauccucucuuccuugcccucacccucugccaacauauaggaaaguaagucaagucacaauuaauuuuaaguugcccaaagaggucaaaugauuuuauaaaagcuguucuaucaaaaaaggcaaaauaugacauaggaaaaauuaaaacaaaacuuuccuuaggauccuaauuuuucuacuauuaauaucaacagcugcaugaaaacaauuuuuuuuuuuuuuuuaagacggagucucgcucugucucucaggcuggagugcaauugcuugaucucggcucacugcaacucugccuccuggauucaagcaauucuccugccuuagccucccgaguagcugggacuacaggcaugcgccaccaugcccagcuaacuuuuguauuuuuaguagagaugggguuucaccauguuggccaggcuggucucgaacuccugaccuuguguuccacccacuuuggccucccagagugcugggauuacaggugugagcuaccgcgccuagccaaaaacaauuuuugaaauuauuuuaucagaugaacugauuguauuguucuuuuucuguauuaaaaauaggcugcuguguugagugcuuugugcuuguugguuugugcaugugaaugccucagaagagugggauaucaugacuuggguuucuuucuccuuuuuuuggugcuuauuguaaaagaaccauuuuauuuauguuuuauaaagaauuguucuuguuuugagccuaaucuauggaaucuucuacaugccuaauagaacuagucaagucagcauacaaaauaacauauacacacauuuaucauuguaauggggacagaaagggaugaagucuagauguuuuauuuaauguguauauacaaaauuguauauuugagaucuacauguuaauaauacacauaggaugggaacaguggcucacaccuauaaucccagcacuuugggaggccaaggcaggaggaucacuugaaaccaggaguuugagaccagccugggcaacauagugagaccuugucguuacaaaaaauuaaaaaauuagccagaccaggcaugauggcacauaccuguggucccagcuacuugggaggcugagauugccugagccuggaaggucaaggcugcagugagccaagauugugccacuguauuccaaccugggcgacagagcaagacuuugucucaaaauaauaauaauaauacacauacuuuacuguuacacaguuacacuuuuccaauuugaguuacuuuaaaauauuuucaucauauacuuuuuauauccauauuaaggaaauuaaaaagcaaauugccccuauuucuaguacccuguaugaugacugaguucaucuuacauuuuucccauuuguuuucauaauaaauaguauaacucuugggaacauguacuuuauauucuacuucuuucguuuauuguauuuuuccauuuucauuauucauggugcuuauguucuauaaagucacugugaacacugaaguagcaaauacugaaucguacauagccucuggccacaucauuuuugucaguugaucaauauguaaccuuguuuuacauauguuucucucuuuuuuuuuuuuuugagacagagucuugcucuguugcccaggcuggagugcaguggcgcgaucucggcucacugcaaccuccgccucccggguucacgccauucuccuaccucagccucccgaguagcugggacuacaagcgcacaccaccaugcccggcuaauuuuuguuguauuuuuuaguagagacaggguauuagcauguuagccaggauggucucgauuuccugaccucgugaucugcccaccucggccucccaaagugcugggauuacaggcgugagccaccgcgcugggcccauauguuucucuuuaagacaccuuauuuaagacacauuguugauucguuaacauugaguucacagccaguagcccuauaacucaugccugaaugccuuaccugauaugguauuuuuccacaaggcacaucacagcccccuugcaucuaggaacacuaggcagcacuucggcacgacacucagggccauuuuaagcagugaaaucacuagcagcaggcacagaagugugaaaaaugugccacucgguggacugaaacagacgcuuguuuacagcaugagaugaaacaggaagguggaguguugcuuuguuugaccuccacugggagugugugugccuggugacucagauuuuuuugccacucugugcgugccagcaaaugaccauggaagcauugcacguauucauuuuggaguuacaaauaaauuugguaaauuugcaaauacaaaaucugugaauaauaaaggucaguuguauuuuaaaugacuuuaugguauuugguuaggcugcugcaucauacuuuaccuagccauccuccuguugcaguaucagaguaauguccauuuggcacuauuauagauagugcuccaauaaaaugucagggaugggaaccccaccuuuuaaaaaggucaccgauguagaguagaaaaucauacuuguuaauuuuagugcuuuuccuaauguuuucugguuaaauuucuucagggcuagugaauguucccgaggaacccauugaagaggaggaagaggaggaggaggaggaagaggaagaggaagaagaagaccaggacauggaugcagaugacagaguggugguagaguaccacgaggagcucccggcucucaagcagccccgggagcggagcgcgucuagacgauccagugccagcagcucagacucagaugaaauggacuaugaucuagaacugaaaaugauuuccacgccuucaccaaagaaaagcaugaaaaugacuauguaugcugacgaaguggaaucucaguugaaaaauauuagguaaaaauuuguuuuaucaaagcuagcuuuuaauuugauuuuaaauacuaguauaacuucuuaauuccuccuaauuuuauaauaucuuuuaucuauucugauuucagucccuuguaggaguuuaauaaacgcauccaguauuuccucuauacaagcagugauucuuguuauaaaaacaaaagacaacauagaaagugaaaaucaucuguauucccauucuuucucaacaauaacuacuguuagcaauuuggcgaauaaccuuucagcuauuuguguguguguguguguguguguguauggcacagggaaaagcuguagauauauuuguauaaaaguauacuuuuuauaaagaugagguuaugcuauuuauaguuuugcauugugcauuuuucacuuaauauauuguagacauuauuuuuuucaacuguauauagucuguuguuugaaaguaucaugauuuauuuaacgaauuccuuuuugauggacuuuagguuucuauuuucuuacaauugcacuaacucaauaaauuccucaaaguccaguuauuacacaaaacaauauguguuuaaaaagaugguaaguauugcuuuauuuuuuuccagaaggguuuuuuguguguuuuuauuuuuuuuuugagacggagucucgcucugucacccaggcuggagugcaguggcgcgaucucggcucacugcaaacuccgccucccagguucacgccauucuccugccucagccucccgaguagcugggacuacaggcgccugccacuacuccuggcuaauuuuuuguaauuuuaguagagacggguuucagcauguuggccaggauggucucaaucuccugaccucgugauccaccugccucagccucccaaagugcugggauuacaggcaugagccaccaugcccgggcucagaaggguuuuaaucccagaaggguuuuaaucacucacauuaccaccuguuaccuacaagcucaccagccuuagcuauuaccauucuuucuaaugcuagcuaguuucaugaacaaaaaaaaaauaguuauuuuaaugugcaugucuuugauuacuacuaggggugagcagauucugugcaggcagaauccacaguucuaaggguuagagucuagggaugcucuguguaacguaguauguuuguggggaggggaaaagaccauucaagcugauuuguuuguauggccuuguucaccacguucuuuuuuuuuuugagacggagucucgcucugucgcccagccuggagugcaguggagcgauaacacgaucucggcucacugcaagcuccgccuucuggguucacagcauuuuccugccucagccucccggggagcugggaguacaggccaccacgcccagcuaauuuuuuguauuuuuaguagagacuggguuucaccauguuagccaggauggucucgaucuccugaccucgugauccgcccgccucagcuucccaaagugcugggauuacaggcaugagccuguucacauucuuauuuuugguuuucagagagcuuucugguagagaaugcugccggaacggugcuggcaccuagcaugauagcauaucucuuugaaagagaagucugcccuuuaaagagagagacuguagacuauacuguguguugacuacagccacaucacagcauguguaaguggaagccccaaucucuuuguaggccucuacuuaacguuugucccagaaaagggggacuuguaguuguaugcuguguaauagcacauacacauguggaaaccaccuucgaaaaccugcucaccagaaccagucucuuuagagcaggcagaucaugguuuccauaagcaaauaauuauaaguuuauggauuuguaagugaauguuggccauguaagacaggauuucuuaaauuguuuccuccaaaguaugagauuguuguuugggucuugucucacaguugaaguugguuaacugugccccauccuacccccuuuuuaaaggaacuccaugagggcagauaguguaucuucaagcaauaucaaaaaccgaauugguaacaaauuaccaccugagaaauuugcagauguccgacaucuauuagaugagaaacgucagcacucccguccacggccaccagucagcaguacuaaaucagguacuguuccucacuuggauuccuggcuggauucugagcuccggaaagcagacuggggcagagagagguuccugaguaaaacaugcgaugugugaacugauuuagcuguccugguucaucaugucuaaauugugggcuagguguuggaaauugaggaaaugaaaaauaaucagacuucugaaaaacuagcuuuaaauguuuuuauuccaaauaauuacaguuguuccuugguaugucugggggcuugcuuccaggacccccuccccgcccccuacagauaccaaaauccauugaugcuuaagucccuuauauaaagugacauauuaucugcauauaaccuacacacauccucucauauacuuuaagucaucucuagauuauuuacaauaccuaauacgguauaaauucuuauccuguguuguguaaaauuuguauuauuuuuugcuguacucuuaugucuuacuuuuuuuccacauguauucgaucagcaguugguugaaucuauagauguggaauccauggaugaggagggccaaccauauuuuccucuguaugacacugguauacuuuauauacaagaauaauagaaauuaaguucggugguugucugaacaguuaagaguuugaacuagauaauuucuauguucaaacacugauucagcaggucuuuagccguaccugcuaugugccagacccuggucuaggugcuaggaaugugagaagccuuuggaggggacgcagagccgucauagaucuacucgggaaguugugaaagacuucuuagagaaaguagcauuagagccaggccuuggagaggguaggaucucuguuggcaaaccugauuuuuuuacaugagaaguaaccugaucuuacaucuauuuuagaaagacaacuugaggguggaguggggugggguagagaguuaaaaaaguaacaagagccugaacuaggucgguggagacagaauggauaaagaacaggauagucuugugaaggaagacucagugcuaggaaguguuggaggaaaggagcucaggucucagugaccagagaccagggugcugcucucugagagaagcuaaagugagaggagaccucggcacagggccucaccaacgaauguguuucuguuguugcuguggugguuagggggaacucaagaggacaggccgauuucuggggggauugagggaaaaacacauuugauccuuugccuuuuccagucucuuuauauuuacugguuaaauguaauaaguuuauugggaacuacuuguauguucaaagauugugccuuccacuuuccaggagcucacaggauuuuuuguucgcugaaacuuuuguaaauuacuuagucuucuugauucugcuuaaagaaaaaaaaaaaaagguuguuucuucagaaauauaguucuggaguaaucaguugaggauuuuuccucugacagccccuauguccgaauuuuccuaaggaaauccagacugauuacaaaggaagaauacuuagcagccugauugucaggcccuguguccucggggcagggguuagcgccagauccguuagaggugucaggcggcuggugccgagcauaaagcacacacacggucacuggugcacuuuuucucuuuuuucagauauacgccagcgguuaggaaaaagaccacauucuccggaaaaggcuuuuaguaguaaccccgucguucggagagagcccucuucugaugugcauaguaggcuagguguucccaggcaggauaguaaaggccucuacgccgauacucgggagaagaaaucagguugguaacacuuaaaacggaugggaauggggauucagugagagcagaggacaguggguguauuggagaaauacuuucuuagcagaaggcaagaaacagcccacgccaaauauaagugauuauuccuuuuccauuauaguuaucgucagcaucagcaucagcaucaucccaacaguuaggaacgcuuagaaaauagaaaaaaauagcacacuccuggcucuuucuguuuggcacaaaucuuuuuaguuucaugugagcuauucuggucuuugcccacauacaaauccuaguuuuuucauacagcauuuuaucguaguuguuugccacauuuuauaaucuuuauaaauaaaacuuuuaggccaggcauagcggcucaacaccuguaaucccagcaauuugggaggccgagacggggggaucacuugaggucaggaguucgagaccagccuaaccaacauggugaaacccugucucuacuaaaaacacaaaaaugagccgggcgugguggugggcgccugcaccacugcacuucagccugggcaacagcaagaccuugucucaaaaacaaaaacaaaaacaacuuugaauugccuuauaauguggccgucuacaaaauucuaaacacguauuucucuauuguuaaauuuucauaaaauauauuucaaaaauuaauggaagggaucugggaguggccuacuucuggcagaauggauuggcacacaggguggugucucagcagggaagggcaggaguaggaggaaacggccucucaggugauucugaugugucuggugacagggagggaccugaccuguccccccacggugagaaucccgugcuggguccagacccuuccguuugcgggcaggggcugcggcccgggaaaugagauuuugccugcccaaggcugcacugugguggcaggcuccacagacugcuggcguuuccugcacagcagguguuggcagugcugcugcccccucagugcuacccugguucuuagcgcugacugcgaaagugaaaugccaucucauccaaacagguaauuuauggacucgccuaggaucugcacccaagaccaaagaaaagaauacgaagaaaguggaucacagggcgccuggcgcugaggaagacgacucugagcugcaaagggcauggggggcucugauuaaggagaaagagcagucucgccaaaagaagagccgguuagauaacuuaccaucucuccagauugaaguuagucgggaaagcagcucugguucagaggcagaguccugaugccccuggggccuauggcagcugcccuaaagccugacauucuugcacaggguggggcgcgcaguaggaaccucccccgcaggagcuggcgcccucucgcuccugcucacacagucacccuccgcucuugcuacuucggcaagacaucuuaagaaugugacacauuuucaagggcaucucuaucuuucgcugcagaguuguaguucugggcccucgauuccuuucccaccaccccacaggcuuuacccuuugagaaaaaggcagcccuccagauuuuguagacauuuuucuuaauauuuuuaacauugugucuuuuaaaagaaauguuuuacacaguucauccaaagagcagagaacugaacuucucacuauugccuuggcccugacagcuguuaccagcacccuuuucccaagaaaagucaauucccaggugcuuauuggacauccuucgagggggaagaggagggaagcggccagcucacccuuccgggacccuaguguggggcgaaucucacggaccugaccucagaggugcaccagugccgcccagguagauaagagcugcagcauugacugugcuuccguucuucccucggggauugcucauggcaugggccucuuacgugcugucagcuugaugugaagaucaaguucagugcugugggauuuuuaggaacaaaaaacugugacgucuggauuugggguugauuuuugugcuggggugggauuaugggucaauguugaagaauuuuuaagucuguauuauguuuaaaacaugaaugauuugaaaguuuaaauuuuuaauuuuuauauguggaaauucuuccuguuggcuaaaggggaagcucaaguggugucgucuuuugugcuguuaaauauauauucuauucuuuggaagaaggcagagagaggagucuuauuauuuuuaaaugcuccuaguuguauagucugucuguuguacauagaguucagcuuguuuuuuggcuccaguaggaaaaaaaauccauccaucugagaugggguccuguuguuuauuaucacucuagaaguuauacauugauauuuauucuuucuguccccacguuguggcaccugaagacaucuucaaaauuggcagaaaagauaauaguuauaaaaauuuuaguucauuuauuuuuaaacuccuuucagauuauuuuaccauuaggaggagguagauuguuucgucuuccugucugauuuuuguuuuguaguauuuaauuuuguauuccucugcaguuuuaagaaacaguguuuuucuucgguuugcuggaacaugggcguuagagaugguaauaaaccgugguccuuuuugcgaugucacgacucuucaccugccugggcuguugugcacacagugcagccuggauccugucgaucuuuacuuguggcggagcuaauggucacauugauaguugauuacacuguggcacgaauuaaugcagaacacuguuauuaauaaaggaaguaaagggcugcaagauuugagagcugcaacaaaaacuguauugucccauauuuuguugauuaaccuugcuuuuucucccucccuuuagagagauuagaggauauaaccaugauauauuucagcuucuuauuaggauucuaggaaagagaugguucugguuucucugccaguugagacuuaagacaucugagauuucucagcuuuucuuucccugugaagcauacagcugagagccagguucuuaggaagggucaggguuuggggaguugguagagugaggagugcgggggccugagaaucggacaccuggaugccaaccccuggcucugcuccauggaccugggccucaguuuucccgucuagcaguugagugggcuguuaccagaauuccu

SEQ ID NO: 192267 - RNA, 95853 nt, Homo sapiens
acgaggcuagauggcuucacaagauggcggcgcgcugggagcguaucaucugcguuucuaggagcuucgcuaugcggcugcuuuaagauucuaggguuguacaggcccacgccagacacgacgucuggcaggaaccucggccucagaggugggucacuuauaucucucacgcagauuuacuaucaugggucacuuaacccguggaucacacggguuccucauucuugaguuuugggcuagugaggugccgacuucggggucuaggaggggagaccugauguggcugugugugcgcacgcggggguguugagaguggaugagugggaggaguuggcgaauagaauagagacuaggacugaaguaggaaagacuccccgguguuuaggagguuuagagagauccaaaacugaggcgggaagacaaacugagcugauaaaaugagggcauggaaagaacggcaguggcaggacuagugggaaacgucggauuuaugagagaaggcgaagagagaagauguagauugguguggaagugggagggaucugugcagaaagaauuugaaguucugaaauuggaauuuagacuguuuuacaggcuguguaucaagagagugguaguugaagaggguuaauggucaagaggaaccaaggaaacagaagcauggagaugagaaagaaaaaaaaaaaaagggaaagccucauucucaggguucuacuauuaacuguggcuuucuggacugacucaaguaaccgggaagaaaaguuccaguccaugggcugagcuuuuuuugaaacucagugagggugcuuugugucggugguccagacagggaagaguucuaucgugguuucaaucaacaaauacuugagugccuacucucuuaggcccuauuuuaggcguugggauaugcggugaacaagacagacaaaauauuuacccucuugaaacuuacugacgggagauuuuuuaaaguaaguaaaauauauggaaugccagauggguaaauucuguguagaaaauugaagcuagagccuggguagcaaagccagacucccuuucuacaaaaaaugaaguaaauuaaccaggugcagugcucuguaccuguagucccagcugcuugggaggcucaggcgggaggauugcuugaucucaggaguuggaggcugcagggagcuaugauuccaucauugcacucugggcaacagaauggaagaccuugucucaacaagaagaaaaaaaaaagaauugaugcccaguuaaacucugaagaauagguuauauuuagcuaagaacucauugccuauauugggagguuaguuagaaaagaagugguuguauuuacucauucuguaucuguucugaccagaaaaguugaauaauguaggaaaugaaucgaaucugccaugucuguaauuuaauuuguuucacauauauucagaguauuauguugugugugcacugaugucagcuauguagucuguagaauuuuccuuaauguguggcagagcccuaacaugccacugucucuugaagucacuguuaggauauggugacuaaagucagcaacaauguauauuucaaaauagcuaggagagggcuugaaauguuaccaauacauagauauaaaaaauacucaaaguggugaauaccccauauacucugacuugaucagcacacauucuaugcguggaacaaauaccgcauaaaugucacaugucccccauaaauugggaaaauauuuuccaucaguuuaaagaaauuacucuuaguuuacuuuuuuuuguugcuugccagaaucacaagaaagaacauuuucuuuuucuuuuuuuuuuuugagacaguuucacugucaccaaggcuggagugcaguagcacgaucuuggcucacugcaaccuccaccuccuggguucaagugauucuccugccucagccucccgaguagcugggauuacaggcacccaccaccacgcccagcuaauuuuuuuuuuuuuuuugagacggaguguugcucugucaccaggcuggagugcaguggcgugaucuuggcucacugcaacuucggccuccugaauucaagugauucuccugccucagccucccaaguagcugggacuucaggcacaugccaccacacccagcuaauuuuuguauuuuuaguagagauaggguuucacuauguuggccaggauggucuccauguuggccaggcuggucucacaaacuccugaccucaggugauccuccagucuuggccuccgaaaguguugggauuauagucgugagcgacugugcccggccaacacuuuaauuuuggauauuuucuuuuuaauaaagucuauuauuuguauuuguuuauuuugagacagggucucacuguguggcccaggcuggacuggaacuccugggcucaagcuauccuuggcaucccuaguagcuaggaacacaggcaugcaccaccuugcccaguugauguuuucuugagaacugggggccauccuaguuuuaugcuccccucuuuccugauggucaguaaaggguaugucaaugcuaggaaauuaagacagguauauagucauuuuuagucauagugugaggggcaaaauguaguaacaguaugcugaaaaacuuucaggugacuacuaauccccucaaauucugaauuguuuacucaaaaaauauuuauuguauacagguugcuggggguauaguaaagacuaggauggauaugguugcaggucuaugugugacauaugcaaauuaauuacacacccaguaguaaacugaagaucucugagggagaagcagcacagggugcuuugaaagcguguagaugggcaucugauuggauuguggggucagagaaaggcugccugaguaaaugaugccuagggugugauuugaguagcuaguggaccuucagaggugaaaggcgauggugggagguugaggagagucuuacaggcaguaagaauaggagauggugagacagacuaccaugcagcagagaaaauggaagaagaccaguaugucuggaaggggaaaguggcaacaaaugaaguuggagggacagauaaggccuggauuaugccugccuuuuuaaugauuuuagacuuuuuuagcuuaauagcuuugggaugccacugaagggauuuaauaaggaaauguucacauuugcauggggggaguggcuugucugcugagugaaaaguggcugguagagggcaagaguguuuaugaagagaucaguuugagacucuuagagcaacccaagaaagacaugauaaugaccugggccagagaggugguguugugaagggugaaaagugggauaaggucaagaaauaauugggagauggaguauucaggaccugguguguugugaaugggggaggcagcauggagaagguguugaagauuuuugauguguuuaucacaagaaagauagcagugcauuuggugagauagggaagaugagaaggaccaguuugggguggguagaagugauuuaauuuugcacauauuguacauguauuuuugagcccuucaagugagaaauaugguaggcaguuggauaugugauuuggaaaagucuggaaugaagacaacaguucuuuucugaaauugguuuaauuuccaguguaggaagcugucaaaaaaccaucugaaauagcauugacagauuuaugacuauguaaaauuaugucucuaacaaagauugcaaaagaaaaauauuuauugcuaggagauguuauaauagaggauuugucuuuuuuuuuuuuuuuauugaucauucuuggguguuucucgcagagggggauuuggcagggucacaggacaauaguggagggaaggucagcagauaaacaagugaacaaaggucucugguuuuccuaggcagagaacccugcggccuuccgcaguguuugugucccuggguacuugagauuagggaguggugaugacucuuaaggagcaugcugccuucaagcaucuguuuaacaaagcauaucuugcaccacccuucauccauucaacccugaguggacacagcacauauuucagagagcacaggguuggggguaaggucacagaucaacaggaucccaaggcagaagaauuuuucuuaguacagaacaaaaugaaaagucucccaugucuaccucuuucuacacagccacggcaaccauccgauuucucaaucuuuuccccaccuuucccccuuuucuauuccacaaaaccgccauugucaucauggcccauucucaaugagcuguuggguacaccacccagacggggugguggccgggcagaggggcuccucacuucccaguaggggcggccgggcagaggcgccccucaccucccggauggggcggcuggccgggcggggggcugacccccccaccucccucccggacagggcggcuguccgggcagaggggcuccucacuucccaguaggggcggccgggcagaggcaccccucaccucccggauggggcggcuggccgggcugggggcugacccccccaccucccucccggacgggguggcuggcuggguggggggcugacccccccaccucccuccuggaugggguggcuggccgggcagaggggcuccucucuucccaguagaggcggccgggcagaggcgccccucaccucccggucggggcggcuggccgggcggggggcugacccccucaccuccuucccggacggggcggcuggccgggcagaggggcuccucacuucgcaguaggggcggccgggcagaggugccccucaccuccuggacggggcggcuggccaggcggggggcugacccccaccucccucccggacgggguggcugccggguggagacgauccucacuucccagacgggguggcugccgggcggaggggcuccucacuucuccgacggggcgguugccaggcagagggucuccucacuucucagacggggcggccgggcagagaugcuccucacaucccagacggggcggcagggcagaggcgcuccccacaucucagaugaugggcggccgggcagagacgcuccucacuuccuagaugggauggcggccgggcagagacgcuccucacuuuccagacugggcagccaggcagagaggcuccucacaucccagaugaugggcggccaggcagagacgcuccucacuucccagacgggguggcggcugggcagaggcugcaaucucggcacuuugcggggccaaggcaggcagcugggagguggagguuguagcgagccgcgauuacgccacugcacuccagccugggcaccauugagcacugagugaacgcaacuccgucugccaucccggcaccuugggaggccgaggcuggcggaucacucgcgguuaggagcuggagaccagcccggccaacacagcgaaaccccgucuccaccaaaaaaauacgaaaaccagucaggcguggcggcgugcgccugcaaucgcaggcacucggcaggcugaggcaggagaaucaggcagggagguugcagugagccgagauggcagcagcacaguucagcuucggcucggcaucagagggagaccguggcaagagggggagagggagagggagagggagaccguggggagagggagagggagggggagggggagggagagggagaggauuugucuuaacuggggagauuagggaaggaaagaucuuccugaagaagaggugcuugaacugugagcccaagaaugacuaagaauuugccgacugaagagagggaggaaaaaacguuacagauaaaaagaauaaccugcauaggaggcugaggcaggagaaucgcuugaacccgggaggcagacguugcagugagccaagauugcgccacugcacuccagccuggugacagagggagacucugucucaaaaaaaaaagaauagccugcauaaagguccuguggucaggguagaaggacacaaagagcaagggcaugugacuuaaacugauggugaaaagauaggcaaggccaggucauguagugccuugcauguaggcugaagugauguuuuuuuauuuuauccuaagaguaagguuuugagcagguggacauaggagaaggacauacugagauuuguguuuggaaaugaucacuacgagguggaaggagggauggugagaacaagaguggaugcagggagaccaauuaagaggcuacuguaaaccaggugcgguggugcacaccuguagucucagccauuugggagcccgaggugggaggauugcuuaagcucaggaguucaagucuggccugggcaauguagucucuaaggaaauaaaaguaaguaaauaaaaaggcuguucuggccgggcgugguggcuuacaacuauaauccuagcacuuugggaggcugagguggcaggauugcuugaggccaggaguucaauaccaaccuggccaacauaacgaaaccauguaucuaaaaaaaaaaaaaaaaaaaaaaaaaaaaaaaaaaaaugccucugggcuugacauuguuggggacagggaaaaagaguggauuuaagagguauuuagcagguaaaaccuacagaaguggugauuucuuggauaugagaaacuaucaacugacuccuagauuuuuggcuaacauaauauuguuuagaagaauaaucauuauuuaaaagguaaaaaauaaagauauuaagaaaauaaaagucacuugccacccagagagagauauauauauauauaauaguaaaauauuuuuuaaauuaccaacuaccuggagauuuacuaaaccauuauaauaguuucucuuucaguguuuaugucuugauauaaguacauuugcuuuuauuucuuguuguaaucuggaagaagacaaaauuauguucguuuucauuugguuuuagcuaccuaggaaugacaagauugaaacuuuaaguuggaaucaaagauauuuuuucaaaguuuggugauguuaugguacacuaccaaauauucaguccuuguaaggauacuguaaaaacuaacccccaagcugggugugaugguucaugucuguagucguagcacuuugggaggcugaggcaggaggaucacuugagcucaggagucggaaaccaaucugggcaacaaagggagacccugucucuacaaaaaauaaaauuaaaaauaaauuagccaggcgugguggcaugguggcacauaccuauagucccagcuacucgggaggcugagguggaaggacuguuugagcaugggagauugaggcugcagugagguaugauugugcuacugcacuccauccuggaugacagagugagacacugucucagaacaaacaaaacaagacaaaacaaaacacaacuaaccucuaacuaauauccuugguuauagaucauauauacagacuguguucugucacuuugaugcucuuaaaggaauacuuuucagcuuucuucccuugauuuaaaaaaaaagacucacucuuacguugucugcauuuuuaaaaucauggaaaaauauacauaacauaaaauuuaccauuuuagccauuuuuaaguguaccauucagugacauuaaauguguucauucucuugugcaaccaucaccucuaucuccagaacuuugucaucauuccaaagugaaacucuguaccuauuaaacaguaacuccucauucuucccuccccagcuccucaucaccucuauuccacucuccaucuguguaauaaauuuaccucuacugggugccucauauaagugaaagcauacaauauuuguccuuuugugugugguuuauuucccuuagcaugguguuuucaggguucuuccauguuguagcauguaucagaauuucauuucuucuuagggcugcauaauauuuauuguauguauauaccguauuuucuugauccauauuuauuguauggauauaccauauuuuguugaucauauguauuguauggguauaucguauuuuguugauccauauuuauuguauggauauaccguauuuuguugauccauauuuaguguguggauauaccguauuuuguugauccauauuuaguguguggauauaccguauuuuguugauccauauuuacuguauggauauaccauguuuuguuuauccauauuuauuguauggauauacuguauuuuguuuauccauauuuauuguauggauauaccauauuuuguugauccauauuuauuguauggauauaccaucuuuuguugauccauauuuauuguauggauauaccauguuuuguuaaucuauauuuauuguauggauuacuguauuuuguugauccauauuuaguguauggauauacuguauuucauugacccauauuuauuuuauggauauacuguauuuuguugacccauauuuaguguauggauauaccguauuuuguugacccauauuuauuguauggauauacuguauuuuguugacccauauuuaguguauggauauaccguauuuuguugauccauauuuaggguauggauauaccguauuuuguugacccauauuuauuauauggauauaccguauuuucauauuuaguguauggauauacuguauuuuguugauccauauuuaggguauggauauacuguauuuuguugauccauauuuaguguauggauauacuguauuuuguugguccacauucaucugcugauggacacucagauuguuucccaccuuuucacucuugggaaugauacuacuaugaacacugcuguacaaauaucuguuucaguuccuccuuucaguucuuuugggaauauaccuaggaguggaauugcugaaucagauaguaauucuauguuuagcuuuuuaaagaaccgccaagcguuuuucgacagcagcugugccauuucacauucccaacagcaaugcaugagaacuccaauuucuucacauccuugcagaacacucguuguuucuguuuuuuuaauuuuuuauuuuuguuuuuuuguugacagcagccauccuaguggguaugaaguggugucucacgugguuuugauuuguauuucccugaugacuaaugauguucaccaucucuucaugugcuuauuuguuguaugcauuuuaaaaaugugauuucuacuuucucacuugaucggcaaagacauguuggcuguaacuauuaacuuggcauccacagcuuuccccacugauuuuuuuuuuuuugagacggaguuucgcucuuguugcccaggcuggagugcaauggcgugaucucggcucacugcacccuccaccuccuggguucaagcaauucuccugccucagccucccaaguagcugggauuacaggcucccgccaccaugcucggcuacuuggcuacuuuuuguauuuuuaguagagacgggcuuucaucccaucauguuggccaggaugggauggucuugaacuccugaaucaggugaucuacuuaccuuggccucccaaaguacugggauuagaggcaugaggcaccgcacccggcccccauuaaugguuuuuaauaaauaugcugauuuucuuucucucuuucucuccuuaagauggcucugaguaaaucaaugcaugcaagaaauagauacaaggacaaaccuccugacuuugcauaucuggcauccaaauauccagauuuuaagcagcauguucagauaaaucugaauggaagagugagguagguaacggaugaaaaaucacuguuauucuugugugauucaaauggauaugauguaauagaaagcccaccugaguguuaaucuuagacauuugauuaaacgucccaugcgaccuuggacaaaucacuuaaccucucuuggucucagcuuuuuaauguauaacauuagaggaauggaccagaugcuuuuaaguuuccuucuggcuuaaaaaaaaauucucuugauguccaaauuguugcuuacccuacggaaaucccagaguaacuucagagauuuacgauugugcucuuugugaucuaaaacuuagugacuggugaggaucuaaacacuuuuuuuuuuuuuuuugagacaaagucucgcucuguugcccaggcuagaguacaguggcaugaucucggcucacugcaaccucugccucccagguucaagugauucuccugccucagccuccugaguagcugggauuacaggcgcccgccaccacacucagccaacgucuguauuuuuaguagagacgggguuucaccauguuggucagacuggucuggaacuccugaccucgugauccgcccaccuuggccucccaaagugcugggauuacaggugugagccacugugccuggccuaaagauauuuuaauaaguguguguuuauuuugaugugaggcaggaaaauaauaaccaggacaucaggacugauuucacagauauuauuauuuaagauguuacuaaauuuaagaaguugauuuauuuuuauuuauuuauuuuguuuuuagagauaggaucuugcucuguugcccaagcuggagugcaguggcacagucauagcuugugauagcauugaacuccugggcucaagcugucuuccugccccagccuccccagauaaaaauagccaagugugcccuaccaugcuuagcuauuuuuauuuuuauuuuuguagagacaaggucuugucauauugcccaggcuggucucaaacgccuagauucaagugguccucccuccuuugccucccaagguucugagauuacagccaccacaccaagccagaaaguugauuuuuuauuuuuacuuuauuuuauuuuuuugagacggagucucuguugcccaggguggaguacaguggugcagucucgccucacugcaaccucugccuccugaguucaagcaauucuccugucucagccuccugaguagcugggacuacaggccucuaccaccacgccuggcuaauuuuuguauuuuuaguagggacagaguuucaccauguuggccagacuggucuugaacuccuggccucaggugauccgcccgccuuggcuucccaaagugcugggauuacaggugugagccaugugcccggccuugauuuuuuuaaauuaagaaaauaauaguauaaguguuucaggaaauggcaaaauuaugauaacuauaugggaaugacugaugugucuuuuauaccucugagaaagaacuaucucuaacugcauuccucaacucugcgaguuacagagggaauuggaaauucccagccugccuggagagaggcguggugauucagcuaugggaaggaagaggagcaggauuagaggagaaaaaggaagggaaagaauaauaguggccgggcgcgguggcucacgccuggaaucccagcacuuugggaggccaaggugggcggaucacuugaggucaggaguuugagaccagccugaccaacagggugaaaaccucaucucuacuaaaaauacaaaaaugagcugggugugguggcgcaagccuguaaucccagcuacuccggaggcugagugaggcaggagaaucacuugaaccugagagguggagguugcagugagccgagauugugccacugcacuccaaccugggugacagacugagacuccaucucaaaaaaaaaagaaaaaagaaaaaaagaagauuaggaucauagggcuugaggcauuuucuucaccucuucuuuacucuaagcccucuucuuauagcuuuagaaauggaggcccuggggcaagacuuaaccuggaagccaagauaacccuuaaaaucauacaggaguucaaacaaauauuuauguucauuuuucugacagauaauccuuagcugucaucacauucucaaagggaucugugaaacucuccacccacacccaaguauaaggguuaagaucacuuugggaggccgaggugggcagaucaccugaaguuaggaguucaagaccagccuggccaacaaagcaaaacccugucucuauuaaaaauacaaaaaauuagcuggguguggugaugcacacuauagucacagcuacucaggagacugaggagggagaauugcuugaacuggggaggcggagguuuuagugaaccgagaucaugccacugcacuucagccugggcaacagaaugagacucuaucucaaaaaaauagaauaaauugagcacagccuauaugugaaugcuuguacuacuuacuguguuaauauauuaaguacauuugaaaacauauuucaaaauagaaauuaaaaauauauuuaaauaggacuucagguauuuucuuuggauaccauaaucaccuuuggcaccuuacuuuggagucacuuacccuaaagagauugaauugggauuucucuguuuauaacaucucucucauuguuuguaagucauuguuucauagugauauacguggauguugauccuaguagcuuuaggaaagauaccauuuuaguggggugcaacacugugcaucuguagucccagcuacaugagaggcugaggugagaggaucuugaguccaggagucugaauccagccugggcaacauagcgaaauccuguaauuaaaaaaaaaaaaaaaaaaaagauauaguuuugucauuguuuguuuccucucuauacuuacuauuguacuuaaucagcuauuuaacaaaaaccuauugauuagccacauugugcucaguucuaggaaagccuuaaaaaacaagaaagaugucacugccacagucacacgcuaguuuauacacuaguggggaaaauggacaaauacauaagccguuaaccuuuuaguaugggagaauccgggggaugugcagugggaucacaugaaaaggagaccguacccugacuuugggauuuagagaaugauuugaaaccgaaauggucucuugguuguguuuuaaggaaugaguggagugagccagguagaaagaagaguauuccaggcagaggcagcagcaugugcaaagaauacugggcagaggggaacugaagaagugaagcguggcuggggugcaguggacaagagacaggaggaggugggcuggggaugguuauacuuuguggugcuuuauaaggcccacugaggaguuugaaauuuuucuuaagggcgugguauggaggauucuugugccuugcccauccccauccucauccacuaaaguuuuauauuauuuucugagacacagucuugcucuguugcccaggcuggagugcaguaaugucaucuugguucacugcaaccuccgccuccuggguucaaacgauucuccugucucagccuccugaguagcugggauuacaggcucgcaccaccacggccaucuaauuuuuguauuuuuaguaaagacggaguuucaacauguuggccaggcuggucucagaacuccugacuucaagugaucugcccaccucaaccucccaaaguacugggauuacaggcgugagccaccgcgcccagcugaugguuaggauuuuuaagauuuuuguuuuguuuugcauuguuuggagacagagucuugcucugucaccaggcuggagugcaguggcgcugucucggcucaccgcaagcucugccucccggguucaagagauucuccugccucaaccuccugaguagcugggacuacaggcacaugccaccaugcccaacuaauuuuuguauuuuuaguagagacgggguuucacuaugaugggcaggauggucucgaucucuuuuuuuuuugagauggagucuuacucugucgcccaggcuggagugcaguggcgcgaucucggcucacugcaagcucugccucccggguucacgccauucuccugccucagccuccugaguagcugggacuacaggugcccgccaccacgcccugcuaauuuuuuguauuuuuaguagagaugggguuucaccguguuagccacgauggucucgaucuccugaccucgugaucugcccaccucagccucccaaagugcugggauuacaggcgugagccaccgcgccgggccuaagagguauauuuuuuaaaaggccaagcgcagugccucauaccugcagucacagcacuuucagaggcugaggcaggaggacugcuugagcccagggggucaaggcugcagugaaccaugaucgcgccacugcacuccagccuaggcaacagagcaagaccuuguuuccaaaaaaaaccugucagucugaagcagaccuaacagauguguuuuuacaacauaucuaaagguaccuggcaagucacaaacauugaguuaauauuuguugacugcaugagaauaauuucucuauuaaaugauaugccaggccgggcauaguggcucaugccuauauucccagcacuuugagaggccagcgaauggcuugagcucagaaguuugagaucauccugggcaacauggagagaccccuucucugcuaaaaguacaaaaaugagccgggcgugguggcauaugccuguaaucucagcuacucagaaggcugaggcacgagaaucgcuugagcuugagagguagagguugcagugagcugagauugugccacuacacuccagccugggcgacagagugagauccuaucucaaaaaaaaaaaaaaaaaaaaaaaaaggccgggugcaguggcgcacgccuguaaacccagcacuuugggaggccaaggugggcggaucaccugaggucaggaguucgagaccagucuggccaacauggugaaaccccgucucuacuaaaaauacaaaaauaagccaggcgugauggugcgcacuugugaucccagcuacucgggaggcugaggcaggagaaucgcuugaacccaggagguggagguugcagugagccgagauugugccacugcagugcaaccugggcaacagagcaagagucugccucaagaaaauaaaaaagaaaaacaacaacaacaaaacgauaugccauacauaaguggcaugagacugguaauuuaugaagaacagaaauuuauuucucauagucugggggcugggaaguccaagagcaaggcccuggcaucugguuaagggcccuuuugcugcauccucacaggguggaagguggaagggggcaaacccacuucugcaagcuuuuuuuuaaacagcagcauuaauccauucauaagggcaaagcccucgugaccuaaaccucucccacuaggucccaccuccuaacacuguuggcauuggggauuagguuuccaacaaaggaauucugggggacacauucagaucauagcacauaccuaaaacggaauuacagagaaaugaaaguaaagggaugcgcaaaaauaaguagguaaaugagaguucccccuaaaucaaauaaaguagaaaagaaggcaaaaagcaucaaaauggaaaauuauguggauaaauaacuuucagugaagaugaagacuuagcauuuugaaaaguauagaaauuuuuaaaaacauguuugacaggguauaguggugcacgucuguaaucccagcuacuugggaggcugagguggggggaucauuugaucccaggaguucaaggcugcagugaacuuaugauuacaccacugcacuccagccugagcgacaaggugagacccaucucuaaaaaacacuguuugacguaauuuggaacuuuuuuuuaaauauuucuaacuaaguagacagaaauauacagagaagagugaacuuagggacuuugagaggauccaugaaugccuugaacacaauuagauaaaaauacuauuuguguaggauguuuuuucuuuuuuuuuguuuuguuuugugugugugugugugcauguguguuuugagacagagucgcucugucacccuggcugcuggagugcagugguguggucucaggucacugcaaccuccagcucccagguacaagcaauucuccugccucagccuccugaguagcugggauuacaggugugcacugccacgcccaaauaauuuuuguauuuuuuaguagagacaagguuuugccauguuggccaggcugaucucaaacugcugaccucaagugacccgccugccucggccucccaaagugcugggauuacaggcgugagccaccgcgcccggccggucuucacuuuuaauucuaguucucuugcuauuuucagcacaucugcaguuacuucccaugcugaagucuugagcccgucagacucaccuaugaggguugaaauaaucuuuuucuuuuuuuuuuuuuuuuugagacagagucuuucucugucacccaggcuggggugcaguggccggaucucagcucacugcagccuccaccuccuggguucaagggauucuucugccucagccuccuggcuagcugggauuacaggugcgcacaaccacaccuggcuaauuuuuguauuuuuaguagagacaguguuucaccauguuagccaggcuggucucgaacuccugaccucgugauccgcccaccuuggccucucaaagugcugggauuacaggcgugagccaccgcacccagccgaaaucaucuuuuucauauucgauuaauguugauaaugaccuccucucaucaaucccaaauguucuuuuauuuuuuguguuuuugagacagggucucacucuguugcccaggcuagagugcagugguauaauuguggcucacaguagccucaaccuccccgggcucaggugauccucuuaccucagccucccaaguagcugggacugggugugugcugccacacccagcuaauuuuuugucguuguuguuucaccccaucuggucuugaacuccugggcucaagugauuugccucucucgaccucugaaaguauugggauuacaggcaugagccaccaugccuggccaauccugaauguuuuuaauggcaucuagaaugcugaaucuuuuccagaagguuuucaauuuacuuugccuagaucugucugaggaaucacuaucuauggccuuaaaauguuucuuaaauaauaagaugugcaaccuccggcucccggguucaaacgauuccucugccucagccucucgaguaucugggacuacaggugcacgccaccaugccuggcuguuuuuuuguauuuuaguagagaugggguuucaccauguuggccaggauggucucgaucuccugaccucaugauucgccugccucagccucccaaagugcuaggauuacaggcgugagcaaccacgcccggccuuguuuuucuuuuuuagagagaggguuccuguugcccaggcuggagugcagugguaggauuauagcucauuguagccucaaauuccugggcucaagcaauccuccuaccucagucuccugagucacuaaaacaaaaacaaacauacacacacaaaaaaacaaaaaacaaagaccacugaucauaaaucaccacaacaaaguuugaaauauugugagaguuacugacauguggcauagagacauaaagugggcacgugcuauuagaaaaauggcaccaauacacuugcuagauguaagauugccacaaacauuugauuugcuaaaaauacaauguauaucccauauacccccuaaauauauauaccuaccauguacccacaaaaauuaguaaaucuugacugggcacaguggcucacgccuguaaucccagcacuuugggaggccaagguggguggaucacuugaggccaggaguuugagaccagccuggccaacauggagaaaccccaucucuacuaaaaauacaaaaauuaaccucccagcgacucgggaggcugaggcaugaggaucacuugaacccaggagauagagguuacggugagccaagauugcaccacugcacuccagccagggcaacagagcgagacucugucaaaaacaaaaagaaaagaaauuaaaaguaaucuuuaaaaaguuuuuuaaaaagacuuguuacagggaagaagaaaugugucugugaggcgaugggaagaggauacggcagucuugaggagaacuuccuuguuuuucuuuuagagaugagagcaaugugagccuauuuauaguugcaaccucgcaugguucgcaggaaccugugguagacauaggagagucuaccuugguguaaaugaccuggcagcucccagaaaucuucccccuuccugcuuagguaggaguuguugaugauugucugcacugguagaauguucuucauuuuuacaaugguuuuuuuuuuuuuuuugagacagagucucacagcgucacccagacuggagugcaguggcccaaucucggcucacugcaaccuccaccaccugagcucaagcaauucaugugccucagucuccugaguagcuggaauuauaggcaugugccacuacagcuggcuaauuuuuguauuuuuaguagagaugggguuuuaccauguugguuaggcuggucucgaacuccugacgucaagugauccgcccgcuuuggccucccaaagugcugggauuacaggugugagccacagcgcccagccuacaauggcuuuguauuuaauucugucaguuguauuaaagaagaauuacugggcugggugugguggcugccuguaauuccagcacuuugggaggccaaggcgggcggaucaugaggucaggagaucaagacuauccuggcuaacacagugaaaccccaucucuacuaaaaauacaaaaaaauuagccgggcgugguggcacgcaccucuaaucccagcuacucaggaggcugaggcaggagaauggcaugaacccgggaggcggagcuugcagugagcugaaauugucucaaaaaaaaaaaaaaaaagaagaaucaccaaaauauaaacucaacuaaugauggaaaagaaaugucacacaaaacauuagaccuucagugggucagagugucacuuauuugcuuaacuccuaaguggucucuuaagggaaucagggguguuuuggaaaggggacauuucuaaguuagucuuguuaaguaucagucuugagggugccaguuccagcuguguuuuuuuuguuguuuuuuuuuuuuuuuuuuugagacggagucuugcucuguugcccaggcuggagugcaguggcguguucuuggcucacugcaaccucugccuccugggguucaagcaauucuccugccucagcguccugaguugcugggauuauaggugccaaccaccacaccuggcuaauuuuuuuauuuuuuauuuuuaguagagacgggguuucaccauguuggccaggcuggucucaaacuccugaccucuugauccaccugccucagccucccaaagugcugggauuacaggugugagccacuguggccggccuuagcugugagauuuuauguaauuuucuuagcuuuacugagacugaaucuucucaccugaaaaggagggaugagaggacauccucaugaagguuagcaguuguguagaaugacuagcauucuauggacacugaguucaugguaggugcucauauuguuguuaagccugguauaaguaagguggcaaggauugcuacucugauaucuuauuuuucuccccugcaugucacugcuuuguuauaaucauaucugaccauugcaauuagauuuuaguuuguguuuuuucacaauaaucaguuccauagggacagccuacaauuuaguucagcacugucaguucagcuugaauagaaugugacacuuaaccgauuuguuuuuauuuauuuauuuguuuauuuuugagacggagucuugcucugucgcccaggcuggagugcaguggcgcaaucucggcucacugcaagcuccgccucccagguucacgccauucuccuaccucagccucccgaguagcugggacuacaggcacccgccaccacgcccggcuaauuuuuuguauuuuuaguagagacaggguuucaccguguuagccaggauggucucgaucuccugaccucgugauccgucagccuuggccuccuaaagugcugggguuacaggcgugagccaccgcgcccagcccuauuuguuuuuauuuuuauuuauuuuaacugauuuuuuuuuuuuuuuuuuuugugagacggugucucgcucugucgcccaggcuggagugcaguggcgcgaucucggcucacugcaagcucugccucccagguucaugccauucuccugccucagccuccggaguagcuggaacuacaggcucccaccaccacgccuggcuaauuuuuuguauuuuuaauagagacgggguuucaccguguuagccaggauggucuccaucuccugaccucgugauucacccgccuuggccucccaacgugcugacauuacaggugugagccaccgugcccggccaacugauuuguuuuuaaaccaaagaccuagcauggaagggcuuuaucaugcuggguagacuguaccauuuuuagcaccucagugaccaucuaaagacuagaaaccaaccuuggaguaacacugggaggcuuuuggcuuuuguuuuuguugcaucagguucagcuucuacaggauuagaaugauuguuauuuuaacaauggauuacagaaaugugucuguucaaaauccaucuguaaugguaauacuguauucaucagugguagagcaggagucauucuggggaaaucggccaugagccuguugacaauaggcuauuuugggaagcugaauguguuaaacaaacaacaaagacugaaaaugaauaaacugcugauuuucacgugagagcuaauuuuaguuccugggccucccugugaucucugaaaugagaaugagaaaagaucuugccugucuguguucagguuuuuugaaugucccagagugcuaacgugaccuagauucuuaacuagugaagucgagugacuugacuuugcccaacaaaaguauuuuugacacucagacuagugucuggaucuuuucagaaaagaaaauaaacaacaaagucuaacaaucagcucuucauugguguucacuuuauuuccuuccaugaaacuagccucagcuuaaugucuuguacuuuuuuaggauauaguuccuugugaauaaauugugugcucuaguucaucauuuuguaaguugaauauauauauauauuugaauaacaagaauuguuuauguaagcaacaacuuucuuugaaggcccuuggaaaacauuaauuacauuguucucuugcccaaaaugucucuugaagcuuuaugaugagcccuacagcugcagcacuaucuuuuggugauugcugucacuguguuacagagagcagauauucuagaaccaaggaccuguuuucugguuuucaaaaaaggaauuauuuuuuacuauacagacauuauagaccccuuaaugggaaaauuagagaaauauauuuuuccuaacuacauuuauaaugguaaugucacauacauacaaaaagucaguucuuucacccuaaaagaugaaauuaguccguaaucucaucuuucuaagcccuugucuuuauucauacguaggaauuuuugugguuguaguuguaguuacauacaaucauucgucgucuucucccccauuugacauuauacuguaagcauuuugcauaaaguuacaaaagcuguaauacauccccccaagcgaguacagugcagucauuaaaaagaauaagacugggcugauccacauacacuuguaugaagagaguuuacauauuuaguuaaaaaaaaaguggaauuauguaauuaaauguguuuagauaauacagaaaugugaggugaaggaagucuccacccgacgcaucuacccaccugcgugcauaucgagucccuacuuaccuuccagacuuuuccucugcaucuguuuauacagggucuuuuuguuuuguuuuuacaagaaugcaaucagaauguacauauauacuucuacucaacuucuuuuucaaacguaauauauugaggaacgcucuucauacaaguauauguagaucagccuaaucuuauucuuuguaauaacuguauaggauuuucuugcaugguuauauuauagcuuauuuagccaauuccauacugauuacuuuuagguuguuccuaaauuuucuguaguacaaaacuuaaauuuaacaguuccucuuuuaucacuggacuuauuuuucuuucuuuuuaagcuucacugaauuuaggguaagucacugggcauugcuaggaaaucgcaguauucguuuuuuuuuuuuuuuuugagucucgcucugucauccaggcuggagugcaguggcgugaucuuggcucacugcaaccuccaccucucagguucaagcgauucuccugccucagccuccuuaguagcugggguuacaggcacgugccaccacgcccagcuaauuuuuuuugcauuuuuaguagagacgggauuucaccgucucuauuaaauggcgauuacaguugccugccaccacgcucggcuaauuuuuguacuuuuaguggagacgggguuucaccguguuggccaggcugcucucaaacuccugacgucaggugaccugccugccucggccuaccaaagugcugggauuacagaugugagccacugcgcccggccgaaaucacaguauucuuaacuaugccuggaaagggcaaagagguguuuggaugacuagauuuuucuuuucuguuaguugcucuuuaguuagcauaggaauggcauuuaaaagaucagccugaaggccuggcuucaagcugcuuuaugcuuguaaucacaacauuuugggaagcuauugcuugaggccaggaguucaagaucagccuggucaauauagugagaccccuucucuacaaaaaauaaaaaaaaauaaaaaaaaaagaaugaaaaguuuagcuugauugaucgagguacaauuuuuuauuuugccaguaggauuuuggauucuuugguuaacuuaggguuaucaguaaugguuguuuccauuguuucaggaucuguguuuuuguauauuacuaucuaauugcuuauuugacccaugagaguguuuaaaaaguggacauuuucuucaauaagucuucuguaucagagaguugaaaagugggaaggaugucaguacaguacgcgaauaauaauuuaaggccacuuaauuuuuuuuauuguugugagaaacgcaacguagaaugucccaucuuaauccaguuuaaguguacaguguguuaacccugugcuuguuguugugcagauuucuagaaccuuuucaugaguuagacuacuuuagauaccuuuaccuuaaaguagaaucaugcaguauuuguuguuuuugacucgcuuauuucacuuagcuugauauccucaaagacuuauccauguucuagcacgugacaggauuuccuuuuuuuuguuuuuuuuaauuuguuuuuuugguggguggggaacggagucuugcucuguugcccaggcuggagugcaguggcacuaucucugcucacugcaaccuauccgccucccggguugaagcgauucuccugccucagccucccgaguagcugggaucauaagcgcccaccaccaagccuggcuaauuuuuguauuucuaguagagaugggguuucaccauauuggccaggcuggucucaaacuccugaccucaggugaucugcccaccucagccucccaaaguguugggauuacaggcgugagccacugcgccgggcugggauuuccuucuuuuuaaaggcagaauaguauuccauuuuguguauauaccacauuugcuuuaucuguuaaucugucaguggaccuuuagguugcuuucaccucuuggcuguugggguuaaugcugcaguaaauaugggugugcagauaucuuuuugagguccuguuuucaaaucuuuugagguuuuuuucauuuuuuagaguugaaauugucuauauuuaagguguacugcaugauuuuuauuuuauuuuauuuauuuuauuuuauuugagacugggucuugcucuguugccugggcuggaauacagugaugcgaucacagcucacuguagccuugaccuccugugcugagugauccuccugccucagccuccugaguagcuaagauuauaggugucugccaccacaucuggcuaauuuaaaauuuuuuuuuguagagacagggucucuuuuuguugcccaggcuggucuugaacuccugggcucaagcaauccucccgccucagccucccacagugcugggauuacaggugugagcuuccacacucugcccucauuuaaucuuuagcugauuccacagugguuucuaacucuaccacuaccaaagcagcucuuuaaaaggucuccagcagccucaugucacugacucugauuuucagggcuccguugccuucugagcagcaggucacucugcugguugguuuauccuucauggauacccucuugccuuggccuccucagcaccacacuggaaaacugguuuuccuucuuccacucugguguuccuuugucuccuuguggaacuuccucuguaaugacugugcauacagcuauuaaaggaguuuucaaagcuugcgccgcagcucucuuuccuucgcacuuuauauuuucuccuucaucgcuguuauccgugccagggcuucacuuguuuguuugcaaaucacuuacauguuuauuucuacacaccucuucucugggcuccaucuccgcuuaaaugucucagaugcagcucagauuuauauuucucuucaaaaacgguucucugccagaguuacuaacuucaguuaggguggcaccgccuauccuguugagcaagcuagaaccuugggagacucaugugaaacacagcaucccuuagcucacauaucauuucguugcuaaaucucacagauguucucuccaaaauaucucuaauuccuuucacuuuucccuaucucugccauugcuaccuuuaucuagauauagccuuuuuuuuuuuuuuuuuuuuuuugagacaggaucucacucuguugcccaggcuggagugcagugguacaauuucggcucacugcagccuccaccucccaggcucaagugauccucccaccucaguaccgcgcccuacucccacucccccgccuagaguagcugggaacacaggugcaugccaccacaccaccacacugacuaauuuuuguauauuuuauagaaauaggguuucaccaugcuacccagguuggucucaaacuccuggacucaagccauccacccaccucagccacccaaagugcuggaauuacaguugugagccaccacacccagccuuuaucuagccucuuaacgcagguauagcaguagcuuccuaauuagagccuuugcuuccacuuuguuccaacuuuauucuauaccauaccuaaauccuuaacauagaauauacuuuuaucagcugggugcaguggcucacaccuguaaucccagcacuuugggaggucgaggcgggcagaucaugaggucaggagauugagaccauccugccugacacggugaaaccccgucucuacuaaaaauacaaaaaauuagcugggcauggugguacaugccuguagucccagcuacucgggaggcugaggcaggagaauugcuugaacccgggaggcguaaguugcaaugagccgagaucucgccauugcacuccagccugggugacagagcgagacucugucucaaaaaaaaaaaaagaguaguauccuggugugauuauuaauaguuuuucuuucacuuucagaaaguuucagacuggacaugauaaaauuauauggucacucuaauuauaaugcccuacguaaucuggaaccugccuuccuccccagcuucaccuugaacuauauacgcuuacuuugcucucugcauuugaggcacagugacugucucuuaguaccuggaaugcuccagaaguucugccuuagggucuuuguacuugcgguuugcuuuaccuaggacccuagaaugccacguucccuucccuucguuccuuccuuugugaauuuuucuuccauugucaguucuuagcuuaguugucugugcagggaagccuccucugaccuuccuaaggcagauccacuaauuagggggggucaguaguaucuuuuaccugucuuuuauagcaucugucgcaguuauaguuuuacagguauuuaagugauuucuggauaauaccuauccuccgccagaccguccgcuucagaaagggagggauugucuguguuugcuuacugcaauaucccuagcauuuugcguaauaccuggcacauaguugacacuuaauaacuauuuguugaaugaauaaaggaaugcaugccagcugucacaguuucuuaaaaauucugaccuauucuguauaccucaguugaacaaaguagugcucaaaauaaacauuuuuauauuucacuuuuaaaaguagaguagccaaguaccccaacuuucuuuacaauucuacuguuuacaauugaguagagcaguggucuccaaccuuuuuggcaccagggaccaguuucacggaugacaauuuuuucauggaccuguggugggggaggggugauuucgggaugauucaagcgcauuacauuuauuguacauuuauuacguuguauuauuucauguaaugaaauaauuauacaacucaccauaguguagaaucagcuuguuuucccgcagcuuguuuccccucagcuagacggucccauaugggggugaugggagacagugacagaucaucaggcuuuagauccucaaggagugcucaaccuagaucccucgcaugcggcguucccaggaggguucacgcuccugugagaaucuaaugcugcgcugaucugacaggaggcggagcugaggcaguaaugugagcaauggaaaguggcuguaaauucagaugaagcuuugcuugccucucaccuccugcugugcggcacaaguccuaacaggccagggaccaauaucaguccauggcccagggguuggggacuccuguaauagagggugcggcccauuagccugugaauuguauaaggcuugcaguuauuauuuauugcccauauuaaucuuaagaaucagauccauuucauaugaaaacauggaucacugguuuuguuugaaaguauuagagagcuggcaaaaccgggcuggcaaauccacacaacauuaacuacuuagagugguggucaccaggcgcgguggcucacaccuguaaucccagcacuuugggaggccgaggcaggcaguaugccugaggucaggaguucaagaccagccuggccaacauggcgaaaccccgucucuacuaaaaauacaaaauuagccgggcauggugguacaugucuguaguccuaucuacucaggagguugaggcagaagagucgccugaagccgggagguggagguugcagugagcugauauugcgccauugaacuccaggcugggcgacaagaacgaaacuucgucucaaaaaaaaaaaaagaacagaguaguggucauaaccuuugaaauggucauuuguggcaucuggcauagugcuacuaaaagugguuauugaacuggcugcuuaaccacagacuauuuguuacuguccacagagauaaggaccuugugccguauguuuagguuaccucacauuucuuugguuuaauugacuuuuuaauguguuguuuacauucuggcacaagcucuuuaucuugucagggacuggcauuuugaguaguaccaauagcuauuccuuauaaauauuuugaaaccccugauuuucacaauuacuuugaaaugccagugcaaaauagcaauacuuuuguuacuauuuacugcccuuagauaauacucuuuaucaagcuuauuuuauaaguaaguuacuaaguuucuuuaauagagauuuuucugaaaacuuuuuucuccucaaauuccuuuuaccaugaaauuuuacguuugagauauuaagccuuugaacauagacaugggauauuuuuccuuuuguguguuuagcagugaaauuuaguuaauaggucaggcuaccauucucgaguuaaagacacgaauguguuugaaugccuuagcaugguacuuagaugugaacuucuucgucauauguaaaacuugacuuucauuccuaugucauugaaggaaauggaauuggcccauuuuucucacacacuugacugauuucacaggaauaaaauauucucguuagaaguaaaacugaagugcuuauagauuuuauaccuuuuuauugcucaucauuuaucuuguugauccugaguuuauacugcuuuuagucgaguaagaaauacaaagauagugcaaaucuuuuuuuuaugugaaaauugauugaggccauugcgugcuauugaguaaagcagaaauguguucgugguuguugccccuggauuaacccucuuuuauuagcccccauaaaugacaaaauuaauacauauccaauucugaugucuaagaauaaacuuaauaccccuuuaaauagacuuaauguauuuuaaugagacuuuuaauugcuagcauauauuuaugcaauaaacuucugcuuccacuguccuauagaagcuguucuuuaaaaccaacacccacagaaauggagucagucacuuuuuaaaguuauuauucucuugaccuccaucagcauuuuauauuuuuaacccauucuacauaguugcucauuuaauccuuuugauccaaaaauuaagguugucuguugugaaauaacuccuauuuucauuuuuauuuguaguugucugggauacuuuugguuaagcuuuuauuuucaaccuuuggaucauuuuguuuuagccguaguuuuuguuuaaaacaguuuauuguaauuaguugguuuugucuuuuguaaucuaaucugagaguauuaugaguuuacuauuuacauucauuucacauucauuuuauaucaugcuuuguucuugcugcuuuuuuuuuuuaacacuauaugaucugauuuucaccuaccuuuccuuuacugccccugauuuuauuugauuauauuauuuaucuucauucuucuaguguuaauauuauuauuauuauuauuuuugagacagggucccacucugucacccaggcuggagugcagugaugggaucuuggcucacugcagccuugaucuccugggcucaagugauccuccugccuccugcguagcggggaccgcaggcucacacaaccaccauacuccacauccagcuaauuuuuguacuauuuguagagacgggcuuucgccauguugcccaggcuggucucaagcuccugagcucaagcaguccgcccaccucggccucccaaagugcugagauuacaggugugagccauugggcccagccaguuuaucuuccuaaaugugugcuucuaucucugcuacuuaguuuaucagccuuaaaugaagucuuuugacccuguguauaaaagcugaggcacucccucuccauuuccuguuuccugucccgaauuuugauuauguguauguugucgugguuuguaaacacuuacauuuuauuauguagccacgguucacagguguuuucaucuuagcucucugguuaaaauggcuuaacugcucagugccaguuguuuugcuauacaguaaguccucaguuaguguugccaguagauucuuggaaacugcgacaugaaugaaaugauguauagcagguccucuaauaacgucauuuccuuauaagugaugagaaaaaaauugauuuuguuacguaugguuucgcuuaaagucaaagaaccuauugucaauguuaagugaagacuuacuguaguuccuuaauuuaucucaauugauuaacuuuuuccauuaggaauuucuucacaaagagcucgugaaaacucuacuccuugaguuccuguauacucaaaauguuuaucuguugucauuauaaucaaaguaaguuuggcugagcauaaaauugugucacacuuuuuuuccucuaagggcuuuguagucacuguucuuuugucuuuuacuauugaauggugcuguguggacaucuaaaagcagccucauguacccuacugcgucccuaaccccaaaaucaauuguuuagcuuacuugccuagauaucuaaaggauuuuuuuuucuuguaagccuuaaagucugguaauuuuuuuagguguugguauuucuaauucuguaucuuuuccugggaacauagugagccuucuauuucuggaaaguuaccuugaaucaugucuuugaauauuucuuuauucuaauccuuugguucucuuauucagaauccccaguuaucugcaagggggucuucauuauuaaccucucuuauguuuacuacuuuuucuuuacuuuuuaaaacuucuugcuccuuuccauuucauuuguuuauugagauauaguucauauacuauaaaauucacucucauaacuuggugguuuuuaguauauugacacguguacaaccauggccacucucuccuuccugaauuuuguuuaauugugccugcuuuuuugggucuugcuugcuguaucccuuucucuucuucucuguaucguugaagcauauaauaccaguuuguuucauaauuagggguauuaacuuuggucacuucguuaaggggguaucugucagauuucuucauuuuacuguuauuuuauccuuucauaaucugauaauugauaucauuaucaagguaguugauaauuuguggggaaguacguugugacuguguaaauauccuggguuuuuuuuuuuuuugucauuguuucuuuuuuuucugaaacauggucucacucugucauccguacgggagugcgguggcuucaucuaggcucacugcaaccucugccccuuccagguccaagcaauucugcaagcucagccuccugaguagcugggacuaaaggugcaugugccacuaugcuuggcuaauuuuuguaauuuuugauagagauggaguugcaccauguuggccaagcuggucuugaacuccugaccucaagugauccaucugccuuggccucccaaaguguugggauuacaggugugagcugccgugcccagcccaauauccuguuuuucaacaaacuuuuacucauuauuuuuagcauccauugauaauucuuaauugaaacaauuauuagcauggcgauugccaaauguaauuaucuaacucuuucauuacuucuacauuuaaggauggacucauguauuuuauucuauggucuauaauccuuuguuagccuucuucauucacauugacacagauuuggccaaagggagccccaucaagcagggucuaguguacuucugauuuguuucuaucuuccuuucagcauguccuguuuucuaauacaauaaaaugcuucggguuuaucuuguacuucccuuuccaauucuggaauaaccauuuauccaaggaacuccgauuccuuuggggagugcuauuuggaaaccaaggucuggcacucuagguaugcucguagcgaugggagcgucauugcuuccaggcucuggcugugucucuucaggguccacuauagucauccuguuucugucugcuguagauuauauuaaagcuucauucuucaucccuuccauuuuccucccuauaaguuagugucuggaagcauucuuagaggucagacgaaaucauuauauucagguauggaaugcaauuuuuguauagauaacaaaucuauauucaugaaaucugaugcugcccaucauccaucuuuuugcaaggucuuuuccugugaaagguauguuuuuucuuuucuuuucuuuuuuuuuuuuuuuuugagacagagucucucucugucaccuaggcugaagugcaguggcacagucucggcucacugcaaccucugccuuccggguucaagcgauucuccugccucagccuccugaguagcugggauuacaggcaugcgccaccaugccuggcugauuuuguauuuuuaguagaguugggguuucuccauguuggucaggcuggucucgaacucccaaccucaggugauccacccaccucagccucccaaagugguaggauuacaggugugagccaccgugcccggccaguccuuuacuuuuauagguggagaaacugagaccuaagaacugaagugacuuacguccauggcaaauugauugcagagccaaaaguggaguccagaucuccuaacuuccauacuagaacauuuuugcuguggggaguggagagagauuggguugaugguaccugccugaaguuuccaugguugcuggguggaaacagcacucuuccuucugucuuggcacucaagcaucccgauggacauugaauuuuuccaaugauuggucauuugaugaccaggcaggggagcagaaaaggagauaguacagaccagaagcuguuugaggauguguuguugccugaccagacaccuugaggccagaauucuaaguaguuucaaaacuccucccuuucauaccccaucuacugacuuucugcuuucuucaaaaugcucuguuggccaggugcagugguucacgccugcaaucccaacacuuaggcugaggcgggaggauuacaugggcccaggaguucaagaccaguugaggcaacauaaggggcugggcccuuuucucuacgaaaaaaaaaaaaaaaaaaagcuuaguguggugguaugcaccuguagucccagcuacuuguggggccgaggcaggagggucacuugagccugggagggugaggcugcagugagccaugaucacaccgugcauuccagucugggagacagugaggaccuggcucaaaaacaaaacaaaacaaaacaaaacccacaaaaaccaaaaaagacccugcucuguuuauaaauaaggucuguugauauucuuuuuuaauauuuucaguuuagcaguauuuugacaucaacauaguuauauugguacaaguuucuuaaaagguuaaauacaaauauaucuuaugauccauuccugacugucuacccaagagcagcgaaaacguauguccacacaaagacuuguauguaaauguucauagcagcauuguucgugauggucaacaauccaucaugaccgugauggaaacaacccagauguucaggaacuggugaauggauaaacaaaauguagucauucuuacuauggaacauuauucgcccauaaaaagaagugaaacacugacaaguuacaaaauggaugaaccucacaaacuuguguuaagugaccagaagaccucauuaugauuucaguuacuugaaguguccagaaaaggcaaaucuaugaagacagaaaguacaucaaugguugccucaggcuaacguuggaaaugaggaaagacaugcaaauggucaugaguucugcuuuuuggggugauaggaguguucuaaaaguggguuuuggugaugguugcacgacucuguuaauauacuagaaacuauucaauuguacacuuacaggugaauuuuauaguaugugaauuauacuucauaaagcuuuaaaaaguuacauuuaaaauuugaugucuguaauauuugucauauuuaaguaucuuauccuguguucauauuaaacauuuuuauacugacuucuuuccacuuuuaaguaggauuuucaaggaaugcuaaugucagaugauguuaaugguaagaguaaaaacagcuagcauuuguaaaauaguuauuaugcaccagacauuaugcuaaguacuucucaggucaucucacaguagcauugugauauugguauuacuguccucauuucacagcagaggaaacacuuucauagagguaaaugacuuguucaaagucacacagugaggagacgacgagacaggaauuugagccgagucauuuaaucucugugcuccauauacggauaugcaguguuuuugguggaggauuguacugauuuucauaagcugugacugugugaaacacucguguaugugccacugggaugagugcucuguguaacugugugugaucucccugggagguucggauggguauuugguucugccuguuugccguagagcuuguacaacauagugaaucuuacuaaucaguuuuacuuccuuuucuuuauuccucagccuuaauuuuaaagaccccgaagcagucagagcucugacguguacucuccuaagggaagauuuuggacuuucuauugauauuccauuggagagacuaauucccacaguucccuugagacucaacuauauucacuggguagaagaucugaucggucaccaggauucugacaaaaguacucuccgaagaggaauugacauagguauaucauuuuaaauucuuuuuuggcuaaacaguuuucauaaguuuugcgagaucaaauucuuuguaaacuuuucuacuggguauuuguuguuguacaaaagaagcuggcuacagauacagguugagcauccuuaauccgaaaauccgaaaugcuucaaaaucugcaaccuuugagcacugauguguugcucaaaggcaaugugcguuggagcguuccagauuuggggguuagggauguucagccuguaaauauagugcacauauuucaaaaucugaaaaaaaaauugaaauccaaaacacuucucaucccaagcauuuuggauuagggauccucagccugcauuaccguucuuuuuuacuacaccuggccuuuucucccacugauuucucuugagaagggauugucaguccaaacagggagcaagagguuaagggaaguacaaaaugaaaaugaggcucuuauuuauauagcuuuucauuuuauuuuuuuaauuuaaaaauuuuuuuauuuugagauggggucucguguugcccagguuggucuugacuccugggcucaagcaguccaccugccuuggcuucccaaagugcugggauuacaggcaugagccacuacgccuggcccuauuuagcuuuucagauuaccacuuugaugucugugucuguugggcuuuauuuuuacucuggauuauuugauguguucguauucugauuuuuuuuuuuuuuugaaacggaauuuugcucuugucgcccaggcuggagugcaauagcacggucucgacucguugcaaccuccgccucccggguucaagcaaugcuccugccucagccucccaaguagcugggauuacaggugccugccaccaccccuggcuaauuuuuguauuuuuaguagaggugggauuucaccauguugaucagguuguucucaaacuccugacgucaggugauccgccugccucguccucccaaagugcugggauuacaggcgugagccaccaugcccagccucuauuucuaacugaguagaacuaauagcaguccuaauuucuagauagcaguaaauguuuaacuuugauauuugcaugcauuuucagcccucauccuacaugaucuuuucagcggcauuuauugaucccuccuuucucuuuuguucacucuccuucauuggcuuccaugacaccagacugcugguuuccucuuucauuucuuugcacuguucuccacuuuucaggcauaccuuccuguagcugaccacuagauacugguauuccuugcauaaggcucagccuuuagcuccuuucucacucagcacccuacccugguaauugcauucacuucuaugacgauuucccaacuccaugcaaauaaaucacauauuuauauguuccuccaacucagauuacuuuccuugaccuccaaucucauauauaugagaaacuuggauuucugaaaaacaucucagacuugcuauguccaagaccaaacccacacucuguuucccuaauccugguucucuuuguuucuuguuucagugagucuaccauaguccacccugugguccuugauacuugcuucuccacaugcagugaaaaaauaucuaucacuguuuccuguugacuuugucucuuaaauacuucugaaaucaucuacuucucuccaucuccacugccauccuagccaagucaucgucucucaccuuucugcauuucucaccucuucugcuucucagcuaguuugcuuaaaaagcuugacagccuaguugguacuaauuugauuuuaauuaugccccaaacccucuaaaauagcacuuggggauagaggagguuaauggauuucaauucuucacaaggggcacuaccuaacugcaaucacauccauucuaauuaggguuuuauauaaauucuucccccagacuccaucaguuugcucuaauucuaccauuauguacuuuccauuuuuauuugucauuacaaagauuauuacccauuuaaaaaugucauuuggcuuucugaggggauuucauucuguccuguaaaggacuaguagagaaucuguugcguucuauuagagugcaagucuuugggucuuaagaauuaagaaacuuuuuuuggcgcugacaaaucuuuuauguguauuuauuacccuggagguaaguguacuuuuuuaucuuuuaaaugaaauugaaguuugaagagagaggcaguuguauaaaagucaaggaucuggucuggauuuuuuuccuacagagucgaaaguacaacugacauguucuuacuguguguguguuuggcuuacuagaacggcuagcagcagccaaagaacugugguuucugacaggaccucgaauacccuuuaccacgccuucccucacugccccgcagguauccaaggacgugcuuguccaguagcacuggggccaggauacccucgggcaaaaaugguaggcaaugcagcguucaccgugaccgucggagagcuuaaauguugcggccaucaucuuuuacuagccuguucaggaugcguaaugaggaagcaguaugacgagucuggauuuccucuggguuaagaguaucuagccucugcuucuuccuggcaaauccuuacaaggcuagaccagaauugggauauggucagaugagagcaggccuagaguggcugguagaggcugacugcuuuaggcuuuugggagaaacacucuucucuugauaauacucuuuaggaucuaauuggccaagauagucaauauuguaagagagagagagagagagagagacuugaugucaccuaggcuggagugcaauggcacgaucucggcucacugcaaccuccgccucccagguucgagcgauucuccugccucagccuccugaguagcuggagguacccaccaucaugcccagcuaauuuuuguacuuuuaguagagaugggguuucaccauguuggccaggcaggccucgaacuccugaccucaggugguccgccugccucggccucccaaagugcugggacuacaggugugagccaccacgcccggccuguaaaaacaauauucuugguuaguauauaguccaguccagggcuagcgguucuacauaauuuaguaccaaacccuaguggucaaagaguguuuuuuuuugcauggagcguuugccucuugagugcuucccuugaaacugugguggggcuagccagugacucugaugucguggcuccaaaccaaauauuuucgcaugucuucucaucugagagaugaguuaucucuuuaguuuagcuuuuuuuuuuuuuuuuuuuuucuuuuuguuucuuucagcugacaacuuacagacauuuggguaauucagcaguuuaauauaauaaacauuuuauacccuacauauuuuuuccugcuuuuggagaauggaauguacauugauccauuuuaagauauuacaaaggcauuuuaauaaauagcauuguuuucuuuuaagaaaauugaguuuuguaugagauuuaaaaugaagacucuuuacaaaguaaaucagcugaguuuugagcauuuuaggugaauuagucauguauuccucgaccucugcuuguguguucuucauuuuuuauacaacacacgaaagaggaggccagcaagguuucgauccuuuaggaaguuggaucuaauuaggagguaggacuaacauacacgaaugacuagggaacccaguagccauaacauguaugacaucagguaccagcuugugauuucucugccaaaaaauacaaaaauuacagaaaauacaaaaaauagccaggcaugguggcaugcaccuguagucccagguacucaggaggcugagcagggagaaucgccugagcccagaaaguugaggcugcagugaaccgugaucacaccacugcacuguagccugggcgacagagugagacccugucugcaaacagaauucugagaagaaugguguuuucaugauuauuguaaccuuucccucugguguguagaauguguuuuguauuuuuauuuuauuaggcacgggggcaucuugcaucuaccccuuacuuggagcaaccuugaauggcugguauuuccucgcaacagaaguggaugauauguguuucaacuaugcaaagaaaaauguggaacagaauaacuuaucugaucucauaaaagguuagcgccacagaaugaaugccuccaaacuuugugucuucaccugccuuuuuaguuuaacgcauuucauuaccuuuuucuuuaauacacagacuucgguaauuuaaaaaaaucuggcacuuuguaauuggguuugcugucuugauaccagaauuaacucagaaaauaguaacuacaguugauccuuaugauuuguggauucuuuuuuugugaauuugccuauuugccuaaauuuauuuauuuauccauucauuuauuuuaguagauuuucuugaauaaauguuucuuuauucgcuauaaccccuuagaaacauuuccagagacuuuaaguggggguuuuuuguuuguuuguugaguuuauuuuuuagggcauuuuuagguucauagcaaaaugaagugaaagguucagagauucccuguauaucccugcccccacacacgcauagccuucuccauuaucagcaucccccaacagagugggauauuuguuacaggugaugaaccuaugcuggcacaucauuaucacccacaguucauucuuuacauuacgguuuccucuuggugguguacauucuguaguuuuggaauaaugaagcugacauguaucucccaguacgguauacacagaaucguuucacugcccugccgucuucugugccucaacuguccaucucucacugcccccaaccccaggaaacuacugaccuuuuuacugucuccacaguuuuacauuuuccagaaugucauauaauuggaaucauacaguauauagacuuuucagauuggcuucuuccacuuagugacauuuauuuaaauuuccuaaugucuuuuuauaguuugauagcuuuuuuuuauucuuuuaauuuuuuuuuuccugcugccucucuaauugcagaaagcucauuuauuuuuagcacauuucauuuugauauuccauuaucuggguguaccagaguuucuccauucaccuauugaaggacaucuugauugcuuucgaauuuugacaauuacaaauaaaguugugagaaacaucugugcgcagcuuuuucugugcauguaaguuuuugacuccuuuagguaaauaccaagcagugugcuugcuggaugguaugguaauaguauguuuaauuuuguaagaaaccacuaaacugucuuccagaguacuguuuugcacucccagcagcaauggaugaaaguuccuguugcucacauccuugccagcacugggugcugggugcugucgguguucuggauuuuggccguucuaauaggcguguagugguauuucauuauuuuaauuugcauuuugcugauauucauguggagcaucuuuucaugugcuuauuuaccaucuguauaucuuuuuuggugagaugucuguucaggccuuuugcccuuuuuuuuuuuuugagacuuaguuuugcucuuguuccccaggcuggaaugcaaugguaugaucuuggcucacugcaaccucugccuccuggguucaagcaauucuccugcuucagccuccuaaguagcugagaugacaggcgccugccaccacgcccagcuaauuuuuguauuuuuaguagagaugggguuucaccauguugcccaggcuggucucaaacuccuguccucaagugauucucuugucuggaccuccuagaacguuggaaugauagacaugagcuacugcccccagccaagcccagcuuauugaucccuucuuauuuuuauuuuuuauuuuuugagauggagucucgcucugucgccaggcuggagugcaguggcgcaaucucggcucauugcaagcuccgccugcuggguucacaccauucuccugccucaccucccgaguagcugggacuacaggcgcccgccaccgugccuggccaauuuuuuguauuuucaguagagacgggguuucacuauguuagccaggauggucucgaucuccugaccucgugaucugcccgccucggccucccaaaguacugggauuacaggcgugagccacugcaccuggccauugaucccuucuuuuaaggaaugguauacaguacuguugguauuauauccaaaaagugcuguaaucucagcaugcugggaggcugagguggguagauccuuccggucaggaguucgagaccagccuggccuauaugaugaaacccccaucucuacuaaaaauacaaaaauuagccagcgugguggcgcaugcauguaaucccagugacucagguggcugaggaacaagaaucacuugaaccugggaggcggagguugcagugagcugagauugcgacgcugcaccccagccugggaaacagagcaggacucuguuacuuucuaggaguuuuauagucuugcauuuuacauuuaggucugugaucuguuuugaguuaaauuuugugagggauauaaggucuuugucuagauucauuuuaugcauguggauguccaagugaugugccaguaucaguucuugaaaagacuauaucuauucucuucuguugaucuauucauucacuaaaaacauacuguuuugauuacaguagcuuuguaguaagucuuagaauuggguagugucaguuuuuuaacuugccucuucucuuucaguauuguguuggcuauccugagucuuuugccucuccaaauaaacuuuacaauuaguuuaucaauagcuaaaguguauguauauguuuguaugcaugaagguauuuacuuauuuaauuuuagagacagggucucacugucacccaggcuggaguguagugguucacuguagccucaaccuccuauguucagguaaucauccagccucagccuugugaguagcugagacugccagugcgugccaccacgccuggcuaauuuuuguguuuuuuuuguagagauggggucuuaccguguugcccaggcuggucuugaacuccugggcuugagugauuuucuggccucagccucccaaagugcuggaguuacaggcaugagccacugcccccaaccuaaaauuuauuuuuaacuuaaaauugacauucaugguacuuuuguggucauucacagacuugugcauaguggcaaauaauuggaguugccccagugugcauguucccagcugaggcucaacaaggcaaugcucugccuucuuacuccagcuuccggacugugaaccaagcguccuuuuauuggucuauuuaauaccacguuuugggguuuuuuuuuucuuuuucauuuuugugcuuucucuuggugauuuugcuguuuaaaauagucccuaaacauagugcugaaaggcugucuuguguuccucagugcaaaaaggcugugaugugccuuacagagaaaacacguguguuagacaagcuuccuucagacgcgagcuguagugcuguuggccaugaguucaguguuagugaaucagcgacauauauucgauaaagugucuuugaacaggaacaccauaaaauaagguugugugucuaucaguugaugaaaauacgaagagagacuuguaggaaccuaacccuguauuuccccugggaaucagugguucaguauucacucauugacuauuuguggcuacuuuguagaauauaacuagcgcagauaaugagaauugacuauauaugaaguaacuuagucaccaagauuuuaaaaggaaggaaacccuacuguugauuaaacuauaccaucuuuuuaauuucaguacauaggccgggugcgguggcucacaccuguaaucccagcucuuugggaggccgaagcagauugucugaggugaggaguuugagaccagccugaccaacauggugcaacuccaucucuacuaaaaauacaaaaauuagccaggcguggugaugggcaucuguaaucccagcuacuugggaggcugaggcaggagaaucgcuugaacccaggaggcagagguugcaguugaguggagaucucgccgcugcacucuauccuguucuacagaaugagacugugucucaaaaacaaauaauaauuucaguacauagaacugugcuagaaauagucaaauccccuugugauuaguuacuuuuuauuuuugugaccauucuguguauaaagcaguguuaauuuuuuuuccguuaaagagauuuuaugucucuuuaugaaagaaauaagacuuuucuucauaguauugaacauaucuuuguaaggggagacauuaauauuauuagugcauuuguuuuauuucuccauuguuguguaacaaauuauuccaaaaucuaggagccuauuuauuuauuuauuuuuauuuuuuauuuuuugagacagagucuugcugugucgcccaggcuggagugcaauggcacaaucugcugcucacugcaaccucugucucccagguucaagugauucuccugccucagccuccugaguagcugggauuguaggugcccaccaccacacccgucuaaguuuuguaauuuuuuaguagggacaggguuucaccauguuggccaggcaggucucgaacuccugaccucaagugauccaccugccucggccucccgaaguguuggaauuauaggcaugagccaccaugccuggcgcuaggagccuuuuagaaaaaaaaaacacacacacacaacaacaaaaaaaaaacauuuuuuuauuagagacagggucucacucugucauccaugccggugugccguggcgugaucauggcucgcugcagccucagccuccugggcucaagcagucucucacuuuagccucccaaguagcuggaauuacaggcucguaccaccaugcucagauaauuuucuuauuuuuaaaauuuuuguagagauagguucuugcuguauugcccagguuaaucuggaacucuuggucucaagcaguucucccgucuuggccucccaaagcacugggauuacaggcaugaaccaucacacuuggcccuagcaacuuuaaacaauaaacauuuaucuccuaguuccuaugggucauaaauuuuggcauggcuuaguugagugguucuagcugagacccuuugaugcauuugcggucaaguuguuggcuagagcuacagucaucugaaggauguaugggugguagagauuugcuuccaagauggcuuacucauggcucacucacacgacucuuggaaggaaacccuaguucauagccauguggaucucuccaugaagcuauuugaguguccuuaaaaugcagccuauacuuaaggggagggaaauuaaacuccaucuccugaagggaguacugucgaagaguuugaggacauacagucacaccuuacuuaacagcagggauauauucugagaaaugcauuguuaggugauucaucguagugugugcucacacacaccugaaugguguagccuacuacacaccugggccuauguguaauagccuguggcuccuaggcuauaaccugaacaguaugucacuguauugaauacugaaggccauuuuagcacaaugguauuugucuaucuaagcauaucaaacauagaaaagguacaguaaaaaugugguguuauaaucuuacgggaccaccaucauauaugcaguugaccaaagaaucauuacgcagugcgcgguuauacuuuagaaccacugcaacauuaauauuaguucacaguccuguuuuuucuccuaguggugaaagugccacagaagacacuccugauggaugcucuuaaagaagaaucugagauaaucuaugacuuuugcaugugcaacccucccuuuuuugccaaucaauuggaagccaagguaaaaugucuucugcuuuaaaauaauugaauauaggcugggcgcgguggcucacgccuguaaucccugcacuuugggaggccaaggcgggugaaucaugaagucaggaguuugagaccagccuggccaacauggugaaacuccgucucuacuaaagauacaaaaaaauuagccaggcgucauggcccaugccuguaaucccagcuacuugggagguugaggcaggagaaucgcuagaacccgggaggcagagguugcagugggccaagauugcgccauugcacuccagccugggcuacagggcaagacucuaucucaaaaagaaaaaaaaaucuaaauuugccuuauuugcacagauaagagcaaagaaaacuuuaaaaaauuaacuuacuauuuuuuaaauuaauauauuugagaugaggucucgcuguguugcucaagcuggucuugaacauccggacucaagcagucccccgcccgucagcuccccuaguagcugaggccauaggcgugugcugcagugccucgcuuuugaaagcuguauaccaguuagggggcuuuugguuugaaguacuuucggcucucuguauccacagguccuacaccuguggguuccgcaucguggauucagccagccaugcauugaaagcauugggaagcuugcacggugacucacacuuguaaucccaguacuuugggaggcugagguggguggauagcuugagcucggaguucaaaaccagccugggcaacguggugaagcccugucucuacaaaaacuacaaaaacaauuaaccaggcacuauggcgugugccuguagacccagcuacuugggaggcugaggugggaggaaggcuugagcccaggaggugcagguugcauugagccaggaucguguuacugcacuccagccucgguaacccugucucaaaaaaaaaauauuuugggaaaaaaagaaaacaaaaaaaaauaacaauguaacaaugaaaaauaauacaaaaauacaguaucacuauuuuuacauagcauucacauuguauaagguauuauaacuaaucuaggaauuauugaaaguauaccagaugaugugggcaggugaaauucaaauccuaccccaugugauaaaagggacuugagcuuccuuggauuuugguaucuaaggcagaucuuccucagauaccgaggaguccuguaccuaaaaacccaauuuagauugacuuaacgacaaagaaaguucauuggcugacauauuugagaaacccagcaguaguugggauuucauaaugacuugauuaagguguuggcaguauuaagagcucuguuuuucucuuggcugugacuuguucuaugguuguuuuuguucuuaagcugguuuacuugugguacagcaauauuuagagggugggagggugaggagagagcuuuuuucuucccuaaaccauugaacauuugauuuucuucucauuggaccaacucaggucauaguccacuccuggacugagcuucuuggcuuaggaaggaaaucaauguuuuuacuguuaaguggcuuuuuuuuuuuuuuuuuuugugacagagucuuacucuugucacccaggcuggaguguaguggcgugaucucagcucacugcaaccuccaccucccagguucaagcaauucuccugccucagccuucugaguagcugggaucauaagcgugcaccuccacgcccggcuaauuuuuguauuuuuaguagagacgggguuucgccauguuggccaggcuggucucaaacuccugaccucaagugaucuaccugccuuggccucccaaagugcugggauuacagguguaagccaucacacccggucaacacuucuuauuuguccuuuuuuuuuugaggucgggggguguggggaauggagucuuguucuguugccaaggcuggagugcaguggugagaucucugcucaccgcaaccuccaccuccuagguucaagugauucucaugccucagccuccugaguugcugggacuccugguggacaccaccgcguguggcuaauuuuuuuugcauuuuuauuagagacaggguuuuaccauguuggccaggcuggucucgaaauccugaccucaagugaucugcccaccuuggccuccccagaugcuaggauuacaggcaugagccaccaugcccagccugaucugucuuuuuuuuuuuuuuuuuuuuuuuuugagauggagucuugcucugucgcccaggcuggagugcaguggcgugaucucguuucacugcaaccucugccuccuggauucaagcgauucuccugccucagccccccgaguagcugggacuacaggcgugagccaccacgcccagcuaauuuuuuguauuuuuuuuuaguagagaugggguuucacuuuguuagccaggauggucucaaucuccugaccucgugauccucccgccucggccuccuaaagugcugggaugacagacaugagccaccgcgcccggccugaucugucuuuuugauuauagccauccuaguggguaaaaagugguaucucacugugguuuugauuaggauuucccugaugacugaugaugcugagcaucuuuucacgugcuuauuggccauuuacauaucuucuuuggagaaaugcuuauucauaucuuuugcucacguuuaaguugguuuguuuuuguuuuuauuauuaaguuguaagcauucuuuauaagcaaguuccuuauuagauagugauuugcaaacauucccuuccuguggguugucuucucacuuucuugacggugcccuuugcagcucagaaguuuuuaauucggaugaaguccaauuuaucuguuuucuuuuguugcuuaugcuuuuguuaucaugucucagaaaccguugccuaauccaagcucaugaaaauuaauuuucuuaaugaaaauuaauccaagcucaugaaaauuuauaguuuuagcuuuuccuuuuaguucuuugaugaauuuugaguuaacuuuucauaugguaugagguaaggguggauuaaauauuuaaaugugaaaagcaaaaccgugaaaaugcuaggaaaaaacaaguaaauauuuguuuaaucuuuggguggaucuucuguacaggagaaagaaagcauaaagaaaaagugacagauugggcuuuauaaaaagguaaacaauuuucauguuuaaccacaaaaauggaaaguaaaagaccugggaagaaauaguugcaugaaguagcuguuugaaauaaaauauuuuaguggcuaugauuuuaaaauccuaaaucuagcauacuauuuggaaaguaaaaauugcaacuaaacauucuaacuuagagauagauuacauucaaacuugguucuugggguguacacauuuuucaccaggguuuuuuguuguuuuucagggaguaaacucacgaaauccucgaagaccuccgccuaguucuguuaauacaggaggcaucacagagaucauggcagaaggaggugaauuagaguuuguuaaaaggaucauccaugacagucuacaacuuaaaaaaagauuaagguaagucuguuuuuacaacauagaguccaucuuuacaacacaggaauauuuacccgcuauguaguucucuuuuuuuugguggcgggggacagagucuugcucuuguugccaggcuggagugcaguggcgugaucucagcucacugcaaccucugccuccuggguucaagcuuuucuugugccucagccucccaaguagcugggauuacaggcaccugccaccuguaauuuuuguauuucuaguagagacaaggggguuucaccauuuuggccaggcuggucuggaacuccuagccucaggugaucugccugccucgaccucccaaagugcuggaauuauaggcaugaggcucugugcccggccuccccuguguaguucuaaaacaaacuaugucacucagagcaaaaguaauccuagugcucagaagaacaagcagauaaagauugcaggcugggcgugguggcucacaccuguaaucccagcacuuugggaggccgaggugggcagaucagaagguuaggaguucaagaccagccuggccaauauagugaaacccugucucuacuaaaaauauaaaaaugagcugggugugguggugggugccuguagucccagcuacuagggaggcugacgcaggagaaucgcuugaacccaggaggcagagguugcagugagccgagaucaugccacugcgcuccagccugggugagagaguaagauuccuucuccaaaaauaaaaaugaaaauaaaaauaaagauugcaaagguaguggcuccuacaaucugcgaagacuguguuucugaggauguuccaugccuuuaauugauuaguguuuacuguaaucauguauauuacauagacaggaaagaggaaaauaccgcaugauuguauugcucccauuaggaugguccugugauagaacaaaacggauucaaauauggcuuuugauuagaaaacagauggguucaguucugucccaugaaccagaauaaauuuguugccucguccuuucagcaguuuagguucuuggaaucagucucccagugacagaugugaggacauugagcugucaagaacuuaaugaagggaaacugagaucacuaaccaguugcagaggaggguuaaggccauuccuuuugaaagcuaauuauuuuggacaacacaccugucauuaagcaacauaagguacucaaaaagagcuauuugucucgcuugacuucucacccugccacauguuguugaaaugauggauaauaugguaguucaaaaacuaaaagagcuuucaauccaaggauuuagcuuugggacauagggaagguuuuauuuauuauuauuauugugguaaauacacguaacauaaaauuuaccaucuguauuaguccauucucacacugcuauaaagaaauaccugagacugaguaauuuguaaagaaaagaggcuuaauuaguucacaguuccacaggcuguaccggaagcacggcuggggaagucucaggaaacguacaaucauggcggaaggugaaggggaagcaggcacaucauuacguggccagaggaggaggaagagagggaaggaggaggugcuacacacuuaaacaaccagaucuagugagaucucacucacugucaccagaacagcaaggggaaaucugcccucaggauccagucaccucccagcaggccccgucgccaacacuagagauuacaguuugacaugagauuugggcggggacacaaauccaaaccguaucgccaucuaaaauuuuagaguauaguuuaguaaugugaaguacauucucacuguugcacaagcagucuccagaacucuucauguuuuguaacuguaacucuguacucguuaaaucccuccuauucucuccuuccugagccccuggcaaccaucauucugcugucugucucuaugaacuugacuacucuaggcacuucauacaaauggaaucauacaguauuuguccuuuuaugacuggcuuuuuucacuuuucgucauguuuucaagguucuuccaugaugcagcauauuucagaauuuucuuccuuuuuaaggcugauaugccacauuucguuuauccguucaucuauugauggaagauacuuagguugcuuguacccuuuggcuauugugaauaaugcugugugaauguggguauauaaauaucuccuggagacccugcuuucauuucuuuggauguagaccuagaaguggaauuccuggauagggaagauuuuuuuccuauacgguauuguccucuuuucugucuauguaguauagaugauuauaggaaacaaaaucacuuaaagacaugagaaggcugggcacgguggcucacaccuguaaucccagcacucugggagaccaaagcggguggaucaccugaggucaggaguuggagaccagccucaccaacauggugaaaccccgucucuaguaaaaaauacaaaaaauuagcugggugugguggcaggcgccuguaaucccagcuacucgggaggcugaggcaggagaacugcuugaaccugggaggcagagguugcagugaaccaagauugugccacugcacuccagccugggugacagagugagacuccaucugaaaaaaaaaaaaaaaaaagacaggagaacauccucagaaaugaaaacauccucagaaacagggucuuugcaggcuacaggagcuacuacuaccuuuucaaucuuuguauauucuuauucuauaaaucuuuccuaucucccaaagguggaaagcugcuuauuuuauuaaagaccaauuccaaaaucaucaaauauccuguuuuuguuuguuuguuuguuuuuuguuuuuuugagacagagucucacucugucacccaggcuggagugcaugcacuagggugauguuggcucacugcagccucugucugcuucccaguuucaaacaauucucaugccucaacuuccugaguaguugggacuacaggcacgcgccaccacgccuggcuaaguuuuuguauuuuuuuuaguaguguugggguuucaccauguuggccaggcuggucucgaagucuugaccucaggugauucuccugucucagccucccaacguguuaggauuacaggugcgagccaccgcacccagucuagauugacuuauuuagacacauuagacuaucuugaagaagaaauagacuaaaauuauacugagcauugagaaaagucugagaaaguaaaauaaacuuaaagaagguaacagcacugaaauucacagaaaagaguuaaccaagucaugugaccauuucaugaugacuuuuuuuuuuuuuuuuuuugagacugaguuucccucuuacugccuaggcuggagugcaauggcgugaucuuggcucacugcaaccucugccucccagguucaagugauucuccugccucagccucccgaguagcugggauuacaggcaugugccaccacaccaagcuaauuuuguauuuuuaguagagaugggguuucuccguguuggucaggcuggucuugaacucccgaccucaggugauccacccgccuuggccucccaaagugcugggauuacaggcgugagccaccgcgcccaacccucauuauggcuuuugagggaacuagagccagccaggaaaauggggaacuguagguggcucuacuaggcuacaauaauaaugggguuguuuuuaggaggcuuuuaaacaguaaauuucuguuauuuccaaaguaccauuugaacuacaaaaauauguuugaauagaacaccauucuaagggguagaaauggacucaguauguuccuagucugcuuauacuuggcucuguggcagccugcaaauugaaugaaggguguaaauuugcuaggaaggauaaaaugcaagagcccaucccagcucuggagagcuggccauuuugugcuuggucucauauaugggaaacacugcccuuuaggauuuauuuaaaacagggugcaacuuucuucucugugaggacucaagcaguuugagaguuuagaugaaagaaaggaagaaaugaagugauuuuuacugagaagaaacuagaacaguguuuugugaaaggguguugcuugcaaguauuguuuucacucacauccuaccaugaugacuuacauuuguacaacuaccaguucguguccccaugcauguauauauacacauauauacacauacguuuucugagauggaguuuuugcucuuguugcccaggcuggagugcaauggugugaucucagcucacugcaacccccgcuuccuggauucaagcgauuauccugccuccgccucgagaguagcugggauuacaggcaugugccaccaugccuggcuaauuuuguauuuuuaguagagacaggauuucuccauguuggucaggcuggucucgaacuccugaccucaggugauccgccugccucggccucccaaagugcugggaugaaaggcaugagccacugcgcccggcccccaugcauauuuuuauaguugacaucauaauguuuauacaaccgugugacucacauuucagaaugcucugaaaauuguguauuuugaagcucuaaaaaauaagagauuauaaacaagugccuuaacccuaccaucuguuucuuaucccuguagaauguuuuucuccuugucccugaagaaauacaggaacuaagcagaauuugcagcauuauggggugaaauaaguuaaauguguuggacugaccucaggauggcgcuugugaugccucgccuccccugggagguucaugucucaccucugucaugcucagcagcaguuaacaguuuuguuuuguaucuuaaggaauuuugcagcuggaaagaccuugagagguaaaguuauccaaccucuugguuuacagacuggaaauuagaacucagauauccucauucuaguccaguggucuuuccaccaccccuugcagccucugcagcucuaagcugcaguuggacucugugaagagccuuucugucguugaugaggauuuacaagugcuugucacccuuacuuuggcuuuuugugccuguggcuugagcuuacuuaauagcuuuuuuuucucaagugacucacccaguccgggcacaauggcucacaccuguaaucccaacacuuugggaggcugaguugguggaucacuugagcccaggaguucaagaccagccugggccacauggcgacaccccuucccuacaaauaauacaaaaauuagcuggaugugguggcacaugccuuuagucccagcuacucgggaggcugagguaggaggaucgcuugagcccaggaggucgaggcuacaguaagccgagauuguaccacugcacuccagcuugagugacagagugagacccuaucucaaaaaagaaaaaaaaaaaagggacucacccaucuaaccuucuagauaaauuaccagacuuuaucaaacuccucauggccugaauugugugugaguguguguguaugugugugugugucagagucuugcucugucacccaggcugcagugagguggagugaucuugucucacugcaaccucugccucccaaguucaagugauucucccacgucagccucccuaguugcugggauuucaaauguguacccccacacucagcugauuuuuguauuuuuauuagagucaggguuucaccauguugcccaggcuggucuggaacucuugagcucaaaugaucugccccccuuggccucacaaagugcugggauuacaggugugagucaccacacccuggcccugaauuuuuuuuuuuuuuaauuuauucuccacaccauaauuuuguauguuuuggauucucucuugucauugguuaccaguucuauaacugaugcccuuuauggcaaugauuuuaggcuuuucuuaggaaccagagaucuguauucuacaaagcaccagcguguccccugccagaugauggauacugcuuggauuuggauauaauccaccuauuuugggauggguaauaaauuuaauaaucugggccuaggccaggcacaguggcccauaccuauaauccuagcacuuugggaggcugagguaggacgaucaguugagcucaggagauugagaccagccugggcaacauagcaagaccccaucucuacaaaaaauuuaaaaauuagcuggguaugguugcacgugccuguggucccagcuacccaguaggccaagguggaagaauugcuugagccugggagguugaggcugccaugagcuguguuuaugccgcugcacuccagccugggugacagagcaagagcccgucucaaaaauugguaauaaucugggccuuuugaaugugauucuuugguuugaaauuuugauuuaucauugguaaaauggaaugauaguagcuaucucauaaagugguuauagaauuaaaugaauacauauuugacauaauaauaauaguggauauuaaauagggugauuuuuaacucuuuuuuuuuuuuuugagacagagucucgcucugucauccaggcuggagugcaguggcgugauuuuagcucaccgcaaccuccgccgucuccuagguuuaagcaauucuccugccucagucucccaaguagcugggauuaaaggcacgcgccaccaugccuggcuaauuuuuguauuuuuaguagaaaugggguuucagcguguuggccaggcuggucucaaaacuccugaccucagguuauccgccugccucggccuccuaaagugcugggauuacaggcgugagccacugugcccggccgauuuuuaacucuugacuauucuaggagguugcagcauguaguauaaauguuagauaaugacuuuuuuuuuuuuuuuuuuuuuuuuugagacggagucucgcucugucguccauguuggagugcaguggcgcgaucucggcucacugcaaccuccgccucccagguucacgccauucuccugccucagccucccuaguagcuuggacuacaggcgcccgucaccacgcccagcuaauuuuuuuuuuuguauuuuuaguagagacgggguuucacuguguuagccgggaugaucucgaucucaugaccucgugauccacccgccuuggccucccaaagugcugggauuacaggcgugagccaccacgcccagcugacauuauuauuuuuauaauuuuguuaucucuuaaacaauauaaccacacuuacaggaaauuagaaaauggagaaagcugcuuuggcauuuaaaaaaaaaaaaaaggccgggugcaugcgccuguaaucccagcuacauggcaggcugaggcaggagaaucacuuaccugggagacagaagguugcagugagcugagauugagacaguguacuccagccugggcaacagagugaaacuaugucuuaaaaauaaauaaauaaauacaaaauaaguagcuugacaguccgggugugguaacucaugccuguaaucucagcacuuugcaaaccugaggcuggaggauggcuucaggccaggaguucaagaccagccugggcaacauagcaagacucugugucuacaaaaaaucagccuggugugugguggcauguuccuauagucccagcuacuugugaggcugaggccugaggaucacuuaaguccaggaggucaaggcugcagugagccaugaucacaccauugcacuccaaccggggcaacagaacgagacccugucucagucaaucagucaguagcuagugagcuuaacaacaguccauaauuaacuaauucuuuguuauugggcauucagagguuuucuuguuuucacuguuaaaaagaacauaccacuucuuguuucuuacugaacugccaucuguugaggcuguuaugaauggcuacguuugaccccugcuuucaucuuugacugggacccaaaguaggguugucagucaguaaagguguuuuaggguaucauuacaaagaauugugccccucagcuuccuacacagauaccagagauagagaaguacuggggacagaugguguaccagcuuguucuccagguagugcagcguuuuugcaauuaaaacaugaaggaacauuucccaguugugagcuccacaggggguagaugcugcuauuuugauuuuuccuucauacuaagguaggaaaaagaaggauaagcagccugaaagauaagggacuaccuuauuuuauuuuaauuaauuaauuaauuaauuaauuuucgagacagggucuugcucugucacccagacuagagugcaguggcaugaucacggcucacugcagccuucaccuucugagcucaagcaauccuccugccucagccuccugaguagcuaggacuauacgugcacaacaccaugccuggccaauuuuugcauuuuuuuguagagaugggguuuugccauguugcccaggguggccucaaaguccugggcucaagucauuccaccccaccuuggcuuccuagaguucugggguuacaggcgugaaccauugcaccuggccuuaccuuauuuucuuugaugaauuagguuauaugcauuucaucauuuuaacucagguaugaugcuuaguuuaaucccuuucaggauugauauggcagccuuguugauuggugucugcucugaggucucagggagaaaagauuggauccagcagcuugcgccacggugagcuagcugugucagcuuacauggcauuuccgacuacgugacauagucacugcuugguucugcguuagcuggugaaagaagagaauucuuaaaaucaacaagcauguauuuugaguucaucuaacagucuacaaaggaauaacaggcugggcacgguggcucacgccuguaauccuggcacuuugggaggcugaggugggcggaucaccugaggucaggaguugagaccagucuggccaacauguugaaaccucgucuuuauaaaaauacaaaaaguagccagacgugguggugcaugccuauagucccagcuauuugggaggcugaggcaggagaaucgcuugaaccugggaggcggagguugcagugagccaagauaacgccauugcacuccagccugggcaacagagugagacuccgucucaaaaaaaaaaaaaaaaaaaguaccugggcauaguggcacgugccuguaaucccagcugcuugggaggcugaggcaggagaaucgcuugaaacugggaggcagagguugcagugaaccaagauugcgccacugcacuccagccugagcaacagagcgagacuccaucucaaaaauaauaaauaaauaaauaggauaacaaauuaaaagccuugguuccacuugcuuguuauaauguagucuuuuggcugggcgugggggcucacuccuguaauccuagcacuuugggaggccaaggugggcagaucaccagaggucgggaguucaagaucagccuggccaacaugaugaaacccugucucuacuaaaauacaaaaauuagcugggcaugauggcgggugccuguaaucccagcuacuugggaggcugagaugggaaaauugcuugaacccaggagacagugguugcagugagcugagaucaugccacugcacuccacccugggcggcugagcaagacuccgucucaaaaaaaaaaaaaaaaaaauaauaauaauaauauagucuuauccaugucaaaaagugaauaauuaaaaucacuuauaagagcauaggauaaaaguuuauuuuuaguuauauagauucgaaauuuaugauaguuuaaauaguaaauuuugagaucagguggacauuggggcugcuccguugaauaucuaggggcauuuguucugguaauuuauuauaggcagcaagguguuggauuuuacuacuuagagaacuuuuuagguaagguucauaauugcuuauaccccaaaccucugcuuuccuguuuuucuauauuauacuucacuugaguuuuuaauaaguuucuaaauaaccguuccccagugaggggaaaaaaaguuuuuuggagaaacgguaaauuccacuucugaguuggggugaauacacaaugagccuggaauaucuucuaguaccagaaaguaaugacauacucaaaaaaugacaugucagaagaaccuagagugagcucagggcaaagcugggacaacaugaguuucaagaugaauaaugacaauaaugacuuauaacccauugaauaagauacaguacauacaggggauagaguggaugccgaugaauaaauauagaaagaauaauaaacuauuauauuacuuauuucuaaaauaauguaauagcauuuuucauacuuuuaaaguuagauuuuucauguauguuauuuaguguaugagguugaaauaccagauugccagucuucaauaguuucugaccuaucaaauaguuuuugauguauaaaaaugucaguuucauacaguuuuaaccuaauuggugauuuuagaggcucuuaaauuuugcaacaaucauaguaauaauugauucguggaacaauuggcaaagggaaauuugaaaaggaacaggauaacuaccuaguuucaaagaaccaccccuucccccuuuagguuacuuacaguuacagagagaagugugggaguuuacaaaguaaagaguuugcuuuggagaaagcacaggccaccucccugaccaggugcucaucuccugaugugacgcaccuggaaggacaagcagcgccuccgugcucuucacgccagaaaugugucaucugaauccaaugacguggaaacuucagacacacccaguugagggacuguguaaaaucagcuccucaaaaacauuaaggucaugagaguaaaagaagacugaggaacuauuccagauugaaggaggcuaaagagacaugacaaguacaugaaauucgcaauccuaaggggccuuguaucggggagaauauugggauaaacaggugaaauuuaaguguggacuguauuccagauaauaguauugaaugaguguuaaguuuuagcaauuugauaauuccucugugguuacaaaaaugaauacacuuguuuccgugggggcgcagcggcucacaccuguaaucccagcacuuugggaggccaaggcagguggaucaccugaggucaggaguucaagaccagccugaccaacacagugaaacccugucucuagggaaaauacaaaaauuagccuguugugguggcacaugccuguaaucccagcuacucuggaggcugagucaggagaaucgccugagccugggagguggaggugcagugagcugagauugcaccacugcacuccagccugggagacagagugagccucugucugaaaaaaagucuaaaaaaaacaaaaacaaaaacaaaaaacaauacacgcuuuuaaaauggacaugccaaaauauuacaguuaaugagacauguugaugucuguaacugauucucaaacagcuuaggaaaaaacacauacacacagaaugaaggaagauguaauuggugaaucugggugaaggguauacuggagucauuugcgcgaauccugcaacucuucugaaaguuugaaauuauuucaaaauaauuuuucuugaaaccuaccaucucagaggaauuccuaaauguuguaauaaguagagugcuacuuucaucauuaaaauaguuuaauggauucaaagucucuugggugacuagaucuuccuuuucuucauuuuuuuuuccacuugcauuuugauuaguugucacaagaugcccguugagaguagcuaggaucuaguggguaggcauauuuaaaaugugcagcuaaaauaggauuuuuaacacauccaaugacuucugcuuuuuccauaacaaauacaacuguugcugaaaacagcguauauaugacauucaaucugaaaugauucgcagugugguauucaguuuagugcaaagguuaaaagaaauaugaacucccucccgagugucuauuaaguaucaauggcauguuuaacuauuacuagcuuuucuugucuucuaaauauuucuuuuccuucaucuccugaagaaccuuacaguaucuuuuuuuuuuuuuuuuuuuugagacaagggcuugcucugucauccaggcuggggugcaguggugcaaucacugcucacugcagcccugaccucccaggcucaagcgauccuaucaccucagccccccuaguagcugggaccacaggcaugcaucaccaugcccagcuauuuuuuguagagauggggucuugccauguugcccaggauggucucaaacuccugggcucaagugauccaccugccucggccucccaaagugcugggguuacagaugugagccaccacgccaagccaguaucuuuuuuuguuguucugugccgcuucuuggcuucugauagcucugaucuaucuaaucuguugaggaaugcuaguuuuaaaggaaacuguuaaccuguuuuaugcuguuacugugucagcacuaauugcucccgauuucucuuccuuccucuuguucauaauauacccaaggcuuuaaauuccugguuaaugaauccauuuauacacuuucuuucuuuucuuuucuuuuuuuuuuuuuggaaacagagucuaccucugucacccaggcuggagugcagugccaccaucucagcucacugcaaccuccgccuccuggguucaagcgauucuccugcuucagccuccugcguaccuggaacuacaggugcgcaccaccacaccagcuaaauuuuuuuguauuuuuuaauagagacaggguuucccauguuggccaggcuggucccgaacuccugaccccaagugauccuccuaccucgcccuccgaaagugcugggauuacaggcgugagccgcugugcccgaugauacuuucuuaaagggaacauauuauuuuucuucuaaacauuuuuaaaccaccaaaugaaauuuauuauccuuuaaauaacuuuaccgggguuuguuuaaaguguuuuagcuauaacaauuauuucuuuauuuucaaagggaaaaaggauugccuaaacaaaaauagauguggucaccucuuguugaauucacagugaagacaaaauauuuguugaugcccacuguuucuaaaguaauauaauaguauuuuucauacuuuuaaaauaauuagauuuuucauuuauguuauuuaauguaugaggucgaaauaccagauugccagucuucaauaguuuuugaccuauaaaacaguuuuugauguauaaaaaugucaguuucauacaguuuuaaccuaauuggugauuuuagaggcucuuaaauucucuuagaauuuaaauucuugaaauuucuugaaauuuaaauucuugaaauuaaauucuugaaaauucaucuuguaguaggcauuuuguauauaaacaauuaaauauugaauguauaucccuuaaucugaaauuucccuuuuaaugcgauuaggugaauuuugaaugacacagguugauuauaaugcuuagugagaaaagcaggagacagaauauguauuguuaguuuggcuaagcuguuacaaaacaagaaggaaacauguaaaacguuacgauaugguuaaccuuauuuuauguguauuugaagguauaagauaaucccauuuauaaauuuauauauuucagucagucguccugagguaaacuugaguaacucccauuuaagugugcaguuggaugaguuuagacaaauguggaacauuuccaucacccugaaaaguuuccuguuccccucugcagucuguccacacucugcucccagcuuccuguagcccugauguacuuucugucacaacaguuuuguguguucuagacuuuucauacaaauggagucauagaaaauguagguuuugauugucugcuuucuuucacguagcagcauauccaugauuuuuugugucaguggccugucccuuuuguugcuaaauaggcugaguauaccacaguucguucauccauuugccaguugaaggacauuugggucauuuccagguuuuggcuaguaggaauaaaacugaacauuugcuuauaauuuuuugugucuaauuaaauuuuccuccaucuuaaguaaauaccugagaguaggacuccugguccuguuguaaguguauguuuaacuuuauuaagaagcugcuuuucaaagugacuauacagcauuuuacauucccaccagcaauaucugagaguuuccguugacaccauuugguacuguugucaccuuuuaaaaauguaucuguucuaacggguagguagugguaucucauuaugauuggaauuugcauuucucugguggcuggugauagggaguauccgcaugugcuuauuggccauuccuguaucuccuuuuuauugguuuauuaaucuuacugauuggcaguucuuuauagauucugaauacaguccauugucaaauguguuuugcaaguauuuccucccagucuauaguugccuuuccauuucuauaaaucucuuuuaaaaagaccaaaccuuuaguggccuuuguuuaaaaucagcugaccguguaagugaguuauuucuggacucuguuccauucuguuaaucugugucuaucuuaugccaguaccauauggucugaauuaucauagcuuuguagaagucuugaaaucuggcaguauaaauccucuaucuuuguuuuuuuuuguuuguuuuuuguuuucaaaauuguuuuaagccagacaugguggcucacgccuguaaucccagcacguugggaggcugaggcaggaggauugcuugcauccaggaguuugagaccagccugugcaacauaggcauacccugucuuuauggaaaaaaauuuguuuuagcuacuugaaaucuuuugcauuuccauauaaauuuuagcaucaguuuaucaauuuucaugaaaauguaugguugggauuguguugaauuuauaggucaaguuggaaagaauugauaccuuaacaauaaugagucuuccauuccaaccugguuuagcuguucauuuauuuaggucuucaauaucuuucaccuuuacacacauuauacgaacuuuauuccuaaguauuuuauguauuuucaugcuaccguaaauggcauuuuaaaauuuuaauuucuaguuagguauugcuacuauaagaaaauacaguugauuuauuuuauuaguauuuuacuuuuuuuuuuuuuugagacggagucuugcucugucacuaggcuggagugcaguggcgcaaucucggcucacugcaaccucugucucccagguucaagcgauucucaugccucagccucccaaguagcugggacuacaggcgcgcaccaccacacccagcuaauuuuuguauuuuuaguagagaugggguuucaccauguuggccaggaugcucuuuuuuuuuuuuuuuuuuuuuuuuaaauuuuauuuuuauuuuuuuauuuuuuuauuuuuuauuuuuuuuauuuuauuuuuuuuuuuauugaucauucuuggguguuucucgcagagggggauuuggcagggucauaggacaauaguggagggaaggucagcagauaaacaagugaacaaaggucucugguuuuccuaggcagaggacccugcggccuuccgcaguguuugugucccuggguacuuaagauuagggaguggugaugacucuuaacgagcaugcugccuucaagcaucuguuuaacaaagcacaucuugcaccgcccuuaauccauuuaacccugaguggacacagcacauguuucagagagcacaggguuggggauaaggucacagaucaacaggaucccaaggcagaagaauuuuucuuaguacagaacaaaaugaaaagucucccaugucuacuucuauccacacagacccggcaaccaucugauuucucaauuuuuuccccacccuucccgccuuucuauuccacaaaaccgccauugucaucauggcccauccccaaugagccgcugggcacaccucccagacggggucguggccgggcagaggggcuccucacuucccaguaggggcggccgggcagaggcgccccucaccucccggacggggcggccggccgggcggggggcugacccccccaccucccucccggacagggcggcuggccgacccccacccccccgccucccucccggacggggcggcuggccgggcagaggggcuccucacuucccaguaggggcggccgggcagaggcgccccucaccucccggacggggcggcuggccaggcggggggcugauccccccaccucccucccggacggggcggcuggccgggcggggggcugaccccccccaccucccucccggacggggcggcuggccagguggagggcugaccccccaccucccucccggauggggcggcuggccaggcggggggcugacccccccaccucccucccggacggggcggcuggccgggcggggggcugauccccccaccucccucccggacugggcggcuggccgggcggggggcugacccccccuccccccucccggacggggcggcuggccgggcagaggggcuccucacuucccaguaggggcggccgggcagaggcgccccucaccucccggacugggcggcuggccgggcggggggcugaccccccccaccucccuccuggacggggcgacuggccaggcagaggggcuccucacuucccaguaggggcggccgggcagaggagccccucaccucccggacggggcggcuggccgggcggggggcugaccccccccaccucccucccggacgggguggcugccgggcggagacgcuccucacuucccagacgggguggcugcuggacggaggggcuccucacuucucagacggggcgguugccaggcagaggguuuccucacuucucagacggggcggccgggcagagacgcuccucaccucccagacaggguugcggccagcagaggcgcuccucacaucccagacagggcggcgggucagaggugcuccccacaucucagacgaugggcggccgggcagagacgcuccucacuuccuagaugggaaggcggcggggaagaggcgcuccucgcuuccuagaugggacggcggccgggcagagacgcuccucacuuuccagacugggcagccaggcagagaggcuccucauaucccagacgauggguggccaagcagagacgcuccucacuucccagacgggguggcggcugggcagaggcugcaaucucggcacuuuggggggccaaggcaggcggcugggagguggaggcuguagcgagccgagaucacgccacugcacuccagccugggcaccacugagcacugagugaacgagacuccauccgcaaucccggcaccccgggaggccgaggcuggcggaucacucacggcuaggagcuggagaccagcccggccaacacagcaaaaccccgucuccaccaaaaaaaaaacgagaaccagugaggcguagcaggcugaggcaggagaaucaggcagggaggcugcagugagccgagauggcagcagcaccguccagccuuggcucggcaucagagggagaccguggaaggagaccguggagggagagggagagggagagggagagggagagccaggaugcucuugaucucuugaccuugugaucuacccaccuuggccuuccaaagugcugagauuacaggugugagccacugcaccuggccccaacaauugauuuuguguugaccuuucauucuguggccuugcugaacucacuuauuaguucuaauagguuuuuccuagauuucauggaauuuucugcguagaagaccaugucuucugugauguaaaggcagaaguaaaggcaguuuuacuucuuucauuucaguuuguaugcauuuuauuucuuuuucuugccuuacuuguacugacuaggaucuccagcacaauuuugaauagaaguggugaagaguggccaucuugcaucauucccaaucuuaaggcaguuuuauuauacuuugaccaugaugauguuggcuguuacagaguuuuuugguuuggggguuuuguuuguuucuuagauucacuuuauuagguugaggaaguuuucuucuauuucuagucuguuuagaguuuuuaaucaugaaugaugaguuuugucaugaaaaagcauugacuuuuuccaaaugcuuuuucuagucuauugaggugauaaugugguuuguccuuuuuaguccauuaauacagugacuuauagauauugauuuuugaauauuaaaccagccuugccuucuuguaguaaaugccccuugguuauaauguauuauucuuuuuauauauugcuggauuaaauuuacuaguauuuuauuaaggauuuuaaagccuuuuuuauauaccuuuuauuuuauuauuuuuuaaauuaauuaauuuuuuuuuuuuaaguuagagucuuacucuguugcccaggcuggaguggaguggcaccaucucagcucacugugaccucugccucucggguucaagcaauucuccugucucagccuccugaguagcuaggauuacaggugugugccaccacaccugucuaauuuuuguauuuucaguagaggcgggguuuugccauauuggccaggcuggucucaaacuccugaccucaagugauccacccaccucagccucccaaagugcugggauuacaggcgugagccaccacgcauauaaaucccugaccuuuauaugcauuuuauuuuuacuugacaaauaauaguuguauuuuuugggggguacaaggugauguuuuaauauacagucauguguugcuuaaugaggggggaaaucugagaaaugcaucauuaggugauuuuuuuguuauugugugaaugcuauagaugauauagccuacuacacaccuaggccuauaauguaauaauagccuguguuuucuaggcuacaaaccuguacggcauguacagcaugguauugaauaccaugggcaguuuuagcacagugguaaguuuuguguauguaaacauaucaaacauagaaaagggacaguaaaaauuaaagauaaaaaugggcugagcacggcggcuuacaccuguaaucccagcacuuugggaggccaagguggguggaucacgagguuaggagauggagaccauuguggcuaacauggugaaacccugucucuacuaaaaauacaaaaaauuagccuagcaugguggcaugcaccucuaauuccagcacuuugagaggccuaaguggguggaacaccugaggucaggaguucaagaccagccuggccaacauggugaaacccugucacuacuaaaaauacaaaaauuagcugggagugguggagggggugccuguacucccagcuacucgggaggcugaggcaggggaauugcuugaacccgggaggcagaguuugcagugagccaagaucacgccacugcacugcagccugggcgacagagcgaaacuccaucucaaaaaaaaaaaaaaaaaaugguccaucuguguagggcacuuaccaugaguggagcuugcaggacuagaagcugcucugugugagucagugagagaguggcgagcgaauaugaaggccuagaacaucacuguauaguauuguagacuuuauaaacaccguacacuuaagcuacacuuuauuuuuuaaaacugugcuaugauguugcaacagcuacgacaucacuaggcaauaggaauuuuucaacuucauuuuauuuuauuuuauuuuacuuuauuuuauuuugagacagagucucgcucuguagcccaggcuggagugcaguggugugaucucugcucacugcaaccuccaccucugggguucaagcuauuuuccugcgucagccuccugaguagcugggauuauagaugcccaccaccacaucuggcuaauuuuuguauuuuuagcagaggcaggguuucaccauguuggccaagcuagucucgaacucuuggccucaagugaucugccgccuuagccucccaaagugugagccaccgugcccggccucaacuccauuuuaaucuuaugggacccccuguuguaagugccaucuguuacugacugagauguccuuaugugacucauggcuguauguauuuauuguuaaaugauucaaucaaacuaacuaacauaugccucacccaauuuuuuguguggugagaacauuuuaagucuaaucuuuuagcaauuuugaaauauguaauaugucauuauuaacuauagucaacaugcuaugcuaaaaacuaaaacuuauuccugcugucugaaacuuugugcccucccaccaacaucuucccuuuucccagccuacccucccuuguuaaggauuuuuauaucuuauguucaugaaggauaccuggucuauaccuuucuuaucauuauaagaaauaaggccaggugcgguggcucaccccuguaauccccgcacuucgggaggccgagguggacggaucacgaggucaggagaucgagaccauccuggcuaacauggugaaaccccguuucuacuaaaaauaaaaauaauaauaaaaaaaaaauagccgggcgucguggugggcgccuguagucccagcuacucgggaggcugaggcaggauaauggccugaacucaggagguggagcuugcagcgagccuagaucgugcuacugcacuccagccugggugacagagugagacugugucucaaaaaaaaaaaaaaagaaaugauaugauuuguugauguaauacuggccuuauaagaugaguuggggaaguguucccucuuuaauauuuuuuggaagaguuugcauauaauuaauauuauuucuuccuuaaauguuuaguagaauucacuagugaagugacuugggucuggaaaguuaauacaaauucaguuucuuuaauugauagagaacuauucaaguuaucuauuucucugucacgcaugguggcucaugcuuguaauuccagcacuuagagaggcugaggcgggaguuugagaccagccuguccaacauggugaaacccugucucuacuaaaaauacaaaagaaaauuagccgggugugguggcgcacgcuuguaaucccaacuacucaggaggcugaggcgggaaaaucgcuugagcccggaaguggagguugcagugaguggagaucacgccacugcacuccagccugggcgacagagugguacucugucucaaaaacaaaaaaauuaguugggcgugguggcacacacauauaaucccagcuacuugcgaggcugaggcgggagaauuaccucaacccggaaggcggagguggcggugagcccagaugguaccacugcacuccagccugggcaacagaacaagacuaucucaaaaaaaaaaaagaacuauugaaguuaucuauuucuuccugaguaaucuuggguaguuuguguuuuugaagcaauuuguuucaucuaaguugugaaauuuauuggcaaaaaguuguucuauaccucuucacacccuuuaauaccuguaggaccugcgggacguccccucuuaauaccuauagggucugugggacguccccucuuucaguucugauacugagaguucugucuucuuuuuuucuugacuucaagaaaauuuguuuucauagaaccagcucuugguuucaucauucuucuccauuguuuuccuguuuucucuuuccucaguuucugcucuaaucuuuuuuuuuuuccuuucuucuucuuacuuggguuucauuugcucuuguuaauuugcuuuacaaaucguaacuccgucagcaucucugaacuuugaucugugucucaucaacucagcaagacguuggacuguguuugaauuucuuuucccuguacugcagucugggaauuuccuucuaggaaagcucuagcaaaugcaggcucaccucauuuguuucugggacuguaggucugcacugccaguuauccaaugucugaaaaacagcuauuuuauauguuuuguccaguuuccugguuguuuaugguggaagggcaauucccauaguaacuaaucuuucaugggcugaagcaaagguccuuuacaaacuuuuuagaauaaucagaagcaguauauucuaucccuuuaccuuuuaaucaguucaguccaacuucuccacauuccuucuucuggauuuguuuuuacucuagagcaaauugauuucaugaucuguugaaacucaaaugcauuaucuauccuuaaauuacgugcagaugaggacaucucacaauacagguucaugcuggaucuaaucuugaguucucuuaguauuauguuuuuguuguuuuuuauuuucuaauuucuguccuagagauaaacggccuucguuguaagcaugacagaugagacuucuuuacucuuuuuccaaauauuuaauacauagcccugaagcauuggagaggcuaaguacauuuauuuauuuauuuauuuuuuaaguugccuugggcuuguuuuccaucauuagauuuggucuuugucgaaauacauuguauguaauuccugauauuuuucacuugugaccuuacucaauguuuguuuguuacuguucucaucuuauucacuugaauaaugcuuaguuuaaaauuuuaaccacauaaaccguauuuacuugucugauuuuuuuuuuccuagaugguauagcugcaugcugggaaagaaaugcagccuggcgccucugaaggaggagcuucgcauacaaggggugaggcuuccucauuacuguucucguguagcuacuuuucuuuguauccauggggcacaaguacaguuuugcuacauugauauauugcauuguggugaagucagggcuuucaguguaacugucaccggaacaauucaugucguugugcauguccuacccaccaagcaaccucccgucacccggucucccacuccccaaccacaagucucccuuugcccgucauuccauacuuugcuuccauguguacacauuauuuaacuccuacuuagaaguaagaacacgugguauuugucucaguuguuucacuuaagauaauggccuccaguucuguccauguugcugaagacacaauuucauucuuuuuuauggcugaauaguauuccauuguguauguauacugcauuuuuaaaauccaguccuuuguugauggauacuuaaguuuauucaaguccagauaucuuuucuuucuuuucuuuucuucuucuucuucuucuuuuuuuuuuuuuuuuuuuuuuuuuugagaucaagucuagcucuguucccaggcuggaguacaguggugggaucaugacucacuguaaccuugaacuccugggcucaacccauccuccuaccucagccuccugaguagcugggacuauaggcagauggcaccaugccuagcuaauuuuguuuuucuuuaguagugauggggucuugccauguugcccaggcuggucucaaauuccugggcucaagcaguccucucaccucagccucccaaagugcugggauuacaggugugcaccauugcaccccaccuaaugauuucuuuuccuuugggaccaagucuucuaguauuuuuuguacuuucaggucuuauauucaagucuuuaguccaucuugagguuuuuuuucauauaucuacuguuuuguuuuuguuuuuuuuugagaaauggggucgggcugggcgcaguggcucacgccuguaaucccagcacuuuggcaggccgaugugggcggaucaugaggucaagagaucgagaccauccugggcaacauggugaaaccccaucucuacuaaaaaugcaaaaauuagccgggcaugguggcacgcgccuguagucccagcuacuggggaggcugaggcaggagaaucucuugaaccugggaggcagagguugcagugagcugagaucgugccacugcacuccagccuggugacacagcgagacuccgucucaaaaaaaaaaaaagauggugucuugcucugucaaccagacuguagugugguugcacagucauaguuugcugcaaccucaaacaucuaggcuuaagcaauccucccacuucagccucucaaguagcugggacuguuggcacacaccaccacgcccagcuaauuuuuaaauuuuuaguagaaacaaggucucucuguguugcccagacuaguucaaacuccuguacucaaguaauccuuauuuuuuauaaagauagggucuugcuguauugcccaggcuggucucaaacuacuggccucaagugauccuuccaccuuggccucccaaagugcugggauuacaggcgugacccaugcaccugaccugugucuacucugaugguaguuuugaguauagaauuuucuuuauacucuaaaacucuaaauauguuuuuuguuuuguuuucuaaguuuuauauuuuuagggcuaaaauauauuuuuuauagauuauuaaaacaaggccuuuuuugacaauuauagagaaagguggagaaaaacagggugaguagaaugucagagagaagccagaaaucaaaaaaccugguaucuaccacugaccucacaucgaacuccuuuuuaauauuuuuuuaauuuuuauuuuuuacuaugccuccaagacaaguucaacucacuccuuuauagauccagaaacucaagcuacauagguuuaagggcuuguugugggccaugcaguuagcucugggggaacagcaccagcacacggucucgguccccugugcuucccacuaggaugacauuccacaagagcagagccccgugcuccuguuucagaaggcaggucgcaaguaaguacucccaggccgggcaaaguggcucaugucuguaaucacagcacuuugggaggcugaggcgggcagauugcuugaaccuaggaauucaagaccagccugggcaacacagcgaaaucucaucucaacaaaaaaauacaaaaaguuagccaagugugauggcgcgugcuuguaguccccacuacccaggaggcugaggugggaggauccauugagcccggaaaguugaaguugcagcaagcuaagaucacgccacugcacuacaaucuggacgacagagcgagacccugucuccccaaaaaauuuucuuuuaaauaaaauaaauacucccaccgccacuuccacuuuccucccaguuucugguuuuuagugugagucagaggacuucucagcaaaagggucagaugcaagccagugggaggagcagaguuucuggucucugguuucucucugacguccuauuccuccucuuuuccucacaauaccauuucuuggguaaauugugagagcuacaaacuaguuccuuuaccuuuccuaaaaucugauugauaaaacagauuaccuaccugugucuagcccagacuuugguugacuuucuuucuaaaaaagaaaacaaaaaaucacuugaggcugggugugguggcucacaccuguaaucucagcacuuugggaggccgaggugggcggaucgccugaggucaggaguuugagaccagugauggugaaaccccaucucuacuaaaaauacaaaaauuagcugggcgugguggcaugcgccuguaaucccagccacucgggaggcugaggcaggagaauugcuugaaucugggagguggagguugcagugagccaagaccgcacacugcacuccagccugggugacagagcaagacucugucucaaaaaaacaaaaaacaaaaaaacucacuugagucauauuacaaauaauucucuaaagagcuguguuuucaguguuucauauauuugaaccuucaagucauaucuguaaauucucuuauguuuuaugggaggaaaaaauauaacuuuguugagagaugauuuauucauucauuauuaggcagcuaucuauaacuguuguuugguaauauuguuuguuaacugauuaaaaagaaggaucaacauaauauggcaugacgcagcagccagaaacauauugguagaaugauugcaguuugaugagaugcugucuuuguugguuucagguucccaaaguaacguacacugaauucugucaaggucggacaaugagaugggccuuagcuuggaguuuuuaugaugaugucacaguaccaguaaguacagaccuugcuccgcuucaccaccugccagcacaugguggguuucaguccaucauaagugaacugaauugguaguguccuguuuaacugaaguuugucccaaaugcuuaugucagaauggaaagggguuguaaccaagacacaguccuagaaggcugguccuggagacuguggagccuuccucugugagucuguacaacauagugauuuuugcucagcugacagaaauguaucuuuuaggaauuaaaaauuuggcugggcaugguggcuuaugccuguaaucccagcacuuugggaagccgagcugggcggauaacuugaggccaggaguuugagaccugccuggccaacauggugaaacugugucucugcuaaaaaugcaaaaauuagcugggcgugguggcacuccuguagucccagcuacucgggaggcugaggcacgagaauugcuugaacccaggaggcggagguugcggugagcugagauugugccacugcacuccagccugggccacagagcaagacucugucucaaaaauauuaaaaaugaaauaaauaaaaauuuuuuuaaaaaacaaaauucagguaacauaaccuguagaaacauuuugcagauauaauuacgcugguggacauuccucaagaauugaaaaugaggucucuuucuuuuccuuaccacugcugcuuuccuagaauagcugccucuuggggcuccuggagaacguagaaguugacuuuuuggauugcaggcuuuugaugugcaacacuuggggaucauuuuaaugaaggguucugucuuggcuuucagauuagcacuagaaucuuaaccauuuuugaagcugggugauagaucauuauuccuuucuauuuugugugugcuagaacauuuucuggaauaaaaaguuuaaagaaaugauuuguguccaggccugguggcucacaccugugaucucaacacuuugggaggccgaggcgggcagaucacuugaacucaggaguucgaaaccagccuaggcaacauggugaaaccccgucucuacaaaaaauacaaaaauuuuuguauuuugauggcgcaugccuguagucccagcugcugcggaggcugaggugggaggaucacuugagccuggcagguagaggcugcagugagcccugaucgugucacugcacuuucugcacuucagccuggggcaacagagugagauccugucucaaaaaaaaaaaaaaaaaagguuuguucacagaugucucuuuguccucagugcugcuauagguaaaggaaaaccaccucugagcuggccagacugaaugauuuuccgggcagugacagaacagcaucuguugcuucucacaguucccucccaggugugguuggcuucuuguugccuggagauucccagcugaagugucugcacacacugcccagcaggugcucuuccuuucuuaguaugugcggggaccugacaccugcugcuuugcucccucagcgccuacagugggcuuguucugggugcuguucuuccaagcucuuggcugcucuuggucucuaacgucaucuuacauguugcugugugucugagucucuucuccugcucuuguaggguagaggaguagagacauguagcacaagggaacaauuugcagauacuaccauguuucugaaaacaggagcuuaaauccgagguugagccuguccuacucugcagcuagaagugcugcuggguucaauuacacuccccagugccauuugaauggcccuuccaugaaggguagacuccuggacagugcaguaaguuaucuagagguuuguguuugaaauagucucugguuaaaaagaugcuucuccuuuuuugacaccccucaccaccccgaagaauuauccuuucugucauuuucuagaauaucagggcccucacaccacaugguuaaaaucauuaguaaugcucugaguuauccccguggagacacuaacagcugcagcaaacuggaacugcaccuguuuucaagugcuuucugcuucacccgccucccacaugugucggcgcugcagguggaagagcagauaaagcacccuggcacuccacaccagcuccgagaccgaguccuccgggcccuccugcaugaguagccuugucagguccacguaguaaagggcacugcuucuguguuaacaaaaccagcuuauuuugcaaaggaacccccuaagcuucccuccccuccucuccucuguuuuggggcauccuucagccccguucauaguucucaaccaucagagaaugcugagggccccagauucccccccuaccagagucuuccucccuccccaccacuaccccagccccaagccgcuaauaaugcacucccaucucaaccaucagagaaugcugagggccccagacuccccccugccagagucuuccuuccuccccaccacuaccccagccccaagcugcuaauaaugcacucccaaguguucuguuagacgcacuucagccgcuacaggaaaaaacggcaauuccugauuuguaguaacccagcaacaguuucuuagcacugcugcccuugaucggcaacugcuuuccccagggggucgucccaggguacucacgagguuuuuauuuagccauccucuugguucucuucccucuuccuagaccucucuccccacccucguuuuuugaaaaccccaucugacuuucccccucuugcuccugguggggguaaggaaggaggaggaugcugcuuuagacaaggaauagagcuaguuaagcagaaacauugaccuauuuccccacccccacucccgccauuuuaggguaaaugugcaaguuacuauggcaacuucuguuuucacuuaucucaggccuacugacucguuucuguuggugcugaaugcugaaaaauucuaauucacuggugauucaagugcccacacucagcccauuccuguugucuggauuucuuuuagcaacaaaaagguccuaauguugauagaauuuuguuccauaauuucagcuaaugaugaauauaaggaagcauguucuacaaacuguucucugcagaauucuaacaagccacuuaccucuuuguuccagcucuccgcuaauugccgaaagcauuauuuuagcuuuguuuugguuugcuugaaggaaguuugacguuuguuaggagaaaaaggggaaaguguagcccuagugaguuguucacucuuggugugagcacugcucaggaacucugggcuuaaaaaggauccccugcauugaagacauuaccuuuaagccugggacguggcugucuagggaguaagaacuagagggcuuuuuggagagcagauggaggagaggugucaaauuaauuaggcaacuuugugcauguuggagcuggguauccugacagugcccagcucccuucuccuuagguuuucagucuuguccacauagcugagggaugccagguaggugccccaggguggggcagacaucaggcugguacuugagaccucccucucauuuuaaagagcucaucugcuuuuaucauuauuauguguugauuuauuuguugaaaguguccugcuguuaagaaaugguuugggcuggccgugguggcugaugccugugaucccagcacuuugggaggccaagguggugaucaccugaagucaggaguuugagaccagccuggccaacaugaugaaaccccaucucuacuaaaaauacaaaaguuagcugggcgugguggugcacaccuguaaucccagcuacuggggagacugaggcaggagaaucgcuugaaccugcaaggcggagguuacagugggcggagguuacagugagccgaggucacgccguugcccaccagccugggugacagagugagacugggucucaaaauaaaaagaaguuugaauaaaaauaguuugaaaaccaguacuguaccaggcugugcauuaugcuacaagauggacaggggcugagcucuugagcaaaaccaaagcuuaggacccucuucuuaguuacuuuucuucuuaaguguggucuucauugugaugauaaacaaaucagacauuguuuucuguuacucacaaugaugaguuuuauaggaaagaaaaacacguggagcuauugaucccgaucugcagcagauuugcaugugaguaagugcugagugguaggggcaggaguggccaggaguugagaaaaggaaguggcucaggcuggggcuagucaaagaccgcuuuauggaggaggagucgccagcgucugacucguaggucgguggguggcguucccaguguuuguuguauguuuaaaggaaugguguaggacuugcguuaaagagcaacaucgugcgcaggauccaguagauuuaguagauuugaagcacuggauauaauauuuguuguuguuugaauacuucacauacauuauagucucauuuuauuuccaccugacagcaaucgagugaacuacgucuacugcaggcuccaaaaagucagguuagaacccagaugagucugauuucacagccugagcaccuaaugucacucugacacucugcccgccacggcccuauguuguuccuggccuggccagaaccugcucaugauggccucacaucuugcuuauggaccauccuagcaguuucucaucugcgagugacuggauucauccugcagucagcauccugcucacccacuccugaguggccaccuaccacaagugggaggaaguacagcuccucguuuggcuccuugggccucccagaucuguccugacuuuccauccuaaucacucccaguuguccugacuguacugucuccacagccuucccauggugccgaagucagagcugacuuuguacagccuuugcucauacccuguucugauccuucccucugacguccuccacugcaacccagcccaguuccaacuuacuugcauagagcucccauaagcauucagcccauagaaccuggacaucucucccuuccucuggacuuaacugcauugaucucuuucaguuaucuauacucugcauaaacuuccuuguggcauacuuuacacugguguuuuguuuaacugagguacuguggauaacaccaaaaccuucuugcauagguguggaaaaggccuuuugugagcuggucccugucuggcuuuacauagaacaggcuacuuaacuucgcuaaacuucaguuuccucaucuguaaaauggggaagaauaauaguaucuaccacauaggguuguuuugaggauuaaguguacuuaacuuagugccugguauguaguaaugcucaguaaaauauauuguguugucauuucccaccauuucuucccaccugccccuguauuuguuacuccagucauguugagcuacagcucucuaaucccucugccuggagauuccuccucugaccauuaacccauuuaugccggaaguugcaaguuuuuuuuuugugaaaacucagaccuuggcgaugaccgugagcgucggauauaaauaauuccaccaagcuuaauuuuuuuuuuuauuuugagacugggucucacuguugccaaggcuggaauguauuggcgcgcucacggcucacugcagcuuugaccucccaggcucgugugauccuccccugucagccucccuaguagcugcgccuacaggcaugugccaccaugccuggcuaauuuuuguauuauuuuauagagacagagucucccuagguugcccagguuggucuugaacuccugggcucaagugauccaccuuccucggccucccacagugcugggauuacaggcauaagccauugcacccagccuaaaaugcaaacuaauuuaacauugagucacauuuaagcugggcgugguggcucacaccuguaaucccagcacuuugggaggccaaggcaggcggaucacgaggucaggagaucgagaccauccuggcuaacacggugaaaccuucccuccgucucuacuaaaaauacaaaaaaauagcuggacaugguggugcgcgccuauagucccagcuaccccagaggcugaggcuggagaacggcgugaaccugggagacagagugugcagugagccaggaucgugccacugcacuccagccugggcgacagagcaagacucagucucaaaagaaaaaaaaaaaauauugagucacauugagcuucugagaagauagcuuguuguuauuucuccuuguuauuauuguuauuauauccuuguuguuauuucucuugcuccguuguuauuucuacaaauuauggcaaaugauaagguuauuuuuaaacauuuaauuuuaaaccaucuauuccccaaaaugcagauugcagacuccccaauucacaggcauuuuauuuauuuauuuauuuuugagucaaaagauaccaaaaaggauguuaaaucucauuaguuauuagagaacugcaaaugaaaagcauaauggcauacuggauagaccauccagcguuggcaaggaugcagagcaauugccgauccucucaugcagcugggugucaacugguaacauucaggagaacauaucuuuaggaagauuuaugagagcugagcuugcucauacccugugacccagcaauuccacuccuaaguuuauauccaaaagaaauguguauucacacguaucacaaacauuguacaagaauguucacagcaacauuauucauaauagcccuaaacuagaagccacugaaaugucucuaaauaguagaaaggguaaauaaguuguaguauauucagaagauggaaacuaaacaguaauucuguuccagugaaugaaccugccuucacaacaauaugaaugaaucccauacacaugauuuacacgaaaaggcugggugcagcagcucccacauguaauccuagcauuuugggaggcagaggcaggugggucaccugaggucaggauuuugagaccagccuggccaacauagugaaacucugucucuacuaaaaguaacaaaaauuagcugggcaugguggcacauuccuguaaucccagcuaguugggaggcugaggcaggagaauugcuugaacccaggaggcggagguugcagugagcugagaucacaccacugcacuccagccugggcaacaagagcgagacucugucucaaaaauaauaauaauuauuauuauuuaauaauuuacaugaaagaagucagauacugaagccugcaaacagguacaacccauggugauagaaauugggauacugagagagggauugguaauggccaaugagcaugagagggaauugggguuccugguaaauaaguucuuaagacuuaacguuuauaacagaugugcuuuucuguaucuauauuucaauuuaaaaaaaaauucuaaaaauauaucuaggcugggcgcgguggcucacgccuguaaucccagcacuuuaggaggccaaggccggcggaucgcgaggucaggagaucgagaccauccuggcuaacacagugaaaccccgucucuacuaaaaaaauacaaaaaaauuagcccggcgugguggugggcgccuguagucccagcuacucaggaggcugaggcaggagaauggcgugaacccgggaggcggagcuugcagugagccgagaucccgccacugcacuccagccugggcgacagagcgagacuccgucucaaaaaaaaaaaaaaaaaaaaagagaauucuaaaaauauaucugaauagaacagaauuaaggcaacugaaacugucuaaaguucauaauucaacuuuaaauacagauagaagcauauuuuuagguacagcagcgcugucucuaugaaaaaaaaaaauagccaggaguggugguaugcgccugaagucccagcuacuugggaggcugagaugagaagaucgcuugaccccaguaguuugagucugcagugagcuaugauugcaccacugcacuccagccugggugacagagcaagacuuugucuuaaaaagaaaaaaagugggaagugggcagguggcucaugucuguaaucccagcacuuugggaggccgaggcagguggaucaacugagguuaggaguuugagacuagccuggccaacauggugaaacccccgucuccacuaaaaauagaaaaaaauuagccgggcaugguggcgggcgccuguaaucccagcuacucgggaggcugagacaggagaaucgcuugaacccgguaggcagagguugcugugagcugagaucgugccacugcacuccagccugggcgacagagcgagacuccgccucagaaaaaaaaaaagaagcagcagcagcuugaucagauacaggguugauuguucuuuuuuuuugauuggggagggggagcaagaauacuuugcaggugguaugugguauauacuaucguauggaggcacauguuagauugugucuucaugaugugagcagucauugaugaucauugccuagauccauuaauucauuuagaguugcaaauaaugauauuccaauucuauucgucccuucauuuauuagcugagguacuucuaugaaaggaaacuucuccuauuaguuauuaguaacuuugaaguacaguucaucuaguaaagccggauaaauguuugauucuuggccgagcacaguggcucacaccuguaaucccagcacuuugggaggccgaggcgggcggauugccugaggucaggaguucgagaccagccuggccaacauagugaauccccgucucuauuaaaaauacaaauuuagucgggugugaugauacacgccuguagucccaucuacuugggaggcugaggcaggagaaucgcuugaacccgggagguggagguugcagugagccaagaucguaccacugcacuccgccugggugagacuacaucuccaaaaaaaaaaaaaaaaguuucauucuuuugcuuuaucaguuuuaaaaauaaugaguuggcugggcacgguggcucaugccuguaaucccagcgcuuugggaggccgaagcggguggaucaccugaggucgggaguucgagaccagcccaaccaacauggagaaacccugucucuacuaaaaauacaaaauuagccaggccugguggcgcauaccuguagucccagcuacucgggaggcugaggcgggagaaucacuugaacccaggaggcagagguugcggugagccgagauugugccacugcacuccagccugggcaacaagagcaaaacuccgucucaaaaaguaaaaaaguaaaauaaauaaaaacaaugaguuggugguucccuagcaucuuccaaaagugaccaaagagggugguuugguuuuccuuuguagcaucuuaugaagucauggauuacuuuuuuuuuucuuuuuauuaaauagagauggggucuuacuauguugcccaugcuggucucgaacuccugggcucaagugauccuccugcuucugccucccaaagugcugagauuacaggugugagccacugugccccgcuguauuacaauuuauauauauauauauauauauauauauauauauauauauuuuuuuuuuuuuuuuuuuuuuuuuuuuuuuuuuuuuugagacggagucucgcucugucgccugggcuggagugcaauggcaggaucucagcucacugcaagcucugccucccggguugaggcuacauuuuucaauucauuacacuuacuaucucuacugaggcacaguuaaccgccuuuggccauggagaauuuauucaacuuggcucgugagucuuuuuuaucauauccacuguagucuuugguggcuuccuugcuuucugguaucacagguuguucuaggcucauauuuuuuccucucucagaucuggaaucaaccauuucucccaggagaucugguuuauuuugcugggaagucguauuuaaagguauucaucugggcacuagggaugguaccagguuagucauuguuuuuagaggcuuuuucagcagagcuaggaauuacuauuuuuaagaugaaauauguugcaaguucuuguugauuccuuuccuuucuuuuccuuuccuccucuccccuccccuuccuuucccaucccucuccuucccucuuccacuuccucccucccucccuuccuuccuugccaccacauccagcuaauuuuuuuuuuuuuuuggguaaagauggaguuuugccauguugcccaagcuggucucaaacucuugggcucaagugauccuccugccucgaccuccccaagugcugggauugcaggugugagccacuguacccagcauauacuugcugauacuuuauucagcuucacaucuguggguuuuuacuuaauuucaucaguuguccaucuguaucucccauucaaaaauccugugacugcgguggugcacgccuguaauccuagcuacucaggaggcugaggcggggggaucacuugagcucagguguuugaggccagccugggcaacacagaagacccuaucucuuaaaaaaauaaaagaaucccaugccaaaaacuccaguccucagccaacauauuacucauuaacuuuaucucacaauaugccccaggagucucaaaaguaacauuaccaucaacaaagugauuucugaaaauagcuacuuuuuuacuuuuacaauucuuuuuuguccuuggagacucucaugauggauuucaaagucauuuggaacguuuccacucugaauuuucugcauggagucaggacagagguucguuuguuucaucaucuucagauuuuuagggagugccuuuuuuguuguuaguuuuguuuuguaauaaaauauauuucuuauuucucuaccugugaaaugaaaaaaaucucaaaagaauggucagaagucugacuucuuucuucuaucucauucacccuaauccuuuacuucuucauggguuacuauuuaaacaguuuuauaauuuaucauuccuuuauuuguauuuauauuuuugagccagggucuugcuccguugcccaggcuggagugcuguggcacgaugucggcucacugcaggcccugccuccuggguucaagcuauuauucuccugccucagucuuccgagcagcugggauuacagguguaugccuccaugcccggcucuuuuuuuuuuuuucguauuuuuaguagagaugggguuucaccauguuggccaggcuggucuggaacuacugaccucaagugaucugccugccuuggccuccaaaagugcugggauugcaggcaugagccaccgugccugacccauuuuuucaaauucaaagaaauacacguauguauuuauaaucauuccuucuuaaauagguagcauucugcaauaguuuucuuccccuugcuauuuuuacuuuuuuuuuuuuuuuuuuuuuuuugagacggagucuugcucugucacccagguuggaguccaguggcgugaucucggcucacugcaaccuccgacucccugguucgagcaauucuccugccucagccugccgaguagcugggauuauagacacgugccaccaugcccaacuaauuuuuauauuuuuaguagagaugggguuucaccauguuggccaggcuagucuugaucuccugaccuugugaucuaccugccucagccucccaaagugcugggauuacaggcgugagccauggcacccggcugcuauuuuuacuuuuuacuguuuuuacguacuccugggggugauuucaggacauuuuaaacaacgaccugucagauuaagaugaaagaaaugggcuggguguggugaugugcaccuguaguugcagcuacuugggaggcugaagugagagaaucaccugcgcacaggaguucaaggccagccugggcaacauuguaacucccuaucucuuuuaaaaaacagacggccacugcacuggggucuccucucugcccuguccccuuuccacuugagguuuuucuagaagcugcuuugccaaaacaaagagguuguggcuucgugcgcaccagauuucucuguagaauggcucuucucuuccugcaaauacuagagagaauuuaaugauuucauucagccuguggcuuuuuuuuuuuuuuuuugccuuagccauaauuaacggagacauaacaugcuacacugaucugugucaagcuacaccacaugugaaaguuucuuggcugauggcaucauugagauuuagaaauuaaagugaagauucaaauuuguaccagucugggcgacauggcagaaccccaucucuacaaaaaauacaaaaauuagcuaggcaugguggcacacaccuauagucccugcuacucagaagacugaggugggaggaucacuugagccuaggagguggaggcugcacugagccguaauugcgccacugcacuccagccugggugccagagcaugacccugucucaaaaaaaaaaagacaagaaaagaaauuuguagaccacccugcuacguagcauauuuuaaaauuuaagaacugguuuuuuguuuguuuguuuguuugugccugauugauggcuucugugaucuaauguguuuuuaacgcuugcaguuccucucuuauugaugaucauuccuugacuacuuggaauucaaaagauauaaaaccuguggucucugcagaccuacgacugcucaccaggcuucucucacauuguaauuccagcagugcaucuucaaauccaaaaucagcuguaaauucaccuaguucuuugcauuaaacuggauuaaucauuguaaaugauugguuuugggguagacuuuaaaauguugaauuauuuauguacgccuugccugcuaaacuagauuaugacaguuugaguguagcacucuucauuuaaaauauuuguguuuugcaauuauaaggauauuagcaaaauaagaucauuucaauuggggaaaaacugacagcuucuauguacuaguguuugcagcaaaauguaaaaauugccuacgaccagagagcugugguguugaauuuaacuauuaauuucuuagaacuugauccuauauuuuacugugacccugcccacgaggacuuuucaugauaaauaagaggggacugaacaacugcugugagccauacuucaguuaaucuuucaucauuuaaaagccuugccugagaacuccuggaguaugaauuaucugucuuuuuuuuuuuuuuugagacggagucucgcucugucaccgaggcuggagugcaguggcgcgaucucugcucgcugcaagguccgccucccggguucacgccauucucccaccucagccucccaaguagcugggacuacaggcgugugccgccacgccuggcuaauuuuuuguauuuuuaguagagaugggauuucaccauauuguccaggauggucucaaucucccgaccuugugauccacccaccucagccucccaaaaugcugggauuacaggcgugagccacugcgccuggccugucugucucuuaaugucuaguuucuauaguagagcaaagccaaauugaagaccguccugagaugaugugugugcaugugugugcuagagcaguucauuagaaaucuuccgaaugcagcuggcgcaguggcucaggccuggaguccgaacacuuugggaggcugaggcagauggagagcuucagccuaugaguuccagaccagccugggcaaucaauauagcaagacccuucucuauuuaaaaaauaaaaauaaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaauaaaauaauaaaauaaaauaaaauaaaauaaaaggaaaauuuuuuaaaaaaucuucaggaauaucaaguuuguugacugaccauuguauaugggaaaguugggucaggaugcaggugaaggagccauauuugagagagggaaguuuucauuuuaguccugagauaacuggguaauaaguugucgauuuugugauuucugacuuccucagaacucugaaaguaucccugauagaguucuugucagguugguaaagauguauuuucuuauuuuaaucucuagaaaugaugaagcccguccuuacuuuuggagaaagagugucgcaggucagcuuuagcauaaugagaaacagcaauauccugacuuuacuggucagaauuugugagcaaaaugaucacuccuucugugagaagagaugggaagugcugcccuuuuagccaugcuuguaggugaccuuugcuguacagggcgggcuggcagggagggccagguugcagugagcucuccauggucauggccuuugauguugggacggggaauggggagucugauucuccacccccaucauccucccacacaccggcuuaauacgcuucuuccccagcuuaauacgcuuauuguaagcuccuuacugcaaagcguuaggcucucaguagacuagaaauuauguuucucaugcaggaugauugaguaauaacaauaugacugucuuaaugucaauaugaauuugucucaucuugucugaaacauaauugaacaaguucagguucagacaggucuuagaguccacuauucauuucucaagagcagguucuucaaacacacacacacacacacacacacacacacacacacacacacccuuuguuuuuuauccuucccuaacaguuuccuaguauagaauaaacugguuagguuguuguguauguaugcagugugaggccgcugguuaguucuuauuagaagacgucccccaguaaucagaaccuguggugucugcaugugugcgugugcgcugucaguguggccagguacgacuggaaugaucaguagcagucgucagauuccuuuuagcagaaaaagaucuucaaaccugacuugguguuuuuucuuuuuuauccuuuuuguuguuguuguuuuugagacacagucuccuucugucuccaggcuggagugcaguggcgcaaucucaucucacugcaaccugcaccuccuggguucaagugauucuccugccucagccucccgaguagcuggaauuacaggcgcggccaccacacccggcuaauuuuuguauuuuuacuagagaugggguuucaccauguuggccaggcuggucucaaacuccugagcucaauccauccggccgccucggccuccgaaagugcugggauuacaggcauaagccaccacacccagccuaaaguuucuacuuuaaagaaagaaauucucaggcuggacacgguggcucacacuuguaaucccagcacuuugagaggccgagguggguggaucacgaggucaagagaucgagaccauccuggccaacauggugaaaccccgucucuacuaaaaauacaaaaauuggcugggcuuggugacguagucccagguacuugggaggcugaggcaggagaaucgcuugaaaccggagguggagguugcagugagccgagauggcgccauugcacuccagugacagagugagauuccaucucaaaaauaaauaaaugaauaaauaaauuuucaauacagugguggcauugguuuuguuuuuuuuuuuuucuaaaacggaguuucacucuuguugcccaggcccagacuggagugcaguggcacaaucucggcucacugcaaccuuuggcucacugcaaccuuuggcuccuggguucaagcaauucuucugccucagccucccgaguagcugggauuauaggugcgugcccccaugcccagcuaauuuuuguauuuuugguagagacgggguuucaccaugugggccaggauggucuugaacuccugaccucaagugaucugccugcuucggccucccagagugcuaggauuacaagcaugagccaccgcgcccggcaggugccauugguuuuuaaaguggaacuugagucccucuaguggguaggguauaauucaccuucccagcuugagauagaauggaagaugccagucgugauuuucuuggaaccagcuuugaaauccagucuucucaucagcgccggugucacccuccccagcuaaaaggcagugcuuagcucgccgccggcuuggucccgacaucagccacgauucaggaguccuccuccucugcccacgugaucuuaguggcccugauccuuccucgcaugucaucucauggcugugguucaccggcugcuuuaucucaagccucagccaauauaaacucaaacuacaaguugaugauguuucugcccugcaguucuuuccagccaagaacacagugcccccaggguccucgaguugucaugaaauaaauaauugugcaggucugcuuuggguaccacagguacacgaaggacguuuagcaguuggaggaguuacaucugauagccagaacaaaggcagugcggugcggcuggaaagaacguggguucggcguucaguccuaacugcaguuacugugugaccuugagcugugugacauagccuuucuguaucuucguuuuccuggagaugccuaaacuaucuugugggguucuuauuuuuuuaauuaaaaauuuuuuuuuucuuaagagacagggucucaccccguuuccugggcuagauugcgguggcgcaaucagagcucccugcagccuggaagucuugggcucaaaugauccucccuccucugcuuucagaguagccgggaccacaggcauacaccauuguggcugacuaguuuuaaacguuuuuuuagagauggaggucuuacuauguugcuggggcugaucucaaacuccugggcucaagugaugcuccugccauggccccccaaagugcugggauuauaggcgugaaugacugcaccuugcaggguuguuuuaagugcuggacauaacacacacaaaacccuuuguguuuucagugcucuaugauugguagcagaaguuguggaaauuuucucugaguucauuacaaugcaugagguuuaauuauucggauaacuuucuucucuuuucuaugcuuccuuuuucuugcagucaccaccaaguaagcgaagaaaauuagagaaaccgagaaaacccauaacauucguggugcuggcguccgugaugaaggaauuaucccucaaagcaucaccucugcgcucggagacggcggaaggcauagucguugucacgacauggauugaaaaaauucucacugauuugaagguaccugcuuaaccauauugacgaaguacucauaaugauccuucucuuuuuucuuuuuucuuuuuuuuuuuauugagaguuuggagagaggggaaacgugauuucccacaaaauucuguuuuuccuccaaacagguccagcauaaacgaguucccuguggaaaagaggaagucagccuuuuccuaacggccauagaaaacuccuggauucauuuaaggagaaagaaaagagagcgugugagacagcugagagaaguuccccgagcuccugaggacgucauucaggccuuggaagagaaaaagcccacccccaaagagucuggcaauagccaagaacuggccaggggcccccaggagaggacccccugugggccugcucugcgggaaggcgaggcugccgcuguggagggcccgugcccgagccaggagucccugucccaggaggaaaacccggaacccacggaggaugaaaggagugaggaaaagggagggguggagguuuuggaaaguugucaaggcucuagcaacggagcccaggaccaagaggcuucugagcaguucggcagcccaguggcugaaagggggaaacgucucccaggaguggccggacaguaccuguuuaaguguuugauaaacguuaagaaggagguggacgaugccuuaguggagaugcacuggguugagggccagaacagggaucugaugaaccagcuuugcaccuacauacguaaccaaauuuucaggcuuguugcaguuaacuagaaaccuccugcacaguuggaaacguguugauaguaacuugcuuuggaguggccugugggguggcaagaggaauccuaccagcggcccauuaguagcacgauguggaauuaucuucgaaaacaaaaaccuaugaaucugucccccaccuccccccgccuccuucccgcuuuuugaguuacagggagucguaguguggucauuuacaaggaggaauuguggucaucaguaacaacagaaagcccucaguaaacucccgagggauugcaagcuggcucaagcuggccccucagcucuggacugccucugcaaggucagaaggguuguuuguggagucugggcugggcagcacugccuagaauaucaugcugucucugucacccaaggguguuucuugaggagggguggcucucucugccuccagcuggaggcccugguacccuguucuaggucacucuucaagauggggccuaccuugcaucaaucccacaaagggagcuguauggugggugguggggaaucugggagagaaaccuuaguaaugcugggaaggagcagcagagucuggggaccacccgguaaauggcacauuccugacaccuggcuguuuugauguugcuuauuucagaagcagaauuagguaagcaaaacuccccggugugacugaggcacacagaaggcacccauacccccaccuccagccuguugacaguaccauuuuguagcaguuuuacuacugugugauuuuuguuuggacaucugaaguagagcuuguuuuguuuuuaaauaagaauauucacaaauuaaaaaccagcgguccuauuugaauccugggguuagcugagugagcggcugaugauagaaaugagaaauagaacaaaauaguaugugccguagguagcuuaagaaagucucagauauuuuguugcugaucaaauacuguuuuuuuguggcuucacuuguaauccccccuguacuuaccuacucacauuggagaguucugaggccggaguaacuguguccuugaaacacguuucuaauuggaaugccaggguucaguagccguccccccggaaaggggugaccuuuugcugugcuugauguugcaucagcagccuaggguucuguuuagacuaaaaucuuggccagagcuccuugccaucugcuaagaagacuggggcugaguaguuaagccagccuucugagagguggcuguuggucaggacgggaagcuggugaccuuggcaugucuuggcagcagcuagaucaggcccucggcagagacacaggaagcggaacugcugugccuuaacuuggcuguggagcuggagcuggagaaggcagcauacugaccaguggcuuuuugauugauuguuuguuaugagguggaguuuuacucuuguugucuaggcuggagugccguggugcgaucuuagcucacugcaacccccgccucccggguucaagcgauucuccugccucagccucccaaguagcugggauuacaggcacgcgccaccacgccuggcuaauuuuguguuuuugguagagaugggauuucaccauguuggccaggcuaaucucgaacucaugaucucgggugauccgcccaccuuggccucccaaagugcugggauuacagccgugagccacuacucccagccucugaccaguguucuuaaccugguccguggaccuccagagaguccauguaccuccuagaguuacuucuaaaagcucugugagcauguguguguguguguguguguguguguauuuuuuuuccuggagagaggguucccagaacccucagacacagacaaaggggucaauaacccacuaaggauuaagaaucauuauucuaguccaagcauucaugugucaggcugcaaaaaacaauacccagggucacacagagccaagacucaauucaggaccguggauuccccuggucuagaaauuuucugcugugccagcccacaccaccccacuguccuuaccucgagugaauauuacauuugagucauuugcugggcccaaaccuaguuuccuugguauaauuuuaggauaauuguuuaaguggcaacuauucauucaguaaguaguaaguacuuauuguuugcuuguuucauuaugaaagaguggcacaugcucauuaaagauuuggaaaaaugaaagucaaaacaacaaaaucaccccgagucccaaccuucuguaacauaaccacucuuggcauuggcguguuccuuucuagucucucuguagacggggugugugaguguguggguuuaacuuugguuguccucaugcugcguauucaguuuuguauucugguccuuuguucauuuaacaucuuacaaguauuuguccauguuguaacaguaguguauuagcuuacacuccuugccuguucaaaaugucuuucaggcacagcacuggccuuuaagccugugucguagggauuuccagagaaugcucuguguauugaagcacagaagguguuucugugucucaguguguuucugucccuagguuuaaggcuucaugucauggaggagauuuuauagaugucaagcuaaugaccuuagaguuuuaaaaaauccgugaccguggccaggcgcaguggcucacgccuguaaucccagcacugugaggcugagaugggcgcaucgcaugaggucgggaguuugagaccagccuggccaacauggcgaaaccccgucucuacucaaaauacaaaaauuagccgggcaugauagcacgugccuguaaucccagcuacucgggaggcugaggcaggagacucgcuugaaccugggagguggagguugcagugagccgagaaugccacugcacuacagccugggcgacaaagugggacugucucaaaaaaaaaaaaaaaaaaaaaaaaaaaggaacccaugagcaggccagcuuucagucuggagccgagugccuucugugcauuuggauguuuccauuuccuucccugagaagauuuucuuaggcuaccuagugagagaacauugaaaauauuuuuaaaggacaucuaagcauuguuuuggucaugcauaugcuuuauaauuguguguuguuucauagcauauaccucugguacaggugggcaaguuuuucuuugaagaaauggguuauugacucauaugucauaaccuugaguguuacucucccgguguccagaggucacauucauguugcgggguugguaugaaauuaaaucuuggugaugugacccuacauucucuucuggucccuagaaucggcuucuggucuccugauaacugaaguggagacagaaguugagccuguugcccaggcaaacuaaagcugcuuuuguucuucggaaucugcuuugccuccgucagccugcuuccuuccccacacaugcuggccgcacuguccccacuccagaccucugcuguguguccugggcagggccgcguuuuggcaguacccuuucaacucauccuaagcuucguguagauuacuuuaguauauauuuuuuauaaaacauaaagccuuuccucucgauggaaaucaaagcuuaccaugugagcacucgaacuucuaaguugugacaggaauaacaaaacugcaaggaguggaaaagauggaaaagccugugggaaauccgaggccuuuugaaagaagggagcugaugacuucacgaccagcuccuggagccccuccuuucugcugaagccgcggcauuucccuccguggccacacgagggcacccuuggcccuuuuaucaaagcgccuucacuuccccgugggaauggagacaagucuguccacgguguuuucuugaaauacccaguugcuacccagauuuguauuuuuauguaaacaaauacauuuucacagaaauaaaauuugaaaaauaaaaguagaaagagaa

SEQ ID NO: 192268 - RNA, 43541 nt, Homo sapiens
aagauggcugcggagccgagcaccgggcaguggcugcggcggcggcggcggcggcgggccgggagcgcggcgggcgggggcuccgccuugcgcguggggcgcugagccgagaggcgcggaggcggcgagggcgcgggggcucugaggaccgcucggcgccgccuccugccacaccaugggcagcgcagaggacgcagucaaagagaaacugcuguggaacgugaagaaggagguaaagucgagucaagaaccccggggggcucgcgcccuggcccgcgcggcccagggggcagaaagguccgcgcccaccccccggcgcgggcacccgggccgaaccugggccgggcggggcggguccuggacgggcugcgccuccuuccccuuucucggaugggggagggcagcgccccucugcccgggggacccggccggcgcucccggcuuguuugcuucgcagccccgcagcuccccgcccagugacggcagcggcgcugggagcccaaggccgggggagggguggcggcgauggcggggauggcuggauccggagcugcccauucagugcccgcgccgccaggggagggggcggggccccgcgcgagcucccgcggcgcaggugggugucgugcgggccgagcuuccccacguccuaagugggugucgugcgggcugagcucccccuuguccgacguccgcugugccuccagcuacggagugaucgcugccggaggggugcgccgcacaccucaguuucucccuccacgcccaccuccuuagccagggaccaggggcuuguuuggaaugguuuuuaacacucggaaguuuuucccuuuugagggaagccccccuacuucagaaagagaaguaguccuucccucuacuaacuccguuuaccuugacccugcccaaaagcccauuuccauuucggguggggggcagugaccaugugaaugacucacucccauaugagagcuggagagcuccaacccacagcgcagcuuagaauacauugggccuccuuccccugccugccucuguggcuguugucugccugguaaguaaacuccaccagggcaggagacccucuguuuuguccacugccuuguauccagugccuggcauacuguaggcacuccgugacuguuugguaaauaaaugugcugauuuuggagacuucgaggccugguguuuggaaagcauacauuuuggaauagucuggaccuaauucugugugaccuugagucucuaugccgucucccuaauauauauauauauaaccucacgccuguaaucccagcacguugggaggccuagguggguggaucaccugagcucaggaguucgagaucagccuggccaauauagugaaaccccgucucuacuaaaaauaccaaaauaagccaggggugguggugcgugccuguaaucccagcuacccgggagacugaggcaggagaaucgcuggaaccugggagguggagauugcagugagccgauauugugccacugcacuccagccugggcgacagagugagacuccgucucaaaaaaaaaaaaguuuaccuuagcugagccguaauuagaguuucaggguuggggaagcgucuggacucucauaacauccuggaaaguggacaggcgcgguggcuuacgccuguaaucccagcacuuugggaggcugaggcggguagaucacgaggucaggaguuccagaccagccuggccaagauggugaaaccccaucucuacugaaaaaaacaaaaaauacaaaaauuagccaggcacaguggugggcaccuguaaucccagcuacucgggaggcuguggcaggagaaucgcuugaacccaggaggugugguugcagugagccaagaucgaaccacugcagucuagccugggcgacagagcaacucuccgucuaaaaaagaaagcugggcaugguggcucacgacuguaauccuagcacuuugggaggcugggacgggcggaucacgaggucaggagaucgagaccauccuggcuaacacggugaaaccucucucuacaaaaaauuagcugggcgugguggcgggcgaauguagucccagcuacuugggaggcaggagaauggcaugaacccgggaggcagagcuugcagugagcccagaucgugccacugcacuccagccugggcgacagagcaacacuccaucucaaaaaaaaaaaaaaaaaaagucccggaaaucucuagaugguucucaugcguuagccauggccuggcuacuaggcccuaauguuuguucccaccccuccccuugguaaagauguaguugaagccaucagcuuucccgcuugugggagaagcuucauuaugucuuugcugugaagaggcccaaaaaaggauuucuuaggccagggguguaucaagucagcauuuaagcccaauucugcucuccccaaugaaaagagaaaucuugauucuccugcaaaaggaagcagucuagugacagagacuugaacaguguaaacaaaauagaaaaguacuugugucuacacuugagguggauaugcugggauuauagauauggcucaauuuuggagguuagucacagauaaugggaaauacuuuuuuuuuuuuuuggagacggagucuugcucugucgccaggcuggagugcaguggugcgaucucagcucacugcaaccuccagcuccuggguucaagcgauuucccugccucagccucccaaguagcugggacuacaggcacaugccaccacacccagcuaauuuuucguauuuuaguagagaugggguuucaccauguuggccaggauagucucgaucuccugaccucgccuuggccucccaaggugcugggauuacaggcaugagccacugcgaccgccaggaaauauuuuuuaagaggaugaugacuuuuuccaccagugcuuagaaacuggacuauacugcuccaaaagugauuccuaagaaaaugugagaaaugucagaauaugccacagcuacguaucauuccugacaaaaguugaccugcucugaacucauguuucuccuuuccuccuucaguguuugauuucuuuuuuuuuuuuugagauggagucucgcucuguugcccaggcuggagugccguggcgccaucucagcucacugcaagcuccgccucccggguucacgccuuucuccugccucagccuucugaguagcugggacuacaggcgccugccaccacgcccggcuaauuuuuuguauuuuuaguagagacgggguuucaccauguuagccaggauggucucgaucuccugaccucgugauccgcccaccuuggccucccaaagugcugggauuauagucgugagccaccacgccuggcccaguguuuaauuucuacagaaacauccugucccuucugcaaggaaaaacaacaggaauauugguagaccaggcuggccuuucacaaaggaccacugguauaauucuagggguaucugcagauccuucaacccaaaaauccuccccaucagccugcuucagaugccuccaggucuuuagcugugacauuauccucuguugaaugcuaacauccuugggagguaaucuaggaaguuuuuuuuguuuguuuguuuguuuuuuugagauagaguuucacucuuguugcccaggcuggagugcgaucucagcucacugcaaccucugccuccggguucaagugauucuucugccucagccucuugaguagcugggauuacuggcacccaccaccaugcuuggcuaauuuuuguauuuuuaguagaaaugggguuucaccauuuuggucagccugauccucccaaagugcugggauuacaggcgugagccaccaugcccagccgucuaggaagcuuuuaacagcuuagagugcauuugcauuaauugaucugauccccuuuuaccugagcacuaaccauuagcaguuuccggcagggaggggccuccagguccuucuucccgccuccccaggcuuuugagguucuaccacccuccaaacuauacagucuugacuaagggucuugggaaccuggacagcaucagaacauuacauuccugucuaaagaauggggaagacuagcucuacccaaggcucacuuuauguguaacauucugcacuagguaaucucuauaaucuccaguacuaggacugccugcuagcagguucucccaggacaucaacagaguuuggguuaaauguugggaaccaccagaaccucauacaugggaguguaaagugguauaaccaacuuuggagaacaauuuggcaauaucuaauaaagugugugcaucagacauuccuugccuagaaacauaaaucccaaacauuuguucaccagaagacaguccucaauguucacagcagcaguauccauaacagccccaaacuggaaaccacccaaacgccggguguuuguacguucacaccacggagagugaacaaccuacaacuguacacaacgcgcacggagaaugaacaaucuacagcuauacacaacaugaacaaauuucagaaugacacaggugagcaaaagaaacuagucacaaaacacuacacgcugagugauuccacuuauaaaaaguauaaaaacccaggccgggugugguggcggcucacaccuguaaucccagcacuuugggaggccaacgcggguggaucaccgaggucaggaguucaagaccagccuggccaacauggagaaaccccgucucuacuaaaaauacaaaaaaaaaaaaaaaagccaggugugguggugcaugccuguaaucccggcuacuguggaggcugaggcaggagaaucucuugaacccgggaguuggagguugcagugagcugagaacgcgccacuucacuccagccugggcaaaagagcgaaacuccauuucagaaacaaacaaacaaaaaaaguauaaaaacccacaaaacugucguguuggaaucaggagaguggguacccuuagggggaauagugacuagaagggaaggugaugaggcgaggguguuggucacauguucuguuucuugcucuaguugcugauuucacaggaguguucaguuugugaaaauucaccacgcuguguaauugugauauguucuuuuauauguuuacugcacaucaguuaaaaagauuucuuuuuaagugcuuucuuaaagaaaugacugagcacaguggcucacgccuguaaucccagcacuuugggaggccgggcggguggaucaccugaggucaggcguucaagaccagccugaccaauauggugaaaccccaucguuacuaaaaauacaaaaauuagcagggcgugguggcaugcaccuguugucccagcuacucgggaggcugaggcaggagaaucgcuugaacccgggaggcagaggcugcagugagccgagaucacgccacuguacuccagccugggcaacagagcgagacuccaucucaaaaaaaaaugacuguuuaccuuacaagguauuugggaacuuuuacauccaggugggaaccccaaacaucagaguucuagacccuagauggaaagaaggcugggcuuuugagcauguagagggugucccugagguaugagaccuaccccuaaccuuggagaauagggagaaaaggaggaggggcagguuguuuaucugcaggcuguaccgagaugguuugucucuaaaggacaguauaucugcccagaagcccuucgugagcugagaacagaugagcaaacagcauccuauuccuguucuccaaggcagggcacuuccaccugggcuggaacaugcacugauuguuugauggguuuuuggcaucucuuucccugguuuccccuccaaaagacuggaaucagacugugcugaagaaacuuugcuuccccacaccuuucaucccugucaucucugcaagugucugaaagugcccuucagaccagaagggcggaaccaaacuauuuauuugcccagaggucuuugauaagggaaaauaauaaaagcagugaugcuguccauguguccgcaggugaagcaaaucauggaggaggcugucaccaggaaguuugugcaugaagacagcagccacaucauugcuuuauguggugagugagugacugaaggaugaugggaggucggucuagagccgaggacacuggccuggggccaggaaaagaugaguccucaggugcaguagcucucaaaucuggcugcaaguccaaaucaaccuggaagcuuuugaaauccucuuuggccccauuugcagaccuacuaaaucagguucuucaggggucaagaaucugcguauuuuuuguuccccaggauaguaauucucacauuuuagcauguaucagagucaccugaagggcuugguagaacacagauuucugggucccaacccuggaguuucugauucuaguaggucuggggaccccacuuugagagccgcugcccuaggucauuugaguucaggaaccagugcucugacugauuuugauuuugacuucagggagggguuugugcuuuucggaugcucugugccacuuucccuuuguuucccacccguguugcuccaugauccuaaccccaagcccuugacuggaugcaaaggagccugagcgugggcuaggagagguggcuaaggcuuccagccucagaagggacucucucaucaccuccuucucaguguggccaagccuuccagccccagaaaggagagagucgcuuauaaaccauuuccgccuccucagccugaagacuuuugcuuuguaggagcaagccuaucccuacgcacagacucuucuuggauuucuaggaauuucagcuuccucucaaccccccaucugaagggacagggaaccauucaccuucucuguguuguauuccuuggccucugagauugguguugggguuuguggagggaaaauaaugaaagaacagauaagggaagggaugcuuuggacgguaguguggcacagcagauacagcugcccuuccccucauccagcagcagauccccaccaagggcucaccaggugccagacaccguucaccgugcaaggaaauggcagugacaagauggacagagucucugccgcaggagcuuacauucuguuggggagacagacaggaaacaaaugcgcaaguaaauaugucauccaauaacuuggcaugugauaagagcuaggaagaaaaaacaugugggagggcagucggagaggcagccucugagcagagucugagugacagacugggguuugaauccuggcguccugccuuuuaagucgucuuggacaaguuucuuaacuucucucacccucaguuugcuccucuaaaaacagacugaugauucccaccucaaggaacuuucguggggauugagaugauguguguaaauguucauucguucguagcauuguaagcacucaaagaauauucgucucuccuccuuuggcuguugaggcugaagguagguuuguaggacuugaguucauaccauguccguuugggaagguuuccccaguucuuugagaugguggaauaaugauuccuagguuuacaagacacagccugaccucaguuuuucucagcagaaccuaugcucuggaaaaaaaaaaggcaugccaguauuaugauaagcaacuuugaagaguauuagaauucucggccgggcacaguggcucacgccuguaaucccagcacuuugggaggugaggcagguggaucaccugaggucaggaguucgagaccagccuggccaacuuggugaaaccccgucucuacuaaaaauacaaaaauuagcagggcgugguggcgggcgccuguaaucccagcacuuugggagguggaggugggcggaucacgaggucaggagaucgagaccauccuggcuaacacggugaaaccccgucucuacuaaaaauacaaaaaauuagccaggcgugguggcgggcgccuguagucccagcuacucaggaggcugaggcaggagaauggcgugaacccgggaggcggagcuugcagugagccaagaucgcgccacugcacuccagccugggugacagagcgagacucugucucaaaaaaaaaaaaaaaaaaaaauuccuacuuuuuaaauacugacagcuaauucccauuuaaaaaaaaauugugugggccacacaaaagacaucugccagccucugccagugugcagccucuguuuuggguucgguacagucacggagaacaggagcaggagagguuccaacaguaucgggcuaagucaggccaggguaucucagggccuacagacagagaaauccuuaugcuuugucaaaauuggugcucaguggugagcuaaaucccaauuugggcugaaacugaggcucguugaaagcauugauuaucaaccuuuuuccucugccugcaaagcagcuuccuugcauugcaugguggaaucacgagagacucuugcgggggacggggagggaagacuagcaagguauggaucaaaaacaccaccccucucugccuuuuuggagauucugaugugccagucucccucagucccuggaaaaaugcucugaaaugcauuuuuagucugaaguugauccagacuuaaacugugccuugcuacuguccuagccacguccgaauucagcuuuguugugggagaaaugggaguauagagaacgugcugagaggucaagagcagagugaagucuguggagacuggauuaccagccuagcgacaccacggucccuaguuucaagggacccuuguguacugggccccucaacuccacaccgacccaugguucuuggcagaggaggguugggggugacugaggagagccaggccuaggcaauacaagcuucucugagcuucuuagaaugcagacauuuaaacagaaaacacagagccuuccuggagagccuuccugaagaaucacugugucaagaccugaccaugggcaaacccaggaaaguuugcagccagauccccauuccuguuacccaacgggaggggcaagacuccuaggacuggcuagaaaauugcuuuguugaguguuugcugugguuguuccuaaaccugucuguccagaagcuggacaugcaguaggccccugcgaguagaaacuuuccuuguguggaaguuuucgcuggcaaaccagucuggcggcagcaggggggugggugggguucucugugugcuguucccaggcccgaggaucagaaccuauguaacugccaccuccgugccaguggaggguggcgcuaggagaauggacucaaaacuaccacuauggggccaggcauggugacucacaccugcaaucccagugcucugggaggcugaggcgggaggaucccuugagaccagaagcuugagaccagccugggcaauauuacaggaugcagucucuacaaaaaaauaaauaacucgcugggcaugguggugcacgccuguagucccagcuacuccagaggcugagguaggaggaucacuugagcccgggagguugaggcugcagugagcuaugauugcaccacugcccuccagcuugggcaacagagagagagagagacccugucucguuuguuuguuuauuuauuuauuuauuuagagacggagucucacucugcugcccaggcuggaguucuguggugcuaucucagcucacugcaaccuccgccucucagguucaagcaauucuccugccucagccuccugaguagcugggauuacaggugccugccaccacaccuagcuaauuuuuguauuuuuaguagagacagggguuucaccauguuggccaggcuggucucgaacuccugaccucaggugaucugcccaccuuggccucccaaagugcugggauuacaggugugaaccaucacacccggccucauuuuuuuuuuuuuuuuuuaaacaaaauccaaaaacuaccacuguuggggagaggucuuugauauauccuuuuauccuuuuuaucuuaaaacaucacaucaaguuuacauuuuucucuaucauaugguuuuuggauuuuuuuucauuuuaauauaaagacuuacuguugaauuaaaguauaggcugguaucuccugucgcccccuccccuggaggggaaggugcuuuuguuuuuucuuuuuuuuuuuuuccagaugaggucuugcuauguugccaagauuggucucaaacucgugggcuccagguaugcuccugccuuggcaucccaaguaacugggauuacaggugcauaccaccgcccgagguccauaguguuuuauuuacccuauuccgauugggcacugaguuugcauuuuaaccuuuggcugguagagcagguuucagaggcucacagagaggcuucuggccaggcagagcagguucucaggccaaucauaucucccaggaccucagccuccccaccccccagggauuggggcagacaccagccugccuccucagucaccagauucccugcccugcugugugcaagugggucaacaugaggguugcuucagacugaggaugagcuguaauucgagaaggguggaaucuguggagccgggaauaacaucaggcuuuauuaaccagcucccuguugcuaggcagcuuucauuagccaggaaggucugcccugcagugagcuccuucagggaauggcaaggagaugcuaauaagcugggagagaagccggugcuagggaaggcuugccucuccccugggauauugcagccagcgauauuucagcacauucugagauuuggacuccaggcagucuucagccugucucuuuucaguaaaagggauuccuggaggcugaggugggaggaucccuugcaggaguucgagaccagccugagcaaaaaagaccccaucgccacaaaaaggaggagcggguuccuccuccuucccacccacagggaaugaauagcucauucucuugcuaucuaacucgugccuuccaucuagaaaugaucuaagaggaaggagggagcucugaaggagcugacuccccucacucuaucuuggggcauugcggagggcauauggggauguucauagcugggacuuuggggucacacagaccuggguucacauccuggcugugccacgaaguguguagccgugcuuacucaucucugagccuaccccagaaggcagauguaaggaacagaagagcaaugcaggcaacacacacagcauggaucugaguaugcagaaggugcucaaucgcauucuacuuugguuuuuauuuuguuuuguuucguuuuguuugagauggagucucacucugucuccccgcuggagugcaguggugugaucauagcucacucagccucgaccuucuggguucaggcgauccucucacuucagccuccugaguagcugggucuacaggucuacgcgccaccacacucggcuacuuuuuuguauuuuuguagagacgggguuucgccauguugcccaggcuggucucaaacuccugaccucaagugaucuacccgccucggccucccaaagugcugggauuacaggcaugagccaccaccccaccccacaucugcuuuguuuuugaaagggagcauaggccgggcacaguggcucacgccugcaaucccagcacuuugggaggcucagcuggguggaucaccugaggucaggaguucgagaccagccuggccaaaauggcgaagccccaucuguacuaaaaauacaaaaauuagcugggcaucauggugcacgccuguaaucccagcucuuugggaggcugaggcaggagaaucacuugaaccugagagauggagguuucagugagcgagauugugcugcugcacuccagccugggcgacagagcgagacuuggucuaaaaaaaaaaagugaccuuacaaccuuuccuauaaagccuccucgagccuuccccaggauuccaucugggaaucuguguuucuggaaguuuggagcaucuggagaaucagaaauuugaacaucaggaacucaauaaggaaauuugauaauauaaaggaauuguuaccaauuuugucaguguaauagagguauaagugcauguuuuuaagaguccucuuucagagauaaauauauaugaugucuaaaauuugcuucagaauaauccagugguaggaaacaaugguugcaggcggaggagcugaagcaagauggucgugacuugaucauuguugaagcuggguaaugaguacaugggcagcuguuauacuguccccuuuuccuucuguauaugguuggaauuuucccuagugaaauguuuuguuuuuuuuuuuugagauggagucucccucugucgcccaggcuggagugcaauggagcggucuuggcucacugcaagcuccgccucccggguucacaccauucuccugccucagccucccaaguagcugggacuacaggcgcccaccaccacgcucggcuaauuuuuuguauuuuuaguagacaugggguuucaccguguuagccaggauggucucaaucuccugaccucgugauccgcccaccucggccucccaaagugcugggauuacaggcguaagccaccacgccuggccuaauuuuuguauuuuaguagagaugggauuucaccaugaugcccagacuggucucaaacuccugaccucaggugauccaccugccucggucucccaaagugcugggauuacaggugugagccacugcauuuggccuagaauguuuauauucacaugggaaguaucuaauagggaaaaauugcaggcauaaaaaagagaagagaaguuugcuggaggagcgucuuugaaaaggugcaagggagguggggugcgguggcucacaccuguaaucgcagcacuuugagaggccaaggcagguggaucaccugaggucaggaguucuagaccagccuggccaauauagugaaacccugucucuacaaaaaauacaaaaaugugccgggugugguggcgcacgucuauaauuccaacugcuggggaggcugaggcaggagaaucgcuugaacccaggugguggagguugcagugagccgagaccguaccacugcaccacuguacuccagccugggcgacagagugagacucugucucaaaaaaaacaaaaaaacaagacauaagaaauggugcaggggcagcacuccagccuccagcgugccgguggaaggugaccucagagacaaguccaacuagaccaucccuaggaacgagaggaaggcagggacugggcaugaggugcagggagggaaggcaccugcauucaucaguccccuucggugugguaggcaggggccgagaagccuuucacaccuugggauaugcuguuacuuuucaucacccagcauccauugagguagacccugauuuucucccuaauuacaucagaagcucagagagguuuagugacuugaccaaagucaaacagccaguaaggagaggagcccgugggcugggcgugguggcucacgccuguaaucccagcacuuugggaggcugaggaggguggaucacuugaggucaggaguucgagaccagccuggccaucaugguaaaaccccuucucuacuaaaaauacaaaaauuagccggccaugauggugggugccuguaaucccagcuacuugggaggcugaggcaggagaauugcuugaaccuggcaggcggagauugcaguaagccaagaucacgucacugcacuccgaccugggcaauagaucgagacucagucucaaaaaaaaaaaaaggagaggagcuaguguuugaacccaccucugucuugcuccagacucugugcugcccagggauuggucugccugugaggccuacccaggaguagagacuagaggggcggcggcauugaggaguuggcccucaugcagacgaagcucuggucauugaacugugggcuuaugguguccagagacacucuaggagacuguggcuuccuuacccagccagcugagugugcccacaucaguguccacugcaugagaggcuggcccuggccugguucccuggguagccgccaugagcacugugcaugcggacccugucuugcaucuccagcaggacaaggacaaugggauguguagcauggauuucauuucccccuccuugguucuagguucuggguucaggcgaucucucacuucagccuccugaguagcugggucugcaggucuacgcaccaccacgcucggcuacuuuuuuguauuuuuguagagacgggguuucgccauguugcccaggcuggucucaaacuccugaccucaagugaccuacccgccucaggacaguucuuuauccucccaaucagaguccaguugcgaauguugcuuucuuguuuuggggguugagcagggcugaaugccuuccaaaguugaagcaaacaaccaguaucaccagugcaggcugagagaaaaugcacccuaguuaccgcagaaacgcucaucugaguaaaggcagccacuacaaaucccuggguggaaauagccagggagagaagcggggaagagaggggcaggucacacuuggcgauggcccuucgcuccucucaccuugucuguggcagaugaaacacuggcuccuuccaccggcaguuggaguaaagauacuugaugcuucuucuccuucaguuguuacuugaaagaggcggguccucccacccauuccuuuaucuccaggaaggcugcuccucuccggcauuguugguuccaccauccagggaccugaaccacuggcccccaggcaggcauugggcuuuugaauucugcucuaauuagcgucucccaaagccccagguccagaauggacuaccugaggcuggcugcccugcuugcacuuccucgcuuggguucuguguggcagcgguggcugaacuccccugucgugcagauggcagcugguagcaaaaggugaaaccgggccggagguggggagcaagccacaccugccaacuugcuguccucccauucccaacuccgggcccagcaucucaggcccaguuucauguugaguugugcuaacucugucccuguaccucaagcaaacuaggcuaguccucugaaggccacugagugguucccacuguuaccaggcugggcuuguccaggcugcugagugcagcuuucaacguagauauauaugcacaugagagccaaggcagaaugcaggugcagagacccagcccugcuucugaggcucccugggcugacugaugacccuccuaaccacugcugcauuuucuuuuuuuuuuuuuuuuuuuuuuuuuuuugagacggagucucgcucugucgcccaggcuggagugcaguggcgcgaucucggcucacugcaagcucugccucccggguucacgccauucuccugccucagccucccgaguagcugggacuacaggcguccgccaccacgcccggcuaauuuuuuguauuuuuaguagagacgggguuucaccauguuagccaggauggucuggaucuccugaccucgugauccacccgccucggccucccaaagugcugggauuacaggcgugagccaccgcgcccggcccacugcugcauauucuagcagccgagcuauaguucauuucugugagcuccugagacaccuuagcuugucucagcccucuggaucguuucucuaaucccugccccgcucaggucaccugcugcugcccuaagcagagcccacaugcgcccccuaguggugggaaaccaaacgauuccacagauccuguuuguugagggaggaggugaaacgagaugcccacgggcgacccagccuuccuggguuuugugaauucugauucacaccuagauuggagagacucucuggcaucaucucaugaugggaacccuagugcuggucacccacucaauuauuauaauuaauuuugcauucauaauauauuuaacugguucaaaaaucaaaaccauauaaaaaggauacaguggggccgggcacauuggcucacaccuguaaucccagcaccuuggaaggcugagacgggcagauugcuugagcucaggaguucgagaccagccugggcaacauggugaaacccugucucuacuaaaaauuuuuaaaaauuagccaggcaugguagugcacgccugcagucccagcuacucagcaggcugagguaggaggaucacuugagccugggaggcagagguuacggugaacagagauugugcccacugcaguccagccugggugacagacugagacucugucuuuaaaaaaaaaagcgugcagugaaaagucucacuccuuucucugcucuuauucacccacuuccugucuauguacgagucccacacagguaaccacuuuuguuucucaugcauccuucuagagguuuucuuauguugguuuuuuguuuguuugguuguuuuuugagacaggguuucauucugucacccaggcuggagugcaauggugcaaucucagcucacugcaaccuccugggcugggcucaagcaauccucccaccuccaccuccugaguagcuagaauacaggcucaugucaccacacccagcuaguuuuuaaauuuuuuguagagauggggucucccuguguugccuaggcuggucucaaacuucugggcucaagugaucuucccaccuuggccucccaaacuguugggacuauagaugugagccacugcaccugaccuagaguuuuuuuguuuguuuuuuaguagagacgggguuucacuauguuacccaggauagucucaaucuccugaccucgugacccacccgccucggccucccaaagugcugggauuacaggcgugagccaccgcgcccagccaaguuuuuuauacuaauaaaaaagauuguauucuuuguucacaccucccuuuuuguaauuaaaaggugucaugcaauuauaccauucugcaucuugcuguuggcgagcuuuccauuauucauuccuagagagcauccucauucuuuuucagaguugcaugauauucugcuagagauguaccauauuuacuucaccuguccccuauugaugggcauguggaugacuuccagucuuuugcuguuauaacuaaauaaucacgcaguuauaucuguaggacggauucucagaagagggguuacuggaucagagguuauuugcagcauuaguggagagggccauauugcgucuauacggguugcagcaucuugccuaccuaccagcaauauaugaauggauucagcagcuccccacgucccuuccaucugugucuuccuggcgucuccucuacucuaaauugggucucuuggaauggugaaaucaguguguaaggguugggggcagggacccuauaucuuagaaugguggaaucgggguguaagcguuggggaagggaccccauaucuuagaaugguggaaucgggguguaagcguuggggaagggaccccauaucuuagaaugguggaaucgggguguaaggguugggggaagggaccccauaucuuagaaugguggaaucgggguguaaggguuggggaagggaccccauaucuuagaaugguggaaucgggguguaaggguugggggaagggaccccauaucuuagaaugguggaaucgggguguaaggguugggggcaggggccccauaucuuagaaugguggaaucgggguguaaggguugggggaagggaccccauaucuuagaaugguggaaucgggguguaaggguugggggcaggggccccauaucuuagaaugguggaaucgggguguaaggguugggggaaggggccccauaucuuagaaugguggaaucgggguguaagaguugggggaagggaccccauaucuuagaaugguggaaucgggguguaaggguuggggcaggggccccauaucuuagaaugguggaaucgggguguaagaguugggggaagggaccccauaucuuagaaugguggaaucgggguguaaggguuggggaagggaccccauaucuuagaaugguggaaucgggguguaaggguugggggaagggaccccauaucuuagaaugguagaaucgggguguaagaguugggggaagggaccccauaucuuagaaugguggaaucgggguguaaggguuggggaagggaccccauaucuuagaaugguggaaucgggguguaagaguugggggaagggaccccauaucuuagaaugguggaaucgggguguaaggguuggggaagggaccccauaucuuagaaugguggaaucgggguguaaggguugggggaagggaccccauaucuuagaaugguggaaucgggguguaaggguugggggaagggaccccauaucuuagaaugguggaaucgggguguaaggguuggggaagggaccccauaucuuagaaugguggaaucgggguguaaggguugggggaagggaccccauaucuuagaaugguagaaucgggguguaagaguugggggaagggaccccauaucuuagaaugguggaaucgggguguaaggguuggggaagggaccccauaucuuagaaugguggaaucgggguguaagaguugggggaagggaccccauaucuuagaaugguggaaucgggguguaaggguugggggaagggaccccauaucuuagaaugguggaaucgggguguaaggguuggggaagggaccccauaucuuagaaugguggaaucgggguguaagaguugggggaagggaccccauaucuuagaaugguggaaucgggguguaaggguuggggcaggggccccauaucuuagaaugguggaaucgggguguaagaguugggggaagggaccccauaucuuagaaugguggaaucgggguguaaggguugggggaagggaccccauaucuuagaaugguggaaucgggguguaaggguugggggcaggggccccauaucuuaaaaugguggaaucgggguguaaggguugggggaagggaccccauaucuuaaaaugguggaaucgggguguaaggguugggggaagggaccccauaucuuaaaaugguggaaucgggguguaaggguugggggaagggaccccauaucuuaaaaugguggaaucgggguguaaggauuggggaagggaccccauaucuuaaaaugguggaaucgggguguaaggguugggggaagggaccccauaucuuaaaaugguggaaucgggguguaaggauuggggaagggaccccauaucuuaaaaugguggaaucgggguguaaggguugggggaagggaccccauaucuuaaaaugguggaaucgggguguaaggauuggggaagggaccccauaucuuaaaaugguggaaucgggguguaaggauuggggaagggaucccauaucuuagaaugguggaaucgggguguaaggguugggggaagggaccccauaucuuagaaugguggaauugggguguaaggguuagggaagggaccccauaucuuagaaugguggaauugggguguaaggguuggggugcccauaggauuccaucagcaucuguggucuccagccguguguagcauuuguuaggcugcagaacuugauggcuuugaggucacaucggggcuggugaagggagccccagggcuagucugggucuguaguuccuggccuuucccugggaagauggcuccagaccuuuguagggguguccaacagugugcuggaguuaaaugcaguuaugcuccugcccacucagaguugcaguuccuugagccuugcugucagcaggaugggaugggcugacaggguagagaauguaccugggcucagcuggcccagacuccaaaggccaccagaaaaccagggugacaaaugcccaucauucaacgaguggauaaagaaacugauaaauacauacaguggaauacuacucagccauaaaaaggaauacauucauggcauucgcagcaaccuggaugggauuggagacuauuauucuuuuuauuuuauuuucuugagauggaguuuuugcucuugucacccaggcuggagugcaauggcgcgaucucaacucacugcaaccuuugcuucccagguucaagcaauucuucugccucaaccucccaaguagcugggacuacaggugcccaccacgacacccggcuaauuuuuguauuuuuagcagagacggaguuucaccauauuggccaggcugaucucgaacuccugaccucaggugauccgcccaccucgccucccaaagugcugggauuacaggugugagccaccaugcccagccacuaaagucauguuucucucuucuccauuuugauucauuugcccaaaccuuuccaugccaaccaguguugguuuuuauuaauuaguccacauuuuuucucauaugaaauaagccaaauaaugucagggucaucaccuugugguggugcacccaggguggccguagcuggugcugggacccacuggaucagggguccugaagccuucacaggugggagcccagggcccagacagcucagucagcaggcagguagguucagcuaaccuggugcuuuagcccugcaaguaucuccugccaccacccuccacccugggagguggggucacaguggggaccuggggaaggaaggaguaaggggaguaaggcccuggaguucugcuuggugcucugggccuccagucagaacgggggauaagcuugggccgucauguggacucucccuggggaaggguccuucaccgucccgugucugugagacacguccccggggaaggaggacacuguugcugccggcuuugcaggcaguucugagugugguauucacuagaugcgggauggcauguguuuaugucuccauguauguuucaauuagugacaaugccuggguuucugcucgacucagaagucucagagccaggcucaguggcucaagccuguaaugccggcgcuuuggaaggcugagguggaaggaucacuugagccaggcauuggagaccagccuaggcaacauagugagaccucagucucuacaaaaaauuuuuaaaaauuagccaagcuuagugacccaagccuguagucccagcugcuugagaggcugaggugggaggauggcuugaacccaggaggcugagacugcagugagcugugguugcaccguugcacgccagaccaggcaauagagugagacccggucucaaaaaaaacggcuucuuaaucuuuuuugggucagaagcugagaaccacagaccuacuauccaggaaaaaaagcacucuccuaaucauucuagagcaccucaacaauuugcauucaaauugcucccaauaucagggaggggcucuuuuuuguuguuguuguuguuuuuuuuuuuuuuuuuuuuugagacaaagucucgcuguguucccccaggcuggagugcaguggcgccaucucggcucacugcaaccucugccucccagguucaagugauucuccuaccucagccucccagguagcugggacuucaggugcccccuaccacgcccagcuaauuuuuuguauuuuuaguagagaugggauuucaccguguuagccaggauggucucaaucuccugaccucaugauccgccugccucggccucccaaagugcugggauuacaggcgugagccacggcgcccagacccagggagggaguuuuuggagccccagaagcccauucacaaaguccucucggggccauaguucucaaguaguggugucacuauuauuauuuugucugcacacugcacgcgauaacauauucaucacacgugcacacucucgguggggaacaccuugugggcauggcauaggacaagugcagugugaacaguuacuggccgggagcccacagagcugagucaguaaugccuggccuaauggccuaacuggucuuagcuuggaaagucgaugcaugagagggauuucuccuuccccagacacugccuggcaccuugccuggguugcacagaaggaaauuagggaccgugggguaaaggggggacugagcgugaugccuggcuucucucaguauuccuuaguugcaguaauugcuuaggaaugccuccucucacccgagagaaccccauggcugugcucagaggcuggccgggaagguaggcgaggccaccccgaugggagugcuggggccggccacuccccaguccccacggccuggcugcuuuugcggucgccuagggaagguggggaagcgaaugacucauuaucccggcaauuaaucacaccacugaggcaugugauccgugcaggacaugugccaccugcugccccucuguccuguucagugcugcuucucuccccacucugaaugggaagugcaaccccaggaaaugaucacccccuuuccacaggcacggaauuguagcugcagcagcccaggaccaagagacugggacaaaagggucauucgccuguauaucccagggccacacaagaccuccagggaccagggggaaugaucauggagaggagcauguggacgcuuaagccaaagauuuccccaugugggccgggcgcggugccucacgccuguaaucccagcacuuugagaggccgaggcgggcggaucacuugaggucaggaguucgagaccagccuggccaacguggcgaaaccccgucucuacuaaaauacaaaaauuagcugggcaugguggugugugccuguagucucagcuacucgggaggcugaggcgggagaaucaccugaaccacagaggucagcucucagcugcugugagcugagauuccacgauugcacuccagccugggcaucagagugggucccugucucaaaaauaaaaauaaaaaaaccuugacagaccucaauuucccugucuccacccacuucuggggcagccuuggaucgucucuccagugcacccucuuccugucccugucggggagagguccugcugaaagccagcucuuagaggcuagcuguagaacuguaucugaaccaacagggugaggagucaggaacugaccuagacccagcaccuccugagagccagaccccgcaugggugauuucacauccuccgucucaugugacaucucacacuagcccucuucccauuucacagaggauacaacugagucucagagcaagugaccgugccaagcucagacuuuguucugucugacugucuccagcacagcucacuguuuccaguccgugugaaaaaaccaccuccuucuccccucagugucccugcccccaaccagacacaccuggacguggcaaaaggggcucgggccgaggcuuggagcccuggguccucauccugguggcucugccauguugugacugugaucgaguuucuuccccucuuugggccuuucccuccucaccuguaaaacuguuaguuuggcccaaucauguagaagcuucuccgccccacacacauacacacuccugucuuuagagucugucugggcacagggcagcucccuacugucuccuaccaagcccuucuuuucuuccugcagggucugucuguggaaaguccagacagagacuaagccuaacccuaaaccaugaaugaauggagggaagcccuccuagcauggaaaagagaaaucucucccucagcugcugggcucaucaguccagcggccacugucggguccaagcucugcagugacuucaucaauauuuuagcuccugcagagcccuguuccuuagcaaccgcauccuccgugcccuccagaaaggcucccgagucggguguuccucacauccccguccuguaggugcugugccuugcugucagguuuggagccacucaugccacccugaauggggagcuuugguccucaugacccccaggggugaggcugcauauaggaggugugugcgcaccaggcgagggagagggacagcuuggcaugucaaagcucuucgccccgggcaggagccgagggacggggaggggaauuuuggaaggaagccaggguaucucccuggccugcccuuggcuugcccuuaccccuugccucaccacagguauggggaagaggagcuuuucuuccugcucccccgucuuucccaggcucagaugccguuucccuuuguggccuaggugcaguggaggcuugccucuugcaucagcugagacgccgugccgcuggcuuccugcgcagugacaagauggcagcccuguucaccaagguggggaagacgugcccaguggcgggggagauuugccacaagguacaggagcugcagcaacaagcagagggcaggugagcccugggccagccccuucuucccuccuuucagcucuucccacuuggcaauugcuacuuccuaggacacccaucggaaaguuggcauccugggccuguuccuugcagggccucugggugagggaucagcuugagggaggggauugguuccuugugggcacaaggcucuguaccccuccuucaccucccaaccccagucaguucucugugcucccaucuugggguaccaagccccacucccaaugccagcauucugggguuuaccccuagaccacugcacuccuggagcccuccccgccuuugcaggaaacccucaggggucagccaggaggcccugcggagacagggcucagccagcgggaaggccccggcccucagcccucaggccuugaaacacguauggguacgcacggcgcucaucgagaaaguucuggacaaggucgugcaauaccuggcggaaaacugcaggugaccgccccguuccccaaaaacugcaggugaccaccccguuccccccaaaacugcaggugaccgccccguuccccaaaaacugcaggugaccgccccguuccccaaaaacugcaggugaccgccccguuccccccaaaacugcaggugaccgccccguucccaaaaacugcaggugaccgccccguuccccaaaaacugcaggugaccgccccguuccccaaaaacugcaggugaccgccccguuccccaaaaacugcaggugaccgccucguuccccaagcagccccucccuugacccgucucccgacgucccucagccccagcccucaggaugcuugccuguccgugacagccuguaggcaacccuccaucuccccguccccuucggugcccucaaggcauuggccauaccaggcaccucacgaagcccagucccuaaggacucacuguuucuugaugacugaucugaaucuggucuuuguggggaugucccuaccuggugagcuugacugcccuggaaugagccccggagccucggcagucacacugucugucuccuggcagcaaguacuacgagaaggaggcacugcuggcagacccuguguucggcccgauccuggccucucuucuaggugagccugagagcacaggcacaguggguacggggcaggugcugagggagcaucgucugggcuggcugucucugucuccacagugggacccugugccuuggaauacacuaagcucaagacagccgaucacuacuggacugaccccucugcugaugagcugguccagcggcaccgcauccgggguccaccuacucgccaggacuccccugcaaagcgcccagcccuggggguaggugcccccuccccacccuuugggcucaucugggcuaugcccaugggccuguagggacgggaaaccggccucucuacgggacaggccuuggagaugccccaagguagcggcugccucagaagagccuucuccgcacaauaaaacuuaacacaaaugccgggagcccaugcugguccguggcuggagagcagaggguggcugggaguaaaccggggcaggaaggaccccuggggucagcuggagagggucagcauggaagcgugaggguucccaagccuugaggccaguuucccaaggcuggaggcugagccccggccuuccacacagauccggaaacggcacucaagcggcagcgcgucggaggacaggcuggcugccugugcccgcgaguguguggagucccugcaccagaacucacggacgcggcugcucuauggcaagaaccacgugcuggugcagccgguaggaaagcuucauccugccaucccuccccgaagguccccgaacgagacgacuggaagccucuagccauggcuauuccuuuccugaggagcuugaccagagacgggggggagaauggccccagccucccaacucccuguuucacacgacucacgcccagccuuuaguuggcaggggacaggaauggcagccagcaggcgaggggaguccgcaguguggguauggcuggccuggaauggaccuggcauccaggaggcuggcaggagagagucaguggcaccaggcugaccagggaaacugaguccuguuuuccugugcuucugccccgucccuaguccaggaccccgugacuagccuagcuuggccuccccuccucccagcgggagcucauuucucauaggccaucccugagagccucucagcccuucaucgucggucuuccggugucucccgcuguagaaggaggauauggaggcggucccuggcuaccucucccugcaccagucugcagagagccugacucugaaguggacccccaaccagcucaugaaugggacucugggggacuccgagcuggaaaagaggugggggcuuugggacucaaucccaggagccagggcagggaguggguuugaccucaggcagagggauggagaaaccccgcuugcuccaggaggccaaccucacucuuuauuuggacgccaagaauagcagggagcggcugccuggagugauucccaagcucucuaggacggagccaagccuggccgugaagagguuugucugagccaagcucucagcggcugagacggacagcuguccaugugccgagcgggcagcacagaucucaggggucauggcuggcugugugcaccucuuggcuauggucauccuaucuucaggggaguuucguggggugguaggaccaggagacaaggaaggaaggaaggauggcaggucuuuggacacagugacagcagucugguuccuuucuagcguuuacugggacuaugcccucguggugcccuucagccaggucgugugcauccacugccaccagcaaaguaagccugccuuguccucggcucgggugggaagggagaggcugccuucugccagcugugcacugugcguggggccuguaagacuccucguccuccucccauccuuguuaauggggcucccaggccaugcuguagcccagccaucugccuccuacccagccugggggcacuggccagcagggugugauagccgacgagagggccucagccgcacucuccacguucacccccagagagcgguggcacgcuugugcuggugagccaggauggcauccagaggccgccgcugcauuucccacagggaggacaccugcuguccuuucuguccugucuggagaaugggcugcugccucggggacagcuagagcccccgcuguggacccagcaagggaagguaacucgggugggaggcuuuaggggaagggcugugugugggguucucugcccgccucccuuccuuccccacguggaguucuuaggagcggccuuguguggaacccuggaugagacucugcccuauacagcccgaccaccuaccccuccuuccacaggggaaaguguuccccaagcuacggaaacgaagcagcauucgcuccguggauauggaggagaugggcacggggcgggccaccgacuauguguuccggaucaucuaccccggccacaggcacgagcacagugagugucccgagcuucaucccgggggaggagaggaagacgcucugggaggcggggagcgcagcgucacccaggagggcagcaggcagggcccacugaccaggccagguuaacaccagaggcucaucgccuagccucucagcuggaccuuuuacccacagauauugccuuugaaaaggugcgucucuucuacccagcucccuuccccacuucuccacgccaggacucuuggcucagcagaccuaggcgucacuacacaagacucuuaguuauccuuucagacccuguccagggguaaaacacguggagaaacgagaaguagaagguggggaacccuccauugcucuucaccuccugcuccccaaccccuacaagacagccuggguaugggaccagcgcuacuuuuuuuuuuuuuuuuuuuuugagacgacgucucgcucuuuuacccaggcuggaguuuaauggcgugaucucagcucacugcaaccucugccccuggguucaagcgauccuccuaccucagccuccugaguagcugggauuacaggcgcacaccuccaugcccggcuaauuuuuguauuuuuaguagagaugggguuucaccauauuggccaggcuggucucaaacuccugaccuugugaucugccugccucagccucccaaagugcuaggguuacaggcgugaccacugcgcccggcccagcgcuucuuuuuggauggugaauauugucugcugacuccccuagagccagagcccuccucaaaccaacuacugaugagcguuagcugaaguagcagguugcaucagaggcagacucggggcugccugggggcuuugggcacuggcggguagaaaggcggcuuggcccuuguggguccugccccacccuggacacacaccccugggcccaagggggucucucugucuaugugcaucuaccaacaccaaaguucccuuucuggucagagugcugcugcugcccauaggcuucucugggcagacuugcuuuucuuacagauaaggucggggaauuugccagcccagagcguuuauugcuaacaagaccacccgcucccuaaauuuccaacuugugccaaaaaguugucaacaaguugucucuguauuagggaccggacugcccagacggcacacucagccacagcacagauagcuccaccaggcucagagggcacacggcacagggauguccccccuucccagauguaccugacaaagagacgcaucuuuggccagaauguauuuacacacuuggcacuuagucucaggcuguugcuugguuuagcuucuccagucucugccuccccucuucgaucuuugccauuucccaguccuggucacuucacuuccaggaccaccucgccaagggcaagccagggcacccagaggcugaaacuccaccaagcgacuccagcuccuugaggacagcucugggaaaacccuuuccuuuuccugggagggaagaagguggaauuuauagucugaaaaaggggauuuggaguaaucuucagauuugguccagccugagaggagcuagagaacgaucaggacccaucugccagcugucaugcgcagccucugugagggccgaugaccuccugggcugccagcccaucccagacagucccggucuuucacauccucccaccucuguucucucucuucuguucuuccuagagaggcugccuccgaagagugagguucugcagcugccccagccccucgccuccuuccacacucucccaggaaaaucauccaaagagcuuucugguccccucccuuccccucuucugugcccugcagauucacgaugaccccggccuccauuccacuccccuuaaggagggaguccguccugcccagggaugagggccucaugccucugccucucgcuguucucuuugagcagucacuauuaacuaccaccaccuagcggccagccgcgcggccucgguggacgaugaugaggaagaggaggauaaacugcacgcgaugcucucaaugaucugcucgcggaaccucacagcucccaauccgaugaaagguucuuaucccucccucucccugacccaccucauccccacccucccucccgggcccgccugccacccaccacagggguucgaacggcaguguuggcauuaggggacuugcacccagggcaguucccuuccaucgggggcagaucagggagggcagaaggaggccagacaggugcuggcaagaaaaggggcuggcccagggcagguggcuccaggcugugaggaggaagaggauuugcuaauaggaaggucugauuaucugauugccuccugggcacccugaauggaucucugagcccauuccuacuccgggggucaggcuggcaaaugccagacagaggucucuuccuuucucucugcugauugggaagaccagccucugggccuggugcuucugacuccugacuuaacagaaacaggauggagguaccggguccuuccuggggcaggggcagcagcugugggucaggcgagggguugagggcugccaugcgaagggccccagggcucagucuucccaggaggccugagggccccagccggcagggccugguacuuuggcaugaaaucuagaaauagcugcagcaugguguccaggaaggggccaggcucagggccuggcaacaugaacucccgccccagauaugccccugguucacugugugguuuugagcaaguuucucacuaucccggagcuccgucucuucaccugcgccagggauauaagacagauguguuccugcccucaugagucucaggguccacgaauggagaggucaccuuuguuggaggugauagcguagugcccucagccucucaggguuccucugccuaccacccaucuuuccuagcacagagcuggcuugguagagagggagccccccucuuuucagcaagcaaucagccaggcgaccugugagggcugggaugggugcuccagaaagggguggguaggaagaggcugaggccaguucucccagagacgaggggagcuuccccauucccacccauucccaugcuacaaaaucaauugcuucucccuuuccccgccccugcagaggauguccucagaauaugucacacuccccuuaggcuuccaaaguucugccgggaagcccaguuccuuagccggccacugauccaguaacugucuccgggcaggcaggacggccuggucuguguuagaacacacccagcacacccucugcacaagcugccagcugcccuccuacugccaggcgccugcccucaugcccacccucccucccagcccuuccaauaugagcccguaggccaggccuaggugggaacauccuacuucugauguuuauugccuacacacaccccugccaucugguuucuugcaaaccuggacuuggggcuguugccuauuuacagugaacugacugagcagugugggaagguugagcucugaggggacccacggagcuacuucuucccccacgaacugguagucaggcuagaggcuggaggguccuagcagagcccuuggcagacucggugauaaaaagccuaucccugacuagucuuagggcugaggccuccgggaucagagaaacuuccagacccacuuccagggguccagaggccucagggcucaucugugcauccucucaaggaacucaggggcuaggccaaccuaguauagagcuucugggccccuaauacuugggaaaggagaggaggcauaagagcagaaucagcaggcgguuggggagagggcuggggaaugggggccccccaccuccacuccaguccauaaugacaacacuguugaguccguucugccagcuguugcuuuucaggccugcaacaugcuugacuugugcaugugaaucaguggcgggguguccaaauuuccucucccucccucuuccucuccccuuccuuuuccugcugccuccccacagagcagaugcuauucacucuaauucugcuccaggccaggcaccuuucacucggagucuuaggggcugugggguucgcccacccuguuuucuugcuuuacacuuuccucaugcucagaggagagagucagagucaaagcugacccagcagaccccccuccccccguccagccugugcccucacccagucacgccauagccccagcuaucugcacugggcucgcucagagacaguguucgaauguggcugguucagcuccuuccuggaggauuaaggugaagagcauuggcccaggagaccuuggcugggccuccuuucugggcaugagcuugguucccuuugcccacccccgcccucaccccuguugcccucccugccugcccgccuguugccugcugccugccuggcugggccucuucccaccccggcuccucccgggacuguccucuucucuccugccugcugcaggggccugagcugggcuccugccccacugcaccugcacccuccccuucuucccagagucucaggcauggcuugcaacgcccucacucccagagccgcagccccuccucaccacgcguguucccuuaauuugccuccugguggagcugaagggccagauaucugcaaaacucccggccgugggucugggaagagagccccggccaaggcagggcaaccgcugagggaaccggaaggggcucagcucagcccuccucaccaaggcacacccagagcuggaguccagcucccaccaaagccaggcccacgccugcggcaggccacagugggccccggcccaggcugagccagccgagcaaacugcugcugacaggacucccucagcacacacggcucuccaucccuguucuuccgaacucuucuccacucucucccucccucccggcaucaccccccagugcuuccacuuccucucucacuuugcuucaugucuguggcucccuggaccugccagagucccccuuaagcagugcccugccccacgugggccguggaagcucucgagggucuugaguucugauucagaccgccugggcuggcugggcaggcccugucgcuggcagcguagcugugucuaaggagucaucuucugaggcugcaacugggccuguucuucucugucacauuggauagugggccucugugcccagccaccacucccggccccgcaguggccucguaguccugggaccugugacuuccauccagcucccugguguuuucgggaggccaccaugcuaacugcugucaggcuaggcagggauggagcagagcucagaaaggggccauaggagcugacagcagggguaccuggccugggcacggggcacugcucauccguagccacuggccaccagaucuagacucccccagaagagccaggccuacgggcaggugacucagauuccucgggggcuuugaacaguggggacucccuggaggggagcguucagaguuggaaguauuccaaagaccuccuugagcaucucagaguuugccaagaggaccgagcugaauccgugaaggcugagcuagcugguggcuuugaggagcucaggucuuuguuccuucucuuucuuucccuucccucuagaaaagcaagugcuugcuggucgcaggauagagcuaggcacaaucauccaagacucaguccaagcauuuuaccacaugcagaaggacgccuugcgccccucuccaggcuugcuggaggcuaggaagugucaggcgcccucucucccuaccguuuccaucucugggcucuggaccaggcaggccccaccucugugauuuuccacccaugggugacuugaugcugcagcucugggcacagaggugggcauggugcagggugccugggagagaaggugucucaggcccugaccaugccacccuuccugcccgcagacgcuggugacaugaucgagaugcagggcuuugggcccagccugccagccuggcaccuggagccccugugcagucagggcuccuccugccucuccugcuccuccagcagcuccccacaugcaacccccagccacuguagcugcauccccgaccggugagugggcagcgcucggccccagcuucccguuagcguguccagccacguguguguccgucuguccuuaaaggccgugucaccugcacgacaggguggccucuagagugggacagaucuggguucaaauuucacuuuugcuacccacgugacuuacaaguuauggaauuaccaugagccucuacguuucugaaccucaguuuccucaucuguaaaauggggaugaugccacuugcugccugcaguacuuaugaggacagaaugagagagaacccaagugaagguccggaguugugccggcacaucaugggcucagugcccgugagcuccccuucccgaugugcacacagacccugcugacaggccguccaccugaggacacucagcagccaccugccgugugccagggcagugagugaauggcuuuuaugggagguguucucuuuuaccuuuacuucgucuuccguuuauuaauccugaugauccuccgcugccucucuccauuuuucacaugaggaaacgaagauucauguaggugaaguucguugaccaagaucccugggugguugggggccaggcgggggccccacagcacucuguccagguggcaggcagggacagggcacccacugacggcugcugggcugcggcuccuccuccucgcacccuccccagugccuuaccugccccccaggacagagccuccucccuucucucucuccucccaccagaggggccgcagccccucccugcugagcccgguuguugccacagguugccgcucaggcuacugugugagaguaugaagaggcagaucgugucccgggccuucuacggcugugaguguggggcgcgccgggcuguggcgggcugggggcgggcggcccugggucccagccuccugcugcccaccgcugcccaccgcagggcuggcacacugccgccaccuguccacggugcggacccaccugucggcgcuggugcaccauagcguuaucccaccugaccggcccccgggggccuccgcgggccucaccaaggacguguggagcaaguaucagaaggacaaaaaggugccaacccugggguuccagggccacaggucgaggggcuggggcgggcaggagugagggcuucaggguaaaaugugccagugggugcgguugacaggccagggccgaugccacggagugaccagggucccggcagaaucucuugcagcugggccuggggcugacacgggaagggggcuggacugggaagccguccugccuccacaucgcccugugacccuggacaaagcuuugccucucuccgggcgccauuuccugccccuuaaggaaggagagcagaacgagaucucaucccacugugagcuggggcacgggaggacguggccaccccaaagcaggccuugccugggcuucagcagucacuacaggccccgccccagcccauucuccgugggauggggcucacccagcugggccacggugacuguggaggcugcacagucuugacuccccgggucccucagaacuacaaagagcuggagcugcugcggcaaguuuacuacggaggcauagagcacgagauccgcaaggacgucuggcccuuucugcuuggccacuacaaguucggcaugagcaagaaggagauggagcaggugaggggagccuguucccauggggcugaugagauggggagcugggccaggggacgccagggaggggaccuuggaagccucagccccuucccagccggaaagaagcauggcagggcagcuccaccguccuuacccugaggcccgucuugagucugagacucaggacccaagguccagugcaggcccagcuccugaaggggagggccuggugcacgcuucccccauggucgugguguggucugaguacagguggacgcagugguggcagcaagguaccagcagguguuggcagaguggaaggccugcgaggugguggugaggcagcgggagcgggaggcccacccagccacacgcaccaaguucuccucaggcagcagcaucgacagccacgugcagcgccucauccaccgagacuccaccaucagcaacgaugugagccagacgggaccuggaggguugggggucucgggggccacccgcguuuuaugcacagugguccugagcaccagccugaccucugggaacugguggggcccugcgagaaaggccuaaggugccugugucucauuuucuccaacuggaaauggcuaacugugccucugcugccuacuucucuggguauuguaggaauaaagugagagagugcauugugcucaguuuuagccaacuauagggaaagauggacuuacugggauuuagggaagcccuccuccuuguagaaagaccucaaagcuagcaacaggcagcgcuggguucuagucccagauccacuacugacaagcugaaugucucugggcaagcacuucccgucucugggucucaguuuccccucuccacccauauccucugacugcagaggcuuccugagaucugugggccugagaauaggggagcccguagagcagccccauuggugucgacuggcgagauccuuccuccccgcgauguugccugucacuguacagaacugacuauggcaggcuuguucggagcacgggaggguagcucuuucuggcaucacuccugccuuuugaacagcaaguucuaaacugugacugccuggcccaaccaacacugauaaguuucaauuuuaaggacgcuuuauuaauuuuucuuuaaaauugccucuuuagauaauguguauucuuguuacuuuacuaaauccuuaccaacauuaacagaaaauguaaguugaaguaaguuaaauauaacuggcugggugugauggcucaugccuguaauuccaacacuuugggaggcagaggugggaggauugcuucaguucaagaguuugagaccagccuggguaacauggcgaaacccugucuuuacaaaaaaugcaaaccuuugccgcauguguuggggugcgccuguagucccagcuucucgggaggcugagguggggggaccaccugagccauggagguugaggcugcagugagccgugauaccaccacuguacucuagccugggccauagagugagacacccugccucagaaauaaaauaaaaaaaaagaaauagaacaaacaaggcacauugucauuucccacgugcuuuguucuuaauccccuauccaggaacacauucucccucucucuggcuuuggguuuuguaaaaaucugucugugccagugcccagcugcugagcucauggacagcaguagcuccucgcuggcguauuagauugccacagaaccguggccuuacccagcacuucaugcuuccugcccaaaguagaaacuacuuuuagcauugcuuucccuacguggugaaaacagagagagaaaaaucccaaacagucucuguaugugucucuucuuuuccucgugccuuguccauggugguggacuguaucuaggaggcagaauguuugcuuuuccuuccuacaucuccccaccuugccugagggcuaauggaacugacuaggugcuugcuacagaacguuccugucuuguccugcugaacacucaguacugaaaauaaggcaaaacuuguuuuuccuaaaaccucuaggcuucucuccacccagccacaccaaaacacuaaggccauucucccggucucaugacuucaggcguuucuagaaugagacugaguucaaacuggccauugagcguucagcccccuggcuccccuacuucccuucaguagccacaggaagaccuggggcuguuccuucaagcagggcugaagacgugucuucauguuuggccagaggcuuguuucucuccgccuggcuggcugggucagaagcuggcuuggugccccguggccacaguguuggaggcuguggugggagagggggugugaagaguuuugcauuccagcucccuucuggcccgaggaggcggugggcugcgggaaggugcuggagugcagguggagccgcccuguguucaccccccagguguuuaucucaguggaugaucuggaacccccggagccccaggacccugaagauuccagaccaaaaccugagcaggaagcaggacccgggacuccgggcaccgccgugguggagcagcagcauuccguggaguucgacucuccagacucaggacugcccuccucucgcaauuacuccguggccucgggcauccagucaagccuagaugaggggcagagcgugggcuucgaagaggaggacggcgguggggaggaaggcuccagugggcccggcccugcagcucacacuuugagggagccccaggaucccagccaggagaagccucaggccggagaacuggaggccggagaggagcuugcggcugugugugcggcugccuacacugugcguacaugcuccccaggcuguucccagccgccccagaggcccuccugacaucccagagcuggggaagcgcuggugggguggaaggcggggcgcccugacugcccuggaagggaguucugagcccauuucucagcauccccacaggacucgcucuggucucuggguuccguuuugcugcauuucuuggggcgucaccuccugcccccagccugggaagggcugcccggucucaugccugagggcccuccacucuuccagauagaauuacuggacacuguggccuuaaaccugcaccgcauagacaaggaugugcagaggugugaccgcaacuacugguacuucacgccccccaaccucgagaggcucagagacgucaugugcaggugccuuguggggcggggcucagggugggaggcgggacccugccgccaguuacucugugaagaugagguccggaaggugcccugcuccucucuccugcuccugaaucacacuuggcucccccugccuggaacgcuuuuuuccugcacaccccucccccgcgccucuucauucuuaggggccuaccagaccuccacuucagccacaccucuucaggaagcuuucccucauccccgcacccccgccccacauaccaagcgugacggccuuggcucucccuaagucggagugccuugggggggacccguggguuguuccccguugucucccuguggggggugcacaguacaugccuuagggucguggaaaggcugacuucugggcggcagguggcucuggaggacgucuucccagggaucccgagggagggaagaauggggcacagccacagugacucucccccugccuuucagcuacgugugggagcaccuggacgugggcuaugugcagggcaugugcgaucugcuggcgccucuccuggucacccucgacaauggugagggauggcgggacaugggacugggcugcguaagcuggagaaaggacgagaggguggccaggucuggaggggugggaaugggagccggcucuguccccugcgucuccugcccugccagcuucacuccugucuccccucagaucagcuggccuacagcugcuucagccaccucaugaagaggaugagccagaacuuccccaacgggggugccauggacacccacuuugccaacaugcgcucccucauccaggugaggccgguugccacccaugggcaugggagcaggcagugcugggcugguccaucguccacauggcuagggagcauuccacaaacauacuugacauagaaacuuaacuucuuucauuuuaaaagacaugguuucagcagggcaacguggcucaggccugucaucccagcaauuuaggaggccgaggcaggcggaucacgaagucaggaguuugagaccagccuggccaacaucgugaaaccccaucucuacuaaaaauacaaaaauuagccgggcgugguggcacacaccuguagucccagcuacucgggaggcugaggcaggagaaucacuugaacccgggagguggagguugcagugagccgagaucacaccacugcacuccagccugggugacagagcgagacucugucucaaaaaaaaaaaaaaaaaccaugguuucagcguuagaaauugaggaggagugugugugugugugaaugcucgugcccaugaaaguucuggcgaacaguagggguugcugaugacaucagacacccagaaaauccuauaacccuaaaaauaaugcagcucagagagaugggugaugggaggggcagcaggagcaacccacccuccacaaggagauccgagggggagagagugcaccgcgcagcacagggcaacagacagacccacugccagguuggggaucgccugcaucccugggcgugagcggacggugaguggcggccagaggcagcaucggcucagggcucagccucucucccuuuucccacccacauaagauccuggacucagagcuguuugagcugaugcaucagaauggagacuacacccacuucuacuucuguuaucgcugguuccugcuggauuuuaagagagguaagaaguggguuggaucauggggcugaggucagggacagugagagaucccucuucccccaagccaacaguucucaauccuaacuggaccuuggaaccaccuggggagcuuuaaaaccugccagaacccuggccccacccagcccagacucaugaacuguggcugccugggccuauggguucuuaaaugcucgcugaccagacacaguggcucacgccuguaaacccagcacuuugggaagucaaggugagaggaucgcuugcacccaggaucuugagacuagccugggcaacauagcgagacccugucuuuaauuuuuaaaaaagaaagaaaaaaugaggcugggugcgguggcucaugccuguaaucccagcacuuugggaggccaaggcaagcaaaucacuugaggucagggguuugaggccagccuggccaacauggugaaacuccgucucuacuaaaaauacaaaaaucagccgggcaugguggcgggugccuguaguggaggcaagguuauggugagcugagauugugccacugcacuccagccugggcaacagagccagacugugucucaaaaaaaaaaaaagaaaagaaaagaaaaaauugaaaagaaaacaaaauuuccauaggugauuccgaagugccacuaggguugacaguuacaacucucauagaucauaguuuggggaacuuuuuucaaaccaaagcauuccugagcaccaagaugggaggccugugacagcugcccggcugaagugcaggcagagucugcaggaacccagugugcagaaauuacccaagaaaaggauggggccuugguacgggguacagaacccccauuccugagccaggcucugugucauggagagaaucccacgacuuuggccccugaagcucugaucccucaccuggcuccauuuagaggccugugagcagccaguccggccagcaucagccccagccccagccucagccucagccucagccccagccucaaucccagccucagccucaaucccagccucagccccagauaugcggcuaggacgggugagcagcagccgcuuacucuccgcagaacugcuguaugaggauguguuugcugugugggaggugaucugggcagccaggcacaucucaucggagcacuuuguccuguucaucgcccucgcccugguggaggccuaccgagagaucauccgugacaacaacauggacuucacugacaucaucaaguuuuucaaugguacgagcugguccagccauccaggcugcccugagcagagguguggaggcccccaccucugccccgcacacagcuggaggguucucaggaauccugggggcccuuccccaaaggccgggaugucaagaaucuagcagagcagauggaaacagagcaggguagucagccaccuccuagccugcugcccuuucucugggccucucuacagcucuucacguuuccccccagaacgugcugagcaucacgaugcccaggagauccugcggauugcccgggaccucguccacaaggugcagaugcucauagagaacaagugagcuggggccaggaggcagcagccgugcagagccugggcuccggcagggagaggugcaggggagucaccgcccagaccuccccagccaccaaccgaccccaccucuguuccuaacaaagcgguugugagccuggauccgacucccggcagugcugacccugcagggcaagucaggggccaggaugcccucggaucagggccgggaugggaggggucagccucagggagcagcugccuugggggacacaccuacucugcuccccucucacacaucugggaguagccccacugccaccugcagccgcagccuggacugcugcccacgagugaaccuggggccccacaggauuaacaggggcuauagcggccugggcccuacucagcugggguggcagagggcgagaggcucugugcugugucccuucugagggucccuuugcagucccaguauauugugcgugcaccagccccagcuggagcaaccaaaacugcuucugguuuaggcacacgucacgggugcgggagacccgggcacgggagacccgggccgccuucaggccgcucccccgagauucuggggcagucggaagaugugggcccugggugggagcagcccacuucagcagcacugccacugccuuuggccaccugaggugacccccaggccuccccggccuuguacaguguaccucuguguaucuguacagccucgcuccugccaccccacccuugcguucugcauuagguacuucccugaaaaccacguguaagaagugaugcuuuugccaguggaugaucuggaaugcgaccggagcacuugcucugaggaaucccagggugacucugucggggaagaauccggucacagccuccccucagagacaggccucaguucgagggcagcccauuaucugucgcagacaucugccaugucccugagacugcgggaggcaggggaugcauggguguccccaucugucccuggugagaagcaaggcuagcucugccuuccacaugcuucucaggaugccaagaggccuaggaacccagaaacccccuuggaggagcuguguaugcgggggugccaggaagggcauagcuccugcccccaggccuaggcaugcugcuugcucggccauccccacuuccuccucuaccccaacacaugcaggcuaggccuugcccuggaacauggaggcccugcccggggcuggggccuaguccagcagccaccaaagucuggcagacuuucugcauuugagaaacaugacaaagggccccgcagcccuucugcacccagcacagccugcccagcccagcccugcccccgggcacugcacagccugucugggggccagaccaccccauuguccauccuuguuguccgugaguccuuggccuccaccaagcacguguggccauugugugccugccuuagugacuccgugguuuugugaggagcagaguguguaugauuuuugccucagaaacuauacucuucuguguaacagaccaauaaacaacauuugucaaca

SEQ ID NO: 192269 - RNA, 50347 nt, Homo sapiens
cuggcgcgggacgccggacgcggugcggggcggagcggggcgccaaggggcgcgccaggagcugcgcgggcgcugggagggagaccagggcgcaguuccgggcgcgucugagcgguucucgaggcguucucgccucggucucuggcgagugcacggguugguaucccagaggagguuaaagcuguuccuugagaccuccgcugcuaaauagagucgcaguagugacccgauucguccagcaacgcggggcugacuucccgccuccaagcccugagcuuggcaccguggcggugggggguggggguggggggucuccgaaagggaaucagacccggcccccguccuuagagaagaggacagugugugggggcacuuuaugccgucaguaaccccaccuccagguagacgugguacaggccccaaggguguuggaaucacagcugggaaaucagggacgccgucccggaggaggugccauuugagccgagucgaagaacgugugggaauuuuccagguggacuccauaagccaggguaggguugguccggaaagcaugaguagccuaugccaaaacauuggagaguugaaauagccuggcaagccggggauagcaaugaguuguucaguaugcaagggugcaugcagaggaguaagugacaccugagaauuagaaagucagacaagggucaaguaaggaugguuuuguccugggcuuccugguaugcuuggaguagcguugaugaauuuaagggcagagcacugacuucugucucaguguuggaggcuggauugaaaguggggaguggugccaauggcauggacauuaauuauaacacucuaggaagaaugccagacgagauggugaggacuuaaucagaacgcugaacuauguaagagagggaaauaccuuguuaaaugaauaguugcuggggugggugagaaagaaaaaucugggaugugucucagagaaacuagagagggaucaggccgggcgcgguggcucacgccuguaaucccagcgcuuugggaggccaaggcuggcggaucaucugaggucaggaguucgagaccagccuggccaacauggugaaaccccgucucuacuaaaaauacaaaaauuagccgggcguaguugcgcgcaucuguaaucccagcuacucggaggcugaggcaggagaauugcuugaaccugggaggcggagggugcagugagccgagauggugccacugcacuccagccugggugacagagcaagacucugccucacaaaaaaaaaaaaaagaggaucuaagagcacagaugguagcuaucuagucugcuucgucuuuguauaaccaucaccugcauggugccugugacaaaguagucuuucaguaaauauuucugaauggaaggauguugagugaauugcugugagaaaauauagauccuuccuuagcauauaaacuagaggaaaagaccacaagaauugauuuuauuguuucaggcuuccuugaaugaaaucuugauuuuccuuuuuuuuuuuuuuccgagacagagucuugcucugucacccaggcuggagugcaauggcgugaucucagcucacugcaaccuccgccuccccaguucacgcaguucucuugccucagccucccgaguagcugggacuacaagugugcgccaccacaccuggcuaauuuuuuuguaguuuuaguagagacgggguuucacuguguuagccaggauggucuccaucuccugaccucgugauccaccuaccucggcuucccaaagugcugggauuacaggugugagccaccguaccuggcugaacucuugauuuucuaaaauugugcauuuguaagauuccuauuuucuuacucauuuuauagaucaaaagcagcauggaucugccuguggaugaauggaaaucauaucugcuucaaaagugggcuucacucccgacgucuguucaggucacaauuucuacagcagagaccuugagggauaucuuucuucacuccucuucacuucuucaguaaguaaaucaagcuuuaacaagggaauugugagccaaaaaauguucuauuuugucauuugcucugaaguaaugugucuuuuucuuaaauaaagauugagucuugcuuguuucccaggcuggucucaaauuucugggcucaagcaauccucccaccuuggccucccaaggugcugggaguacaggcgugagccaccaugucuggccugguaacaucucuuuuugauggaaaaugccugaaguacuuuuccugguucguuucuaucccagcguguccugugaacuaauucacuucugucauccugcaggauuagccagaucuuuccucaggaaagcucucccugagccucagcugggccaucuucacucuuuguacauuuacaaugcugugugauuuuccuuuauauaugugugugcucuuuugacuaaugccugccuuugccgcuagauugugaacuucaugagggaagggaccguguuuguauuuguuuuucuuuuuuuuuuuuucuuuuuuucuuuuucuugagacugucucgcucugucacccaggcuagagugcaguggcgcaaucucagcccacugccuccgccucccggguucaggcaauucucguaucucagcuucccgaguauuugggauuacagucgcacaccaccaugcucggcuaauuuauuuauuuauuuauuuuuauuuuauuuuauuuuuuuugacacagggucucacucugucacccagucuggagugcaguggcacaaucucagcucacugcaaucuccaccuccuggguucaagcgauucucaugccucagcgucccaaauagcuaggauuacaggcguacaccaucaugcccagcucacauuuuuguauuuuuaguagagacaggguuucaccauguuggccaggcuggucuugaacuccugcccucaaaugauccgcccgccucagccucccaaagugcugggauuacaggcaugagccacugugcccggccuguuugucuuucuauagacaaaaauagugcagugucaaaaaauaagugguuaguaaacauuaauugaaugacaacuugguaauguauauaaaguucuuaguuuaguuacuggcuguuauuagugcuuaaaaugacguauaaagcagaaccuuauauauuugcagauccagaaacacacaccuuucacguucaagguugaugucuuuaucuuugugccaggcacauaguaggcgcucguauauuaauugaaugaaauaaugaguucaguuuugagccuugccaguucagauacucgguacaguuaggguuauacuuuuuuuguuagucuucauuucuuuucuuuucuuuucuuuuuuuuuuuuuuuuuuuuuuuuuuuggacagaguuuugcucuuguugcccaggcuggagugcaguggcacagucuuggcucacugcaaccuccgccucccaaguucaagugauucuccugccucagccucccgaguagcugggauugcaggcgcauuccaccauacccggcuaauuuuguauuuuuaauagagauggaguuucgccauguugggcaggcuggucuccaacuccuggccucaggugauccgcccgccuuggccucccaaagugcugggauugcaggcaugagccacugcgcccggccccccagugcauuuuuauuucucguguguauugccuauuugugucccuugcccauuuucuagcagguugucuuuauucucuuguucauuuguaggagaucuucauaaaucuagcuguauaguucuuugcuauguaaguuacuauuuguuguauaaauuauucccaaucuguuuaucuuuuuuacccuauuuacaauguaaauguuuuacauuuacauuguauauaaauuguguauauauguuucaaauuuuuaaauuucauuuaaaauuuauuuuuagacacaaggucucaguauguugcucaggcugaccucaagcuccugggcucaagcgauccuccugucuuccuuaggaugguggagugaaccauccuaagcaagacacaacccagaagguauaaaagaagaugagguugggugcgguggcucauaccuguaaaccuagcacuuugggagccaaaggugagaggauugcuugagcccaggagccugggcaacauagugagauuccaucucuauaaacaaauuuuaaaaauuagccaagcaugguggcaugugccugucgucccagcuacucaggaggcugaggugggaggaucacuugaaccugggaggucaaggcugcagcgagccaugauugugccacugcacuccagccugggugacagaacaagacuauuucucaaaaaaaaaaaaaaaaaagaaagaaaaugacagauauggcuguauaaaaaugaagccagacaacaugacaugugccuguaauuccaacuacuugggaguugauaaaaauguucauuguuuucugcuaacauuuuuuuaccuuuagcucucuaauccuucugcacuuuuuccuccaucuuuauugagguauaacugacaaaauauacguuuaagggguacaacauuauguuaugauguauguauacaucuccaauugauuuuguguacuaugugaaggaauauucucacuuuuuuuccagguggacaauuuuucuguagcauuuaaugcaugaugcauccuuuccccagugcuugcaaaugccucaguuauuaaaauuaaauuccuacucauguuacuccauucucacguugcuaucaagaaauacccaagacuggguaauuuauaaagaaaagagguuuaauugacucacacauggcugggaaggccucaggaaacuuaccaucaugguggaagacgaaggaaaaaaaggcacagcccucacaggguggcaggaaggagaagugcugagcaaagggggaaagccccuuauaaaaucaucagauuucaccgggcgcgguggcucacgccuguaaucgcagcgcuuugggagacuggggcaggaggaucacuugaagucaggaguucaggaccagcccagccaacauggugaaaccccaucucuacuaaaaaugcaaaaaaaaaauuagccaggcauugcggcaugugccuguaaccgcaccuacucaggaggcugagacaggagaauugcuugaaccugggagacggagggugcagugcgcugagauugugccacugcucuccagccugggcaacagagcaagacuccaucucaaaaaauaaaaauauaaauauaaauaaaauaaucagauuucgugagaacucacucacuaucacgagaacagcauggggaaaccacucccacgauucuguuaccucccaucaggucccuccgacaacacaggcuucugggaaauaacaguucaagaugagauuuggguggggacacagccacgccauaucacuacuuauccacaaauuuguuucuaggcucuagaucugugccggaacaaaaggguuuuaauuacugugacuuuauaguguauuuuauuaguauuauuuuucuuuugagacugagccucccucugucgcccaggcuggagugcaguggcgcaaucucagcucacugcaacuugugccucguggguucaagcgauucuccugucucagccucccaaguagcuaggguuacaggcacacgccaucaugcccggcuaauguuuguauuuuuaguagagacgggguuuuaccauguuggccaggcuggucucaaacuccugaccucaggugacccauccaccuuggccucccaaaguccuggaauuacaggcgugagccaccccaccuggccuauagugucauuuuagaaacucuagaacucuucaguuucaaguaacagaaacccccuucaaaguaugaaacuuuuagcuaugaaacuaggcuaucugaagggagaucuauuuucaggcuagguuguauucaggggcucaaaggaugucaucagaauguguauuucuucaugugucagacagauucucuccaucuagugggugcuauaaccauucacagcccugggcacacccugauaguguaauaacaccccaggggaagaggcugucuuucugaaguuucagcagaaaacuucuggguggggcucaggucaacugaauuuugaucacaugcacaucccuucaaccagagguaugagacuccucugauuggccaggccugugucaugugcccaacccugcugugaaauggggucuacccuucuucagccucaaaaaauggauuccccacugagauuuaccggaaguagagagaaaggguacuugaaagcaggggagucucaguacccaggcggcucccaggaaguggcccagaggccagcuuccugcucgcacacacauagucauuguucguauuccagaauaucuuggguauuuugugugcauuucccccaugugaacuuuagaauuggcuugucaaguucuuuuuuuuuuuuuuuuuuuuuuuuugagacggagucucgcucugucacccaagcuagagugcaguggcgugaucucggcucacugcaagcucugccuccuggguucaugccauucuccugccucagccucucgaguagcugggacuacaggcgccugccaccacgcccagcuaauuuuauuuuauuaucuuuuuuuuuuuuuuuguauuuuuaguagagauggaguuucaccacguuagccaggauggucuugaucuccugaccucaugauccacccgccucagccucccaaagugcugggauuacaggcgugagccaccgugcccggccagcuucucaaguucuauaaaaaauguuguugggcuuuugauugggaauguguuggauuuauagauucacuuaaggagaccugacaucuuuacaauauuaaauuuccuaauccaaauaaaggguauguccauuucuuuaaggcuucuucuauguccuuaaguaaaguuuuauaguuuucuuuauauaggucuuacacauuucauguucgauuuauucuucuuguaagguuuuuguuguuauugugaauaaggcuuuuccccccaauuacauucucuaauuggugauuggugguguaaauaaaagguaagaguuuuuaaaucaucugaccgggugcaguggcucacaccuguaaucccagcauguugggagcccaaggcggguggaucaccugaggucaggaguucaagaccagccugggcaacguggugaaugaaacccugucucuacuaaaaauacaaaaaauuaacuggccaugguggcgggcaccuguaaucccagcugauaccaugguggguuaugguagccucagaaugaauuggagagcuucccgccuuuuucugugcucugaaauagcuuauauaauguaggaauuaugugcuucuuaaaggcuaguagaaaaauucuguaaaacuauguagaccagaugccuuagugaaaauauuuuccuuccuuaguuuaauuuuuuaucagaauaauaugcauacauacuuuaagaaaucaaauagugcuucaaaacuuaucaggaaaaacagcaacucccuguccacucuuccccauuccugauucuuauuccccagagacagcuacuuuaaauuaacuguuucuucuggcauuuaauuuuuuuuuuaacagguugagucagagucucacucuguuacccaggcuggagugcaguggcgcgaucucuguucacugcaaccucugccucccagguucaagugauuaucuugccucagucucccgaguagcugggauuacaggcaugcacuacuauauaugccuaaaauauauaauuuuuauauuuuuaguagagacaggguuucaccauguuggccaggcuagucucaaacuccugaccucaagggauccacccgccucagccucccaaagugcugggguuacaggcaugagccaucacaccagaccuuuuuuuuuuuugagacagaaucucacucugccacccaggcuggagugcaauggcacgaucugggcucacugcaaccucugccucccagguucaagcgauucucaugccucagccacccaaguagcuaggauuacaggugugugccaucacacccagcuaauuuuuguauauuuaguagagaugggguuucaccauguuggccaggcuggucucaaacucccaaccucaggugaucugcccaccuuggucucccaaagugcugggauuacaggugugagccacugugcccagccuucugacacguaauuuauuauuucuaaacauugcaaauacugcucuuucuugaguuuguauaauuuuagauguaauuuugcucucuucuucccaacucacagguauauacuuuguuuuuuguuuuuguuuuuuugagacagaguuucgcucuugucacccagccuggagugcaauagugccgucuuggcucacagcagccuccgccuccuggguugaagcgauucuccugccuccaccucccgaguagcugggauuacaggcaugcaccaccgcgcccagcuaauuuuguauuuuuaguagagacgggacuucuccauauuggucaggcuggucucaaacuccuaaccucaugugauccacccuccucggccucccaaagugcugggaugacaggcgugaacccccuugcccggccuauacuuuguuuuucccucauucccucaugauaacuguuauauaaccaauagaguauuaaauugauugaaccaacauucaaugcauacauucuuaugucugugugagucuuguucacaugaaccgugaaggaugcuuugaauuacauuuccuuucuuguacugcucucguuuccccugggguuaauaaaucaccuccauuuuuguuugcucuguaugucucucacuaauucauacccagaccucucuccuuaaaaacaaguuagcucaaagagcuauuuguaauucuguuccaucacaaucuaaaguaaccaaaaaagauuuaaacuucugaucuccacaugcaugccuguuagguaaaaauaggaacuggcccuuuaaaguuuaaagccaagcacacacuuuucuuucuugccaauagacauucuuugaggaauguuuucccacaagagaugccuuucaucuauugaaaaccuuuugagacacacgaccucccacuguccaccccuaccucuccacuccugcaauuaauaaucucccagaguguuguaggaaauucuuaauagcuucacuauccacauucacaggcuuauuguuuguuuuuauuuugugcugauucaacuggaauaaccugugucagaaaacaaggacgugcucgaagacuaauagauuuauauaaaaaagagcguaggccagguauggugaccccauucacaccuguaaucccaacacuuugggaggcuuaggcaagaggaucgcuggagcccaggaguuugagaccagccugggcaacauagugagacugugucuccacaaaaacauaaaaaguuagcugggcauggugucacaugccuguagccauagcuauuugggaggcugaggugggaaaauugcuugagcccaggaugucgaggcugucgugagcuaugaugguaccacuguccuccagccugggcaacagagcaagacccuggaucaaaaacaacaaaaaagaacauaggaaccagucugaagagguugucacuggccaauauuagcauaauuugaccaugaaaaaguauaauggugauaauaguuuaugauaauaaauuguuuaaguccauggugguacucuaaauauccgaguuuacuuucuuaauugacuuuuggccgggcaugguggcucaugccuguaaucccagcccuuugggaagccaaggcagguggaucaccugagcucaggaguuugagaccagccuggccaacauggcaaaaccccaucucuacuaaaaaugcaaaaauuagcugggcguggugucaggugccuguaaucccagguacuugggaggcugaggcagaagaauugcuugaaccccagaggcgaagguugcagugaaccaggaucgugccacugcacuccagccugggaaacagagugagacucugucucaaaacaaacaaaaauaaguaaauacauauuaugucuguguaaauauugcucacaugaaacaaguaaaagaaggaaaaggagaaaguuugucuuuaccaaagauugccagcuaauaaauuuagaaauaaugguagaauuagaaaaaucgccauuuuguaaccccuagugugauggaaugauucuggcaauuaucaguagaugcgcaaaccuuuagaaguaacaucacugggaaacaggcucuucacaugaucucaaaguauggcccuauagaguauuuaaguacaagggaaaggugucuuuacauugcagagauucagcaauugccacauuaaguaagugaccaaacuuagcuuccauaauacuggggagacauuauaugucuccugauuugaggcaacaagaaguauauagauuuaacuauguagucauuuuguuuguuuguuuguucugagacguagucucucucugucucccaggcuggagugcaguggcacaaucucugcucacugcaaccucugccucccguauucaagcgauucuccugccucggccuccuggguagcugggauuacaggcaugcaccacugugccuggcuaauuuuuguauuuuuaguagagacgggguuucaccauguugcccaggguggucucgaacuccugaccucaggugauucgccugccucggccucccuaagugcugggauuacaggugugagccaccacacccagccguauucuuaauaaaaauuguuuaaugugaaucuaaccaugaggaaacaaugaagcgaaaccagaaugugaaacguuuuucugguguugaaucuuuaaaaaaaauuacucauuaaaaaaauuguaauuggccaggugcaguggcucacaccuauaaucccagcacuuugggaggcugaagcaggugggucccuugagcccaggaguuugaggccagccugggcaacauagcgagaccccaucucuauuuuauaaaaauaaaaaguaauuuagccacgcaugauaguacgugccuauagucccagcuacucgggaggcugaggcaggagguagagguugcagugagcagaggucguaccacugcacuccagccugagcaauggaagugagaccugucucgaaaaaaaaauuaaaaauaaauuuaaaaauuauaccacuaucuaaaaagaggcuaaagagaaauaacuaaauucaauacaugagaacguugaucuuggauugguuagggugagaaaaagauacaacagacauauuaggaauaauugguaacauuuacauuuaaauaauauuugaauuacuguuaauuuuuuagugauaaugauauuauaguaauauaggagaauguccuuauuuuuaaagcagaggccugcgaauauuuagaggugaacauccaugaugccuguacuuacuuucaaauggcuuagagaaaaaaugaugcauauguggauaugucccagguauuaagcgauuauguccaaucucaguaaucugcacucuacuuuggagccagagcugggacuuucuccuucgccaguuagcuccaugaaaggcuuuacauccccagaguucuagagagagauggcaaggcuggagaaagaaaaaauguguuuuuuuucugucuguauccuaaugacaagcuacaugcaaaaggcugaaguugugccuucauauacaaaaauuaauucaaaauggaucagagaccuaaaguuaagagcuaagauuguaaacaacuuuuuuuuuuuuuuuuuuugagacagagucuugcuccaucgcccaggcuggagugcaguggcacgaucucggcucacugcaagcuccgccucccggguucacgccauucuccugccucagccucccgaguagcugggacuacaggcacccgccaccacgccuggcuaauuuuuuguauuuuuaguagagacgggguuucaccauguuagccaggauggucucaaucuccugaccucgugauccgcccaccucggccucccaaaguucuggggcgugauccacugugcccggccaauuguaaacuucuuaaaagaaaacauaggggaaaaucuugacauuggauuuagcaguuauuucuugcauaugacaccaaaagcacaggcaacaacaaaaaaaauaaacuguacuuuaucaaaauuaaaacuuuuaggcugggcaugguggcucacagcuguaaucccaccacucuuuugagaggccaaggcggaaggaucacuugagcccaggaguucgagaccagccugggcaacaagugagaccccgucucuacaaauaauauagccaggcaugguggcgcaugccuggagccccagcuacucaggaagcugaggugggaggauuacuugagccugggaggucagucaaggcuggagugagccaugaccaagccaacuacacuccagccugggcgacagagcaagaccuugucucaaaaaaaaacaguuuuaggccaggcgcgguggcucacgccuguaaucccagcacuuugggaggcugagguaggcaaaucaguugaggccuggaguuugagaccagccuggccaacauggugaaacccugucucuacuaaaaauacaaaaauuagccaggcgugguggugcgugccuguaaucccggcuacucgggaggcugaggcaggagaaucacuugaacccgggaggcggagguugcaguggccgagaaacugaacuucugccugggcgacagagugagacugucuuaaaaaaaaaaaaaaaagguuuugugcaccaaggacaguaucaagagagugaaaggauaacccacagaaugggagaaacuauuugcaaaucauguaucagauaagaaauuaauauccgaaauauauaaagaacuccuacaacucaauaacaaaaaaaucagauuaaaaauaggcaaaggacuugacucauuucuccaaagaagauacacaaauagccaguagacacacgaaaagauguucaacaucauucauaaucagagaaacacacaccaaaaccacagugagagaucacuucacacaccuacaaaaaggccauagugugcgaucauugugccuguagcuagacugugccuguugcccagguuagagugcagaauagcuacugcccuccagccugggcgacaaagggagacuccaucucuuaaaaaaaaauuuuuuuuuuuuuugagacagagucucgcuuugucgcccaggguggagugccguggugugcucucggcucacugcaaccuccgccuccuggguucaagugauucucuugccucagucccccgaguagcugggauuacacacacgcaccaccacaccuggcuacuuuuuuguauuuuugguagagacggggguuucaccuuguuagccaggacggucucaaucuccugaccucgugauccacccgccucggccucccaaagugcugggauuacaggcgugagccaccgcgccuggccaaaaaaaaauuuuuuuaaauaagcaaaauucugguuuauacuacaacaugauguaccuugaaaacuuuuugcuaagugaaauaaguuagacacaaaaggaaaaguaauguaugauuacauuuacaugaaauaccuggaauaaguaaauucacagaggcagaaagcagaauggaguuugccaggggauguggagagggaggaaugaggaguuaugguuuaauggguagaguuucagcaugggaugaugaaaaaacuuuggaaaugaauagugcugaugguuggauaauaugaauguauguaaugccagugaacuguaugcuuaaaaaaugguuuaaauaggccgggcaugguggcucacaccugucauuccagcacuuugggaggccaaggcgggcggaucaccugaggucaggaguucaagaccaguguggccaacauggugaaaccccgucucuccuaaaaagacaaaaauuagcuggucaugguggcaggugccuguaaucccagcuacucgggaggcugaggcaggagaaucgcuugaacccgggaggcggagauugcagugagccgagaucacaccauugcacuccagccucggugacagagcgagacuucgucucaaaaaaaaaaacauuagauugcuuuuuccaucuuacuaccucaauuuuuuuuuuuuuuuuaaggcagggucuugcugugcugacugggcuggagugcaguggugugaucguagcucacuguagcccugaccuucugggcucaagcgauccucccaccucagccucaauuuuuuuaucauaauauuccagaagacauuaaaaaaaaaaaaaaaagaaucggcuggaugcagugacucacaccuguaauccuaacacuuugggaggccaaggcaggaaaaucacuugagcucaggaguuugagaacagccugggcaagguauugagacaucaucucuacuaaaaaaucaaaaaaguauucugggcacagugacucaacaccuguaaucccagcacuuugggaggccaaggcggguggaucaugagguuaggaguuggagaccugccugaucaacauggugaaaccccgucucuacuaaaaauacaaaaauuagcugggugugguggcgggcaccuguaaucccagcugcucaggaggcugaggcaggagaaucacuugaacccggaaggcagauguugcagugagccgagaucgcaccacugcacuccagccugggugacagagugagacuccaucucaaaaaaagaaaaaaaaaaagacauugaguucauaaucuauuguuaggcaagaagaauuuugcuauuauuacuguuuaccacaaaccuuuuguuugaacuaggguuuuuagguuuaaccuaauuuaaaacaaaaacagaaaaaagaacaagcucugcgguguaccagacaggcauaggguauugccuucauauuuucuggacuggaguaaauguagaacaggcaagcacaccucuuaaauuaaauaaaaucuuuccuaguuuuucuuuuuuguauuauuugacccagguuggagugugauggugcgaucucagcucacugcaaccuucaccucccaggcucaagcgauucucgugccucggccucccaauagcugagacuacaagugcuugccaccacgcccggcuaauuuuuguauuuuuuguggagguggguuccacuauguugcccaggcuggucgcaaacucguggaccaggugaccugcccaccucggccucccagagugcugggauuacagguauaagccacugcacccagcccuauuugugacuugucuguguuguauuuaaauauuaauaaaaucauauuugauacuaacuuuguuuuuaccucauagcaaagauaauguuuuauaaaauguuaauagauucaaacacaaaagcauuauacugagucacaaugugaaagguguuccuuauugugggucuuuguaaacaaaaauuuuuaacuuacuuguaaacauucuccagggcuuuuuguuguuguuuuuuguuuuuuugagacagggccuugcccugucacccaggcuugaaugcaguggggcccuccuggcucacugcagccuugacuuccugggcucaggcaguccucccaccucagccucccgaguagcugggacuacaggcauaugccaccgcacccagcuaauuuuuguauuuuuuguagagacagggucuucccauguugcccaggcuagccuccugagcucaggcaaucuucccucuuuggccucccaaagugcuggaauuacaggcgugagccaccgcaccuggccauucugcagcucugugauuucuucuuugauucaagaguuacuuaagauaauuuuuaguuuccaugucauuuguguuucuacuuuuguuauucauauuuuacuuuauggcauuauagucaaagagaauagucuagguuauucuauauuauuucuuuuuauuggaaaauagguauauuuuuuguuaguauguguauaugucucuauauuuauguauuaguucagcuuuauuaauuuuguagagcauuuguauauuuauuucuuaaacuucuuaguuugaaauaauuucagacuuacuugcaaaaauaguauaaagaggccaggcacaguggcucacaccugugaucuagcacuuugggaggccaaagugggcagauugccugagcucagaaguucaagaccggccucggcaacaugaugagaccccaucucuacuaaauauacaaaaaauuagcugggcgugguggcucacacuccuagcuacuccugaggcugaggcacaagaaucacuugcacccaggaggcggagguugcagugagccgagaucgugccagugcugcacuacagccugggcaacaaagugagacucugucuccaaaaaaaaaaguacaaagaauuggugaauucuuccaaauuucgcaaguguuaacguuuuacuacauuuacuuuaugauucauucucauuaucucucuucugucagccacucaaguauuuucagcaguugaaguggagaauacuccuugauucaaaagacaccauauauuagucucauuuuccagacucaagauccuggcugggcccaguagcacaugccuguaaucccaacacuuugggaggcccaggcaggcggaucacuugaggucaggaguucaagacaaaccuggccaaaauggugaaacccugccuguacugaaaauacaaaaauuggcugaacgugguggugcaugccuguaauccccgcuacucgggagggugaggcaggagaaucacuugaacccaggagacagaguuugcagugagcugagauugcaccacugcacuccagccugggugacagagcgaaacucugucucaaaaaaaaaaaaucuuuuaugauguaugauccgagggaugguucguuggccaauaauuaugagauaaagaauaaaaaauuagccuucaguccucuaaauagaaauucuggccaggugcgguggcucacgccuguauucccagcacuuugggagggugaggcagguggaccauuugaggucaggaguucgagaccagccuggcuaacauggugaaaugcuuucucuacuaaaaauacaaaaauuagcugggccuggugaugggcgccuguaaucccaccuauucaggaggcugaggcaggagaaucacuugaaccagggaggcggagguugcagcgagccgagaucaugauucugcacuccagccugggugacagugagacuccaucucaaaaaaaaaaaaaaaaaaaaaaagaaauucugcugaucauuugagcccaggaguucaagaccagccugggcaacauggcaaaaccccaccucuacuaaaaguacaaacauuagccaggccugguggcacacauccucccaauuagugccagcuacucaggaggcugaggugggagaaucaucugagccugggaagucaaggcugcagugaguggagauggcaccacggcacuccagccugggugacagagugagacccugucucaaaaaauucuggucccugugucucugagacuaugagauuucuuuccucuaaucacauugcacaauguacauauccucaugugugugaaauguuuugcgggcccacuuucuuguuuugagggcaaugguuuagagcuuuccuugaaauaacacauuucugcuuacuuuguuuccuccuuucuucaugcagaccugaggaugagcuguuucuaaaaagacuuucuaaagguuacuuggugggaaaggacucggacgcuccucuuuucuacagagaagaaggaaacaaaaaauuucaggagaaagauuacacaggagcugcagugcuguacucuaagguaaaacacucccagcucaagcaauuuauuauuuauuuuucucugagacagaaucuugcuguguuacccaggcuggaguacagugguauaaucucagcucacugcaacauucgccuccuggguucaagcgauccucccaccuuagucuccugaguagcugggauuacaggcauguggcaccacgcccagcuaauuuuuguauuuuuaguagagauggguuuucgccauguuggccaggcuggucucaaacuacugaccucagguguugcgcccgccucagccucccaaagugcugggauuacaggcaugagccaccaugcccugcccagcccagcaauguaacaaugcguguuucuucaggagauggacccauauugcuaaauuguauagccaguguuaucuuugucuauaauuuauugaauggauuugaaaaagaaaccuggcggaauucugcugugguuauagucugaaacaaaagguaguuuuuaggcccagcacagugguucacacccguaaucccagcccuuugggaggcugagucgggaggaucacuugaggccagggguucaagaccagccuggacaauauagggagaccccuucuccacacacacaaauuuuuuuuaaauuagccugacuagugguggcaugcaucugugguccugaaacggaaaaaguucccuuguuccccucgcagggcgugcgauggagguguggcucgcuuccuccgugcccugcuacucaaaccucuaggggagcauauagaugggcaggcugcggggcuccgaccccagggcagugucuagggaugaauguuuacaguugaagccccagugggcguguguuacagggugcucuuuuaguuugcugucuauacgcggcuuguguuaaccagcucaguuaaacucuccaccuugucgcaaggacagagggcuuccuguaucccggguucuugccuuggugugcuggaagaaucggaucacacgugggcuuuaagaaugagugcaagguuuuauugaguagaaguagcucucagcagguugggagccagaagggagaugguuuuccccuggagucaggccacucagaggcccaccucuuuaccagcugcucuggccaaaguccguguccuucugcacuggucgauggcaugccgaugccugucggcugcucuuccgccggcauacuccugacaacauccagcugcuuaugugucugccugcuagggucuuggguuuuuauaggcccaggcuggggggcguggcaaaccaggguggucuuggaaaaugcaacauuugggcgcgaaggcgggagugcuuguccucaccugggucaguggacacaggcccaagggugaagcccuacccagggacccgccuuucucuacacagcaguucccugccccccucccauaucagucccagccagucaggaggcugaggcaggagggucacugagcccgggaguuccaggcuucagugagcugugaucacugcaacauuugccucccggguucaagcgauccucccaccuuagucuccugaguagcugggauuacagguaugcggcaccacgcccagcuaauuuuuguauuuuuaguagagauggguuuucgccauguuggccaggcuggucucugcacuacccugggugacagagugagacccugacucaaaaaaaaaaaaguaauuuauguguucugaauuucuucaagaaacuucuauuuccauauuccuuccgauacccuguagcaguaagcuuaugggccccucgccugccuugcccaugucugucagcccuuguugaacuacaugccauuuuugucugaaugucugaugagacuguuagcuugauagaauuaguaaucuauuauucuuggcugggcacaguggcucacacuuguaaucccagcccuuugggaggcugaggcaggaggauuguuuaagcccaggaguucaagaccagccugggcaacauagcaagaccccaucuguaaaauaacguauaaaugggccggacacaguggcucacaccuguaaucccagcauuuugggaggccgagguggguggaucaggagauugagaccguccuggcuaacauggugaaaccccaucucuacuaaaaauacaaaaaauuagccgggcacgguggcgggcgccuguagucccaccuacucaggaggcugaggcaggagaauggcgugaacccgggaggcggagcuugcagugagccgagaucgcgccacugcacuccagccugggcgacagagcgagacugucucaaaacaauaauaauaggccgggcgcgguggcucacgccuauaaucccagcacuuugggaggccgaggcggguggaucacaaggucagggguuugagaccagccugaccaacauggugaaaccccgucucuacuaaaaauacaaaaaaauuagcugggcgugguggcgggcgccuguaaucucagcuacucaggaggcugaggcaggagaauugcuugaacccgggaggcagagguugcagugagccgagaucgcaccacugcacuccagccugggcgacagagcaagacucugucucaaaaaaaaaaauaauaauaauaauaacaauaauaauaauguauaaaugacucuuauuguccugcuuucauaguaagaacuggaacaagauccccugagcaacuuccuuccguagcuuuuaagauacuuauaugggcuuaaagcaggaguaugacaaucucuugcaccaguucugugaccuuggauauuaaaagaauaaguuuaaauuugaaggguaggcugggcacaguggcucacucguguaauuccaacacuuugggagaccgaggcgggaggauugccugagcccaggaguucaagacaggccuaggcaacacagcgaggcccugucucuguuaaaaacaaaauuuguuuuucauuugaaggguguacauccuacucugaaucuuuaacagguuuaugcuugaacgugcuugaaguuugggauuaauuuuccaaaaacgaucacaccuacaacagcagcuucuacagcugauaaaaucccugcuuuguaguguuguaauaaaguauuuagcuaaauaauguaagcuuuagugguugcugagggauuaaaguccauuagguguaaugauccagugauaaauggcuuaauaguucuuuuuucagagcuaaucucuucaacuuuauguaugugcaucauaaaugugaucacaugggaaguucuucaaggaaaacagggaaaauaaaaacugaagccagagaaaaaauuaagguuugcucugaauguggagggagaugagccuuccuauuucaugaagccaguauguuggugauuaugguacucugcaauuuucuagaaagcugcuauuuucuuucuuuuuaaaaauauuuguuguuuuugucugauuguaaaaguaauauauguuuacuucggaaaguacagaggagcauaaagaguaaaaaaaaaccucauaaccagugauaggcacuguuaacauuuuugcuuacguccauccagccagacuuuuuccuccgaaaauacguuuuucuuuuacaaaauugggauaaugcugcacuuucucuuuugugaccugcuuuuuuccuucgacaauugauugugcccauuuucucauguuauuaaauuuuccacuggaacaugguucuuuacggcuggcuuaguguuccaugacagagaaaaaaccguacuugauuucacaucuccuaauguuggcaaauuguucgggaucauaauacugcaaugagcaucuuucuauguaaauauguguauauaucugauugcuugcuuaggauaaauuccuagaaggguaauugcuggggcagaaggaauguauuuuuuaaggucuuugguauuugaugcugaauuguucuccaggaaagaacuaguuaacauccccucuggcagacuauggggauauuaauuucuccauaucccaagcaguacugguugugaugauuacgguuuuauuauuauaucgauuuauuugugaggagggaaucuguucauguagauuuuaaaagugcaagaguguccagcgucaucugccucuccuguccccugaccacaugauuuucuguucccauaaacuagcacuguugaguauauuuccagagcauacuccaggcguguguaaauacagccuuccacuccugcacacacaccguguuuuuacaucaguaacauucugcgcauauuguucagcaccaugccuuuuccacuuaacaguaauaauuuaaaggucauuccauuucaguacauaaagagcguccucaggccgggcgcgguggcucgcaccuguaauccuagcacuuugggaggcugaggcagguggaucaccugagguuggaaguugaagaccagccuggccaaaagggcgaaacccugucucuacugaaaauagaaaaauuagcugggcgugguggggccugcgccuauacucccagcuacucaggaggcugagacaggagaaucgcuugaacccuggugcgggguugccggugugggggccggggggggcgguacgcggaaguuuuagugagccaagaacacgccacuucacuccagccugggcgaaagagcgaaacucugucucaaaaaaaaaaaaagcauccucauucuuuaugauggcuacauggcguuccauuaaauggauguaucaauuuauguaaccaguguccuguggaucgaugcuuguuuccugucuuuugcuguuucaaacaagucuaugaugagaaacuuugcacagggccgggcacaguggcucacaccuguaaucccagcacuuugggagaccgagacggguggaucaccugaggucaggaguucaagaccagccuugccaacguggugaaacccugucucuacuaaaaauacagaauaagcugggcaugguggcgugugccuguaacccuagcuacuugggaggcugaggcuggagaaucgcuugaacccgggaggcggagguugcagugagcugagaucaccccacugcacuccagccuggacgacaacgagagacucugucuaaaaaaaagaaaaaaacccuuguauguaugucauuuuucauauauaacuguaggauaagugauuguaucuguaggauuaauuccuagaagaggaauugccuggucaauggauauuuuauauguauauaagauauacauacauauagaauuuugacauauauugcuaaauugcccuccauaauuaugaaaccaguguacacccucacuaacagcauaaugaggauacccaucaucccacuucuugaccaacucugugugccaucaauuuuauuuugcuuugccugauagguaaaaaaauggcauuucuguacaguuguaaucugcauuuuauugauuguaugaggcugagcauuuuuuuucacauauuuaguagccauuuuuauuuccugugagaauuguccauaucauugccuauuuuccuguugauuuacugguugucaucuuagugaucuguaggaaaucuugacaaaguaaagaaauuagcucuuugccuauaguauaaauugcagauauuuuuuccaguucaguguucgccuucugcuuuuauugguuuuuggugugaagauaguuuuuauuuucaggcggucgaguuuauuaaccuuugauaacuucuggguuuugugucagaguuagggauucguccagcaauacuuuacaugcuuucuacaguucuuccagcacuucuauaguuuuguuuuuacauuaaagaauuucauguauuuguugggaggccgaggcgagcggaucacgaggucacgagaucgagaccauccuggcuaacacggugaaaccccaucucuacuaaaaaauacaaaaaauuggccaggcgugguggcgggcgccuguagucccagcuacucgggggcacugaggcaggagaauggcgcgaacccgggaguuggagguugcagugagccgagaucgagccacugcacuccagccugggcgacagagcgagacuccgucucaaaaaaaaaaaaaagaauuugauguauuuggaauuuauccaaugaaagauucaucacuuuauuuugcucauugucuaccuacuuauacauauauauauauauuauuauuuuauuauuaauuuauuuuuuugagacagagucucacucugcugcccagacuggagugcagugguaugaucucagcucccugcaaccucugcuuccugaguccaagcaauucuccugccucacccacccgaguaacugggauuacaggcgugcgccaccaugccuggcuaauuuuuguauuuuuaguagagaugggguuuugccauguuagccaggcaggucucaaacuccucaccucaagugauccaccugccuugaccucccaaagugcugggauuacaggcaugagccaccaugcccggucucaucccaguaguuuuacugaguaaucaccaucuuuccuacauuuacuugaguaccauauuuaugguuauuauuaauccuugccaauuugaugguagaaaaaaguauucuuuuuuguuuguuugugacaguccaacucugucacucaggcacuaucucagcucacugcaaccuaaccuccaccucccagguucaagccauucucaugccucagccucccaaguagcugggauuacaggcgcacauuaccaugcccugcuauuuuuuuguauuuuuaguagagacgggguuuugccauauuggucaggcuggucucgaacuccuggccucaagugauccacaugccucagccucccaaagugcuggaauuacagacgugagccacugcacccagccuaguaucccuuuuuugcguucauuuucaucuauuuggcuauccauaugugaauuaaucauuuguuuucuauaacuauuuguguuucuucuuuugugaauuucuauuugugccacccacccuuuguuauauucagguuguaggauauuaugcuugcagguaugucccucaguuuuuuauccaccuucaguauuguuugugguugaagcuguaucugacaaagugcuuuuaauacugauguccucacuugcucuucacagcuuugcucucagguaguuaaaagauaagcugaagcacaaagagguucaguaacuuucccaguuucacacagucuucaguacuagagcccggaauaucugaaaaauguucuucagagaugcugguguccauuuauacuuuuaaccaguucauuguuuugcagggagugucacauucaaggccuaacacugaggacaugucacugugucaugcuaaccgcucggcagcccucuuccaccugggucaguaugaggugaguaucaggauaccugguaugagaggacaggauccggagggcuucuuacuggaggacuagaccuucaucucugcuucuuccauagaacacuaaaaucaugucaugcugcuauugguugaauuggaagcacauuaauaucuaccuaaagucggacugggcgcucauugccuguaaucucagcacuuugggaggucaaggcgggcggaucaccugaggucaagaguucaagaccagcguggccgacacaguggaacccugucucuacuaaaaauacagggauaaaaauuagccggguguaguagcaugcaucuguagucccagcuacucaggaggcugaggcaggagaaucacucgaacucgggagguagagguuacagugagccgagaucgcaccacugcacuccagccugggugacagagugagacucuaucucaaaaaaauguacuaggccaggcacaguggcucaugccuguaaucccaacacuuugggaggcugaggcaggcggaucaugaggucuggaguucaagaccauccuggccaaaauggugaaaccccaucucuacuaaaaauacaaaaaaugagcugggcaugguggcaggcaccuguagucccagcuacuucaguggcugaggcaggaguauugcuugaacccaggaggcagagguugcagugagcccagaucgcaccacugcacuccagccuggcaacagacucugucucaaaaaaaaaaaaaacuaacugaacucgcccuuucuccugagucauuucacugaucacaggugaccauaugggauaguguugauugacaagaaagagcuauggggccaggcauggugguucacgccuguaaucccagcacuuugggaggccaaggcagacggaucacuugaggucaggaguucgaaaccagccuggccaacauggugaaaccccgucucuacuaaaaauacaaaaaucagcugggcggguggugggcgccuguaaucccagcuacucaggaggcugaggcaggagaaucucuugaaccugggaggcagauguugcagugagucagugagcugagaucgugccacugcacuccagcuuggguaagacaggacucugucucaaaagagaaaggaaagagcgagcuaugggacauuccauggggauguggacuguccaagaggucagcaguguucagugucaggaucagccaagugacauguugcugcuaauacuucagguuccaaguguuugcaaaguauacuguuugcugcuuuaaauaaguagagcguguuuaagauuaucccuguaguaauagcucagccuucuuaagugucgugagugcaaaaggaaaaccuaccuugaacugcccgugucugccugugaggucagcuuucugugaaugacauucuucucauccccuaauuguugcaacagagaaaaaguugaggacuuugucaguggaguuuuuguuuuguuuuguuuuguuuuuuugagacagugucucgcucugucgcccaggcgucagugcaguggcgugaucucugcucacugcaaccuccgccucccggguucaacgauucuccugccucagccucugaguagcugggacuacaggcgugcaccaccacgcccggcuaauuuuaaguagagauggcguuucaccauguuggucaggcuggucucaaacuccugaccuugugauccucccgccucagccucccaaagugcugggauuacaggcgugagccacugcgcccagccgugucaguugaguuuuuaaaacaggaagugaccaaaaucggauuaauguuuuaggaggauaccucugaggcaucuggcauuuguauuagagaggucuaaggacaagcucuaaaaugccauuuugauacaucuguuucaacauucuacaaaaauucaaauuauacccuaggguugagaacuauuggaauaguaagaaguccacacuuacugcccuucagacuaaaagagaaaagcaggaaucuaacccuugacccuaaacaagaaaguccuggacugcugaggccagugauuaggaaaaagaacuugcaauacauugaacccuuuauaacuuuucuuuauugauuguuucuguuuuccuuuuucuuuauuuuuuuuuauuuuugagacagggucucuguuacccaggcuggagugcagugacucgaucauagcuaacugugaucucaaacuccugggcucaagcagucuuccugcuuuagucucaugaguagcuaggacuacagguaugugccaccaggccuggcuaauuguuuaauuuuuuuauagagcccagggucucaucuguguuguccggguuggucucaaacuccuggacucaagugauccgcccaccucggucucccauaaugcugggauuacaggcgugagccaccaugcccaaauguuuuccuucuuauaauaaugauuaucauuuauugagcacauacuguguuccaggugcuccuuuuggcauguuagauauauuauuuccuuuuauccuuaaaacaacacugggagauauuauuaucccuguuuuuuagauaaaauuaagacacagaaauuaagucgauugcacaaggucauguggcuaguaagaggcagaguguauuugguuuuuuguuuguuuguuuguuuuugagacagagugucgcucugucacccaggcuggaguucaguggcaugaucucggcucgcugcaaccucagccucccagguucaagcguuucuccugccucagccugcugaguagcugggacuacaggcgcccaccaccacgcccagcuaauuuuuuguguuuuuaguagagaugggguuucaccauguuagccaggauggucucgaucaccugaccucgugaucugcucgccucggccuccuaaagugcugggguuacaggcaugagccaccgcacccggccagcagaguguauuugaaugcaggucugcuuggacucaaagccugccucuuuuuuuuuuuuuuuuuuuuucaaagccugccuguuagucaccaugcuauaauucuucuauucauaagacuucuuuuuccuuaaaaaauagaaauauuuaauccaggggcugggcgcaguggcucaugccuguaaucccagcacuuugggaggcugaggcgggcguaucaugaggucaggagaucgaaaccauccuggcuaacauggcaaaaccccgucucuacuaaaaauacaaaaaaaaauagcugggugugguggcgggcaccuguagucccagcuacucaggaggcugaggcaggagaauggcgugaacccaggagguggagcuugcagugagccaaggucgcaccacugcaauccagccugggcgacagagcgagacuccgucucaaaaaaaaagaaaaaauuuaauccaaaaacauuaagcauaacaauauccucaacaaguauugcuaaucacucaaaggaucacacagaacuauaugauuuuaauaagcaugugguuguaauuguuccauuuuuuaauaauccuuaacuuuccuguagauuuuuggaaacauuuucaguaaacauugaagaauagggaccaagggucauugugggauuuucuuucuguuuucagacgugucuuaaagacauuaacagagcacagacacauggguauccagaaagguugcaacccaagauuauguuacguaaagcagaaugucugguggcccuggggagacugcaggaggcaagccagaccaucagugaucuugaaaggaacuucacagccacaccagcccuagcagauguccucccucagacucugcagagaaaccuccaucgucugaaaaugaagaugcaagaaaaggacagucucacagaaagcuucccagcagcucuggccaaaacccuugaggaugcagcgcugagggaggagaaugaacaacuuuccaaugccucaucauccaucggcuuaugcguagauccuuuaaaaggucgcugucucguugccacaaaagauauucucccaggagagcuccuggugcaggaggaugcuuuugugaguguucucaacccaggagaacugccaccaccgcaucacggccuagacagcaaaugggacaccagagucaccaauggggaccucuauugucaccgauguuugaagcacacuuuggccacaguuccgugugacggaugcaguuaugccaaguauugcagccaggaguguuugcagcaggccugggagcucuaccacaggacagaauguccucugggagggcugcuucucacacugggugucuuuugccacauugcccugagguugacucuuuuggugggauuugaggauguucgcaaaaucauaacgaagcuuugugauaagauuaguaacaaggacaucuguuuaccugaaagcaacaaucaggucaagacacuuaauuauggccuaggggagagugagaaaaauggcaacaucguugagaccccaauuccuggaugcgauauuaaugggaaguaugaaaauaauuauaaugcugucuucaaccuuuugccccacacugaaaaccauagcccagagcacaaauuccucugugcucucuguguuucugcacugugcagacagcuagaagcagccaguuuacaggccaucccaacugagaggauugugaacuccucucagcuuaaagcagcagugacaccugaauuguguccugacgugacuauuuggggaguggcgaugcugagacacauguuacagcuucaguguaacgcucaggcgaugaccaccauacaacacacagguaagagggaaccugauguuccugcuuuucaauauuguucucgauggagcagguguuugagaagaaacaauuccaaaggaaaauaggauucaaacaaaucauugagcuaaugggaucacuaagcugucuuguuuauugucacaaugccauuaagaagcuauaugaccuuaaauuauuugauccugccaggcgugguggcccacuccuauaaucccagcacuuugggaggccgaggugagcagaucacaagguccagagaucaagaccauccuggccaacauggugaaaccccgucucuacuaaaaauaaaaauaaaaaaauuagcugggcauggugguacaugccuguagucccagcuacucgggaggcuaagacaggagaaucaccugaacccgggagguggagguugcaaaugagccgagaucgugccacugcacuccagccuggcgacagagugagacuccaucucaaaaaaaaaaaaaauuauuugauuccguucugccucaguuucucaucuguaaaauggguaguuuuaucccagcuaacuuuacagaguuguguaaagcuauguuuguaaaaauucuuuuuuuuuuuuugagacggagucucacucugucacccccaggcuggggugcaguggcgugaucucagcucacugcaagcucugccucccagguucacgccauucuccugccucagccuccccaguagcugggacuacaggcgcccgccaccacgcccggcuaauuuuuuguauuuuuagcagagacgggguuucaccauggucucgaucuccugaccucgugauccgcccgccucagccucccaaagugcugggauuauaggcaugagccaccgugccuggcuguuuguaaaaauucuuuugaaauucuuuaaaaaguccauauugcugaaaaaaaauuuauuuuuuauuuuacuuuauuuauuuauuuuuuuuuugagacagagucuugcucuuucccaggcuggagugcaguggcgcaaucucagcucacuguagccuccaccucccagguucaaaugauucucaugcucagccucccaaguagcugagauuacaagcaugcgccaccaugccuggcuaauuuuuuuguguuguuaguagagacgggguuuugccauguuggccaggugggacuugaacuccuggcuucaggugauccaccugcuuuggccucccaaaaugcugagauuacaggcaugagccacugcaccuggccuuuuaaaauuuuuuuaauagagaugaggacuugcuauguggcccaggcuggucuugaacuccugggcucaagcaauccucccgccucagccuccccaagugcugggauuacaggugugaaccacugcacucaacccgaauuuuuuugguuaugaaggaaaacugucucaaauaaauaguaauagcaaguuucuuauaagguacauacacaaaaggccugacacaguacgccuguaaucccagcacuuugggaggccggggugggucaaaucacuuacuugagcucaagaguucaagacuagccuggaaagcaugacaaaauacaaaaauuagccagguacgccucuaaucccagccacuugggaggcugaggcaggagaaucacuucagcccaggaggcagagguugcagugagccaugaucgcaccgaugcacuccagccugggugaaacccugucucaagagaaaaaaaaaaaaaauacaugcacaagauuccagagaaagcuauauaguuucucuuuagggagggcagaaauaauagucaaaccagacugcagaaagaagaggcccaguaguuggguaagguaucaaaguccuuuuuuucuuuuuuuuucugagauggaguguugcccugucacccaggcuggagugcgguggcacaaucucggcucacugcaaccucugucugccagguucaagcgauucuccugccccagccucccgaguaacugggauuacaggcgugcacccccacgcccagcuaauuuuuguauuuuuaguagagaugggguuuuaccauguuggccaggcuggucucgaacuccugaccucaggugagccacccaccuuggccucccaaagugcugggauuacaggcgugagccaccgugcccggccagauaucagacccuuaacucaaucagcuacucucugucuucucuuuccaauugagagauauuucccauucuucuaaauuuccagcccagcgcagccuuccaccccacacugcagcagaagcugccagccugcauagugccuguccuuugaucagguggccaaaccucaaggggccaccucuaaacacagacgagcuggcucagccugcuuuccugaacuggagccuauagauaacacuacuuaagauagaugggaagguuggaugugccgagaaucaugauccagcuugacaucuccagugugacugugcugacaacagauacaacuauuauuagaaaaguggcauuuguagucuuucuauuuuaugaucuucauuuuagcagaaaauguuuuuugacucaauccguucauuauacuuuucuuaauuuuuucaauuaacucucuugagagggaggaaaccagguguuagcuaaaccgaguuuuuauagacagaugaauauuaaauguggcuucacuaaacucuacaugcuuagcucauuugaucucacauuaggucaucuagaauuugucagccuauuuuggugugcauguuuauguuuaauuuuaauucagcaggcaaguuauaugguauauagguaucucaguagacauguuuuggccaagauucucuuccccauccugaagcucguggaacaucuaaaaauaggacuggccuggucccaugauacuacuaaaucacaugucagguuagccuguguuuuccucugcccuccuuugcuucuuugugccuuugcuaccaucuaaaauauagcugcugaguauuuuuccagaauuagguucuccuuuggguauauucacuuguauuuuuuaauauacuuuacuuuguucuguuuuucugaacauaaaaauauauggggcuucccaauuaaauagcagaaaguuaccaacucuugauuccaugucuugccuuuaaaauacuuaauagggcugggcgcgguggcucauaccuauuaucccagcacuuugggaggccgaggcgggcggaucucgaggucaagagaucaagaccauccuggccaacguggugaaaccccaucucuacuaaaaauacaaaaauuagcugggcauggcagcgggcgccuguaguccuagcuaccugggaggcugaggcaggagaauugcuugaaccugggagguggggguuacagugagccgagaucacgccacugcacuccagccuggugacagagggagacuccaucucaaaaaaaaaagaauaccugaagccagccgcaguggcucacaccuuuaaccucagcauuuugggaggcugaggugggcggauugcuugagcccaggaauuugagaccauccugggcaacagagcaagacccaucucuacaaaaaaaaaaaaaaaaaacagccaggcaugguggcaugugccuguggucccagcuacuugggaagcugaggcaggaggauugcuugagccgaagaguucgaggcuucagugagacaugaguugcgccacugcacuagagccugggcaacagagagagacccugucucaaaaagaaaaaagaaaaauacaugcuuauucuguggcuaaugaaaacuggaagaauagauacauaucguaauacuggcuacuuggggucauggaaagugguuuggagacaucggcuuuaucuaugagguucuaauguuuuaugcauaauuuauuguuuauguaauguuuuaaaaauauauacauagaagaaacaguagaagcaaaaauaccaaaaucugagcagugauuaauucugaaaguggaaauacaggugauugcuacuuucuucuuugaacuuuucugauuuuuuaacauuaaaaacacuuauucacacagugguaccauuauacuauuaaauuuuaaaaugauuguauaccuuucccauaauucuagaggaaaauacuuaaaaaaaaaaaaaaaaaacucacgggccaggcacaguggcucaugcguguaaucccagcacuuugggaggccaaggcagguggaucaccugaggucaggaguucgagaccagccuggccaacauggugaaacccgucucuauuaaaaauacaaaaauuagcugugcgugauggcaggugccuguaaucccagcuacacgggaggcuaaggcaugagaauugcuugaacuuggaagguagagguugcagugagcugagaucgugccacuguacuccagccagggugacacagcaagucucuuagauagauagauagaugauuagauagauagauagauagauagauagauagauagauagagcugagaucgugccacuguacuacagccagggugacagagcaagucucuuagauagauagauagaugauuagauagauagauagauagccagggcgacagagcaagucucucucagauagacagaccagacagacagacagaaggcugaggcaggaggaacacuugagcccuggaguucgagaccagccugggcaacauagcaagaccccacccacugggaacaacaacaaacagagaacagccuguuucuauacuguguaaacugcuccagccuguggggaaaccuagaacucuuucccagucauuuuagaaagccggugauaaaagcuagagaccagucucacuugugaauguagauguagaaacccuggauaaaccacugcagugucauaucuagcaguuuauugaaggaauaauaauacauaaccaagaagaguuucucccagaaaggcaaagguauuuuaauucggagggauaugaaagacggcuucgauaaccacagagacaugccauguucuuaauggaaagacugaaaacuuugaguuuccugcauuaaccuaaucaguuucauaccauuucaaacagaaucacaguugaguuuuucugggaacuugacaacauucuaaauucaucuugaauaaaugggugagaauagccuuuuuuuuuuuuuaagagaacugaaaggucuugguacugucagauuucauacgagcauuaaagcuacaaaaugaaaaacaacuggaaacugaugacagccccccaaaaaggauuagagucuuuuucaaaucauuaacaacuuaaauauuucagaauuaaaccaucaauuaucuaguuaaagguaagugaacauuuauguagucuuagggugggagaggcuuuuuaaaauacuauagaaugucaaauuuagguaauuaaaagauagcuagauuuaacuacuuagguaccaaauaccaagaacaccauaauugguuaggaagauaaaggauggccgggcguguuggcucaggccuguaaucccagcacuaugggaggcugagguggguggaucacaaggucaggagaucguguccauccuggcuaacacggugaaaccccgucucuacuaaaaauacaaaaaaaaaaaaaaaauuagccuggugugguggugggcgccuguagucccagcuacuugggaggcugaggcaggagacuggcgugaaccugggaggcggagguugcagugagccaagaucacaccacuguacuccagccugggugacagagcaaaacuccaucucaaaaaaaaaaaaaaaaaaaaaauauauauauauauauauauauauacacauauauauacacauauauauacacacauauauauauacauacauauauauauacacacauauauauauauacauauauauauacacaaaaauuagccaagcguggugguggaugccuguagucccagcuacuagggaggccaaggcaggagaaucgcuugaaucugggagguggagguugcagugagccgagaucacaccacugcaccccagccugggcaacgagugaaacuuccucucaaaaaaaaaacacugcacugagaggcagaagaccuaaucuccugaaccucuguguaucucagugucaucauggacaugaugagacuggauaagccucagagccucuggggaaggcuguuugcaaacaugaccacaguuucucccaucccuauaaguugccucuuugcagcuugacauugcugcuucucuugucaagaaguggagauuuuuuuccccucuccuugaaucugggcuagcucuguaacuugcuuugaccaauagacagaagugaccugaugugacuuuugagucuaagccuuaauugccuccacugucaccgucuuggagugauaguguagcccugugaacaagccugggcuggcuuccuugaggauaaaagaccaggugccacagaaaggcagucaugugagucagccccaggcaaaaccagcagaaaaaaaaaaaauacucagcugagccaaaacugccgggguacagaauugugaacaagugaaauugucauuguuuuaacaauccccccaaaaaaaccucauaaacaaaaauuagauguaaauggacaaaaugagggaauaucucuagcaacuauacagcucuuaaaaucaacuuuuaaaaauaugcauagcggccaggcacaguggcucacaccuauaaucccagcacuuuggaaggcugaggcaggaggauuacuugagcccacgaguuagagaccacccggggcaacauggcuaaacucugugucuacaaaaauacaaaaauuagcugagugugguggugcgcgcuuguggucucagcuacccgggagucugaggugggacagcggcucgggcccaggaggucgaggccgccgugagcugagaucaccccauugcaacagagugagacccugucuaaaaaauagcaagauaaaaauaaaaacaugcauaaugaugaaaaucuaaagccggguugugguacuguuugcccaaucuuauaaauuuccccccaaaaaagcacugaaucguacacuuaagugaauuuuacgguagauggauucuaucucaguacagcuguugaaagcacacgugagcaagcacuguaucgaaguagauagugauaaguaaaaacggucacucucuaaccucucuaguaauuaaaaccagauaccuuuguuggccugucacggcagcagaguuguuuuacugguuuuguuuuuguuuuuugagacagggccucugucuguugcccaggcuggagugcagcggcgugaucucagcucacugaagccucgaccuccaggguucaacugauccucccuccucaggcacccaaguagcugggcucaggugugcaccacaccgggcuaacuuuuguauguuuaguagagacaggguuucaccguguuagcaagguggucuccaucuccugaccucgugauccgcccaccuuggccucccaaagugcugggauuacaggggugagccaccgugcccgaccuguauuuuuaauucuaaaaugcauuuuaggccaggcgugguggcucaagccuguaaucucagcacuugaggaggccgaggugggaggaucacgaggucaggagaucgagaccauccuggcuaacgugaaaccccgucucuacuaaaaauacaaaaaauuagccgggcgugguugcgggcgccuguagucccagcuacucuggaggcugaggcaggagaauggugugaacccaggaggcggagcuugcacugagccgcgaucgcgccccugcacucacuccagccugggcgacagagcgagaccccgucucaaaaaaaaaaaaaauguauuuuagguuaggauuuaaagauaacauguuauaucugccugauggcauuacaagcaacugucauuuucucuguaauguucaauuuuuaaauuuuuuucugacuaccacguauuccuuuuguaauuucaauuagugguuuuuuguuuguuuuugagacagggucucacucugucacuuaggcuggagugcaguggggcgaucguagcucacuguaaccucaaacuccugggcucaagcgauccucccaccucugccucccaaagugcugggauuacaggcgugagccacugcgcccagccucaguuaguuuuuuuaauaauaaagauaauucaaaugauaagaguacuuuucuaugaacauuuuuaaggcacuugauacagcuugcaaaauugcccuccaggaaaguuccacugacgcgcccaccagcaagguucacuuucauuguuaaauuucaucucauuuucuuuuagucugcucauauuucuaaucuuguuauaucccuuuuuauuauuucuuugggguuccaaucccucucaauuuaguguucucauugaauuucauuagcagcuguuucauuaguaguacaggcaaaggauuaaaguguuaacuaggauagacuuugacaaaaaccuauaaaaauguauguuauuaucuuugcauaaauccuguuuaaucaaaguuccccagaaaccucucacuagggcuuaucucaagggacagaacuggccacugaugauuuucuagaccgugacacgugugguucugucucagugggaauggcauauuuaugaucuauccggauuccugucauaacaagauuuuauugggguucuguguccugucacuucccaucaauucacugcccauugcuuucacucuucagcauugaaggaaucuaucuuuuuuuuuuuuuuuuuuuuuugagacgggccagcccaggcuggagugcaguggcgcgaucucggcucacugcaagcuccaccucccggguucacuccguucuccugccucagccucccgaguagcugggacuacaggcgcccaccaccaugcccggcuaauuuuuuuguauuuuuaguagagacgggguuucgccguguuagccaggaaggucucgaucuccugaccucgugauccacccgccugggccucccaaagugcugggauuacaggcgugagccaccgcgcccggcaugaaucuuuuuucuuuacuugaaucccaguuuaaaugcaccagggaugggcauggcuuagccagcacuuugggaggccaagguggguggaucacgaggucagaaguucgagacuagccugacuaacaugcugaaaccugucuucuacuaaaaauacaaaaaugagcugaguguggugaugggcgccuguaaucccagcuacucaggaggcugaggcaggagaaucgcuugaacccaggaggcggagguugcagugagaugagaucaugccacugcauuccagccuaggcgacagagugagacuacaucugaaaaauaaauaaauaaaaagaaaugcacuagggauauuagcaagguacuguuuugguauagaaucacucccucuuuauuuuaauacaaaaugucacagauuaaauuugguugaggaacuacauacauauucucacuuucuauuaucucuacuaauagaugauuaaugcacaauacugaguaauuuuuaaaaaucaauacuuaauuuuuuagaaauaauuagagagcuauucaacucugacauaaauacccacacgguuccugggccuacuucugucagaggguaaucuauaaauaauucacaaagcugacauuacucacuguagugugaucauucuuuucuggaaaauuuuagcaaugguucuaauauagauugccaguuaucaguaguuggcaaugcaaguccacuuuuaauuaugcagaggcugauuauucagacgacaaauuguucaugcccuggacggcuccuuccugccaccugccuuuuagcauuuucacugcucauuagcacauauaccagaaggugggcaccggacaagggggagaagaagaaacaaaaaucagcgaagcacuuaggagaagcucugaugaaagauuuuaauacaauuuguagaauuauuaacuagaauugagucauuuggauucccugcaaaauguauuuacuuguucuauucuuguucuccuuagcaacagauaguaaaauugacaacaaaauugacaacauuauuccuauauucaguguuuuccuuuauaaaacuuuuuuuuuuuuuuugagacagagucucgcucuuucacccaggcuggagugcaguggugcgaucucggcucacugcaaccuccaccucccaguuucaagcgauucuccugcuucagccucccgaguagcagggauuacuggugcacgccaccacgcucagcuaaguuuuuauauuuuugguagagacgaggguucaccauguuggccaagcugguguugaacuccugaccucaagugaucugcccgccuuggccucccaaagugcugggauuacaggcgugagccucugcaccuggccuauaaaacauuuucacauaaugguucauaauauuuucuuuauccauuacauuuguaccuagacuauuucuuuggugaauuuguuuuuuuuguuuugcgagacaguuuugcucugucacccaggcuggagugcagcagugugaucugggcucacugcaaccuccuccuccuggauucaagcaauucucguaccucgccucccgaguagcugggacuacaggcgcaugccaccaugcccagcuaauuuuuguguuuuuaguagagacaggguuuugccauuuuggccaggcuacucucgaacuucugaccucaggugauccacccgccucggccucccaaagugcugggauuacaggcaugagccaccaugcccagccuggugagugguuuuuuugagauuccuggcauauauucggugauaucacaguuauuugaugguuuuuuuccaguuuuccagaaaacugaauguuuccuuuuaaauacugguauuuuuuaucuuccaaccuguuuuguuagaaacacaauuugccucaugcuuaaauugagacuacugaagauaauuuaagcguuucugugugcccaagguuaucuuuacuguacauacuccuaggacagauggcuuugagaaaagccagcacagguagagccucuggcuaagugaaguguuacagguggacuuuuaaagugcuaauuauccaccaugcuuucuuuucugaaaugaacaaauuuuuuuuuuuuuggaggcggggucucacucuuguugucuaggcuggagugcagcagcacgaucuuggcucacugcaacguccucagggguucaagcgauucuccugccucagccuccugaguagcugggacuacaggcacguaccaccacacccagcuaauuuuuuguguuuuuaguagagacgggauuucaccguguuagucaggauggucucgaucuccugaccuugugaucugcccgccucggccucccaaaguacugggauuacaggcgugagccaccgcgcccggccaaaaugaacaaaauuuuaaaguaaacuaugggccugaaaagaccaaaaaagaaaaaaauaauaaauguuacaauuagaguaaaacuuuuuuuaaauuuuuauuuauuuuucuucagacagggccugcucugucacccaggcuggagugcaguggugcaauccuggcucacugcagccucgcucucuagggcucaacugauccucccaccucagccuccugaguagcugggacuacaggugugcaccaccacagcuggcuaauauuuuaauuuuuuuuuuuuagagaccaaaucuagcuguguuguccaggcuggccuugaacuccugggcucaagcaauucuucugcgugagccucgggauuucaggcaggagcccuggugccuggccugcuuaaauauauaaaguuugggguaguaacuaggucgcuuguucuguuaaccaaccaaagaccagauaaacaaaagcccuugggcucuaaaagucuuugggaagucaccucaacaggggcucugguuucuaugugagaacauuaugaaacuaucuagaacgcucccuacuuaucaucccuuuuuuauuacuucuuuauaaguucuuaucuuuggcuauuucgugguguagagacacagucguuagguuccaggacuccaguggacuuugugugcguucauccacuuugcuuccuggggacuggagcuugccgugagucaugucccaucugauuuauauuggaucuggcuguggagccaugacucacacgggcugcaggccuagcugcccagcucaucuucugaggaacagagggcaaggccagggcucaugugcugacaccuuuuuccuucuuuccucuugcccuuucaggaccuaaagggagcaucguuaccgacagcaggcaggugcgccuugccacaggcaucuucccuguuaucagccuccugaaccacuccuguagccccaacaccagcguguccuucauuagcacugucgccaccauccgggcgucacagcggauuagaaaggggcaagagauucuccacugcuauggugagccaucccuccgcacugccauccugcccuucuccaacagaaaaggacggggacgcaagucagcaagccaccaggcaugugacuucaccugucuacugucugcuuccuggaagaggcagugaacacuuaggccaaaaacaaggaagggaggauggaaggaauggccuucgugcuagggcccuauugcggcuaaacuaugucucgcuguuuaaucacuauaaacuuccuauucugaaaaugggcuaggaacaacuucuuggcuucucuuucuuccugucucagcaacuuggaagcuuauuuuaguauccaguuccacaaauauuuggguaaagguuagcugucacaugauagguaauuguccagacccucugcuaagcugaagguuuuuacguaguguuugacucucucuugcuuucaauauuggcugacggugaucucccuccagggccucacaagagccggauggggguugccgaaaggcagcagaagcugaggucucaguauuucuuugacugcgccuguccagcuugucaaacugaggcacacaggauggcugcagggcccaggugggaagcauucuguugcaacaguugcggagcgcccaugcagguaauucucucuucugucuccuccacuuuuccuggaggucaguuuuccaccccaagggugaucaguguuuaggaggaagccaucagggacuuguaagugcugagaccaguaauaucaccuccauuuuagccagucauccccauacacuaguuccccuccagagaaaccacagggaaagguucaauuuaguaauguuuccuuuauaaaggacagaagaucccaucugaacugguuugggaucugggggagacugggaauuuauuugcugaagucagucauugaaaagucccaggauaggcugggcacagugacacaugccuauuaucccagcacuuugggaggcugagguggacagaucacuuggaggccagggguucaagaccagccugggcaacauagcaagacccugucucuaccaaaaaaaauguuaugagaaaaauuccaggauaaggcugcuuaagauacagcuugauccaggggcuuucuguccaccccucucagcuucauuuucucuguguuagcccauccucagauagacuucccucuuacgaugcaggauggcugccagcagcccagccugcggauuuccugccaaggaggauaagagcacaugccacucaaacagcagccugggcagagauguuacuguguuucauugaccugagaacuguggcuggaggaaaauuagacauaguuuuccuccagccauuugggccagaggaaggagccauaugugagccacaugccacacccucagcuguagggcaagggccaugggacugagggugagagggauccuuaugagaaacuggguuggguugcuguugccaaaugagaaaauagauaucggccuuugaaacacagcagauguccaccucggagguuuccccucugccacaagugccguauucuucuuaggggagucaugagugaaaggcagagccgguuguguuagaaagcuaaacuuggagacccaaggucaaauguaggacgaucgcaccuagcaccuuuuucuauuaguuuuuuuuuuuuucuuuuuuuuuuuugagauggggucuugcccugucauccaggcugaagugagugcaguggcacgaucucugcuuaccacagccucaaccucccagacucaagcaauucuccugccucagccuccccaguagcugggauuacaggcaugcaccaccaugcccagcuaaucuuuguauuuuuaguagagacgaguuggccauguucuccauguuggccaggcuggucucgaucuccuggccucaagcgaccuaccugccucgaccacccaaagcgcugggauuacaggcgugagccaccacgcccagccuuucuauugguuuucuuuuuuuuuuuuuuuucuuuuucuuuugugagacagagucucucucaugucacccaggcuggagugcaguggugcaaucucggcucacugcaagcuccaccucccggguucacgccauucuccugccucagccucccgaguaggugagacuacaggcgcccgccaccaccaugcccggcuaauuuuuuguauuuuuaguagagacgggguuucaccguguuagccaggauggucucgaucuccugaccucauggauccacccgccucgcccucccaaagugcugggauuacaggcgugagccaccgcaccuggccuucuauugguuuucugaggacuuuuucauaacuacuagaaauguuugucaucaaggccgggcacgguggcucacgccuguaaucccagcacuuugggaggcugaggcgagcggaucaugaggucagaaaaucgagaccauccuggcuuacacggugaaaccccgucucuacuaaaaaaaaaaaauaaauaacacacacaaaaauuuagccgggcuugguggugggcaccuguagucccagcuacucgggagacugaggcaggagaauggcgugaacccgggaggcggagcuuggagugagccgagaucgcaccacugcacuccagccuggagaccgagcgagacuccaucucaaaaaaaagaaauguuugucaucuaaaguccuggccccaaaaagcgacaagaggggcuauagaaguggaaagaaauugugcacuguaccaguucuguuccaaaaaugaaaucucaggugggaucagcuacugcugauacacuucauuagaauugccgccauugccgccaucaaacaaaauucgcucagacuuucgucacgauguauuguuacaggagucucuuucccccaugagguaagaaacuauggagcaguccuguaauguaagcacaggcgguguugauaacugacccuggcauuggaauaaagagaaaacugacuuccacagggagaugacgugcugcgcuguggcagcagaucuugugcagaauccgccgucagcagggaccaccuggucucucgguuacaggaccuacagcagcaggucagaguggcccagaagcuucucagagauggugaacuaggugagacuggcucccugcuuugguccuccagccccuucccuuuuauuuguucugauaccguuuuggacucagggauacucaguacugaugggagaauuggauguaauuauccccaugccagccacaagauggcuauauaggccagugaguccaaacccugaccagcuuuguuacuguggggcccuugaaaaggggccaggugauuucagcuguuguuuucuucugcaucugauugcuaaguugaaguaccccugccaacuaacgggucaucgcugacauccgugagcugugugcaguuccagaaguugagugucauuuauuuuaauuccagggccuagugauguaacuuccuagaagggcgguucuucccuccucagagcuagucucugcuagagagcaguggggcgugagcccagcugauaggagugucuugcuuuugucugagacuugcggagcuccccauugcccuugaaaacccugccuuagagcuugacaucaugggauuuuuauuuacccugcuuuaugaaaguugaccuuuagcuuagauuucagggucaagagaaaucauggccguacgugaaagguagaguuggucgaguugggaaguuaauguugaaaauacaguguaaauguggggaggccuccccuagcgccuuucuccacugacagagaaaacagaagaaaacagcagcuuuauuggaacagacauugugcguuggugacaacccagggaggccagggggaauuuccacauucagcccagcugauucagaggauuugagaccuggauucucauuccuaggacugggcuucugucuauagugagacgucuuuccucugcauugacagagcgagcuguucagcggcugucggggugccagcgugacgccgagagcuuccugugggcagagcacgccguggugggagagaucgcggauggccuggcccgggccugugcugccuuagguacagcaugagccuucacguucugcgucgggaacagucugcugugggcacuucgccguggccccggccuugucugccugguuaccccccgcucuguaaacugagggugcucccccucucguuccauuuccucccccugaaaauaugcauccacaguugacagugguucuuuucuggaacaagauuuuucucuucucacaggagacuggcaaaagucagccacccaucuacagaggagucucuacgugguggagguucgccacgggccguccaguguugaaaugggccaugagcucuucaaauuggcccagaucuuuuucaacgggugagucccuuucccacuucacagggcacacacuguuccuuuccuaggcucuucuggguauuacuuuuuuucuaugguguuuuuaaaagcauguugaaacuucuuuauuuccucuuuaggagagaucuuugccuucuguuuugcuaacaaacauaacgcuuuagaauuuccuccugggaggcggagcuugcagugagccaagaucgcgccacugcacuguagccugggcgacagagcgagacuccaucucaaaaaaaaaaaaaaaaagaauuuccuccugggagauauggggaaagcuuuuagaucucaagugaguuucccagagagaacuuggccaggcagccccacccacccuccaguauagcucuccuucugguuguucucugguucgucacagccccuuuggcugucucauucccagcacucucagcuccaggcucucugccuucucccuacucugcauccucuuccuuuuaaagcguuugcuugaaccagggcugauuuuacccccagacaacauguggcauugccuggagacuuuuuuuuuuuuuuuuuugagaaggggucuugcugucuugcccaggcuggaguacaguggcucggucacagcucacugcuuccugcaacuccugggcucaagcgaucucuggagacauuuuggauugucaugacuuggaaggggggugcugcuggcaucuauucgaaagaggccagaggugcugcuaagcauccucccggguacaagacagugccccccccaccaaccccagcaaagaaggagccagcaacagugucaauagugucagggucgagaaacccugcuuuuuugcugcuguuguuuguuuuuuguuuuaaauccccuguucuacuuugaagguuaaaaggaaagaacagcacgcugaugagcugaugccaaauccacuuuugcuacugagaccauuuagggcccaauuucaggauuuccggguggaaccuccaacccugguaaagcugcccuugguguauguggcuaugagaaagugcuuaaagcuucaaccuaaggcugugcugagugggccugguacccaagacacagagacauucuguuuggucagagagagagaaaagggcugcagaguuaggucagaggucagcccuaagauggucacccuaaaaugaaaacugcuauguaaaccugugguaaauaccagaugaaaacuuugaggccgggugugguagcucacgccuguaauccagcugcccaggagguugaggcaggagaaucacuugaacccgggaggcggagguugcagugagccgaggucgcacaaauaccugggcgacaagagugaaacucuugucucaaaaaaaaaaaaaaaagcuuugagauuugccucguguucucaggauccuggcgucuauacuaucuuuuauaacuguuuucucacacuuuuguuuugcagcguguuugugacagugucuuacuuacuguucuagauuguaggauccuugaugacagaaaugaucuuacauucuucacggugugugaguaggcccucaauuaacauuugccucacaaaucagugaacuaacuccucuuaccucccuuggcucagguuugcaguacccgaagcccugagcacaauacagaaagcugaggagguucugucgcugcacuguggcccaugggacgaugaaauccaggagcuccagaagaugaaauccuguuuguuggacuuaccacccaccccuguagggccugcauuguaggguuccaggaggauuuugacccacagaaaaggagcccauggaacacaaguuaaagagguuuugcuggccagguaugguggcucacgccuguaaucccagcacuuugggaggcuaaggugggcggaucaccugaugucaggaguucaagaccagccuggccaacauggugaaaccccaucuuuacuaaaaauacaaaaaacuagccaggcgugguggugggcaccuguaaucccagcuacuugggaggcugaggcaggagaaucucuugaacccaggaggcggagguugcagugagccgagaucgcuccacugcacuccagcccaggugacagugugagacuccaucucaaaaaaaaaaauaagaggccgggugcgguggcucaagccuguaaucccagcacuuugggaggccgaggcaggcagaucacgaggucaggagauccagaccauccuggcuaacacggugaaaccccgucucuacuaaaaauacaaaaaaauuagucgggcgugguggcggacgccuguauucacagcuacucgggagguugaggcaggagaauggggugaacccgggaggaagagcuugcagugagccgagaucgcgccacugcacuccagccugggugacagagccagacuccaucucaaagaaaaaaaaaaaauauuaagagguucugcugccagauguggguucugugggucggguguggguucugugggucggguguggguucugcagaccaggugcggauucuguguagguucugcaggcccaguguagaggcucacaccuguaaucccaguacuuugagacgcugaggugggaggaucacuugagcccaggaguucaaaaccagccugggcaauauagugagaccguaucacuacaaaaaaguuuuuuuaguucaccgagcaugguggcacaugccuguagucccaccuacucgagaagcugagauagggucaccugagccugguaggcugaggcugcagugagccaagaucgcacuacugcacuccagccugggugacagaguaagacccugucucaacaaaaaaauaacagguucuguugcugcugagcuuucgucaggaagauaagacuuucccaacaguccgaagccuaggauaugagggcugaggaggacucaaaccguugcagucagagagacaccuauuuuggugaauauuuuuugaaauaguuaaguggccuccaguacaaacucccaguucccagaaaagacuuaaaacuaguaucuggagauuccaaguccuuuaaaaggauuuuagcugaucugcaggcaucuggauguuagccugggguuuuggcuggauuccaccucgcucagugaugauagucuguuucccuggaacauuccugugguuuuaguaguaaugagaugugugcaccacuccagugggaacugaagcucuuaguaguuacauuguaauuaaaaaagaauuauaaaacaagaaaucagcaagccugcuuaccuccagagacacaccguuccacuuacaguaucuagcuuccucgacuccuuuguuaaaaucguggaguaugaaccgugaccagagaaguaaauauggagccguuuuauugagcaguuuccuccagggaugacggcugucaguguguuuccugccaguuuuccaguccuuacucucugcccuucauucuguacucuuggcagagucaguaaccaaccacuaauaaaaucaaaguuguaguaaagacuuuauaacacaua

SEQ ID NO: 192270 - RNA, 44828 nt, Homo sapiens
uugccgcagagacgccccgcccccgcgcggcgcugcggaaccggagcuccgggcggcgucggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacauggugcugcucaaggaguagugaguguccggcggccgugcggaagcggggaggagggaggguggggacggccgccggggcgacggcgcggcgagggacgcagggcccggauggacggaggggcagcagggacggagggugccugaggcgggcccagcggggauggaggggauccggggcgggcggcacgugaggcggggcccacggggcacggaggggcggccggggcguggaggggcggccggggcguggaggggcagccggggcguucggcaucugagccggggcccacggggcauggacgggcagccggggcauggaggggcccacgggcacggagggacaacccgggcggacggcuccucaggcgccccgggggccucggaggcccaaguggacccgaggagaggccggggacagcgagggcgaggccaggcccgagacggggucagggcagggagagcuggcccgggacugggggaggccgaggggacgccgagcgcugggagugcuguggggucgcucugcgcgggccgagggcgcgggcucagccgggacugcaggcggcgcugagaggccccgcggcggccgaggaagaggcgcaccggggcaggcagggccucccggcgguggggaaagguggagggccgaacaguucacacggagagccggguggaugggucagaggcuccgcgauggaguugggauggggauggggaggaguggccgccuuaggcaucgggugagggguggugguaaguggacacaggaggaggacuaggaagucagggccuggcuggggagacaggugaagggucugaggacaugcagagggggcugagaugcgggccggaguaaccguggugcccaagcagcuggugcggaagaggaggcuuuuggaacaagcuugggaugacugcuugggacguggggagacuugggcgaggaggccagaaaauguuggguaggguccgaaguggagaaggccgggaaguuaccggggucgaggcugguccggaaagagaguauguugggaugaguauaccugccguuggagaugggggagaccagggcagggccagcuuguuucuaggggauucucagucuuggugcaaagagauggggaaauucuuugaggaauugagggguccauggagccgugaacugaggagagaugguggaagggguggggagcucuugaguagugaagaggggugcgugggaaacuggugacuucuggaaggaguugcaggaugacggguuugcuccugaaauccaggggacugggggacagguggagauguuuggugugcuaaaucuuucaaguacaagaugagccaucguugaagcucaggguuccaaguaagcaucacaggacauuuuucuccccaaagaggagagauaggaugggugugugugugugugugcgugugcgugugugcacagaauuuacagugaaacugcuuuccuggagggagggccagaagccccaggagugggagauggucaaacagagagcaacuugugaggcagccaggcaggugugcagagagcucuugccacuuugucagcgaucgcacuuugaccauccccaccaggcuggcuccuuggaggugcuuaggacauuuaggacauagaguggaguuuggguaacagagggagcugagacccacaugucaucccagcuaaacaccucaucugaagagcauuauuuugaggccucauccccucuguuucuugacauccagucugauguuaauucagccagggcucggagcuuuuccuggugaggaggaagaacuuuacgaugccaacaggagaacguggugcacuuuagauuuuaaucuucaguguccagacugacaggcuuuucccauccuucugauucuuuuuccuguucccaaaugaacccuagaaucuguagaaaucugugguuuugaaaugaaggucaggcagggaaaggaagggaccuucagaggagaucugagugagguuugaagagaggcacuccuucccugucuuuguucuccuccccuugaagccugcaagggaaaaguccaaggugccggagaugcagggccugccugguaucugcguuuccuuccugcccgacucgugccccgugugugcaucccugggcgggggacgggggaggagcaggggcaucagggcauccgagacacuggcuguggccgcagcguugcagcccuggaaagggugcgagugaaggucacauuagagugagugccgcuccaggcccagcccggcaguuccucuguggcccuguccuuuggaauuguacccuauugcugccgaagugguuuuguuccuaaggagcaagggggcagugucagagugugcagccgucacgucagcagccucagcgcaucccgucaggaauuggcccauggcauucucuuuuggggugagacuugguucccacccagcgucugcagguugccccuguugauuuuuccaacacuuccucuaacaggauucuguuuaauuugauuucugcaaaaucuuggaugugauuuugacugcuguucuugaagauaaaaggcuuauuguuuucuaggaaguuucuucugagggugcagaaauucuggccuccaaguugggaguauuuuucugcaccacuggcuuucuguaaugggaggggaggcucacuggcagcauucaguaaacuggaggauuuauguuguuugaguugcucuggaggaagggaguuguuagcaggcaguaaagacuuggagcccauuuuguuuuuccugcuacuuuccugcuuggugucuugccuuugaggugauguuuuccucagaccccucuguguccuucuugcuuccugggggaccuuuguggaacuagaaaauagcuguuuacuagccuggagcaaggagccugaguggugagccggcugcauaaggaaggcacagcagcucaugcuucccuaaugcuucacuaaacaugcaagacacaaaaggacccagagggcuccagcaagggucuggggaccgaacgucuaagcuuggaaacuggcuggacuuguauggguaaaaccaagaguuuuugucuuagcucucccgccucacagcuuugaacuggggguggcucuuggucugcauuucacaugcacggcaccuggagaagugcugcuagcccuggcaccucugugggguucuggcccuggcggagacuuugccggccacggcuucuccaauagguugcugguggcaucuccagcaauugguggucauugaguuggagaagaagaaaagaaaaugauaaauugggauuccuuuggacagcuccuggaggucaggacauaaguugaaugcccucuugguggcuuugugguagcagcuuggauuguaauauccagccccgagcagagaugcccgguguguguucuuaggcuucaaggggcuuggucccuuccuggcccuuccccuggagggcuguuguugggagguuggguccacagaaauuuaaguccccagggccucuuguuugggucugaauccucaccaugauagguccuccuguguuaaccugucuuacuagacucacuggcaagucuuguuggggggacgacucauuggcaaguuugggugaaguuuaucauccauauguccaguuccgaaugugagguggaggccugggaaguagcuggcgggaggauagguuuggacugaaucacaggguucuaacugggaugccucaagguacagaggguccuguccucagagcacuaagagggccauucucugggggggggggcgggggggggguguugucacagaguuuagugucuuacaccucuagggcacagaggguccuguccucagagcacucaaagggccauucucugugggguuuucgucacugaauuuagugucuuacacaauagaaugcugcugacuguuuuaggaugaugcuuuaaagagccuugagcagauugcacagccuaaaguugauacucucuuuucccuuucuuauagucgaguaauccugccugugucuguagaugagguaaguccuuuuacuuucugguccauaguuguguguaacuguuugugaccauuggcuaagcugggcucugagugguuauccuguuuauauaguuuucuuauuuguucuaacauaaauauuucaaugugaauuucguggugccacuuucaguugaaaaauggcacuuacuuuguauaucuggguaacugugugcaaccugucccaagcuguugguaugcuggaugaguagagauuaaaccagccccuuuuaucugcuggggcugugcaugucuggggacccuuuuuuuuuuuuuuuuuugagacggagucuugcucaguuucccaggcuggagugcaguggugcgaucuccgcucacugcaaccucugccucguggguucaagcuauucuccugccucagccucccaaguagccgggauuacaggugugugccaccacacccggcuaauuuuuauaucuuuaguagagaugggcuuucaccauguuggccaggcuggucucaaacucccgaccucaagugauccgcccgccucagccucccaaagugcugggaugacaggcgugagcccccacacccggccggggacgcauuauugaugggaucaagugugugcauuucugggacguccgugacucggcuggcaagugugcguggcucuuucugguugugcaacaaaccagcagggcaggaaaucucuugaggcucucccuagccacgauaggugacugcuggaaagaccaagacacagaacccuccuuuuacgaagggcagggaauaacacauaggcuuggcuuguccucuguccuuuuacgguuccugggucugacauccuuguauguggggaucuggcagcaggauuugcuguaagaagguucauaggccaugcugacucagagucagucucuuggacaacggaaaacugucacggaaccucccuugucucacucuuucucugaacuucuuccacucuccucuccuggcgcagccuuguucuuugcuuccuucugaaaucacagccccaccccgccccagcuuccaguuaaacucgaguuugggugagguucgucagccaguauagugccuccagucacugggcuccgucucucuuuccugcagugucagcaugaagcuccugugauaacuuccacucuguucccaauaugaacugcaccuuugaaaaaugaaaucaggccagcagagccugcagcacauuuaguugagacagacauccaggcuuguuggcccccgagaggggugggcagacacuggcccuuuagaggacugccuccaggggugggcuacauaucugauaagagcuguggggaccuggggagggggccagaggugggccuugaccgugaucuugggguucugggaagggcagaaaagagaaacgagacuggggaaccugggaaccagggagaaugagggaauggcuggguagauggcucuaaucccuguaggcacuggggauguaccuggggccugagaaccaggugccugggcugacagguguuggcuuggaagggucuuguuaacccaccugcuuuggccaugcugucuuuauuuuuuuuauuuuauaauauuuauuuuaaauaguggagauagggucucacucuguuguccacgcuggucuugccucaaguaguccuccugccucagccucccagagugcugggauuacagaugucaaccacuucacccagccugugcugucuuuauugaaaauagcaagcgaugauuuuccaaaccagaaggccaagcaggaaagcccagcgcgucccuugcccucaaacucagcucuuggggagguguccagugacguccucucugcuguacaggaugaucccaccccgaucguuaggaagaugugccccaggaacucgggauuuccuuaguguggugauuaggggugaaauggauccuuugauagggaguuucuugauggaacgaagggcgagagugucucugagaagugcugcagaccaaggagggccagccuguccuggagcaccuggggcuguucuuggaguaaggcugaagggccagacacugauggcuuaugguggggccaagacuggaaggaaaggggaacuuccaccuugagagcauccacaguuggcggguguucacuugugaugguuuuucugcagcauugaggaagugguggggcggaguugaguaaucagagccugaagucuaagcagaagcuugggaagugagugcugaucaggauucaccugucugccuggcaguggucagcccguucucagcaagaaaccauugacaagaaaguaccacguggccuggguagggucgaagcggaacuuaguuucagagaauuagaaaaaucuuggaggggaaggccgaagaagaaacaauucaugaucaaccuucucagagucuuugucaguaaccccauccccauccugacuuaacaguuucuaugggaacagcucagcaucuugugacugguggauucacuuccuaaauuggaggccaugacuugaggccuuugcaguuuucugauuuaggggaaagugaagaaagggaaagagaaggucaugccuuuguaaucauuccgauggccugcaucaauauuuugggggcagaauuagcuucuggguggccagagccuuuggucuaacccugagugucugggcguugugcagcagagcgagaaagcccuggcuguuugacgggguguguccaccagugcuuccuggcacaggucggccgggcugcuucacuucuuguuuccagagauucacggcaccagucccccucugguacccagccugacagggccauguuggugggaccaaagcuguacuguuguuuaugacguguuucaugucaguauuucaggcccacccacugggcucccccucccagauugccaaaguuguggagucuguuuuucuuaguugaaugucuuaguucucugggauaggugaacagaucucaagagcaaggaacaucaucgcaggucugaggaggcuagauucccaguccuguuggaguuuuuuaaaucugauuuaaugaucugacccucccacuccuaucucugccccauccgagucuggcugcuuucccagggggcagagcagcugugccaaaaggaacucuaacgugaaaagcgcccuucacuuguagcuugugcaggccagucuugcuuaccccuuuagauuaacaaaacugccuucacuugucucauugggauuaaaggaucagaauaucaagagagauugaagggggaagaugccagccaacaggcugauccucuuagaaccugcccucugauuccugcagcugaagagaaaccaaaugaaggcgauuagucucugccuggggucccccuucccaagugguaccacuagcugggaaccucgcccccuccaccaggcccucuccccagccuguccuuuaggauugcugagucagugguuagauguucuuacggcucuucucugaaacggaguuacugcuccuucuuaggcaccccuggcucagccaagcccugacccaccugacggguuuucaugugugccuagcugggugguggacuuggagaggcacagggacagcuuggggcuccaggggggcauugaggcagcacugaugcagcuuaggauuagcaaggucaaggugacuggcuuucacccauauguuccucuguauggauuucacugagccucgauugcugccccuuuucauggcauuuuguucugggauuuugcuuugaaaguuagggcucuuucagccuuguggugagcagugaauuguccucguccucugcuucacuuuccagauuuugcccagaaauuucccugcagugcuuaggaagcugccugguagagcagguuucuaaguuugaggcgaagcagcucuggaagcugccucuguccuugcuguuggaggcagugauuuaaguagcaguugccuagagauacauccuuucuguuuuaaucucaaagagagaaaaacccagucccuguaaucccagcuacuucggaggcugaggcaggaggcaggaggcaggagaaucacuugaacccaggaggcggagguugcagugaccugagaucgcaccacugugcgaucucugucuaaaaaaaaaaaaaaaaaaaaaaaaaaauagagaaacacccuugucuuccccccgggggugccaggaguugggcauagagcucgaggaaacccuuugucccccuccaccccccagcauguuggguaaucccauagcuuuuuuccuuuuucucauacucccuaagcagccaugccugauuagcaccggcagcgguaggaaagacacauccguugguguagacauaauuuccugccucaaauguugcuguucauuuucuuuucaccuuguuuucuccucuggacagcuucucagagaagaaggcggaagggcuaagucugggcacugccuaggucauuggcccauccugacagggucagaggaggccaaucauguugacuggugacuugauaggguggcaugugacccaaauaaaggaaaacuagguuuuugccauguaguaagugccaacacagagggugcacccagccggcacagacuguggggcaggaaucuguaauaucucaugugggaagcaggaauacuugcuuggccccaccaggaaucuggaaaaugucaagagguuucauugccugaaagagcuacuugcggggugaggagaggccuaagacuagagaagaagcgaguagaugagccaguuuuacgauagagguugcggauuucacagagcgcugagcaccuuucuuugacaagaaaucaagucuuaggaucuauuuaaaugggugagauccagugauuucuagcaaccaaccuaggucuucuggggucuuaauaccagaagcaggcuuagcacaaaagcuccuuuggacucuaaucuguuuucugcgugguggugucagguuaaguagacucaccugccucuuuaaauccugauggauugacugggaacgguggcucaugcuuauaaucucagcacuuuggcaggccaaggugggaggauggcuugagaccaggaguuuugagaccagccugggcaacauagcaagacccugucucuaccaaaaaaaauaaauaaauaaaaauaaacccugauggguggugugaaaaugagaaggaugaacuaaacacgucugaugggucaagaggggccauggagcagcacugucaguugcuuuggguggguuugggcaaggccugaugugaaacuccagaaccagcuccugcaugaggagaccccagggagauccaguuagacacuuacuggcagcuggauuacguguaaccguugagaaggguccguguugagaauaacaucugucucuguccuuuaguaucaaguggggcagcuguauucuguggcugaggccaguaaaaaugaaacgggugguggcgaaggcguggagguccuggugaaugagcccuacgagaaggacggugagaaaggccaguacacacacaagaucuaccaccugcagagguaugcggcaugagcagcggggccggaugcuggcuuuugugugugugugaaugaguguuauuuccuuuauuguuuuauauagaugggauuauacuaauuguuauauccuaacaauuaauaguuauauacugacuguauaaauguuauacucacauuuauauagaugggaauauacuauuccuuuuuuguuguuacuuaucauggccuccucucccagccuguucugucugccucggucucugaaguccguguaggauucacaguaucaugggggacagaagugcuauagguuguugaacccuccugucuugacgcauauuucuagucauuuccagaugccuacauaauccaguaaaacuccuucuguguagaucuucugauguacuuguauaugcagauuuuuagcaaauauuccuaaaauugaauuccuagaauugcugggcugguaggguuuuuaauucugauaucgugaaaucgaucgcuagagaaauuuugguaccucucuuuggaucaaaggcaucagcauuuuuaaaugaagcuugaacugauuuguguacuggaauccauaucaaacuacacaaauuugcuaaaucccuaacgaaaacaguaauguuucagcaaacugugagcagacccaaagggcguugaugguauuaauuauacaucagcuugaguggaagucaaaccaagcuaguuuuagaagcuauccagaacugguaaagguaaaccugaaucuuuuuaaaaauugugauaaaguacacguaacauaaaauucaccauuuuaaccauuuuuaaguauacaguucagugacauuuaaguccauccacacugcugugaaacugaaagcuggaucuuaauuucuagucucuaaacugaacugaaaucaauugacuuucauuuggaaaaagccccacuucacuguggucugucacuuugauggugucagaggguccaggaccucagugccagggugcgaggagagcagugcugugcaguggggaggaaccucaccaucacccagucuccucgccagaggguccaggaccucaguaccggggugcgaggagagcagcgcuguccagcggggaggagucucaccaucacccagucuccucaccgucacccagucuccucgccagaggguccaggaccucagugccggggugcgaggagagcagugcuguccagcggggaggaaccucaccaucacucagucuccucaccagcacacuuuuucuccaugucucguuuugcuccuccucugguauuuguauuucuuaaagaggauuuugaaaagagauggugaaguugguauuuuagguagaagggaccaauuguuuccucaagacuaaguugguccaaccaaacugacagagacgaggucucuacauaugaaagauggaaccuggccgggugcuucgggggcucacgccuguaaucccagcacuuugggaggccgagacggauggaucacuugaggucaggaguuugagaccagccugggcaacauagcgagacuccaucucuacaaaaaauaaacaaaauuaggcuggugugguggcgagugucuguaguccugucuacucaggaggcugagguggaaggaucacccgagcccaagaggucagggcugcaguaagccauggucacgccacugcacuccagccugggccacagaaugagaucccgccugucucuuacaaaaaaaaaaaaagaaaaaaaagaaaaagaaaaggccagcagugacugccaccacuaccucuccccauggugacaagagaagcuuuacugugucagccaucuggcugcccaaagcagaaagcagagcuccccugcaguacucucacucgcccuucuuaucgcaucaggccccgcugacuccgccccgcaacacucucacucgcccuucgugucccaucaggucccgcugacuccgccccgcaauacucucacucgcccuucgugucccaucaggucccgcugacuccgccccgcaacacucucacuugcccuucgugucccaucagguccugcugacuccaucuccucagcgucuccaacaugucccuuccuugccaccucuugccuggauuacuacagcagcuucuaacgagucucccugccuuucaguucuccgcaccgcuucaaguguucagucuggauggucugucacucccagcgccaaaacugcugacggcuucccuuugccuucaggacgaaguccgugcugucugacauaacuuauaggaccuuuuagccagccugggcaacauagcaagacccugucucuaccagaaaauacaaaaaugagccaggcauaguggugugcaccuguagucccagcuacuugggaggcugaggugggaggaucaccugagcccaggaagucaaggcugccagugagccaugaucacaccacugcacuccagccugggccacagagugagacccugucucaaaaaaaaaacaaaaaaaucuuuuaggauccagcuucaggugucuccuugaauuccccaccuuguaccugcaccgguuacucugaacuugucccucuuuucuccagcuuuucccaccccacucccaucugucucuuagcuuagccccacucauugucccauguguugguucauccugacuuuccucgcagagccugcccggugcacugcaugucccccacuguguucucacagcacuccgccacccagggcccugugcccaccgcauuauggcaugaacuuacaguguugugcuuggccuugucuaguuacacgccccaguagaccggaaacuccuugagggugggagccacaucuguuugguuucucugugugucccccugccuggaccuagaaauacucgccugaauggggauggcagugaguucgugaaucacagaggccgccccaagugcuccagguuagcucucugcucuaguuugcucuucuuucuuaggccugaggcacuaaagcugaugagguugccagagcuugccaaagacuggacagauuaucuguuagaaaccaaggacggcugggcgcgguggcucacgccuguaauccccgcacuuuaggaggcugaggcaggcagauugcccgaggucaggaguucgagaccagccuggccuacaugacaaaaccccaucucuaccaaaaauacaaaaauuagcugggcgugguggcgcaugccuguagucccagcuacuuaggaggcugaggaaggaggauugcuggaacccaggagauggaggaagcaaugagcugaggucgugccacugcacuccagccuggcgacagagcaaggcuccaucucaaaaaacaaaaacaaacaaaaaaaaggaaaaggaauauauguaccauuuucauuuuaauuuuaaaaaaucuuucuaggccaggcacgguggcucacgccacuguaaucucagcacuuugggaggcugaggcgggcagaucaugagcucaggagauugagaccauccugucuaacauggcgaaacccugucuuuacuaaaaauacaaaaaauuagccgggcgugguggcgggaaccuguagucccuucuacucgggaggcugaggcaggagaaucucuugaaccugggaggaggagcuugcagugagccaagaucgagccacuacacuccagcuugggugacacagcaagacugucucaaaaaaaaaaaaaaaauucuaaauguuuuccuacuccgucaaaccacacaccuaccaaaaaaaaaaaaaaaagcagggggcuuauacuguacauguuguucuguaaccugagauaagaauugaguagaagagaccgggcgcgguggcucaugccuguaaucccagcaccgugggaggccaagguggguggaucacgaggucaggaguucaagaccagccuggccaacauggugaaacccugucucuacuaaaaauacaaaaauuagcugggcgugguggcgcaugccuguaaucccagcuacucaagaggcugaggcgggagaaucgcuugaacugggacccuggagguggagguugcaguuacccgagaucgcagcacugcacuccagccugggcgacaaagggagacuccgucucaaacaaacaaacaaaaaaaaagaauugaguagaagaaaauacuuuguccugggaggcaaaugguucuaggcccuccuggccucucagagcugaugaaagcagaucagauaauccuggaucccaaacccaaguuagucggcuaguuacccuggcccuaaaccgagacugguucaugcuuggaggcaucuccuuuguguuuuucucgcaccuuguaguauaaugcccugggcccagcaagcucuggaaaaauguguaaugcugauggaaggggugaugagccacagcagguagccuggggucucuugugugguccuguuucugguggcugguggggcacgucguggguguguguuaggagccagccaagguggggugucaggcucucauacguaacuucucacucccaccaguaaccugcucauugcauggaaacuugcuugucagcuccccaugaagaagcuggaucugaaaagccucuugucuccuuucucucuaccauuucucuuuauaccccuuuuuuuccccgcuauagcaaaguacccacguuuguucgaaugcuggccccagagggagcccugaauauacacgagaaagccuggaaugcuuaccccuacugcagaaccggugagugcagccggggccacgucggccaggcaggggcgggcagcagagcugugggucccaccugcguguuccggauuaggccagggaaaggcucgggcugggucccuuccggcugaugguggguaucagugcuguguccagcacagcuugguggacagcagggcgagaagcaccggucgucacggccugagagcacagagccagucucucacuuggggaugcugcgauuuugauuauuguuauucauuauaacauuuuaguauauuuuucuagucauuuuuauuuauuuauuuauuuuuugggagauggagucucgcucuguugcccagacuggagcacaguggcgugaucucggcucacugcaaccucuggcucccggguucaagcaauucugcugccucagccucccgaguagcugggacuacaggcgcauaccgccacgccuggcuaauuuuuuguauuguaguagagacagaguuucaccauguugcccaggcuggucucgaccuccugaccucagguuauccgcccaccuuggccucccaaagugcugggauuauaggugugagccacugugcccagcccagacacauuuucucgaaaaauuuuagaucauuacuauuuauuuuauuauuauuuuuuuuuugagauggagccuggcucuguugccuaggcuggagagcaauggcacaaucuuggcucacugcaaacuccgccuccuggguucaagcgauucucgugccccagccauacaaguagcuggaauuacaggcauacaccaccaugcccggcuaauuuuuguauuuuuaguagagacgguguuucaccauguuggccaggcuggucucgaacuccugacuucaagugauccaccugccucggccucccagaaugcugggauuacuaauaugauuacuaauuuuuuaauugcuuuuuuugucucacucuguuguccaggcugguguccaguggcacaaccacagcucacugcagccuuaaccucccaggcucaagugauccuucugccucagccucccaaauaccugggacuauaggcauaugccaucauguccggcuagguuuuuuuuuuuuuuuuuuuggagagauggggucucaccauguugcccaggcugguuucaaauuccugggcucaagcgauccucccaccuuggccucccaaagugcuggcauuacaggcaugagccacugugccuggccuaaguuucucauuuuucuucagugaauggauaacauuuuccuugucacuaaggugucugguguuuuguuuuguuuuguuuuuuaauuuauaauagcugcauaguauuccaucauaugaaugaacuguggcuucugcugaaacagcauguucuguaauugaggauacagguauaauuauuuucuuaaucuuggccagucuccugcauagaguuucuugaaaggaaaggaaagauuugaaccuccacagagaacuuucuauucuaguccagacauucuuaaauuucuuucgagugauucagauucuuagccuuccaagauuccuagguuuccagggccaucuaggaauagaccuguugggagggccuaagcugguacugauucauaacccuggggaguccugagagguccccuggcacuugucugugagguaggugaccuuuccucccaccagccuccauguguggguacagacaguguugggcugcgggguccucccaccagccucugcugaccuguccuccugcacuugcuuucuuuguuggcaccugguacucccuagagucugaugagucugggauccuuacgugacgcauaucacccuuauccuguggacuuugggaaugacugcaauccagaauacggggucauugcucuuuccaacccucaguggccccacacagguucagggaccuuguaucaggagauuugcggucauugguggggucugggauguguaacccuuagaguuuucuugcuguagcugaagcacagcccucccuacuccuuaagcacugggcuggaaguuagauucuuggaaaugagggaugcacagauguucuuaaaagacagggucgggcacgguggcucaugccuguaauccuagcacuuugagaggcugaggcaggcggauuacuugaggucaggaguucaagaccggccuggcuaacuuggugaaaccccguuucuacuaaaaauacaaaaaguuauccgggcaugguggugcaugccuguaaccccagcuacuugggaggcugaggcaggagaaucgcuugaaccugggaggcggagguuacagugagccgagaucgugccauuccacuccagcuuggacaacaagagcaaaacuccguuuauuaaaaaaaaaaaaaaaaaaaaaaaaaggcaguaugcaguguggcugggugugucuggucuagggccaaagguggauuuucuugaugucuaagagagucgcagugagcauguguugcaaguguggacaucucccugccuggggcaggguucuggguacacagcuugugccaacugagagaugccccuguucucugugucauucugggaagaguguugcggcugacaugggcauuuuucugcacguuaaauguucauauauugauccuuggccaaaagaaaagaaaaacauaauuucuguaucagcaccaugcgcuaaccaauugcgccacuggagcuccacuggaaaaauguaauuucuaaauauuucauggagacagggaguaggggaaggaagguugguuuccucagugggugcugaccuccuauucaggauacaccuucacacagaauggauauguugaaucuuagaucuguuuaguuagacacuugcucuuuuaaaauaagagauaccagcaggcaaggaaggcuacuuuccaguucccucugggggcugaugggagagagguuauuaguucagacaucuuagcuuggccucaguagauccaaguuugaaggaagauagaugaaggagcaugaaguaaaaugccucauggcuuuuggaaggcucuuccuuucucugagcggagugaaaacagauugggacacccugguaaugaucagcucuugcuguucuuagcuuguuucccucucucuuuuucccuugaagcugaugggaugggcuggaagugaggagaggguaagauaggaguuggucugugaaugaaugaaagugggaaaaggaaaagaaaguuuguuucuccuuccaucucuuccuggaacuauaguccucggcuggauacaguaucacuaagccaugcuuuuauuuauuuauuuuaaauuuuuuuauuuuuugagacagagucucauucugucacccaggcuggaguacaguggugcaaucucggcucacugcaaccuccgccugcuagguuuaagcaauucuccugccucagccucccaacagacaguguugggcugugggguccuccuccugucagccuccauguguggguacagugccugggauuacaggcaugcgccaccacacccggcuaauuuuuauauuuuuaguagaaacgagguuucaccauguuggccaagcuggucucgaacuccugaccucaggugauccgcccgccuuggccucccaaagugcugggauuccaggcgggagccaccgugcccggcccugccaugcauuuaaaaugccuuauuagucucauuuggaaaucucugcucucccacugcaaaagauuuccugcggcuuuucuguguacuuuggguuacaguuugaacaacagggaauacuggaaugcagagguguuugagggccugggagggcuggagaagguuuggggaggauuguuugaucacccaaguuugcaugaaaaggucagcaagggcugucacccucaugauuucggaaaaccagguugucagaacugaguggaucugucucucggggucucacaaagaugaauguguaaaaaccccagcgccagucuaugaaguuacacuaaaacgcagaauugcuaccgaaacgggacauucccauucgaugaucagggcauucuuuucuuguggauucuucuacaugagaaaccaaauuauaaucagaaugccaauguguggcaaagaauguccgcuuggcugagugaucagauucuuggguccauugaugagcacgucucggagaggccgaacuaggagagacuuucuuagaggagauagauucaaaaaaggugcuuaguuggagaaguuuaguggcuggugucaucagaccaggccauccuggcacugcugcccccacuccagggauggcgcugccagagaugccacaugcgggggcugggccuccggggcccaccacggcacaggagaauuucugcugacgagauacuauacccaugauuuccuuuucuuauucuaacgugguuuucuugaagcugcuaacagggcaguuacuucaguguaggccuuucaguuguaaucuuaaucuggugcuuccuucuaagugucuuucguuggguaugggggaauuacugacagucuuuuggguuauuucugugcgugauagcucuuacucuuuauauuucaacuuugccucauuuugugcuccggggucaccuuaacuucaguucuggaguuuguuaccccacacacucuacaaacauggcaguggggcagccagcagaaguggacauagguccuaaauucagaggguacagaaugaaccgggcggucucaggagcagagcuagucuguuccccagugacaugagaggugcagucauuuucucugauaaauaauugaaccaugcuuucuaagggguucccauuacaaugagcaggagugcagagccugggagguuugauuacagcgagaggaagggugcaggaggcagauacagugcauggccaaagcacccugcucugugccccgggagguagaggcugggguaggggugggaggcgccggagaacgcucugaugccagagugaugaguugcggcaccucugcugaucagagcuggucccugucagugcccugcugaaaagaaucccaagaagcccauagcggcgucgcuuuaauuaaauucccuguuugguuuuuugggauguuugucugagugaaauuugaggguuggugcguuaagguauuucugacucacuggggcuuggaggugaccguggaauaagccacagggaguaaaguacacucugccauucguccuccuugugggggguggggggcagauauuucuucaucuucauuaaucuuuuucucucuucuuuccauguccuugccucggagcaguuauuacaguaaguauugucaaggggguuggaacuguagaugauguauaagaacaggagagagaaaaauguaacugcacugguggucuuggguguucuuucccuuggcugauguuuggaguugcugaggcucaguccugucaguggacuaacaaggaaccuguuaacuggcaugaugaccuccugcuuuaagcugcauuggccugcggcuccauuaagugcauccuggcugugggucugacauggacacaguggcucgaggcccugccuccccaggucacaccuuuucaagguuguagagagagcuccauucaacugaccugaccgacaucccuuccccaucugugcaucuguugaguccacugagcacugauccuuggcaaagucgugaagucagcgggguuucucuuccacagccguccccucugucauugcccacccgcccaccauucagcacacucaucugagugccuugucccugccgguaaacacuggcugucucugggaaacugguuccugcugaggcguuaaugggugaauguguuccuccuuugagaaguuccaauuuuuaagaagcaggaagggagggagggaggcaauaauuagcuugaaggguucaguuacugagaagaaaacuuaaggccuuagccacaggcuaguuggagggaaaggggccauggugaguaucuucgauggguuaggaagucuucugugcucuuuccacacugcuuacuacccagaguggcuaaaugcauggauucugaagucagacgaaacuguuuugagacccaacucugucgugaucucugugacuuuuuuuuuuuuuucgaaacggagucuugcuguuguuuccuagacuggagugcaguggugcaaucucggcucccugcagcuucugccuccuggguucaggcgauucuccugccucagccucccgaguagcugggauuacaggcacccgccaccaugccuggauaauuuuuguauuuuuaguagagacggguuucaccacuguuggccagacuggucucgaucuugugaccucaagugauccgcccgccucggccucccaaagugcugagaugacaggcgugagccaccaugccuggcccgaucucugugacuuugguuaagucaccuaaccucuuugaaccucaucuguaaaaugagggugauucuacagagcucucaggcuggggugaggauugaaugggauaauacaugccuagugugucgugggcucccagucaaguuaacuguuauuacaaggcagaggcuggaaucuccuagcugcccaugauccaguaaugcccaucuccaguaaugggagaugguuacucucaacugugaaccuagugacuuucauguauuuuuuuuccuucuuccagaaugaguacaugaaagaagacuuucugauuaaaauugaaaccuggcacaaaccagaucuuggcacgcaggagaaugugaguaguaguucccaaaagccccaggggugaggucuugagucucugccuuguagccucuccagggcuaccaugggguccucucugugguccucuuuugccuggccgggaaggcaguggccucugccuagaccuaucuuaccagcaugggauugcuaugucucugauuugcaaaaugugaucuccggaacuuuuuauggggccuucucguacugcuuggauuggugcaguuccugguacaugggagcuauaucuuuaaaagaccaaaauuacaguuuucuauagagcacaauuugcaguaacucccaaaaaauaaaauacaccuauccuuuagcauuuccaugcccaagaauuuagacaguuauuuucacaugugugaaauaacauauauacaaggagacucauugcagucuucuuuguguagccaaagaucaaaaacaauguaagaccauccugggcaacauaacaagacucugucucuaccaaaaauaaaaaaagaauuagcugggcauggugguaugugccuguggucccagccacucuggaggccgaggcuggaggaucauuugaggcugggaagucaaggcugcagugagcugugacugcaccaccacacuccagccugggcaacagagugacacccugucuccaaaaacaaaaaaacaacauaagagcccguuagaccgggugcgguggcucacgccuguaaucccagcacuuugggaggccgaggcaggcggaucacgaggucaggagaucgagaccauccuggcuaacacggugaaacccugucccuacuaaaaauacaaaacagccaggcuucauggcgggcaccuguagucccagcuacucaggaggcugaggcaggagaauggcgugaacccgggagucgaagcuugcagugagccgagaucacgccacuguacuccaacuugggugacagagcgagacacugucuuaaaaaaaaaaaaagagaaaaaaaaggcccguuaguaggacaacguuaaaugcauugugguucagccaaauagugacauccuugcagccauggaaaaaccaauagagagcagucuucaaguugacuguucagugaaggauggaaguuaugaaacaaggugugugcaugccgcccuucauauuaaaagaaaaauccacgcacauggauguuuguauguaggaucucuuagagguggcuguuacuagacuggggacgagggacaagcaagaagaggaguuacucuaguuacucuauauuguauccuuuuguaauuuugaauuugugucauaauuuuguauuaugugcauguacagccugaucaaaauaaucagcauguugcuaaacagacgccaucucuagaaggguuuacagucuuuacagcgggucagcauguugcuaaacagacaccaucucuagaaggguuuacagucuguacagccgggaacacauggaaauggugugggcaccguaaacauccggaaggcguuuugaccugcagaagugacguuuacccucaauagucagagcauucguucucagucaugucacuuaaaauccagcgggggcugggcgggaggccaaggcggguggaacacuugaagucaguaguuugagaucagccuggccaacauggugaaacccuguuucuacuaaaaauacaaaaauuagcugggcgugguagcccacgccuguaaucccagauacucgggaagcugagguaggauaaucgcuugaacccgggaggcagaguuugcagugagccgagaucgcgccauugcacuccagccugggcgucgcagcaagacuccaucucagacaaacagacaauccagcuggguucaguguugugcaccuauagucccagcuccucaggaggcugagacaggaggaucacucaggcccagcuccucaggaggcugagacaggaggaucacucgggcccagcuccucaggaggcugugacaggaggauugcucgggcccagcuccucaggaggcugagacgggaggaucacucgggcccagcucuucaggaggcuguaacaggaggaucacucaggcccaggcaggagacugagagaggaggaucacucaggcccagcuccucaggaggcugugacaggaggaucacuagggcccagcuccucaggaggcugugacaggaggaucacucgggcccagcuccucaggaggcugugacaggaggaucacucgggcccagcuccucaggagacugagacaggaggaucacucgggccuaggcaggaggcugagacaguaggaucccucggucccaggcaggaggcugaggcaggaggaucacuaggagccugaggcaggaggaucacuccggcccaggaguucaugcuagagugugcugugaucacuccuguggauagccauugccugagaaacacggugagaccccaucucuuaaaaaaaaaaauccauucucccauuucuuuggauaauuuuguauguaauuguauaauuacuuaucauuaggaaucuuacaucuguggcuaugggaauggcaguuccuagguguccauucuggcuaaaggauauuuuauaacugacaaaaacugcauagugguuccccacuuguucccacaggugcauaagcuggagccugaggcguggaaacacguggaagccguauauauagacauugcagaucgaagccaagugcucagcaagguaggauccguuuaaagacguggguggccuucgagacgcagaaaugacuucucaaugcuaaagaaaccaggaaaccauacccaacuuggcacaaaaggaaauucugaugugucuugcuuguuuuauuuuuaaaagugaguauuaggagauuucuugucuugaguuggggaugccaccagaaaauuaguggcccaaauuugugugcccuguuuggccucugaaaauuauuacuggacuaaguagguauuguagcuagaguauuuugcccugcuaaaaugaugcuuagccugaaaaaucggagcaccacuucucaaauuuauuuuuccaacucaguaauuaaaaaaacauuuacuuccugccuacuggguuguggaauauugucaggaucucuggguuccaggugagggaugcagaaugcagggaaagacagguccccugcccuccagaagucgguggcgccuuuucagaguaacacacacuggagcagaccccuggaaaaggacaguccacugguggaccaugaccuuggucaaaagagggaccaggucuggcuugcucacuguuuugcacccaagaaguauuugcucagggaaugaggggguuagauuccuccucauucauuaccauucuuacuaggcagaggccucauugggauuaaaagacaggaauguaacucucugcccacugauagggaauguguguuugcucuuuguaucccaggggugugauaccucuuuccuguggucacucugcacuuaagauauuuuggggccuggcacgguggcucacgccuguaguuccaacacuuugggaggccaaggugaccgaucaucugagguccugaguucgagaccauccugcccaacauggugaaaccccaucucuacuaaaaauacaaaaauuagccaggccuggugguacgugccuguaaucccagcuacuugggaggcugaggcaagagaaucgcuugaacccgggaggcagagguugcagugagcagagaucacaccaucgcacuccagccugggcgacacagcgagacuccaucucacacacacacacacacaaaguuauuuugauuugugcauuuccgaaaagauauaaaaaccaucuugugcuuccuugcccaauaucccaacccccaccuucaaaacguugguggauuuuucaaaaagcuuuuuauggaaguuuaacauauacagcaaagugaauauaaguaugcagcuugaugaauuuucucaaacuggauacuagcaaaaaguaugauucuuugaguauuuugucaacucugguugaucugugugaguggagggaagcagugauggugaauauuuauuuuuuaaagcacacauaaauauaaucuccucagaggcugggcacauuggcucacgccuguaaucccagcacuuugggagaccgaggcaggcauaucacuugaggucaggaguuugagaccagcuuggccaacauggugaaaccccgucucuacuaaaaauacaaaauuagggccaggugcgguggcucacaccuguaaucccggcacuuugggacgccaaggugggcagaucacgaggucaagagaucgagaccauccuggccaacauggugaaacccugucucuacuaaaaauacaacagauuagccaggcgugguggcaggugccuguaaucccagcuacuuaggagacugaggcaggagaaucgcuugaacccaggaggcggagguugcagugagccgagaucaugccuuugcaccagccugggcaaaaagagugaaacugugucaaaaaaaaaaaauacaaaauuagcugggcgugguggcgcaugccuauaauuccagcuacuugggaggcugaggcaggaggaucacuggaacucaggaggcggagguuccauugagcugagauugugccacugcacuucauccugggcgacagagcgaaacucuaucugaaaaaaaaaaaaaaaaaaaaaaucggccggacauagugacucaugccuguaaucccagcacuuugggaggcugaggcauguggaucaccugaggucaggagcuugagaccagccuggccaacauggugaaaccccgucucuacaaaaauacaaaaauuacccuggcguggucgcaggcgccuguaaugccagcuacucaggaggcugaggcaggagaaucgcuugaacccaggagguggaaguugcagugagcugagaucgugccacugcacuccagccuggccaacagagugagaugcugucucaaaaaaauaaaauaaaaaaauaaggcagggcgcgguggcucacgccuguaaucccagcacugugggaggccaaggugggcggaucacgaggucaggagaucgagaccauccuggcuaacacggugaaaccccgucucuacuaaaaauacaaaaaaaauuagccgggcaugguggcgggcaccugucgucccaguugcuggggaggcugaggcaggagaauggcgugaacuugggagauggagcuugcagugagccgagaucgcgcuacugcacuccagccuggccaacagagcgagacucccucucaaaaaaaaaagaaaaaaaaaaaaaacuucucagcuuugggaaauacuuuaugagagagagaaauuuauuaucuuuguuauuuuuguuaaguagaugcuauaaguuuguaucuccugagcccacauuagucaauguagagggacagcugaaaauuaaacuuuuguugugguuaauuaacacaggaaauugacugcauuauaaaucugugaagugagacucaccaguaguggauagguuccauacacugaacauuuccaguaaugauuuuguuaaaacaagccagagggagauugcacuggaagauuuaaggaaugacagccggguauucugagcgcuggcuguauuuuagagucacuugcagagauuuaaaaaaacaaaaaacaaaucugugcugccgucaccugcagauauucucagucacuggguuuuaguuggagugacucaaaaaucuguguuuuaaaaaggucuucccuggugaucuggaugcucaccccagguugaaagucucugucuucaacacgguaaauaugugccugcucagacagucuggugauacuuucacacuggcaaaauggaaaacaaacccuaucggagaaaaucacauagaacucuccucugaggcuaauguaaacaguucuacaucuuguuuauaacauuuucccauauuugcuuugugccaucagcaucaagaucugguauggagugaaugcuaaugaaagaucuguucuccccaucucucacucccucucccacuccccuccaaccccaauuccacaauuucucucaggauuacaaggcagaggaagacccagcaaaauuuaaaucuaucaaaacaggccgaggacccuugggccccaauuggaagguaccauucacaccuucacugccagggggcugggcagcaugugggugggccgcucccuguggaggaggggcauggcuggggugagcuggggacggccugaggucugcccguuguuacuugcguacccauggguauguuucuaaugcagcaagagcuuguaaaccagaaggacugcccauauaugugugcauacaaacuggugaccgucaaguucaagugguggggccugcagaacaaaguggagaacuucauccauaagguaaguagcucggcugaggccuucccagugacugcguguguguguugugggggggugguggagaacuucauccauaaggugaguagcucggcugaggccuucccagugacugcgugugugugcgguggggggugguggagaacuucauccauaagguaaguagcucggcugaggccuucccagugacugcgugugugugcggugggggguguuuggcccagugaagaagauggcccagcccauguggccugcaugacaggguugccaacaugagcauaccucacaguuuggcggcuucccagcugcccaccuucccuugcacugaaaugucuuacgguuuaaugcuguccuuccagggacaccacaugugacagggaaggaaacugaggcaaaagaaggccacaggaagggacuugcuaugacugaccuacagauaaaacucagucuuucuuuucuugcagcugaaaggcaagaggugcugggagccagguuggccggugcccugaauuacucugcugggcaggucuaaggaguuuuagagccuuuuaauccuccgacauguuugagccucacuugggccauauuucauagcugcuggccaguuuuaaucuggcauuagacaccagagacaggaagaaauguggcagugguuuggggcccuuggcuugccuaggaguucaugggcugcugucuugcuggugcuuugggcagagggccuagugugagguaggcauccuucuuucuugggggcucccuccuaugugaagccauaccuguuagacacgugaaggcaaaggucauugacccauggcugguccagauaaccagccgggcauuacuccuccuccuguccgcccguccccagucuaguguggguauucguguggagugcauggagagaagggcuguggcagcagccuuugccuucugcguucuaacgugguucccuccuuucuauagcaagagaggcgucuguuuacaaacuuccacaggcagcuguucuguuggcucgauaaguggguugaccugaccauggacgacauucgaaggauggaagaagagacgaagagacagcuggaugaaguaagugggggcucugggggcucucaauuagauaaacaaacgaagauuaaggagacuguuuugcuggggcgcuucaccgagagcaccauccuguaguucugggaacacgucagugucugcuacagggacgguauccugggcaguacgugggcacuauacggaagaaaacagccugugcucuugaauugacaguugaguugaagucuuggcauacccacagagacaaaaauggcaguaugugccgaaugccaaguggguaauacagcugcuacagcgaugcuucagagccuggugggaaagagcgugcggggcugcagagcuggaggugacccugggaggaggcaggcugggcugaccugugaauaccaugcacauuacccacagaggacagccacagcgcacgcaggagcugacagcuggcggcugucuacggucauuuugagcuaucagaguugagagcuuuugcuuuucuuuuuuuggucuuggcguggaucgcagaaggaggguucccuguuccuuaggagccuaaagacccagcacuucucaugccucauuuggagaugcugaugcuuccuugagaggcccacucagaggagauugucaguuaguaacauucaagcacucacugugugccgucuaccauucugagggccuuuaccuacugcagucuucacgauaccccaugaggaggcgcugcugcucucccuacccucagaugaggaaguggaggcucugagagcucaaugcugcggugcucugggucacaccgucuugcaggugauauggucagaguaagagcccaggacucucuggcccuggaaccacagcucuuaaucacuccccuguacuccucccucuaaaugcaauuuugggcccuccugccaucuuggagcuaaaaauaugauaaggcaggaagcucuguuucauaagaacugccaucacuucucccuccuugccccaggugggguuggcauggaguuuggguauccaguagaggcauugcuuugcaacagcccacucagcucuccugcagggccucaggugagagccaggcuugggcgcccaugcugcccaugcugcacggacggugucugcuucaccaugcuggucuagggcgaaaauuggguccagaaguucuuccucuggaaccccgcagggaacuguuuuuaccauccagaaugacacuuuuccugggcugacucacugguaaguggugcacugaguugguuccucuugaagacagauguuuugguuauucauuuagcuacauuuagcagggaaguggcaggauuucauuggggcacagucccugauucuuucgcuaaggaucuuuaggaagggguagaccucaguguccaggggucuggugauugugacuguguaagagaagccugaggcuuuuggucacccuaguccugacaaaaagaaagggaaaauguuaacaaaugaggaaacauggagacuuucauuggaguuuuagccuggagcuucagccauccacugccugacaaaggccagcaugacguauguugggguucguggaaguauuugcuguccaccuuucauuccuucggguagaacucaaauucuuggagcuagaagaacucuccagaggaucuacuggaucugcuuuguucagauccaaacuuugagagcccucaguguuagagaguuauuuuuuaaucucucagacccuuuugaaaaucuuucucggccaggcacgguggcucacaccuguaaucccagcacuuugggaggcuaaggugggcagaucacgaggucaggagucugagaccaacuuggccaacauggugaaacccugucucuacuaaaaauaaaaaaaauuagccaggcgugguggcggacaccuguaaucccagcugcucaggaggcugaggcaggagaaucgcuugaacccaggaggcagagguugcagugagcagagaucaugccauugcacuccagccugggcgacagagcaagacuccgucucaaggaaaaaaagaaaaagaaaagaaaaucuuucuccauuccauggagaaucaugccaaaagcuuaggugaucacuguccuccaggauaacugcaaauagaagaaacucucuuuggaauuagaauuuuaaaacucaucugcagugggagagaaagcaaguccaccucauugugguacauguuguggucucuucagcaacugugcaggaccuuugugugcugacuacgcuugauguggcuugccuuuuuauuuuuuugucuaucuaaaaauauauguuucaucaaaguuauauuuuguaguuuuaaaacucagcaucccaggauuaugagucccaccccucagaagcagccccuuguaauuccgaugguuguugcuuuuguuaauuacuuccauacuuucaaauaaucuaugcugaugcucuuaguaguucuuuuuuuuuuuuaagaggugagguuguguucugucacccaagcuggagugcuuggcgucgugcaguggcaugaucauagcucacugcagccucaaacucccaggcucaaaauccuuuuaauuuuucuuauuuauuuauuuuuuuucugagacaggcucucacucuguugcccaagcuggagugcaguggcacgaucucggcucacugcaagcuccaccucccugguucacgccauucuccugccucagccuccccaguagcugggacuacaggcgcccgcuuguacucgguaguuacaguggggggaaccucuaccucaggguacucgguaguuacauucgggggcgggaaccucuaccucaggacuucgagucuuuuuuucacggaggcuugucacuuucccuauagaggacuccccugucucuugcugugggagacaggcaggcagccagcauucuggaggccacacugaggaagggucccagugggcucauugugccauugauucgcuuuaacuuuaauuccgucguauucugccucuugcccaccuucccccuagcagcaccugggguccugaggucaggguucccucagcgcuucagagagugaaccuccuggcuuuugcugugaaggaaaggagggugguugcuugacuuccagagcaggagaagggaacaccaguuccuaaccguucuccauuuggacuuucaaaaagucaccaguuuugagccacaccugguacucccaucugcagcgggaccuggugcuuccaguuccugagccuuugcagaaccugcagcuccuucuccgcucuccauccuccaggcacuuagguucagcuuuugcugcucugcaaauuagcuacugacucuucuguccuuuuuccaucucccaaaagguuguuaacuggcucuuaccugcugugguguccucuguuccuguugucuucauaguuuuuaucuuuuuaaauuccuuuacugucaugucauaggguuugggggaggaauagagauagaugccugucuuccaugcaccgugaugaacugcacacuuggaauaggaauuaugacuguuagucucuaagccaguacauagucgucuagugcaggcagauuuuguuugugagugaugaagggucacugcaaggccacagucaucacugcuguaacucuagucccuguccgggcggacccaccauucuugaaugaggcuugaagauuugggaagcaaggcaucgagagauuaguucuucgcccuaaaaagaaaaaauuucuggaacuaugugccuguaggaaagcaguuucugucucucucuuucuccccaacuugccuuuuuucucccuuucccaagcucuuacucucuuaagaggcccauaaucugaaaaauggaaggagguaucuuaaaggucauuugguccaauuauauguucagugcuugaguacucucugaagcuucccuaccagccuuugcuugauuacugccuguaauggggaacucacugucucccaaauaugguaguaauaaaaauauuuguauuauuaauagaagcuaacauuuauugaggacuuccugugugccuaucacguaugcuaagaguuucacauguauuacaucacccaguuuucauggcaaccuguaacacagguauuaguuucauuuuauagauaaacuguggcucacagaaguugaggacguuuuauaauucacugaacaaguaccucuuggccuuuggccauuaacucuuuagauaaugagauucagaaaagagaauucacuuaaaaaauguuaagaaaacuuguuuucuuuuuuuuuuuuucuuuugaaacagagucucgcucugucacccaggcuggaguacaguggugcaaucuuggcucauugcaaccuccaacuccccaauucaagcaauucucaugucacagccuccugaguagcugggacuacaggugcccgccaccacgccuggcuaauuuuuguauuuuuaguagagacaggguuuccccauguugcccgggcuggucuggaacuccugagcucaggugacccacccgccucagccucccaaggugcuaggauuacaguugugagccacugugcccagccaagaaucuaaaauuuuauuuuauuuuuuuugagacagaaccuugcugugucacccaggcuggaguggaguggcgccaggcuggagugcacuggcacaaugucagcucacagcaaccuccaccucccagguucuagcaauucuccugccucagccucccaaguagcugggacuagaggcgcccgccacuacacgccacuaauuuucuauuuuuaauagagaggggguuucaccauguuggccagacuagucucgaacuccugagcucaggcaaugcaccugccucggccucccaaagugcugggauuacaggcaugagccaccaugcccagccucuaaaacuuucauaggagcugcagaggcugcaggaucccuauaugugaaggaugacacugcccucauggagucucucucucucuuuuuuuuuuuuuuuuuuugagauggagucuugcucugucgcccaggcuggacugcaguggcgcaaucucggcucacugcaaccucugccucccggguucacaccauucuccugccucagccucccaaguagcugggauuacaggugugcgccaccacgcccagcuaauuuuuguauuuuuaguagagaugggguuucaccauguuggccaggauggucuugaacuccugaccucaggugauccgccugccucggccucccaaaguguugggauuacaggugugagccaccaugcccagccacucagggagucuuaauucccuccaaccugcuggcagugauugcagaccaucuggaacaucagccaacauccccaauuauggaaguagcuuuguuuucuuuucuuuuuuuuuuuuuuaagagagacagucucgcucuguggccuaggcuagagugcagugcugugaucauagcucacugcagccuucaacuucugggcucaagugauccucccacguuaagcuccuaaguagcuaggacuucaggucccaccacuacaccugacuaauuuuuuuagagacaagaucucaauauguugcucaggcuggucuugaauuacuggucucaagugauccucccaccuugguuucccaaagugcugggauuaccaucaugagccacuauaccuggcccuguuuucuuuuuaaauacaguuuaaggcacgguggcucaaaagccuguaauccuagcacuuugggaggcuaaaguugggcugaucaccugaggucagaaguuccagaccagccuggccaacauggagaaaccccgucucuacuaaaaauacaaaaaucagccaggugugguggugugugccuguaaucccagcuacuugggaggcugagacaggagaaucgcuugaauccaggaggcagaaaugguagugagccgagaucaugcugcugcacuguccagccuuggcgacagaacaagacagggucucacacuguugccuaggcuggaguauggcagccugaaacgcuuggauucaacugauccacccaccucagccucccaaguagcugggacuacaggugcaggccaccacgccuaccuaauuuuuaaaauuuuuuuaauuuuuguagagacaggaucuugcuauguuguccaggcuggucucaaacucccagccacaagugauccuuccaccucagccucccgaaguguugggauuguaggcgugggccaacacacccagccagcuucauuucugcaccgaaccuuuuauuuugaaaugauugaaagauucacuugcaguuauaaaaaauaacguggaaagaucuauguacccuuuacccaguuuuugccaaugguaacaucuugcaaaacuauaguacaauguaauaacucggauauuaacauugacacuuuacuauuuuuuuagaucaaagguguauuucauacuuaauggucaaaaugauuuucaaaagauagaaaaaaaauuuaaaaauagaaguccaaauaacuaauaggugaauacauaaauaaaagucuucuuguuucagccccuggccucauucccuaaaggaaaccacuguuaaaaacaaaaacaaaccagggcugggcacgguggcucacaccuguaaucccagcacuuugggaggccgaggcggguggaucaccugagcuugggaguuugagacagccugaguaacauggagaaaccccaucuacuaaaaauacaagaaauuagccaggcgugguggugcacgccugcaaucccagcuacucgggaggcugaggcaggagaaucacuugaacccaggaggcagagauugcggugagcugagaucgcaccauuguacuccagccugggcaacagagcgaaacucuaucucaaaacaaaccaaccaaccaggauugaaguuucuauuuuccuauuuucacauacacauuuucuucagccauauuauauguguauguauagccuacauuggcuaaaucugaggaacaccacaaacaucagauaaaucucucaugucguguaggccccaggaaacaggaaauaagcauucuuagaucauuguaagacugaaguaaugggcugggugcgauggcucacaccuguaaucccagcacuuugggaggcugaggcagguggaucaucugaggucaggaguucgagaccagccuggccaagauggugaaaccccaucuacuaaaaauacaaaaauuagcuggauguggugcaccucuaaucccagcuacuuaggaggcugagacaggagaaucacuugaacccgggaggcagagguugcagugagccaacaucaugccacuguguucuagccugggugacagagcaagacuccgucucaaaaaacaaacaaaaaaagauugaaguaaugaauuuuauuucagugguauggggaaccuuguuucugacaguaggggaagcuaucauguuccugguaggagguugcaucuuauuucaagcggugggaaaacaggaccuggcuuugcauuaguaacugaagccagguggugaacucucagcauguguaaggagccggcugagaaggagcuuugcucccaugauauuaaauuaucugauuauugaaaacuuuuguaaauggucauuagugagcaaauugucuuuuuaaaaauucuauuaugaaagaguuuuaaacuuaacagaaaauaggcaagaacagugccaagaacuccuguacacuccuuugcccagagacuauuccuuuagagcaaaggcuacagcccagaaucacgcgcuucaccccauucaucacagcucuccuuucuguccaucuggugccacuccucaguuuuccugaacuuccgcgauuuuggcguuuguggagguuauaggcugaucauuuuguagaaugucuuucaauguggauucguugauguuucugcaugauuagaccccaccuguguguacuugaagccugaaugucacagacucuguucuuuuuauccuauucugugucuuucuguccaguuacuggugagguuacugcugucgccuugaagcacaagguguucuggguuugucuuguuuuuucaugacccuguaacuggccacaucuucaaggagcgcugcuuccauauaguggagggggguguuuggaaaugagaucugguugcuggugugccuauuuccacuaggguauugcagcucccagaccuucucauaggauagagcuaggggacuuguacauuuauaguuauuucuguaucugcgucauauaucauguucacacaaaugcaucuaauuccaaucuaacaucacagaguugucuuuuaaaaauaugacaagcuggccaugcgugauggcucacgccugucaucccagcacuuugggaggccaaggcaggcggaucaccugagguugggaguuuaagaccagccuggccaacauggagaaaccucgucucuacuaaaaauagaaaauuagccaggcaugguggcacaugccuguaaucccagcuacucgggaguuugaggcaggagaaucgccugaacccgggagguggagggugcagugagccaagaucgugccacugcacucuagccugggcgacagagcgacagagugagaccuugucucaaaaaaaaaaaaaaaaaaaaaaaaguuucccaguggagaacuacugccagagauagaaucuccacaaaauguggcaguauuaaauuuucagugacuagaauacaauucugaagugggcuauggcuuaaaauuccagguucuucagagcuucuauacacaucuccuuugcuauaggacagugucuggaacgaaagaauaaaauaaacaacauuugaaacagggucucaaauaauuuuuuauuggccgggugugguggcucauguuuguaaucccagcacuuugggaggcugaggcgggcggaucaugaggucagaaguuugagaccagccugaccaacauggugaaaccccgucuguacuaaaaauacaaaaauuagccaggcgugguggugugcacuuguaaucccagcuacucaggaggcugaggcagaagaaucgcuugaacccaggaggcagagguugcagugagucgagauggugccucugcacuccagccugggugacagagcgagacucugucucaaaaacaauaauaauuuuguauucuauaacauaaacagcauuuggaaccgcgucuccaguaauuuucaucucuacacaggccccgaauacucagugcauacuccacgucaggcacucugcucugcuaaguacacgaaaaccucuuuuuuuuucuuuuuugagauggagucucgcucugucgcccaggcuggagugcagcggugccaucucagcucacugcaagcuccaccucccggguucaaacgauucuccugccucagccucccaaguagcugggauuacaggugccugccacaaugcccagauaauauuuuuuguauuuuuaguagagaugggguuucaccaugcuggccaggcuggucuugaacuccugaccgcacaucuuaaaucuucaucacaauccuauguacuguuaucucuauuuuauuauuauagaaauuggggcuuaggccauacccaguggcucaaaccuguaaucuaagcacuuugggaagcugagguggguggauugcucgaguccaggagugugagaccagccugggcagcauggcaaaacucucucucuacaaaaaauacaaaaauuagccuugcauggugaucgcaccacugcacuccagccugagugacacagugagacccugucucaaaaaaaaaaaaaaaaaaaggccaggugcgauggcucacgccuguaaucccagcacuuugggaggccaaggcgggcggaucaugaggucaggacauggagaccauccuggcuaacauggugaaaccccgucucuacuaaaaacacaaaaaauuagccgggcguguuggugggcaccuauagucucagcuacucgggaggcugaggcaggagaauggcgugaacccaggaggcagagcuugcagugagccaagaucgugccacugcacaccagccugggugacugagcgagacuccgucucaaaaaaaaaaaaaaaaagaaaaaagaaaaaaacugaggcuuagagagcauugcaguaacuuacucaaggucauacaauuagugauggagucagaauacaauccaggccaggugcaguggcucauuccuguaaucccagcacuuugggaggccauggcgggaggacuacuuaaguccagggguucgagacuagccugggcaauacaaugagacccuguccccacacacaccgaaaaaauaaaaaaucagccagguggcugggugcaguggcucacgccuguaaucccagcacuuugggaggcugaggcaggcagaucgugagguuaggagauugagaucauccugaccaacauggugaaaccccgucccuauuaaaauacaaaaaaaaauuagccaggcaugguggcgugugccuauagucccagcuacuggggaggcugaggcaggggaauugcuugaacccgggaggcagagauugcagugagccgagaucacaccacugccauccagccuggcgacagagagagagacugugucucaaaaaaaaaaaaaaaaaaagccaggcgugguggcacaugccuguagucccagcuucuugggaugcugaggcaggaggaucacuugagccagggagucgaggcuguagugagccaugauugcgccacugcacuccauccugggcaacagagccagacccugucucaaacaaaacaauacagucuagggaguuucauucuagcagcuaugcucuuaggugcucaaaauuuguugaacauuauaaagaacaaaaguugagcagaaaacuaauggauagugaagaaauacuuauugacauucuucacauagaauggaguuuucaaaucagaacugauuuuagagagaugacgucuacaguauccccagugaugucugccuggaaggugccagugacagggaccacuuggugcuuccacagaagcccccauccuguuuuccagcagccuugcacaucuguggaucugagaccugcaccugcacuuuccaccucugcauccuugugccuaguucugacaccacauugugcccaccuuuaaacaggucaggaaagggaaguucuguuacucugccgggaacuccucucccggagagccacaggauuuucucccucauuucucucagguuucaucucaaaccucacauacaagcuucuguaacuaccuaaaauagcacuuacccacagucauucuguauccgagcagcccacaguccuagcugacauagaugaauguuuguucucugcccauccugccccagaauauaagcuccuugaggagagaacuggucuguuuaguucacagcuaaauauucccagcccucuggaagucccuagcacuaaagagaugccucacugaggcugggugcgguggcucacgccuguaauccaagcacuucaggaggccaaggcaggcagaucaucugaggucaggaguucaagaucagccuggccaaaauggugaaaccccgucuccccuaaaaauacaaaaauuagcugggcgugauggugcauaccugcaaucccagcuacuugggaggcugaagcaggacaaucgcuugaauccaggaggcagagguugcaguaagccaacuuugcgccacugcacuccagccugggcgacagagcaagacuccucacacacacaaaaaaagauguuucggccaggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcggcagagcgagacuccgucucaaaaaaaaaaagauguuucauaaguauuuguugaaugaauaaaugaaugaaacgggccaagugugguggcucacaccuaugcuguaaucccagcacuuugggagguugaggcagaggaucgugugaggccaggagcccaagaccagccuggucaacauaggaagacccccccacacacaccucuuuaccaaaaaaaaaaaaaaaaaaaaggugcuucaaacaccgugacacgagagaacuagaaaucauggauggugagaccagugacacagaucuggaaauguauggcuucgaguccauaugcagaauucuuccguccuuccagugucuugcuuuuuacacaaaauaugccccaccccaccuaugggcaggacugagaaggcaggaguuccaucagcagcaggagccuuccauuuguccugcuuuuuuuguuccagaugagacaaaaggacccagugaaaggaaugacagcagaugacuaaagccgccuuuccccucugcacuguacguaccaaauuucucacugugcgugucacagacgcuaaaaucaguuuggguuucaaggccucagcagcucacuauggagucagaaaaccuauuccuccuucccucuaguaaugaugguugccacgcucgauagcucuccacuuccacuaggagauuauggcccuugggacauuucagggacauuuuccaaagaaccacccagauagagacaauggacagggagggggugguggauauagaaggggaguucaucugcugcgaaucacuccuccugucugccagcuugauccaucucaaguugcagcugucauguugggcacucccuggccuucccacgccagcgccagcucccaaaagcugccauuaccugcccuucccccuuggaaaacuugcuggccagacagcuuuuguuagcacccacuguugucuggugcuucauuuccuucuuuauacccccgaucccauacuaagcugcccucaucagagguggcaucuuucagaugcugggaggguguuucugcccaggucacagggccagauugggggccccuuguuucauguugucacuuuuccccaagcccccuccuuccguuaacucucggugcugguuucccagugcccuguacaccacccgagucaugggauuccagcagcucaaagcagucuuaaucacugaaugaaaaaccuggcucugcucccaauuagccucagagagaaaauuauuuuuacaaauaaaagcuggccucuaacccuacgggcaaggagggccagggucucaccaggagugacggcaggcccugcuuacucucccugccccauguucccaaagcagccucggggaggcuggaggguggaaugaggcggacugcugugaugccagcuucucagucacugcucugggccucagugcucucccccacucccuuccccacccacccacuggcuucccuccuccucuugaaauuauccauucaggacgauuuacaguguuucuguuuucuccucuugcuuccuuaauacuuucauuuuucuucuaguuuugcaagacaguggucaacaggaagacccagcagcuccacccucccaagugacaggccauuuucggacgcagccguucugugcccauucuucaggcaacuuucgauuccuuacuguagcuaauucuagaugcccuucaguauugugaacaaauagaccgucuggugucacagagcccgcgugugcaggagccugcuccuccgagauacguggcguguagguugcuguaguuacagcgccuccgucucucuccauuguguuccgauccauuucuguguguucccccaaccuuuauuuccaagugacauuuucagucuuucaaauagcugccuuuugugauguggugauuuaaaugauuuaaguucauuuguucucaaccuugggguaaacugagguauuuugcuuccugggaagaucuucgcaauuuugagugcuccuguggggagcggggaugagcuaaagauacaauguuucccugccccgcaccgcuuccacaaaauagcaaugugguuuugcagcucugacuucugcucccaguaacccaucguuagggcacucuagcacuauggagguacccaaggcucagccagucucuauuuaagaaaauuuaacaaauacgaguaacccugucccaaucacugaaucucuaguuacuacucuuagaaacaccuguggcuucuuggcccuccuguugcccgcucugaaucucucugcagucuacaaaaucgccccagucaacucuccacuuggagggaauuguccaguguggccccuagaauugagucacccccuagauaccaacugucugaccccgaggagcucuguaagucccugcuccuccucuucccuuuggggcuggugcugccacucagcaauaauccucuuuucucugugcuuucuuaggucccuguccucugucuuugaggcugguuaggaagcaagaguccugaucuuucaugcugcacaauaugagcaugcaaaaagcuuuuuccagcagaacauguucccucgucuccaguugccggaaaggaauuuggggaucaagaacuuagcucguccuacccccauguugaguucugcccuggaaaacccaaagcaaguagugaucauaguacagaacccgaccaaaguaggcuggugaggaaguccaggcuccaggggaacagacgcugcccaguguucauagcuuccugcaacuugacagagccugaguuugccucuuagugggagaaugagagagagcuguagugucaccugacauuccccaaaccuugugaagcacguuggccuaagugugccgugaucccagcccacacuagccugggugcaucugcuaaugggagaccaaaucuuuguccgggaagcaagaagugggugggagaauguauccuguuuuugucaguuuguuugccuuacucauuucuaagugcaauaagggagugucucacaggauugcaccugugacauccugauggaugcuucccuguggcccuccuggggcaaggguggacagacucagacccccagcaugguuagcgcugaccuucauugaggucccuuuggaaccagaugucuuguuacagacaccuuccucuguguaagucuccucaccuugaggggucuuuaguaaugcaucuggguagcaucucaacugcugguagcauuuaucugacuuggaaaguuggagaagaggcauuccuacuggagaaaaaugucaguguuuuccuauaagcucuguguuagcuauucauuauauuugugcuuaaagauguuccuucauucaucaacuaggggaaguccagaugcggguuaucuugaaagaaacaaacugacauucuaggcagacaguugucuauguggucugagggucagcagcuguuagucuccuuccuuuggcucuugagacccacacauaucacuuuagcccuaacaagggcuccucccaccuccaccuguugccccaguugaaaagcauccauuaugagcugaggucagccuggaucuggaauugcagcccacauaaacauaaaggaggaugucccuggucuguuccauccccacggaugguguugcugcugggcaacaguguuggcuucuuuuaaguacccccuuuccuccucacccaccuccaaacugacuagcacucagagggacuuaugauaaagguucagcuccagggguaguaccugagugugugccaugccccuucagaccagcugcuuccaucagaauuccagggucacagccccaacagaagcagcagugccucuguaggaggggugcugggcucuggccuucucaugcagagagguccgggacagggucaguaucgugggcauguguauagcuucccaaguucuuuuacagucccugcugggacucccugacuuacuuugguugguuccuagugcuacuuguuuuacaaacuacacuuuguagaauugauuagauuaccuuguuuauuuaaugugaguuugugccuuuuugucucaaucuuccaauacagguauauugagaaaaaaagcagucuaauaaaauccuagacagaa

SEQ ID NO: 192271 - RNA, 44828 nt, Homo sapiens
uucugucuaggauuuuauuagacugcuuuuuuucucaauauaccuguauuggaagauugagacaaaaaggcacaaacucacauuaaauaaacaagguaaucuaaucaauucuacaaaguguaguuuguaaaacaaguagcacuaggaaccaaccaaaguaagucagggagucccagcagggacuguaaaagaacuugggaagcuauacacaugcccacgauacugacccugucccggaccucucugcaugagaaggccagagcccagcaccccuccuacagaggcacugcugcuucuguuggggcugugacccuggaauucugauggaagcagcuggucugaaggggcauggcacacacucagguacuaccccuggagcugaaccuuuaucauaagucccucugagugcuagucaguuuggaggugggugaggaggaaaggggguacuuaaaagaagccaacacuguugcccagcagcaacaccauccguggggauggaacagaccagggacauccuccuuuauguuuaugugggcugcaauuccagauccaggcugaccucagcucauaauggaugcuuuucaacuggggcaacagguggaggugggaggagcccuuguuagggcuaaagugauaugugugggucucaagagccaaaggaaggagacuaacagcugcugacccucagaccacauagacaacugucugccuagaaugucaguuuguuucuuucaagauaacccgcaucuggacuuccccuaguugaugaaugaaggaacaucuuuaagcacaaauauaaugaauagcuaacacagagcuuauaggaaaacacugacauuuuucuccaguaggaaugccucuucuccaacuuuccaagucagauaaaugcuaccagcaguugagaugcuacccagaugcauuacuaaagaccccucaaggugaggagacuuacacagaggaaggugucuguaacaagacaucugguuccaaagggaccucaaugaaggucagcgcuaaccaugcugggggucugagucuguccacccuugccccaggagggccacagggaagcauccaucaggaugucacaggugcaauccugugagacacucccuuauugcacuuagaaaugaguaaggcaaacaaacugacaaaaacaggauacauucucccacccacuucuugcuucccggacaaagauuuggucucccauuagcagaugcacccaggcuagugugggcugggaucacggcacacuuaggccaacgugcuucacaagguuuggggaaugucaggugacacuacagcucucucucauucucccacuaagaggcaaacucaggcucugucaaguugcaggaagcuaugaacacugggcagcgucuguuccccuggagccuggacuuccucaccagccuacuuuggucggguucuguacuaugaucacuacuugcuuuggguuuuccagggcagaacucaacauggggguaggacgagcuaaguucuugauccccaaauuccuuuccggcaacuggagacgagggaacauguucugcuggaaaaagcuuuuugcaugcucauauugugcagcaugaaagaucaggacucuugcuuccuaaccagccucaaagacagaggacagggaccuaagaaagcacagagaaaagaggauuauugcugaguggcagcaccagccccaaagggaagaggaggagcagggacuuacagagcuccucggggucagacaguugguaucuagggggugacucaauucuaggggccacacuggacaauucccuccaaguggagaguugacuggggcgauuuuguagacugcagagagauucagagcgggcaacaggagggccaagaagccacagguguuucuaagaguaguaacuagagauucagugauugggacaggguuacucguauuuguuaaauuuucuuaaauagagacuggcugagccuuggguaccuccauagugcuagagugcccuaacgauggguuacugggagcagaagucagagcugcaaaaccacauugcuauuuuguggaagcggugcggggcagggaaacauuguaucuuuagcucauccccgcuccccacaggagcacucaaaauugcgaagaucuucccaggaagcaaaauaccucaguuuaccccaagguugagaacaaaugaacuuaaaucauuuaaaucaccacaucacaaaaggcagcuauuugaaagacugaaaaugucacuuggaaauaaagguugggggaacacacagaaauggaucggaacacaauggagagagacggaggcgcuguaacuacagcaaccuacacgccacguaucucggaggagcaggcuccugcacacgcgggcucugugacaccagacggucuauuuguucacaauacugaagggcaucuagaauuagcuacaguaaggaaucgaaaguugccugaagaaugggcacagaacggcugcguccgaaaauggccugucacuugggaggguggagcugcugggucuuccuguugaccacugucuugcaaaacuagaagaaaaaugaaaguauuaaggaagcaagaggagaaaacagaaacacuguaaaucguccugaauggauaauuucaagaggaggagggaagccaguggguggguggggaagggagugggggagagcacugaggcccagagcagugacugagaagcuggcaucacagcaguccgccucauuccacccuccagccuccccgaggcugcuuugggaacauggggcagggagaguaagcagggccugccgucacuccuggugagacccuggcccuccuugcccguaggguuagaggccagcuuuuauuuguaaaaauaauuuucucucugaggcuaauugggagcagagccagguuuuucauucagugauuaagacugcuuugagcugcuggaaucccaugacucgggugguguacagggcacugggaaaccagcaccgagaguuaacggaaggagggggcuuggggaaaagugacaacaugaaacaaggggcccccaaucuggcccugugaccugggcagaaacacccucccagcaucugaaagaugccaccucugaugagggcagcuuaguaugggaucggggguauaaagaaggaaaugaagcaccagacaacagugggugcuaacaaaagcugucuggccagcaaguuuuccaagggggaagggcagguaauggcagcuuuugggagcuggcgcuggcgugggaaggccagggagugcccaacaugacagcugcaacuugagauggaucaagcuggcagacaggaggagugauucgcagcagaugaacuccccuucuauauccaccacccccucccuguccauugucucuaucugggugguucuuuggaaaaugucccugaaaugucccaagggccauaaucuccuaguggaaguggagagcuaucgagcguggcaaccaucauuacuagagggaaggaggaauagguuuucugacuccauagugagcugcugaggccuugaaacccaaacugauuuuagcgucugugacacgcacagugagaaauuugguacguacagugcagaggggaaaggcggcuuuagucaucugcugucauuccuuucacuggguccuuuugucucaucuggaacaaaaaaagcaggacaaauggaaggcuccugcugcugauggaacuccugccuucucaguccugcccauaggugggguggggcauauuuuguguaaaaagcaagacacuggaaggacggaagaauucugcauauggacucgaagccauacauuuccagaucugugucacuggucucaccauccaugauuucuaguucucucgugucacgguguuugaagcaccuuuuuuuuuuuuuuuuuuuugguaaagaggugugugugggggggucuuccuauguugaccaggcuggucuugggcuccuggccucacacgauccucugccucaaccucccaaagugcugggauuacagcauaggugugagccaccacacuuggcccguuucauucauuuauucauucaacaaauacuuaugaaacaucuuuuuuuuuuugagacggagucucgcucugccgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgccuggccgaaacaucuuuuuuugugugugugaggagucuugcucugucgcccaggcuggagugcaguggcgcaaaguuggcuuacugcaaccucugccuccuggauucaagcgauuguccugcuucagccucccaaguagcugggauugcagguaugcaccaucacgcccagcuaauuuuuguauuuuuaggggagacgggguuucaccauuuuggccaggcugaucuugaacuccugaccucagaugaucugccugccuuggccuccugaagugcuuggauuacaggcgugagccaccgcacccagccucagugaggcaucucuuuagugcuagggacuuccagagggcugggaauauuuagcugugaacuaaacagaccaguucucuccucaaggagcuuauauucuggggcaggaugggcagagaacaaacauucaucuaugucagcuaggacugugggcugcucggauacagaaugacuguggguaagugcuauuuuagguaguuacagaagcuuguaugugagguuugagaugaaaccugagagaaaugagggagaaaauccuguggcucuccgggagaggaguucccggcagaguaacagaacuucccuuuccugaccuguuuaaaggugggcacaauguggugucagaacuaggcacaaggaugcagagguggaaagugcaggugcaggucucagauccacagaugugcaaggcugcuggaaaacaggaugggggcuucuguggaagcaccaaguggucccugucacuggcaccuuccaggcagacaucacuggggauacuguagacgucaucucucuaaaaucaguucugauuugaaaacuccauucuaugugaagaaugucaauaaguauuucuucacuauccauuaguuuucugcucaacuuuuguucuuuauaauguucaacaaauuuugagcaccuaagagcauagcugcuagaaugaaacucccuagacuguauuguuuuguuugagacagggucuggcucuguugcccaggauggagugcaguggcgcaaucauggcucacuacagccucgacucccuggcucaagugauccuccugccucagcaucccaagaagcugggacuacaggcaugugccaccacgccuggcuuuuuuuuuuuuuuuuuuugagacacagucucucucucugucgccaggcuggauggcaguggugugaucucggcucacugcaaucucugccucccggguucaagcaauuccccugccucagccuccccaguagcugggacuauaggcacacgccaccaugccuggcuaauuuuuuuuuguauuuuaauagggacgggguuucaccauguuggucaggaugaucucaaucuccuaaccucacgaucugccugccucagccucccaaagugcugggauuacaggcgugagccacugcacccagccaccuggcugauuuuuuauuuuuucgguguguguggggacagggucucauuguauugcccaggcuagucucgaaccccuggacuuaaguaguccucccgccauggccucccaaagugcugggauuacaggaaugagccacugcaccuggccuggauuguauucugacuccaucacuaauuguaugaccuugaguaaguuacugcaaugcucucuaagccucaguuuuuuucuuuuuucuuuuuuuuuuuuuuuuugagacggagucucgcucagucacccaggcuggugugcaguggcacgaucuuggcucacugcaagcucugccuccuggguucacgccauucuccugccucagccucccgaguagcugagacuauaggugcccaccaacacgcccggcuaauuuuuuguguuuuuaguagagacgggguuucaccauguuagccaggauggucuccauguccugaccucaugauccgcccgccuuggccucccaaagugcugggauuacaggcgugagccaucgcaccuggccuuuuuuuuuuuuuuuuuuugagacagggucucacugugucacucaggcuggagugcaguggugcgaucaccaugcaaggcuaauuuuuguauuuuuuguagagagagaguuuugccaugcugcccaggcuggucucacacuccuggacucgagcaauccacccaccucagcuucccaaagugcuuagauuacagguuugagccacuggguauggccuaagccccaauuucuauaauaauaaaauagagauaacaguacauaggauugugaugaagauuuaagaugugcggucaggaguucaagaccagccuggccagcauggugaaaccccaucucuacuaaaaauacaaaaaauauuaucugggcauuguggcaggcaccuguaaucccagcuacuugggaggcugaggcaggagaaucguuugaacccgggagguggagcuugcagugagcugagauggcaccgcugcacuccagccugggcgacagagcgagacuccaucucaaaaaagaaaaaaaaagagguuuucguguacuuagcagagcagagugccugacguggaguaugcacugaguauucggggccuguguagagaugaaaauuacuggagacgcgguuccaaaugcuguuuauguuauagaauacaaaauuauuauuguuuuugagacagagucucgcucugucacccaggcuggagugcagaggcaccaucucgacucacugcaaccucugccuccuggguucaagcgauucuucugccucagccuccugaguagcugggauuacaagugcacaccaccacgccuggcuaauuuuuguauuuuuaguacagacgggguuucaccauguuggucaggcuggucucaaacuucugaccucaugauccgcccgccucagccucccaaagugcugggauuacaaacaugagccaccacacccggccaauaaaaaauuauuugagacccuguuucaaauguuguuuauuuuauucuuucguuccagacacuguccuauagcaaaggagauguguauagaagcucugaagaaccuggaauuuuaagccauagcccacuucagaauuguauucuagucacugaaaauuuaauacugccacauuuuguggagauucuaucucuggcaguaguucuccacugggaaacuuuuuuuuuuuuuuuuuuuuuuuugagacaaggucucacucugucgcucugucgcccaggcuagagugcaguggcacgaucuuggcucacugcacccuccaccucccggguucaggcgauucuccugccucaaacucccgaguagcugggauuacaggcaugugccaccaugccuggcuaauuuucuauuuuuaguagagacgagguuucuccauguuggccaggcuggucuuaaacucccaaccucaggugauccgccugccuuggccucccaaagugcugggaugacaggcgugagccaucacgcauggccagcuugucauauuuuuaaaagacaacucugugauguuagauuggaauuagaugcauuugugugaacaugauauaugacgcagauacagaaauaacuauaaauguacaaguccccuagcucuauccuaugagaaggucugggagcugcaauacccuaguggaaauaggcacaccagcaaccagaucucauuuccaaacaccccccuccacuauauggaagcagcgcuccuugaagauguggccaguuacagggucaugaaaaaacaagacaaacccagaacaccuugugcuucaaggcgacagcaguaaccucaccaguaacuggacagaaagacacagaauaggauaaaaagaacagagucugugacauucaggcuucaaguacacacagguggggucuaaucaugcagaaacaucaacgaauccacauugaaagacauucuacaaaaugaucagccuauaaccuccacaaacgccaaaaucgcggaaguucaggaaaacugaggaguggcaccagauggacagaaaggagagcugugaugaauggggugaagcgcgugauucugggcuguagccuuugcucuaaaggaauagucucugggcaaaggaguguacaggaguucuuggcacuguucuugccuauuuucuguuaaguuuaaaacucuuucauaauagaauuuuuaaaaagacaauuugcucacuaaugaccauuuacaaaaguuuucaauaaucagauaauuuaauaucaugggagcaaagcuccuucucagccggcuccuuacacaugcugagaguucaccaccuggcuucaguuacuaaugcaaagccagguccuguuuucccaccgcuugaaauaagaugcaaccuccuaccaggaacaugauagcuuccccuacugucagaaacaagguuccccauaccacugaaauaaaauucauuacuucaaucuuuuuuuguuuguuuuuugagacggagucuugcucugucacccaggcuagaacacaguggcaugauguuggcucacugcaaccucugccucccggguucaagugauucuccugucucagccuccuaaguagcugggauuagaggugcaccacauccagcuaauuuuuguauuuuuaguagaugggguuucaccaucuuggccaggcuggucucgaacuccugaccucagaugauccaccugccucagccucccaaagugcugggauuacaggugugagccaucgcacccagcccauuacuucagucuuacaaugaucuaagaaugcuuauuuccuguuuccuggggccuacacgacaugagagauuuaucugauguuugugguguuccucagauuuagccaauguaggcuauacauacacauauaauauggcugaagaaaauguguaugugaaaauaggaaaauagaaacuucaauccugguugguugguuuguuuugagauagaguuucgcucuguugcccaggcuggaguacaauggugcgaucucagcucaccgcaaucucugccuccuggguucaagugauucuccugccucagccucccgaguagcugggauugcaggcgugcaccaccacgccuggcuaauuucuuguauuuuuaguagaugggguuucuccauguuacucaggcugucucaaacucccaagcucaggugauccacccgccucggccucccaaagugcugggauuacaggugugagccaccgugcccagcccugguuuguuuuuguuuuuaacagugguuuccuuuagggaaugaggccaggggcugaaacaagaagacuuuuauuuauguauucaccuauuaguuauuuggacuucuauuuuuaaauuuuuuuucuaucuuuugaaaaucauuuugaccauuaaguaugaaauacaccuuugaucuaaaaaaauaguaaagugucaauguuaauauccgaguuauuacauuguacuauaguuuugcaagauguuaccauuggcaaaaacuggguaaaggguacauagaucuuuccacguuauuuuuuauaacugcaagugaaucuuucaaucauuucaaaauaaaagguucggugcagaaaugaagcuggcuggguguguuggcccacgccuacaaucccaacacuucgggaggcugagguggaaggaucacuuguggcugggaguuugagaccagccuggacaacauagcaagauccugucucuacaaaaauuaaaaaaauuuuaaaaauuagguaggcgugguggccugcaccuguagucccagcuacuugggaggcugagguggguggaucaguugaauccaagcguuucaggcugccauacuccagccuaggcaacagugugagacccugucuuguucugucgccaaggcuggacagugcagcagcaugaucucggcucacuaccauuucugccuccuggauucaagcgauucuccugucucagccucccaaguagcugggauuacaggcacacaccaccacaccuggcugauuuuuguauuuuuaguagagacgggguuucuccauguuggccaggcuggucuggaacuucugaccucaggugaucagcccaacuuuagccucccaaagugcuaggauuacaggcuuuugagccaccgugccuuaaacuguauuuaaaaagaaaacagggccagguauaguggcucaugaugguaaucccagcacuuugggaaaccaaggugggaggaucacuugagaccaguaauucaagaccagccugagcaacauauugagaucuugucucuaaaaaaauuagucagguguaguggugggaccugaaguccuagcuacuuaggagcuuaacgugggaggaucacuugagcccagaaguugaaggcugcagugagcuaugaucacagcacugcacucuagccuaggccacagagcgagacugucucucuuaaaaaaaaaaaaaagaaaagaaaacaaagcuacuuccauaauuggggauguuggcugauguuccagauggucugcaaucacugccagcagguuggagggaauuaagacucccugaguggcugggcaugguggcucacaccuguaaucccaacacuuugggaggccgaggcaggcggaucaccugaggucaggaguucaagaccauccuggccaacauggugaaaccccaucucuacuaaaaauacaaaaauuagcugggcgugguggcgcacaccuguaaucccagcuacuugggaggcugaggcaggagaauggugugaacccgggaggcagagguugcagugagccgagauugcgccacugcaguccagccugggcgacagagcaagacuccaucucaaaaaaaaaaaaaaaaaaagagagagagagacuccaugagggcagugucauccuucacauauagggauccugcagccucugcagcuccuaugaaaguuuuagaggcugggcaugguggcucaugccuguaaucccagcacuuugggaggccgaggcaggugcauugccugagcucaggaguucgagacuagucuggccaacauggugaaacccccucucuauuaaaaauagaaaauuaguggcguguaguggcgggcgccucuagucccagcuacuugggaggcugaggcaggagaauugcuagaaccugggagguggagguugcugugagcugacauugugccagugcacuccagccuggcgccacuccacuccagccugggugacacagcaagguucugucucaaaaaaaauaaaauaaaauuuuagauucuuggcugggcacaguggcucacaacuguaauccuagcaccuugggaggcugaggcgggugggucaccugagcucaggaguuccagaccagcccgggcaacauggggaaacccugucucuacuaaaaauacaaaaauuagccaggcgugguggcgggcaccuguagucccagcuacucaggaggcugugacaugagaauugcuugaauuggggaguuggagguugcaaugagccaagauugcaccacuguacuccagccugggugacagagcgagacucuguuucaaaagaaaaaaaaaaaaagaaaacaaguuuucuuaacauuuuuuaagugaauucucuuuucugaaucucauuaucuaaagaguuaauggccaaaggccaagagguacuuguucagugaauuauaaaacguccucaacuucugugagccacaguuuaucuauaaaaugaaacuaauaccuguguuacagguugccaugaaaacugggugauguaauacaugugaaacucuuagcauacgugauaggcacacaggaaguccucaauaaauguuagcuucuauuaauaauacaaauauuuuuauuacuaccauauuugggagacagugaguuccccauuacaggcaguaaucaagcaaaggcugguagggaagcuucagagaguacucaagcacugaacauauaauuggaccaaaugaccuuuaagauaccuccuuccauuuuucagauuaugggccucuuaagagaguaagagcuugggaaagggagaaaaaaggcaaguuggggagaaagagagagacagaaacugcuuuccuacaggcacauaguuccagaaauuuuuucuuuuuagggcgaagaacuaaucucucgaugccuugcuucccaaaucuucaagccucauucaagaaugguggguccgcccggacagggacuagaguuacagcagugaugacuguggccuugcagugacccuucaucacucacaaacaaaaucugccugcacuagacgacuauguacuggcuuagagacuaacagucauaauuccuauuccaagugugcaguucaucacggugcauggaagacaggcaucuaucucuauuccucccccaaacccuaugacaugacaguaaaggaauuuaaaaagauaaaaacuaugaagacaacaggaacagaggacaccacagcagguaagagccaguuaacaaccuuuugggagauggaaaaaggacagaagagucaguagcuaauuugcagagcagcaaaagcugaaccuaagugccuggaggauggagagcggagaaggagcugcagguucugcaaaggcucaggaacuggaagcaccaggucccgcugcagaugggaguaccagguguggcucaaaacuggugacuuuuugaaaguccaaauggagaacgguuaggaacugguguucccuucuccugcucuggaagucaagcaaccacccuccuuuccuucacagcaaaagccaggagguucacucucugaagcgcugagggaacccugaccucaggaccccaggugcugcuagggggaaggugggcaagaggcagaauacgacggaauuaaaguuaaagcgaaucaauggcacaaugagcccacugggacccuuccucaguguggccuccagaaugcuggcugccugccugucucccacagcaagagacaggggaguccucuauagggaaagugacaagccuccgugaaaaaaagacucgaaguccugagguagagguucccgcccccgaauguaacuaccgaguacccugagguagagguuccccccacuguaacuaccgaguacaagcgggcgccuguagucccagcuacuggggaggcugaggcaggagaauggcgugaaccagggagguggagcuugcagugagccgagaucgugccacugcacuccagcuugggcaacagagugagagccugucucagaaaaaaaauaaauaaauaagaaaaauuaaaaggauuuugagccugggaguuugaggcugcagugagcuaugaucaugccacugcacgacgccaagcacuccagcuugggugacagaacacaaccucaccucuuaaaaaaaaaaaagaacuacuaagagcaucagcauagauuauuugaaaguauggaaguaauuaacaaaagcaacaaccaucggaauuacaaggggcugcuucugaggggugggacucauaauccugggaugcugaguuuuaaaacuacaaaauauaacuuugaugaaacauauauuuuuagauagacaaaaaaauaaaaaggcaagccacaucaagcguagucagcacacaaagguccugcacaguugcugaagagaccacaacauguaccacaaugagguggacuugcuuucucucccacugcagaugaguuuuaaaauucuaauuccaaagagaguuucuucuauuugcaguuauccuggaggacagugaucaccuaagcuuuuggcaugauucuccauggaauggagaaagauuuucuuuucuuuuucuuuuuuuccuugagacggagucuugcucugucgcccaggcuggagugcaauggcaugaucucugcucacugcaaccucugccuccuggguucaagcgauucuccugccucagccuccugagcagcugggauuacagguguccgccaccacgccuggcuaauuuuuuuuauuuuuaguagagacaggguuucaccauguuggccaaguuggucucagacuccugaccucgugaucugcccaccuuagccucccaaagugcugggauuacaggugugagccaccgugccuggccgagaaagauuuucaaaagggucugagagauuaaaaaauaacucucuaacacugagggcucucaaaguuuggaucugaacaaagcagauccaguagauccucuggagaguucuucuagcuccaagaauuugaguucuacccgaaggaaugaaagguggacagcaaauacuuccacgaaccccaacauacgucaugcuggccuuugucaggcaguggauggcugaagcuccaggcuaaaacuccaaugaaagucuccauguuuccucauuuguuaacauuuucccuuucuuuuugucaggacuagggugaccaaaagccucaggcuucucuuacacagucacaaucaccagaccccuggacacugaggucuaccccuuccuaaagauccuuagcgaaagaaucagggacugugccccaaugaaauccugccacuucccugcuaaauguagcuaaaugaauaaccaaaacaucugucuucaagaggaaccaacucagugcaccacuuaccagugagucagcccaggaaaagugucauucuggaugguaaaaacaguucccugcgggguuccagaggaagaacuucuggacccaauuuucgcccuagaccagcauggugaagcagacaccguccgugcagcaugggcagcaugggcgcccaagccuggcucucaccugaggcccugcaggagagcugagugggcuguugcaaagcaaugccucuacuggauacccaaacuccaugccaaccccaccuggggcaaggagggagaagugauggcaguucuuaugaaacagagcuuccugccuuaucauauuuuuagcuccaagauggcaggagggcccaaaauugcauuuagagggaggaguacaggggagugauuaagagcugugguuccagggccagagaguccugggcucuuacucugaccauaucaccugcaagacggugugacccagagcaccgcagcauugagcucucagagccuccacuuccucaucugaggguagggagagcagcagcgccuccucaugggguaucgugaagacugcaguagguaaaggcccucagaaugguagacggcacacagugagugcuugaauguuacuaacugacaaucuccucugagugggccucucaaggaagcaucagcaucuccaaaugaggcaugagaagugcugggucuuuaggcuccuaaggaacagggaacccuccuucugcgauccacgccaagaccaaaaaaagaaaagcaaaagcucucaacucugauagcucaaaaugaccguagacagccgccagcugucagcuccugcgugcgcuguggcuguccucuguggguaaugugcaugguauucacaggucagcccagccugccuccucccagggucaccuccagcucugcagccccgcacgcucuuucccaccaggcucugaagcaucgcuguagcagcuguauuacccacuuggcauucggcacauacugccauuuuugucucuguggguaugccaagacuucaacucaacugucaauucaagagcacaggcuguuuucuuccguauagugcccacguacugcccaggauaccgucccuguagcagacacugacguguucccagaacuacaggauggugcucucggugaagcgccccagcaaaacagucuccuuaaucuucguuuguuuaucuaauugagagcccccagagcccccacuuacuucauccagcugucucuucgucucuucuuccauccuucgaaugucguccauggucaggucaacccacuuaucgagccaacagaacagcugccuguggaaguuuguaaacagacgccucucuugcuauagaaaggagggaaccacguuagaacgcagaaggcaaaggcugcugccacagcccuucucuccaugcacuccacacgaauacccacacuagacuggggacgggcggacaggaggaggaguaaugcccggcugguuaucuggaccagccaugggucaaugaccuuugccuucacgugucuaacagguauggcuucacauaggagggagcccccaagaaagaaggaugccuaccucacacuaggcccucugcccaaagcaccagcaagacagcagcccaugaacuccuaggcaagccaagggccccaaaccacugccacauuucuuccugucucuggugucuaaugccagauuaaaacuggccagcagcuaugaaauauggcccaagugaggcucaaacaugucggaggauuaaaaggcucuaaaacuccuuagaccugcccagcagaguaauucagggcaccggccaaccuggcucccagcaccucuugccuuucagcugcaagaaaagaaagacugaguuuuaucuguaggucagucauagcaagucccuuccuguggccuucuuuugccucaguuuccuucccugucacauguggugucccuggaaggacagcauuaaaccguaagacauuucagugcaagggaaggugggcagcugggaagccgccaaacugugagguaugcucauguuggcaacccugucaugcaggccacaugggcugggccaucuucuucacugggccaaacaccccccaccgcacacacacgcagucacugggaaggccucagccgagcuacuuaccuuauggaugaaguucuccaccaccccccaccgcacacacacgcagucacugggaaggccucagccgagcuacucaccuuauggaugaaguucuccaccacccccccacaacacacacacgcagucacugggaaggccucagccgagcuacuuaccuuauggaugaaguucuccacuuuguucugcaggccccaccacuugaacuugacggucaccaguuuguaugcacacauauaugggcaguccuucugguuuacaagcucuugcugcauuagaaacauacccauggguacgcaaguaacaacgggcagaccucaggccguccccagcucaccccagccaugccccuccuccacagggagcggcccacccacaugcugcccagcccccuggcagugaaggugugaaugguaccuuccaauuggggcccaaggguccucggccuguuuugauagauuuaaauuuugcugggucuuccucugccuuguaauccugagagaaauuguggaauugggguuggaggggagugggagagggagugagagauggggagaacagaucuuucauuagcauucacuccauaccagaucuugaugcugauggcacaaagcaaauaugggaaaauguuauaaacaagauguagaacuguuuacauuagccucagaggagaguucuaugugauuuucuccgauaggguuuguuuuccauuuugccagugugaaaguaucaccagacugucugagcaggcacauauuuaccguguugaagacagagacuuucaaccuggggugagcauccagaucaccagggaagaccuuuuuaaaacacagauuuuugagucacuccaacuaaaacccagugacugagaauaucugcaggugacggcagcacagauuuguuuuuuguuuuuuuaaaucucugcaagugacucuaaaauacagccagcgcucagaauacccggcugucauuccuuaaaucuuccagugcaaucucccucuggcuuguuuuaacaaaaucauuacuggaaauguucaguguauggaaccuauccacuacuggugagucucacuucacagauuuauaaugcagucaauuuccuguguuaauuaaccacaacaaaaguuuaauuuucagcugucccucuacauugacuaaugugggcucaggagauacaaacuuauagcaucuacuuaacaaaaauaacaaagauaauaaauuucucucucucauaaaguauuucccaaagcugagaaguuuuuuuuuuuuuucuuuuuuuuuugagagggagucucgcucuguuggccaggcuggagugcaguagcgcgaucucggcucacugcaagcuccaucucccaaguucacgccauucuccugccucagccuccccagcaacugggacgacaggugcccgccaccaugcccggcuaauuuuuuuuguauuuuuaguagagacgggguuucaccguguuagccaggauggucucgaucuccugaccucgugauccgcccaccuuggccucccacagugcugggauuacaggcgugagccaccgcgcccugccuuauuuuuuuauuuuauuuuuuugagacagcaucucacucuguuggccaggcuggagugcaguggcacgaucucagcucacugcaacuuccaccuccuggguucaagcgauucuccugccucagccuccugaguagcuggcauuacaggcgccugcgaccacgccaggguaauuuuuguauuuuuguagagacgggguuucaccauguuggccaggcuggucucaagcuccugaccucaggugauccacaugccucagccucccaaagugcugggauuacaggcaugagucacuauguccggccgauuuuuuuuuuuuuuuuuuuuuucagauagaguuucgcucugucgcccaggaugaagugcaguggcacaaucucagcucaauggaaccuccgccuccugaguuccagugauccuccugccucagccucccaaguagcuggaauuauaggcaugcgccaccacgcccagcuaauuuuguauuuuuuuuuuuugacacaguuucacucuuuuugcccaggcuggugcaaaggcaugaucucggcucacugcaaccuccgccuccuggguucaagcgauucuccugccucagucuccuaaguagcugggauuacaggcaccugccaccacgccuggcuaaucuguuguauuuuuaguagagacaggguuucaccauguuggccaggauggucucgaucucuugaccucgugaucugcccaccuuggcgucccaaagugccgggauuacaggugugagccaccgcaccuggcccuaauuuuguauuuuuaguagagacgggguuucaccauguuggccaagcuggucucaaacuccugaccucaagugauaugccugccucggucucccaaagugcugggauuacaggcgugagccaaugugcccagccucugaggagauuauauuuaugugugcuuuaaaaaauaaauauucaccaucacugcuucccuccacucacacagaucaaccagaguugacaaaauacucaaagaaucauacuuuuugcuaguauccaguuugagaaaauucaucaagcugcauacuuauauucacuuugcuguauauguuaaacuuccauaaaaagcuuuuugaaaaauccaccaacguuuugaagguggggguugggauauugggcaaggaagcacaagaugguuuuuauaucuuuucggaaaugcacaaaucaaaauaacuuugugugugugugugugugagauggagucucgcugugucgcccaggcuggagugcgauggugugaucucugcucacugcaaccucugccucccggguucaagcgauucucuugccucagccucccaaguagcugggauuacaggcacguaccaccaggccuggcuaauuuuuguauuuuuaguagagaugggguuucaccauguugggcaggauggucucgaacucaggaccucagaugaucggucaccuuggccucccaaaguguuggaacuacaggcgugagccaccgugccaggccccaaaauaucuuaagugcagagugaccacaggaaagagguaucacaccccugggauacaaagagcaaacacacauucccuaucagugggcagagaguuacauuccugucuuuuaaucccaaugaggccucugccuaguaagaaugguaaugaaugaggaggaaucuaacccccucauucccugagcaaauacuucuugggugcaaaacagugagcaagccagaccuggucccucuuuugaccaaggucaugguccaccaguggacuguccuuuuccaggggucugcuccaguguguguuacucugaaaaggcgccaccgacuucuggagggcaggggaccugucuuucccugcauucugcaucccucaccuggaacccagagauccugacaauauuccacaacccaguaggcaggaaguaaauguuuuuuuaauuacugaguuggaaaaauaaauuugagaaguggugcuccgauuuuucaggcuaagcaucauuuuagcagggcaaaauacucuagcuacaauaccuacuuaguccaguaauaauuuucagaggccaaacagggcacacaaauuugggccacuaauuuucugguggcauccccaacucaagacaagaaaucuccuaauacucacuuuuaaaaauaaaacaagcaagacacaucagaauuuccuuuugugccaaguuggguaugguuuccugguuucuuuagcauugagaagucauuucugcgucucgaaggccacccacgucuuuaaacggauccuaccuugcugagcacuuggcuucgaucugcaaugucuauauauacggcuuccacguguuuccacgccucaggcuccagcuuaugcaccugugggaacaaguggggaaccacuaugcaguuuuugucaguuauaaaauauccuuuagccagaauggacaccuaggaacugccauucccauagccacagauguaagauuccuaaugauaaguaauuauacaauuacauacaaaauuauccaaagaaaugggagaauggauuuuuuuuuuuaagagauggggucucaccguguuucucaggcaauggcuauccacaggagugaucacagcacacucuagcaugaacuccugggccggagugauccuccugccucaggcuccuagugauccuccugccucagccuccugccugggaccgagggauccuacugucucagccuccugccuaggcccgagugauccuccugucucagucuccugaggagcugggcccgagugauccuccugucacagccuccugaggagcugggcccgagugauccuccugucacagccuccugaggagcugggcccuagugauccuccugucacagccuccugaggagcugggccugagugauccuccucucucagucuccugccugggccugagugauccuccuguuacagccuccugaagagcugggcccgagugauccucccgucucagccuccugaggagcugggcccgagcaauccuccugucacagccuccugaggagcugggcccgagugauccuccugucucagccuccugaggagcugggccugagugauccuccugucucagccuccugaggagcugggacuauaggugcacaacacugaacccagcuggauugucuguuugucugagauggagucuugcugcgacgcccaggcuggagugcaauggcgcgaucucggcucacugcaaacucugccucccggguucaagcgauuauccuaccucagcuucccgaguaucugggauuacaggcgugggcuaccacgcccagcuaauuuuuguauuuuuaguagaaacaggguuucaccauguuggccaggcugaucucaaacuacugacuucaaguguuccacccgccuuggccucccgcccagcccccgcuggauuuuaagugacaugacugagaacgaaugcucugacuauugaggguaaacgucacuucugcaggucaaaacgccuuccggauguuuacggugcccacaccauuuccauguguucccggcuguacagacuguaaacccuucuagagauggugucuguuuagcaacaugcugacccgcuguaaagacuguaaacccuucuagagauggcgucuguuuagcaacaugcugauuauuuugaucaggcuguacaugcacauaauacaaaauuaugacacaaauucaaaauuacaaaaggauacaauauagaguaacuagaguaacuccucuucuugcuugucccucguccccagucuaguaacagccaccucuaagagauccuacauacaaacauccaugugcguggauuuuucuuuuaauaugaagggcggcaugcacacaccuuguuucauaacuuccauccuucacugaacagucaacuugaagacugcucucuauugguuuuuccauggcugcaaggaugucacuauuuggcugaaccacaaugcauuuaacguuguccuacuaacgggccuuuuuuuucucuuuuuuuuuuuuuaagacagugucucgcucugucacccaaguuggaguacaguggcgugaucucggcucacugcaagcuucgacucccggguucacgccauucuccugccucagccuccugaguagcugggacuacaggugcccgccaugaagccuggcuguuuuguauuuuuaguagggacaggguuucaccguguuagccaggauggucucgaucuccugaccucgugauccgccugccucggccucccaaagugcugggauuacaggcgugagccaccgcacccggucuaacgggcucuuauguuguuuuuuuguuuuuggagacagggugucacucuguugcccaggcuggagugugguggugcagucacagcucacugcagccuugacuucccagccucaaaugauccuccagccucggccuccagaguggcugggaccacaggcacauaccaccaugcccagcuaauucuuuuuuuauuuuugguagagacagagucuuguuauguugcccaggauggucuuacauuguuuuugaucuuuggcuacacaaagaagacugcaaugagucuccuuguauauauguuauuucacacaugugaaaauaacugucuaaauucuugggcauggaaaugcuaaaggauagguguauuuuauuuuuugggaguuacugcaaauugugcucuauagaaaacuguaauuuuggucuuuuaaagauauagcucccauguaccaggaacugcaccaauccaagcaguacgagaaggccccauaaaaaguuccggagaucacauuuugcaaaucagagacauagcaaucccaugcugguaagauaggucuaggcagaggccacugccuucccggccaggcaaaagaggaccacagagaggaccccaugguagcccuggagaggcuacaaggcagagacucaagaccucaccccuggggcuuuugggaacuacuacucacauucuccugcgugccaagaucugguuugugccagguuucaauuuuaaucagaaagucuucuuucauguacucauucuggaagaaggaaaaaaaauacaugaaagucacuagguucacaguugagaguaaccaucucccauuacuggagaugggcauuacuggaucaugggcagcuaggagauuccagccucugccuuguaauaacaguuaacuugacugggagcccacgacacacuaggcauguauuaucccauucaauccucaccccagccugagagcucuguagaaucacccucauuuuacagaugagguucaaagagguuaggugacuuaaccaaagucacagagaucgggccaggcaugguggcucacgccugucaucucagcacuuugggaggccgaggcgggcggaucacuugaggucacaagaucgagaccagucuggccaacaguggugaaacccgucucuacuaaaaauacaaaaauuauccaggcaugguggcgggugccuguaaucccagcuacucgggaggcugaggcaggagaaucgccugaacccaggaggcagaagcugcagggagccgagauugcaccacugcacuccagucuaggaaacaacagcaagacuccguuucgaaaaaaaaaaaaaagucacagagaucacgacagaguugggucucaaaacaguuucgucugacuucagaauccaugcauuuagccacucuggguaguaagcaguguggaaagagcacagaagacuuccuaacccaucgaagauacucaccauggccccuuucccuccaacuagccuguggcuaaggccuuaaguuuucuucucaguaacugaacccuucaagcuaauuauugccucccucccucccuuccugcuucuuaaaaauuggaacuucucaaaggaggaacacauucacccauuaacgccucagcaggaaccaguuucccagagacagccaguguuuaccggcagggacaaggcacucagaugagugugcugaauggugggcgggugggcaaugacagaggggacggcuguggaagagaaaccccgcugacuucacgacuuugccaaggaucagugcucaguggacucaacagaugcacagauggggaagggaugucggucaggucaguugaauggagcucucucuacaaccuugaaaaggugugaccuggggaggcagggccucgagccacuguguccaugucagacccacagccaggaugcacuuaauggagccgcaggccaaugcagcuuaaagcaggaggucaucaugccaguuaacagguuccuuguuaguccacugacaggacugagccucagcaacuccaaacaucagccaagggaaagaacacccaagaccaccagugcaguuacauuuuucucucuccuguucuuauacaucaucuacaguuccaacccccuugacaauacuuacuguaauaacugcuccgaggcaaggacauggaaagaagagagaaaaagauuaaugaagaugaagaaauaucugccccccaccccccacaaggaggacgaauggcagaguguacuuuacucccuguggcuuauuccacggucaccuccaagccccagugagucagaaauaccuuaacgcaccaacccucaaauuucacucagacaaacaucccaaaaaaccaaacagggaauuuaauuaaagcgacgccgcuaugggcuucuugggauucuuuucagcagggcacugacagggaccagcucugaucagcagaggugccgcaacucaucacucuggcaucagagcguucuccggcgccucccaccccuaccccagccucuaccucccggggcacagagcagggugcuuuggccaugcacuguaucugccuccugcacccuuccucucgcuguaaucaaaccucccaggcucugcacuccugcucauuguaaugggaaccccuuagaaagcaugguucaauuauuuaucagagaaaaugacugcaccucucaugucacuggggaacagacuagcucugcuccugagaccgcccgguucauucuguacccucugaauuuaggaccuauguccacuucugcuggcugccccacugccauguuuguagagugugugggguaacaaacuccagaacugaaguuaaggugaccccggagcacaaaaugaggcaaaguugaaauauaaagaguaagagcuaucacgcacagaaauaacccaaaagacugucaguaauucccccauacccaacgaaagacacuuagaaggaagcaccagauuaagauuacaacugaaaggccuacacugaaguaacugcccuguuagcagcuucaagaaaaccacguuagaauaagaaaaggaaaucauggguauaguaucucgucagcagaaauucuccugugccguggugggccccggaggcccagcccccgcauguggcaucucuggcagcgccaucccuggagugggggcagcagugccaggauggccuggucugaugacaccagccacuaaacuucuccaacuaagcaccuuuuuugaaucuaucuccucuaagaaagucucuccuaguucggccucuccgagacgugcucaucaauggacccaagaaucugaucacucagccaagcggacauucuuugccacacauuggcauucugauuauaauuugguuucucauguagaagaauccacaagaaaagaaugcccugaucaucgaaugggaaugucccguuucgguagcaauucugcguuuuaguguaacuucauagacuggcgcugggguuuuuacacauucaucuuugugagaccccgagagacagauccacucaguucugacaaccugguuuuccgaaaucaugagggugacagcccuugcugaccuuuucaugcaaacuugggugaucaaacaauccuccccaaaccuucuccagcccucccaggcccucaaacaccucugcauuccaguauucccuguuguucaaacuguaacccaaaguacacagaaaagccgcaggaaaucuuuugcagugggagagcagagauuuccaaaugagacuaauaaggcauuuuaaaugcauggcagggccgggcacgguggcucccgccuggaaucccagcacuuugggaggccaaggcgggcggaucaccugaggucaggaguucgagaccagcuuggccaacauggugaaaccucguuucuacuaaaaauauaaaaauuagccgggugugguggcgcaugccuguaaucccaggcacuguacccacacauggaggcugacaggaggaggaccccacagcccaacacugucuguugggaggcugaggcaggagaauugcuuaaaccuagcaggcggagguugcagugagccgagauugcaccacuguacuccagccugggugacagaaugagacucugucucaaaaaauaaaaaaauuuaaaauaaauaaauaaaagcauggcuuagugauacuguauccagccgaggacuauaguuccaggaagagauggaaggagaaacaaacuuucuuuuccuuuucccacuuucauucauucacagaccaacuccuaucuuacccucuccucacuuccagcccaucccaucagcuucaagggaaaaagagagagggaaacaagcuaagaacagcaagagcugaucauuaccagggugucccaaucuguuuucacuccgcucagagaaaggaagagccuuccaaaagccaugaggcauuuuacuucaugcuccuucaucuaucuuccuucaaacuuggaucuacugaggccaagcuaagaugucugaacuaauaaccucucucccaucagcccccagagggaacuggaaaguagccuuccuugccugcugguaucucuuauuuuaaaagagcaagugucuaacuaaacagaucuaagauucaacauauccauucugugugaagguguauccugaauaggaggucagcacccacugaggaaaccaaccuuccuuccccuacucccugucuccaugaaauauuuagaaauuacauuuuuccaguggagcuccaguggcgcaauugguuagcgcauggugcugauacagaaauuauguuuuucuuuucuuuuggccaaggaucaauauaugaacauuuaacgugcagaaaaaugcccaugucagccgcaacacucuucccagaaugacacagagaacaggggcaucucucaguuggcacaagcuguguacccagaacccugccccaggcagggagauguccacacuugcaacacaugcucacugcgacucucuuagacaucaagaaaauccaccuuuggcccuagaccagacacacccagccacacugcauacugccuuuuuuuuuuuuuuuuuuuuuuuuuaauaaacggaguuuugcucuuguuguccaagcuggaguggaauggcacgaucucggcucacuguaaccuccgccucccagguucaagcgauucuccugccucagccucccaaguagcugggguuacaggcaugcaccaccaugcccggauaacuuuuuguauuuuuaguagaaacgggguuucaccaaguuagccaggccggucuugaacuccugaccucaaguaauccgccugccucagccucucaaagugcuaggauuacaggcaugagccaccgugcccgacccugucuuuuaagaacaucugugcaucccucauuuccaagaaucuaacuuccagcccagugcuuaaggaguagggagggcugugcuucagcuacagcaagaaaacucuaaggguuacacaucccagaccccaccaaugaccgcaaaucuccugauacaaggucccugaaccuguguggggccacugaggguuggaaagagcaaugaccccguauucuggauugcagucauucccaaaguccacaggauaagggugauaugcgucacguaaggaucccagacucaucagacucuagggaguaccaggugccaacaaagaaagcaagugcaggaggacaggucagcagaggcuggugggaggaccccgcagcccaacacugucuguacccacacauggaggcuggugggaggaaaggucaccuaccucacagacaagugccaggggaccucucaggacuccccaggguuaugaaucaguaccagcuuaggcccucccaacaggucuauuccuagauggcccuggaaaccuaggaaucuuggaaggcuaagaaucugaaucacucgaaagaaauuuaagaaugucuggacuagaauagaaaguucucuguggagguucaaaucuuuccuuuccuuucaagaaacucuaugcaggagacuggccaagauuaagaaaauaauuauaccuguauccucaauuacagaacaugcuguuucagcagaagccacaguucauucauaugauggaauacuaugcagcuauuauaaauuaaaaaacaaaacaaaacaaaacaccagacaccuuagugacaaggaaaauguuauccauucacugaagaaaaaugagaaacuuaggccaggcacaguggcucaugccuguaaugccagcacuuugggaggccaaggugggaggaucgcuugagcccaggaauuugaaaccagccugggcaacauggugagaccccaucucuccaaaaaaaaaaaaaaaaaaaccuagccggacaugauggcauaugccuauagucccagguauuugggaggcugaggcagaaggaucacuugagccugggagguuaaggcugcagugagcugugguugugccacuggacaccagccuggacaacagagugagacaaaaaaagcaauuaaaaaauuaguaaucauauuaguaaucccagcauucugggaggccgaggcagguggaucacuugaagucaggaguucgagaccagccuggccaacauggugaaacaccgucucuacuaaaaauacaaaaauuagccgggcauggugguguaugccuguaauuccagcuacuuguauggcuggggcacgagaaucgcuugaacccaggaggcggaguuugcagugagccaagauugugccauugcucuccagccuaggcaacagagccaggcuccaucucaaaaaaaaaauaauaauaaaauaaauaguaaugaucuaaaauuuuucgagaaaaugugucugggcugggcacaguggcucacaccuauaaucccagcacuuugggaggccaaggugggcggauaaccugaggucaggaggucgagaccagccugggcaacauggugaaacucugucucuacuacaauacaaaaaauuagccaggcguggcgguaugcgccuguagucccagcuacucgggaggcugaggcagcagaauugcuugaacccgggagccagagguugcagugagccgagaucacgccacugugcuccagucugggcaacagagcgagacuccaucucccaaaaaauaaauaaauaaauaaaaaugacuagaaaaauauacuaaaauguuauaaugaauaacaauaaucaaaaucgcagcauccccaagugagagacuggcucugugcucucaggccgugacgaccggugcuucucgcccugcuguccaccaagcugugcuggacacagcacugauacccaccaucagccggaagggacccagcccgagccuuucccuggccuaauccggaacacgcaggugggacccacagcucugcugcccgccccugccuggccgacguggccccggcugcacucaccgguucugcaguagggguaagcauuccaggcuuucucguguauauucagggcucccucuggggccagcauucgaacaaacguggguacuuugcuauagcggggaaaaaaagggguauaaagagaaaugguagagagaaaggagacaagaggcuuuucagauccagcuucuucauggggagcugacaagcaaguuuccaugcaaugagcagguuacuggugggagugagaaguuacguaugagagccugacaccccaccuuggcuggcuccuaacacacacccacgacgugccccaccagccaccagaaacaggaccacacaagagaccccaggcuaccugcuguggcucaucaccccuuccaucagcauuacacauuuuuccagagcuugcugggcccagggcauuauacuacaaggugcgagaaaaacacaaaggagaugccuccaagcaugaaccagucucgguuuagggccaggguaacuagccgacuaacuuggguuugggauccaggauuaucugaucugcuuucaucagcucugagaggccaggagggccuagaaccauuugccucccaggacaaaguauuuucuucuacucaauucuuuuuuuuuguuuguuuguuugagacggagucucccuuugucgcccaggcuggagugcagugcugcgaucucggguaacugcaaccuccaccuccagggucccaguucaagcgauucucccgccucagccucuugaguagcugggauuacaggcaugcgccaccacgcccagcuaauuuuuguauuuuuaguagagacaggguuucaccauguuggccaggcuggucuugaacuccugaccucgugauccacccaccuuggccucccacggugcugggauuacaggcaugagccaccgcgcccggucucuucuacucaauucuuaucucagguuacagaacaacauguacaguauaagcccccugcuuuuuuuuuuuuuuuugguaggugugugguuugacggaguaggaaaacauuuagaauuuuuuuuuuuuuuuugagacagucuugcugugucacccaagcuggaguguaguggcucgaucuuggcucacugcaagcuccuccucccagguucaagagauucuccugccucagccucccgaguagaagggacuacagguucccgccaccacgcccggcuaauuuuuuguauuuuuaguaaagacaggguuucgccauguuagacaggauggucucaaucuccugagcucaugaucugcccgccucagccucccaaagugcugagauuacaguggcgugagccaccgugccuggccuagaaagauuuuuuaaaauuaaaaugaaaaugguacauauauuccuuuuccuuuuuuuuguuuguuuuuguuuuuugagauggagccuugcucugucgccaggcuggagugcaguggcacgaccucagcucauugcuuccuccaucuccuggguuccagcaauccuccuuccucagccuccuaaguagcugggacuacaggcaugcgccaccacgcccagcuaauuuuuguauuuuugguagagaugggguuuugucauguaggccaggcuggucucgaacuccugaccucgggcaaucugccugccucagccuccuaaagugcggggauuacaggcgugagccaccgcgcccagccguccuugguuucuaacagauaaucuguccagucuuuggcaagcucuggcaaccucaucagcuuuagugccucaggccuaagaaagaagagcaaacuagagcagagagcuaaccuggagcacuuggggcggccucugugauucacgaacucacugccauccccauucaggcgaguauuucuagguccaggcagggggacacacagagaaaccaaacagauguggcucccacccucaaggaguuuccggucuacuggggcguguaacuagacaaggccaagcacaacacuguaaguucaugccauaaugcggugggcacagggcccuggguggcggagugcugugagaacacagugggggacaugcagugcaccgggcaggcucugcgaggaaagucaggaugaaccaacacaugggacaaugaguggggcuaagcuaagagacagaugggaguggggugggaaaagcuggagaaaagagggacaaguucagaguaaccggugcagguacaagguggggaauucaaggagacaccugaagcuggauccuaaaagauuuuuuuguuuuuuuuuugagacagggucucacucuguggcccaggcuggagugcaguggugugaucauggcucacuggcagccuugacuuccugggcucaggugauccucccaccucagccucccaaguagcugggacuacaggugcacaccacuaugccuggcucauuuuuguauuuucugguagagacagggucuugcuauguugcccaggcuggcuaaaagguccuauaaguuaugucagacagcacggacuucguccugaaggcaaagggaagccgucagcaguuuuggcgcugggagugacagaccauccagacugaacacuugaagcggugcggagaacugaaaggcagggagacucguuagaagcugcuguaguaauccaggcaagagguggcaaggaagggacauguuggagacgcugaggagauggagucagcaggaccugaugggacacgaagggcaagugagaguguugcggggcggagucagcgggaccugaugggacacgaagggcgagugagaguauugcggggcggagucagcgggaccugaugggacacgaagggcgagugagaguguugcggggcggagucagcggggccugaugcgauaagaagggcgagugagaguacugcaggggagcucugcuuucugcuuugggcagccagauggcugacacaguaaagcuucucuugucaccauggggagagguagugguggcagucacugcuggccuuuucuuuuucuuuuuuuucuuuuuuuuuuuuuguaagagacaggcgggaucucauucuguggcccaggcuggagugcaguggcgugaccauggcuuacugcagcccugaccucuugggcucgggugauccuuccaccucagccuccugaguagacaggacuacagacacucgccaccacaccagccuaauuuuguuuauuuuuuguagagauggagucucgcuauguugcccaggcuggucucaaacuccugaccucaagugauccauccgucucggccucccaaagugcugggauuacaggcgugagcccccgaagcacccggccagguuccaucuuucauauguagagaccucgucucugucaguuugguuggaccaacuuagucuugaggaaacaauuggucccuucuaccuaaaauaccaacuucaccaucucuuuucaaaauccucuuuaagaaauacaaauaccagaggaggagcaaaacgagacauggagaaaaagugugcuggugaggagacugagugauggugagguuccuccccgcuggacagcacugcucuccucgcaccccggcacugagguccuggacccucuggcgaggagacugggugacggugaggagacugggugauggugagacuccuccccgcuggacagcgcugcucuccucgcaccccgguacugagguccuggacccucuggcgaggagacugggugauggugagguuccuccccacugcacagcacugcucuccucgcacccuggcacugagguccuggacccucugacaccaucaaagugacagaccacagugaaguggggcuuuuuccaaaugaaagucaauugauuucaguucaguuuagagacuagaaauuaagauccagcuuucaguuucacagcaguguggauggacuuaaaugucacugaacuguauacuuaaaaaugguuaaaauggugaauuuuauguuacguguacuuuaucacaauuuuuaaaaagauucagguuuaccuuuaccaguucuggauagcuucuaaaacuagcuugguuugacuuccacucaagcugauguauaauuaauaccaucaacgcccuuugggucugcucacaguuugcugaaacauuacuguuuucguuagggauuuagcaaauuuguguaguuugauauggauuccaguacacaaaucaguucaagcuucauuuaaaaaugcugaugccuuugauccaaagagagguaccaaaauuucucuagcgaucgauuucacgauaucagaauuaaaaacccuaccagcccagcaauucuaggaauucaauuuuaggaauauuugcuaaaaaucugcauauacaaguacaucagaagaucuacacagaaggaguuuuacuggauuauguaggcaucuggaaaugacuagaaauaugcgucaagacaggaggguucaacaaccuauagcacuucugucccccaugauacugugaauccuacacggacuucagagaccgaggcagacagaacaggcugggagaggaggccaugauaaguaacaacaaaaaaggaauaguauauucccaucuauauaaaugugaguauaacauuuauacagucaguauauaacuauuaauuguuaggauauaacaauuaguauaaucccaucuauauaaaacaauaaaggaaauaacacucauucacacacacacaaaagccagcauccggccccgcugcucaugccgcauaccucugcaggugguagaucuuguguguguacuggccuuucucaccguccuucucguagggcucauucaccaggaccuccacgccuucgccaccacccguuucauuuuuacuggccucagccacagaauacagcugccccacuugauacuaaaggacagagacagauguuauucucaacacggacccuucucaacgguuacacguaauccagcugccaguaagugucuaacuggaucucccuggggucuccucaugcaggagcugguucuggaguuucacaucaggccuugcccaaacccacccaaagcaacugacagugcugcuccauggccccucuugacccaucagacguguuuaguucauccuucucauuuucacaccacccaucaggguuuauuuuuauuuauuuauuuuuuuugguagagacagggucuugcuauguugcccaggcuggucucaaaacuccuggucucaagccauccucccaccuuggccugccaaagugcugagauuauaagcaugagccaccguucccagucaauccaucaggauuuaaagaggcaggugagucuacuuaaccugacaccaccacgcagaaaacagauuagaguccaaaggagcuuuugugcuaagccugcuucugguauuaagaccccagaagaccuagguugguugcuagaaaucacuggaucucacccauuuaaauagauccuaagacuugauuucuugucaaagaaaggugcucagcgcucugugaaauccgcaaccucuaucguaaaacuggcucaucuacucgcuucuucucuagucuuaggccucuccucaccccgcaaguagcucuuucaggcaaugaaaccucuugacauuuuccagauuccugguggggccaagcaaguauuccugcuucccacaugagauauuacagauuccugccccacagucugugccggcugggugcacccucuguguuggcacuuacuacauggcaaaaaccuaguuuuccuuuauuugggucacaugccacccuaucaagucaccagucaacaugauuggccuccucugacccugucaggaugggccaaugaccuaggcagugcccagacuuagcccuuccgccuucuucucugagaagcuguccagaggagaaaacaaggugaaaagaaaaugaacagcaacauuugaggcaggaaauuaugucuacaccaacggaugugucuuuccuaccgcugccggugcuaaucaggcauggcugcuuagggaguaugagaaaaaggaaaaaagcuaugggauuacccaacaugcugggggguggagggggacaaaggguuuccucgagcucuaugcccaacuccuggcacccccggggggaagacaaggguguuucucuauuuuuuuuuuuuuuuuuuuuuuuuuuuagacagagaucgcacaguggugcgaucucaggucacugcaaccuccgccuccuggguucaagugauucuccugccuccugccuccugccucagccuccgaaguagcugggauuacagggacuggguuuuucucucuuugagauuaaaacagaaaggauguaucucuaggcaacugcuacuuaaaucacugccuccaacagcaaggacagaggcagcuuccagagcugcuucgccucaaacuuagaaaccugcucuaccaggcagcuuccuaagcacugcagggaaauuucugggcaaaaucuggaaagugaagcagaggacgaggacaauucacugcucaccacaaggcugaaagagcccuaacuuucaaagcaaaaucccagaacaaaaugccaugaaaaggggcagcaaucgaggcucagugaaauccauacagaggaacauaugggugaaagccagucaccuugaccuugcuaauccuaagcugcaucagugcugccucaaugccccccuggagccccaagcugucccugugccucuccaaguccaccacccagcuaggcacacaugaaaacccgucaggugggucagggcuuggcugagccaggggugccuaagaaggagcaguaacuccguuucagagaagagccguaagaacaucuaaccacugacucagcaauccuaaaggacaggcuggggagagggccugguggagggggcgagguucccagcuagugguaccacuugggaagggggaccccaggcagagacuaaucgccuucauuugguuucucuucagcugcaggaaucagagggcagguucuaagaggaucagccuguuggcuggcaucuucccccuucaaucucucuugauauucugauccuuuaaucccaaugagacaagugaaggcaguuuuguuaaucuaaagggguaagcaagacuggccugcacaagcuacaagugaagggcgcuuuucacguuagaguuccuuuuggcacagcugcucugcccccugggaaagcagccagacucggauggggcagagauaggagugggagggucagaucauuaaaucagauuuaaaaaacuccaacaggacugggaaucuagccuccucagaccugcgaugauguuccuugcucuugagaucuguucaccuaucccagagaacuaagacauucaacuaagaaaaacagacuccacaacuuuggcaaucugggagggggagcccagugggugggccugaaauacugacaugaaacacgucauaaacaacaguacagcuuuggucccaccaacauggcccugucaggcuggguaccagagggggacuggugccgugaaucucuggaaacaagaagugaagcagcccggccgaccugugccaggaagcacugguggacacaccccgucaaacagccagggcuuucucgcucugcugcacaacgcccagacacucaggguuagaccaaaggcucuggccacccagaagcuaauucugcccccaaaauauugaugcaggccaucggaaugauuacaaaggcaugaccuucucuuucccuuucuucacuuuccccuaaaucagaaaacugcaaaggccucaagucauggccuccaauuuaggaagugaauccaccagucacaagaugcugagcuguucccauagaaacuguuaagucaggauggggaugggguuacugacaaagacucugagaagguugaucaugaauuguuucuucuucggccuuccccuccaagauuuuucuaauucucugaaacuaaguuccgcuucgacccuacccaggccacgugguacuuucuugucaaugguuucuugcugagaacgggcugaccacugccaggcagacaggugaauccugaucagcacucacuucccaagcuucugcuuagacuucaggcucugauuacucaacuccgccccaccacuuccucaaugcugcagaaaaaccaucacaagugaacacccgccaacuguggaugcucucaagguggaaguuccccuuuccuuccagucuuggccccaccauaagccaucagugucuggcccuucagccuuacuccaagaacagccccaggugcuccaggacaggcuggcccuccuuggucugcagcacuucucagagacacucucgcccuucguuccaucaagaaacucccuaucaaaggauccauuucaccccuaaucaccacacuaaggaaaucccgaguuccuggggcacaucuuccuaacgaucggggugggaucauccuguacagcagagaggacgucacuggacaccuccccaagagcugaguuugagggcaagggacgcgcugggcuuuccugcuuggccuucugguuuggaaaaucaucgcuugcuauuuucaauaaagacagcacaggcugggugaagugguugacaucuguaaucccagcacucugggaggcugaggcaggaggacuacuugaggcaagaccagcguggacaacagagugagacccuaucuccacuauuuaaaauaaauauuauaaaauaaaaaaaauaaagacagcauggccaaagcagguggguuaacaagacccuuccaagccaacaccugucagcccaggcaccugguucucaggccccagguacauccccagugccuacagggauuagagccaucuacccagccauucccucauucucccugguucccagguuccccagucucguuucucuuuucugcccuucccagaaccccaagaucacggucaaggcccaccucuggcccccuccccagguccccacagcucuuaucagauauguagcccaccccuggaggcaguccucuaaagggccagugucugcccaccccucucgggggccaacaagccuggaugucugucucaacuaaaugugcugcaggcucugcuggccugauuucauuuuucaaaggugcaguucauauugggaacagaguggaaguuaucacaggagcuucaugcugacacugcaggaaagagagacggagcccagugacuggaggcacuauacuggcugacgaaccucacccaaacucgaguuuaacuggaagcuggggcgggguggggcugugauuucagaaggaagcaaagaacaaggcugcgccaggagaggagaguggaagaaguucagagaaagagugagacaagggagguuccgugacaguuuuccguuguccaagagacugacucugagucagcauggccuaugaaccuucuuacagcaaauccugcugccagauccccacauacaaggaugucagacccaggaaccguaaaaggacagaggacaagccaagccuauguguuauucccugcccuucguaaaaggaggguucugugucuuggucuuuccagcagucaccuaucguggcuagggagagccucaagagauuuccugcccugcugguuuguugcacaaccagaaagagccacgcacacuugccagccgagucacggacgucccagaaaugcacacacuugaucccaucaauaaugcguccccggccgggugugggggcucacgccugucaucccagcacuuugggaggcugaggcgggcggaucacuugaggucgggaguuugagaccagccuggccaacauggugaaagcccaucucuacuaaagauauaaaaauuagccgggugugguggcacacaccuguaaucccggcuacuugggaggcugaggcaggagaauagcuugaacccacgaggcagagguugcagugagcggagaucgcaccacugcacuccagccugggaaacugagcaagacuccgucucaaaaaaaaaaaaaaaaaaggguccccagacaugcacagccccagcagauaaaaggggcugguuuaaucucuacucauccagcauaccaacagcuugggacagguugcacacaguuacccagauauacaaaguaagugccauuuuucaacugaaaguggcaccacgaaauucacauugaaauauuuauguuagaacaaauaagaaaacuauauaaacaggauaaccacucagagcccagcuuagccaauggucacaaacaguuacacacaacuauggaccagaaaguaaaaggacuuaccucaucuacagacacaggcaggauuacucgacuauaagaaagggaaaagagaguaucaacuuuaggcugugcaaucugcucaaggcucuuuaaagcaucauccuaaaacagucagcagcauucuauuguguaagacacuaaauucagugacgaaaaccccacagagaauggcccuuugagugcucugaggacaggacccucugugcccuagagguguaagacacuaaacucugugacaacaccccccccccgcccccccccccagagaauggcccucuuagugcucugaggacaggacccucuguaccuugaggcaucccaguuagaacccugugauucaguccaaaccuauccucccgccagcuacuucccaggccuccaccucacauucggaacuggacauauggaugauaaacuucacccaaacuugccaaugagucguccccccaacaagacuugccagugagucuaguaagacagguuaacacaggaggaccuaucauggugaggauucagacccaaacaagaggcccuggggacuuaaauuucuguggacccaaccucccaacaacagcccuccaggggaagggccaggaagggaccaagccccuugaagccuaagaacacacaccgggcaucucugcucggggcuggauauuacaauccaagcugcuaccacaaagccaccaagagggcauucaacuuauguccugaccuccaggagcuguccaaaggaaucccaauuuaucauuuucuuuucuucuucuccaacucaaugaccaccaauugcuggagaugccaccagcaaccuauuggagaagccguggccggcaaagucuccgccagggccagaaccccacagaggugccagggcuagcagcacuucuccaggugccgugcaugugaaaugcagaccaagagccacccccaguucaaagcugugaggcgggagagcuaagacaaaaacucuugguuuuacccauacaaguccagccaguuuccaagcuuagacguucgguccccagacccuugcuggagcccucuggguccuuuugugucuugcauguuuagugaagcauuagggaagcaugagcugcugugccuuccuuaugcagccggcucaccacucaggcuccuugcuccaggcuaguaaacagcuauuuucuaguuccacaaaggucccccaggaagcaagaaggacacagaggggucugaggaaaacaucaccucaaaggcaagacaccaagcaggaaaguagcaggaaaaacaaaaugggcuccaagucuuuacugccugcuaacaacucccuuccuccagagcaacucaaacaacauaaauccuccaguuuacugaaugcugccagugagccuccccucccauuacagaaagccaguggugcagaaaaauacucccaacuuggaggccagaauuucugcacccucagaagaaacuuccuagaaaacaauaagccuuuuaucuucaagaacagcagucaaaaucacauccaagauuuugcagaaaucaaauuaaacagaauccuguuagaggaaguguuggaaaaaucaacaggggcaaccugcagacgcugggugggaaccaagucucaccccaaaagagaaugccaugggccaauuccugacgggaugcgcugaggcugcugacgugacggcugcacacucugacacugcccccuugcuccuuaggaacaaaaccacuucggcagcaauaggguacaauuccaaaggacagggccacagaggaacugccgggcugggccuggagcggcacucacucuaaugugaccuucacucgcacccuuuccagggcugcaacgcugcggccacagccagugucucggaugcccugaugccccugcuccucccccgucccccgcccagggaugcacacacggggcacgagucgggcaggaaggaaacgcagauaccaggcaggcccugcaucuccggcaccuuggacuuuucccuugcaggcuucaaggggaggagaacaaagacagggaaggagugccucucuucaaaccucacucagaucuccucugaaggucccuuccuuucccugccugaccuucauuucaaaaccacagauuucuacagauucuaggguucauuugggaacaggaaaaagaaucagaaggaugggaaaagccugucagucuggacacugaagauuaaaaucuaaagugcaccacguucuccuguuggcaucguaaaguucuuccuccucaccaggaaaagcuccgagcccuggcugaauuaacaucagacuggaugucaagaaacagaggggaugaggccucaaaauaaugcucuucagaugagguguuuagcugggaugacaugugggucucagcucccucuguuacccaaacuccacucuauguccuaaauguccuaagcaccuccaaggagccagccugguggggauggucaaagugcgaucgcugacaaaguggcaagagcucucugcacaccugccuggcugccucacaaguugcucucuguuugaccaucucccacuccuggggcuucuggcccucccuccaggaaagcaguuucacuguaaauucugugcacacacgcacacgcacacacacacacacacccauccuaucucuccucuuuggggagaaaaauguccugugaugcuuacuuggaacccugagcuucaacgauggcucaucuuguacuugaaagauuuagcacaccaaacaucuccaccugucccccaguccccuggauuucaggagcaaacccgucauccugcaacuccuuccagaagucaccaguuucccacgcaccccucuucacuacucaagagcuccccaccccuuccaccaucucuccucaguucacggcuccauggaccccucaauuccucaaagaauuuccccaucucuuugcaccaagacugagaauccccuagaaacaagcuggcccugcccuggucucccccaucuccaacggcagguauacucaucccaacauacucucuuuccggaccagccucgaccccgguaacuucccggccuucuccacuucggacccuacccaacauuuucuggccuccucgcccaagucuccccacgucccaagcagucaucccaagcuuguuccaaaagccuccucuuccgcaccagcugcuugggcaccacgguuacuccggcccgcaucucagcccccucugcauguccucagacccuucaccugucuccccagccaggcccugacuuccuaguccuccuccuguguccacuuaccaccaccccucacccgaugccuaaggcggccacuccuccccauccccaucccaacuccaucgcggagccucugacccauccacccggcucuccgugugaacuguucggcccuccaccuuuccccaccgccgggaggcccugccugccccggugcgccucuuccucggccgccgcggggccucucagcgccgccugcagucccggcugagcccgcgcccucggcccgcgcagagcgaccccacagcacucccagcgcucggcguccccucggccucccccagucccgggccagcucucccugcccugaccccgucucgggccuggccucgcccucgcuguccccggccucuccucggguccacuugggccuccgaggcccccggggcgccugaggagccguccgcccggguugucccuccgugcccgugggccccuccaugccccggcugcccguccaugccccgugggccccggcucagaugccgaacgccccggcugccccuccacgccccggccgccccuccacgccccggccgccccuccgugccccgugggccccgccucacgugccgcccgccccggauccccuccauccccgcugggcccgccucaggcacccuccgucccugcugccccuccguccauccgggcccugcgucccucgccgcgccgucgccccggcggccguccccacccucccuccuccccgcuuccgcacggccgccggacacucacuacuccuugagcagcaccaugucgcuucgcggcucgguggcugcccgcggcccgcccggccucccgcccgcugcccgccggccgcucuccccguggcccggcccggcccggcugccugugcgucuucgucgugcucugcuccguccccgccgcccucgccgcggucgccgcgccggcuccugccgcccgggccucgucgccucucgcgccgcugccgacgccgcccggagcuccgguuccgcagcgccgcgcgggggcggggcgucucugcggcaa

SEQ ID NO: 192272 - RNA, 206189 nt, Homo sapiens
gaagugccggagcggcugacagagcggcugacggagccgggcucaccaggucgcugccgcgagggaguugcugugcuggggccuggguggcggcuggaggccugaguugggcucgcggcgggggucggcagggggccggguggcggaaugauggaggaggaggaacuggaguucguggaggagcuggaagccgugcugcagcucacgcccgaggugcagcuggccaucgagcagguaagcguuccgccccucaggaggggaaacgggagugcgggaggggagacggcagcuccgggcgcuggggaggccgcggcggguggacggagggccgggggcucgcggcagaagggaaaguggagguggggagguggugcgggugagaagcgguuucugaaucagaaggaaaggaaagagaacccuuucuaggcuuugauugucuuuggcgagggcuggggguucuggugguuuuggggaaaggaauugugcgcuuagagaggacgacgcuaggagaaugcaggccuugggugccauccucagauucuggggacugugggggcuucaugcauuuaccagacucgugccaacgccccgguuuugcaagcuggcaccucgugaguggcuuggaacugggggaagggaaugacuuuaauuucugaagcggacggcagagaagagagaaaguguugaaaaaugacaucguuaccauucuuaaaagguugagaauuccuaccguugaauaguuugggugagguuggagaauacucccaaggggccucuuuucccuucaggaacuuuuuuuuuuuuuuuuuuuugagacggauucucgcucugucgcccgggcuggagugcaacggcacgaucucggcucacugcgaccuccgccucccgaguucaagcgauucuccugucucagccuccugaguagcugugauuacaggcgcacgccaccacacccggcuaauuuuuuuuuuuuuuugggguaaagacggggguuucaccguuuuggccaggauggucucgaacuccugagcucaaguaacccgcccgccuuggccucccaaagugcugggauuacaggcgugagccaccacgcgcggcccugccugcaggaacucuugccuuugcaaguuuauugaguuuuuaaggcuaaugauauuagaaauagugauuuuuuucuuuucuuuuuuucuuuuuuuuuguuuucugagacggagucucgcucuuucgcccagguuggaguguaggggugccaucucggcucacugcaaccuccgcuuccagguucaagugauucuccugccucagccuccugaguagcugggacuacaggcaaccgcuaccaugccuagcuaauuuuuguauuuuuaguagagaccggguuucaccauguuggccaggcuggucuugaacuccugaccucaggcuauccgcccgccucggccucccaaagugcugggauuacaggugugagccacugcacccggucagaaauagugauuucuaauacugcaggguauugcuccugauaaacggagaaaaucucccuuaaaggaauugucaugaaguuauaugauuuaagaaagggauuuaugauugaggaaauggacaauuccauuaugccuuauuuaaugaccccugggaaacuuuuuuuuuuugagauagggucuugcucuguuguccaggcuggaguacaguggcauaaucguagcucacugcagccucgaacuccuggggcucaagugauaacccugccucagccucccgaguagcugggacuacaggugcauucauugacgcuucgauguguguuuuuccaguagugguuggauuacuuauacaaccaacuuuguccuagccugagaacgccaaaccauugggcaggaagcuuuuaguguuccggccacacggcuccaccacuuaccuccuuuugccagaaaaagacauaacauuucuguugcucuuuggacuagugggcucucauggaagaaaagaauaaugcagucaguuacuguuugguugacagguaucagaaaagcacauuuuugcuauuucuuuuguuuguuucaacagcuuuugggguacaggugguuuuugauuacauggaugaauuacauagcggugaauucugacauuuuuccuauuuuguaagaauaaguuugagugauaguauagcagacaucuuuaugucaagcagaauucagacaucauuaugucaagaugaauucagaauuuuuucuuacuuuagcacucugaaugaaauucuguaguagcauacuuguaaagaguagugaugugugaggagucaggaaggguugauaaaauggaaucacauuuuacuccaagaugaagucccagagucauugcauaaggugaaaauuggcugggcucgguggcucacaccuguaaucccagcacuuugggaggccagggcggguggaucacgaugucaggaguucaagaccagccuggccaacauggugaaaccccgucucuccuaaaaauacaaaaauuuagcugggcaugguggcaggugcccguaaucucagcuacucgggagguugaggcaaagaacugcuugaacccgggaggcagagguugcagugagcugagauggugccacugccuuccagccugagcgacagagugagacuccaucucgaaaaaaaaaaaaaaaaaaaaggcgaaagucacucuagacaugaaaaucacucugcccugaaguucuuuaaauugcccaugaaggccggguguggaggcucacgccuguaaucccagcacuuugggaggccgaggcggguggaucacaaguucaggagauugagaccauccuggccaacacggugaaaccccuucucuacuaaaaacacaaaaaauaagccggguaugguggcgagcgccuguagucccaccuucucaagaggcugagacaggagaauggcaugaaccugggagguggagcuuguagugaaccaagaucgcgcuacugcacuccagccugggugacagcgcgagacuccgugucaaaaaaaaaaaaaaaaauugcccaugaaguaccacguaugcaucucugauaagucuagggcuguuaguuuuuuuccuccaucauuggaaccagucauucuuuuuucagcuggcuuuuguuaggagccuuguuacaugaaaacaauuuaaaaccuaggacagcacuaaaaccuaggagucgugagaggaauacagaaacugagagcaacuugaggaaauaguuuguaucucuuguauccugcucucuguggguuauacuuucccucuggugagcacguaucauugagacuguguaaauaaccuguguauaugugcauuauggaaacagcaaugcugaacauuuuaaaaagaaaacaucuucacuuucuucucauccaccuccucuugaugugguagaaggcuucagcuuuucuaacaguugucuugaagauauuuugauuuuuugacucuauauuucuuuggaaggcuucuucagagaugaaguugcuucccacaguuguaacucuaucaagcugggugagacccaguguccaguggauaauuuggcugcuuguaucauccaccuuguugcguguucuucagguuguuagggaguuagcuguaugucuuagagguggacuguuuuugagagaggaucucacucugucgcccaggcuggaguucagugauagaaucucggcucacugcaaccucaaccuccugggcucuggugauccucccaucucagccucccacguagcugggacuaugacaggcaugugccauggcacccagcuaauuuuuuuuuguagagaugugguuucaccauguugcccaggccagucuccaacuccugagcucaagcgauccgcgcagccuuauuuuaauuaauuaauuaauuaauuuaauuuugagacagagucuugcucuuucgcccagacuggaguguaguggugugaucucggcucacuguaaccuccgccucccggguucaagcaauucuccugccucagccuccugaguaguugggauuacaggugugcgccaacaccacacccagccaaguuuuuauuuuuaguagagaccugaccucaggugauccaucugcuuuggccucccaaagugcugugauuacaggcaugagccaccgugcccggcccuuuccuuuuaauugacaaauuaaaauuauauauauuuacgguauacuacauguuuuuauauauacuccucucuuucuauauagguguuuccaagccaggacccucuagaucgagcagauuucaaugcuguugaguauaucaauacccuguucccaaccgagcaaguaaguagaguuucagguuuccuuccuuucagcagcuuuuggcacaucuuggguguuaugcuucguguguuacacuagaucaucuacgggcccuugauacacaagggagaguuaaauucaaaucaaacuccaucaucaccagcuggggcagugagcuacacuguguuggaauggaauucauuguauagugaacauauuauuaauaauuguacucuuagguugugagaguccucccaaauuuucugcuguaaauugaaaguggaaaggauuuuuauaauguaguagggacaagugggggugaggcaggcaggauaagcccagaaucauaaagccacuuucaccucuauuucaagauguaaauuuuuauuucuauuuauuaguuuuuuugagacggaguuuugcuguugucguucaggcuggagugcaauggcgcggucucggcucacugcaacgucugccuccuggguucaggcgauucuucugccucagccuccugaguagcuggcacuauagguacccaccaucacgccuggcuaauuuuugugauuuuaguagagacgggguuucagcauguuggccaggcuggucucaaacuccugaccucgugauccaccugccuuggcccccuaaagugcugggauuacaggcgugagccacugcgcccggccucaagauacagauuuuuagacuucacguuuuauuauuuuuuguccggugauuuuccuguggagauggauuuucuuacaaaauugguuuuuggguguuugggugagaaguagaccagaacuggaaguagcagaguugggagaagggcagugagagucccgcuucguuuccauuuuuucagucagcaguuguucaguaggugccugucauguguugucagucacugugcuaggugcugagggugcagagaugauaagguccaguccaugcccuugaggugugcaggaucaaguggugggagacccuggcgaaugccgucagugacagugggacagugcgguaaggaaacaaagaccaguucuuccaaggaaaaucacaacuucagagaggagguagccugucugccgagcuugagggauucauucauguauucauuuaguaaaacguagcagucguuuauuaaaugucugcuaagugucagguauuauuuuuagaaacuagggagaaauguaaacaugacaaaucuggucuuggucuuauggagucuaguguagggagaaagacaagaaauaaaccaacaaauacacuagagaugaucaaacaugguggccgugauaccaggcagguuccgugacagagcgugcugcgccgugauaccaggcagguuccgugacagagcgugaugcgccgugauaccaggcagguuccgugacagagcgugcugcggaggguccuuuaaauaaaggggcuuaacgggaaguucucugugaggugguucccucuaagcugagaccugauggacaggaaggagucaagcuugcagcagucuggcagaacaguauucuagacagagccagcagcuagguaucucuuccaggaugaugagggaaggaaggcgugggcggaaagaaacccaggugccgaggcaagagacugaaggcacaaccuguuccaauauaauaaagaaaauaguuaaauaaguagaguuauaauagaaauaggauauagagaugauuguauauggauauuaucaaucauuagucuuuaguauuaaucuuuguuucauuauuacgaccaaggaaaaaccaggccauacagagucaggagaccagaagacaacagugagaaccucugucaugccuggauaagggcugcuugaaggcaccuuggucuugcgguagugccagugccugggaaggcacccguuacuuagcggacugugaaagggagucucccuuucccugggggaguuagagaacacucugcuccaccagcucucguggggggccugacauuccccaggccugcccacagucauccggaggcuucagcaucucccuguggugcugugcuucaguggucaugcuccugguccacuuucauguuccaccuguacaccuggcuccuccuuuaaguucuuagaagauagcaguagcagaauuagugaaaguguuaaagucuuugaucuuucugauaagugcaaagaaaaaaugcugacgucugcuguccucccucucugcuucggcuaccacaaagggaagggcccccugucacguggacaugugacuugcuugaccuugucaaucauuugagaugacccacacuccuuacccugccuccuugccuuguauacaauaaauagcaguggguccaggcauucggggccacuauuggacucugugcauuggugguaguggugccccgggcccagcugucuuuccuacuacuucuuaguuucgugucuuucuacaaucucucgucuccgcacacgaagagaaaacccacaaggccccguagggcuggacccuacagaaggcccuucuaaacacaggaccaaggcacagaaacaggagacauaagaugugcacagugagcagagacucacaggagaugaggcugaggagggagagcaaggauccuggaggaucucuguccucuaggcuuaucguugccaguuuuuuuggagaccacaugccuuucagugaaaugcuuuuuuucuuucuuccuuuuuuuuuuuuuuuugaaagagaguuuuacucuguugcccagguuggagugcaguggcacaaucacaguaacugugaacucccgaacucuagcgcucccacuacaucggccuucugaguagcugcgacuacaggcgcaugccaccacacacagcuaaguuuuaaaauuuuuuuaguagagacgagaucucacuacgaagcccaggcuggucucgaacuccugagcuaaugugauccucccgccucagccucccaaaauguugggauuacaggcaugagccacugcaccuggcccaaauauuuuucacagaacugauuuucuuuuuuuuuuuuuuuuuuugagacaaagucucauucuugucccccaggcuggagugcaauggcaugaucucggcucacugcaaccucugccuccuggguucaagugauucuccugugucagccuccugagcagcugggauuacaggggccugccacuacgcggcuaauuuuuguauuuuuaguagagaugggguuucaccauguuggccaggcuggucucaaauuccugaccucaggugauccgcccgccucggccucccaaagugcugggaugacaggcgugagccaccgcgcccgacccacagagcugauuuucacuuggauaauuuuuaagccuguauccccagaauauuauauacauaugugaguaccaauuuuaaauguuaggcuucaguaguauuugcuauauaaauagaaaauaaacauagaggcuucaguguuugcuccucacaccccagggggcaguguggcagaccccguggggacguucgcacccugcucuggagguugcugcuguaggcagugaguauucauugaaggacuuuuggcaggauaaugacuggagcacauucacguuuuuaaaauuccgucuggcagccauguggaggacgagcaagggauggagguggggagagacuacaggcaggagacucacgcaguagaucacuggaaagagauggugagaccuggagaaaagcugugggauagagagaaccagaucugagagcuauugaggggaccaaagucaugcaguuugguaccugagggcaugaaaguagagggucauggagaauccaaaauucacucauucguuuauucaguuaaaaaaacacccacucuaccuagcuuuauaagaaaucugggguagagaagugagcaagacagauauagucuaccaacacagacuucauagucuaucuugauaguuaaucucacaguaacagauuauagguaaauuaugauguuacaaugacuugcuuguguaauuuuuuuuuuuuuuuuuugagacugagucucacucuguugccaggauggaaugcaguagcacaaucccggcucacugcaaccuccaacuccuggguucaagcgauucucccgccucagccuccugaguagcugaguuuacagacacgcgccaccaagccuggcuaauuuuuguauuuuuaguagagacgggguuucaccauguuggccaggaugguuucaaucucuugaccuugugaucugcccaccuugaccucccaaagugcugggauuacaggcgugagccaccacgccuggccugacuugcucauauaauuuuuaaauauuauuugucacuugcucuuauauaaccuuuacuacaacuguaauaguaaucuuuauuagauacuuccuguguacccgacagcacucuaggcacuaaacagugauaaacuccacuuuguuauccuucuuauuuuagaguaagaaucacgaggcacggaaagauaacacucggcuuaaaugugauagcguugccaugaaggaagcaugccaaauacagugacagcagaacccagggccuuacuugcucaagauggauugaaaaggcuuacucccuugaggaaaugguguuuuagcugaauacuacaggccaaguuaauaauuuuuuuuugagauggggucucacucucuugcccgggcuagagugcaguggcacaaucauagcucacugcaaccucaaauuccuggacucaagcacuccucccacuucagccuccucaguagcuagcacuacaggugugugccaccacacccagcugaguauuauuauuauuuugagauggagucuugcuuugucaccagguuggggugggguggugccaucucggcucacugcaaccucccacucccugguucaagcaauuccccugucuuagccucccgaguagcugagauuauaggcacgcgccaccacgcccagccaauuucuguauuuuuaguagagaugggguuucaccauguuggccaggauaggauggucucgaucuccugaccucaugauccaucugccccagccucccaaagugcugggauuacaggagugagccaccgcgcccagccccagcugauuuuuaauuuuuuuuuuuuuuuuacagacugggccuugcuguguugcccaggcuggucuggaacuccuggccucaagccacccuccugccucagccucuccgagugcugggauuacagauuugagccacugugccuggcccuaaguuaagaauuuugaacugguuucuagguagccagauuuggcugacuggauggguaauggcagcuuuccacuuuacccaauuacugaguguaaggagaaagagcagguuucaguggcagguagggcuggagugggcuguaaggugagcccaaguuugaacauacucaggucauccagguggaaauaaguuguuggguauuugagugcagagcucuugauccccaucauugugaauauuuuggcagauccuuccaaacuuuuuuuaauggauauacugauuuuuaaaauaaaguuuaaaagaugauauacugugugauugucuuuuuugagauuucacgaaaagccuuuauagcucaucauuuuguaugaaaggggaauuuuaggaauuagcuggagauagacauuugggaauagcuaggauaaagauaguaauugcugauucaccaaaacaaaaagaaguguuagauuugaaaauuuuguaggaaaccaccagguucucaccucuugugguguguguguaugugcuguauuuuuuuuuaaacuacugaaaacucaagaucuuuguuguuccacagauucaguucugugucuugucuaauuaugccccagguauaugauaauguacagucacguuucuuagaguaacucagaacauuuaugacacaggguuaucuuuacuucucuagucucagaguuucacuuagcaggucaucugagugaaaucuaagccagauuccuguggaucuuaaugaaaagguaguagaaaguaguggcauagcuugaaauuuaacuauugucagauauugggcaaaaaccaucuguauaccucauggaccuccaguaaacacuuguacauuaugaguuuagauuguuuaaaguagauuucaguauuuccagagugaauuuaguguuacugugaggaggagggugagaauauguuucuguugaguggaaguacuugugugucugcgguugucuggagccuguugaguggccuggaauggaugccucuuacuauuucacccagccaggccugagaggagcuugggauuuuccaugcagcagagugccugugggguuuaaauaguagccagguuuggucgcaguggucuagaaaaucguuuuagccuccuaauaguaaacugaagauaaucauuugaaaguuugauuagaggaaacuaaaugaaauuuauggaaaacuaauacaaaacuaacauaauuaggaacuuugagaaaagaguuauauggggauguuucuaaagaguuucuggugaccccaaaaaugcucuggaucuguauuguuaagagaaaaaaaaacccaagauccagcucauggcuguauucucuaaucccagcacuuugggagaccaaggcggguggaucacugaggcaggaggaucgcuugagccugggagguggaaguugcagucagcugagaucgugccacugcacugcagccugggugacagaaugagauccugccuuaaaaaaaaaaaaaaaagaugccaaauugcuuaucaucccaguuuauuuuuguacagcuauacaguuucguaguagaaggcaauacgcaaaaauucugauuguggucauacuguccugggugugcagaugacuaccuauuuucuguaauugucaagaauuaccauuagaaucaggaaauauuuugcaauaacuaaaacauuuaaaaaguaaacaaaacuguacaaccacauuauaacuaaacgagaugagugauucucaaagcaggauaaaccccucugcccagccaauguggauucccacagggcuuuuccccaacuccaggagaggcccucgacccuggugaggaucacugccauagccagacacugaacuaacugaugagagugggugugucauagcuguccggugucuuggggugcaggaaaauuaggucaagaaucauugcguuagagguagaugcuagaguaagaaagaggaucucugcagcuucaggcaaagcaccuguccugcagagcacguuucccaucuguuuuuuauuugaggugggaucucugcagcuucaggcaaagcaccuguccugcagagcacguuucccaucuguuuuuuauuugagguggguucccacucugucaccuagguuggaaugcaguggugugaucucggcucgcugcaaccucugccucccaggcucaagcgauccucccaccucagccuccugaguagcugggaccacaggugugcaccagcaagcccagguaguuuuuuguauuuuugguagagacaggguuuugccagguugcccagagacuggucuugaacugcugagcuuaggaaacccacguaccuuggccucccaaaguguugggauuacaggcaugagccaccaugcccggccuccgccuccauaguucccaaucuuaacguugaagaggagaaaagugugccucgccuggcagaggggauuaagggaaauaauuucugugaagugccugcaauuguugccuaggagauccacauuaaaugcuagcagccuuucccuuuccccuccagcagaaagccuggaaaugaagggaaaacagucacccaaaggccaccugacuaucaaauaguguaacuuuaggauauuucuuucucuucuauuuauuuauuuauugagacagagucuccuucuguuauccaggcuggagugcaguggcgcgaucucggcucaccgcaaccucugcuuccuggguucaagcaguucuccugccucagccucccgaguagcugggauuacaggcaccugccaccacgcccggcuaauuuuuuuuuguauuuuuaguagagacgggguuucaccauauuggccuggcuggucucgaacuccugaccuugugauccgcccaccucggccucaaagugcugggauuacaggcaugagccaccgcgcccagccuauuuuuauuuuauuuuuauuuauuuuuucuuuuugagauugucacccaucacccaggcuacaguucaguggcuccaucacagcucacugugcccuggaauuuacagacucaaucagucuucuuuccucagccuaauaagcagauuguacuacaggcgugugcuaccauacccggcuaauuuuucuauuuuuuuguagagacggaguuucaccacguuguccagguuggucucuaacucuugggcucuagcaguccacccaccucagccucccaaaggacagacauaagccuccacacccggccucuguucuuuuuaaaagcuacauucauuauauuauaaaaaugauauuauagggccgggugcacugccucaugccuguaaucccagugcuuugggaggccaaggcgggagcauugcuugaagccaggaauucaagaucagcuuggacagcauagcaagacccuguguuuauaacaaaauaauaaaauuagccaggcucagugcauguaccuuuuuguuccuagccacucaggaggcuggggugggaggauugcuugagcccaggaguuugagguuacagugagcuaugauugcaccacugcacuccagccuuggugacagagugagccgccaucuuaaagguaggcuauuugauauuauaaaaauacuugcuaucauaaaaugauauuagaaauguuuuccucuuggccaggcgcgguggcucauaccuguaauccuagcacuuugggaggccaaggcgggcagaucacgaggucaagagaucgagaccauccuggccaacguggugaaaccccgucucuacuaaaaauacaaaaauuagcugggcgugguggcaugugccuguaaucccagcuacucgggaggcugaggcaggagaaucgcuugaaccagggagucggagguugcagugagccgagaucgcgccauugcacuccagccuggugacagagcuagucuccaucacacacaaaaauauauguauauauauaauuauauauaaauuaaaguaauuuuucugagauucguuuuucuuuuuuuuugagacagggcuguuuagcccaggcuggagugcaguggugcaaacaugacuuacugcagccucgaccuucugggcucaggugauccucccaccucagccuccugaguaccugggacugcaagcacaugccaccaugccuggcuaacuuuuuuuuauuuuuuggagagaugggaucucacuguauugucugggcuggucuugaauuccuggauuuaagugauccucccaccuuagccucccaaagugcugggauuacaggcaugagccaucacguccagccugagauucauuuuuaccucaagcuguucuuggauuucugaaaauucugaguaacuguuggcuuggucagaacaguaggaugagcugugacaacccagucugacaucucaaacacucauggccuguuucucuuaccagaccugcuccuggaaggcaccuggccuccuccucccaucagagguagccagaagcaauuuauaagcauauuuccuacaauaucccuaauuccuucugagauaaaauauuuguuaagggagagaggaagaggauuuauuaaauuguauuuugaaaacuugaauuaaaauaguacuauaaaauuguaccuccucuuguccauuagggggcaccauuuccucacauuuucucaucucuaaggucagaagugaucccuuuguuuuaauuguuguuauaauaagcuuauuauaaucacaguaguagugcauagucaauaauuauaaaauacagacaaaaagaagaaaauauuuuuuuuugagacagaguuuugcucuuguugcccaggcuggagugcaauggcacauucucagcucacugcaaccucugccucccggguucaagcgauucuccugccgcagccucuugaguaguugggacaacaggugcccaccaccaagccugccuaauuuuuuuuuuuuuguauuuuuaguagagaugggguuucgccaugacggucuggcuggucucaaacuccugaccucaggugauccgccugccuuggccucccaaagugcugggauuacaggcgugagccacugcacccggcccaagaagaaaaauuugaaaucacuucuuuucauauugcaauacguaguugauagauuauagcuacuaaugcugcaacuacuaauacauuacaauuacuccuaucuauccuuccagacuuuuuucuaguggaucuauauaauaaaaaauaaauuuguguauuuauugaaguauaacauaauacagaggaguacacaaaucuuaaggguacaacuugaugaaguuucacaaaaugaacauagccauguaacugccacccagaucaagaaauaaaacauuuaaaaaaaucuucagaaggccuuuccuugccuguucacugucacuaccuucccccagagauaaccacuguccuagcuucuaacaggagaauuauguuagugaaaucauauccucuguccccuugugucuggcuuuuucugugccccauuccguuaguaaaauguuuauccaugguguugugcauucauucauuuuuguugcuguauuucguuacgugaauuugucacaaucacguacaccaugggucagcagacucuccuguaaagguccagauaguaaauacuucaggcuuuguggcuguacagcgucuuucacgacugccuaccugccauguuagcuuaagagcagccgcaggcaauauguaagugaacgggcauggcuguguuccagugaaacuuuauuuacaaaaaacaggggcugggcuagauguggcuguagcuuccaacuacugcuuuacuuuuuuuuuuuuuaaagcaaaacucauaucaugugauuaaauuuuuugagauuucauaaguagcuauuauagcacaucauuuuccugugaaagaggaauuccaggaaguggacuaacagcugggcacucuuccuucuuuauuguagucucuggcgaacauagacgaagucgugaacaaaauuaggcugaaaauaaggugaguaaagcugugugauuguucauaauuaaugaaaaguauauuguuaauuuaguuaaucacauucuggaucacauuuuucugugagagcacugaaaucucaaguuugccauagaugguaauauaauuccuuuuaaaauuuuuauuauuuauuuauuuauuuuugagacggauuuuugcucauugccuaggcuggagugcaauggugugaucuuggcucacugcaaccuccaccucccagguucaagugauucuccugccuuagccucccuaguagcugggauuacaggugugagccaccacgccuggcaaauuuuguacuuuuaguagagacgggguuucaccauguuggucaggcuggucucgaacuccugaccucaagugauccaccugccuucgccucccaacgugcugggaugacaggggugagccaccgcacccggccauauaauuauuuuauccauaugaacuuuguggcaaggaacucaaugcuuuggccagucuucaauucuucauacaaaaggaaggaagcugugauagagucuacucaaaacaucuuuuguaauuauagaaggaggcaaaagcuuuucugauagauuuuuuuuuucuuuuuuucuguuuuuuuuucaaaacaaggucuuacucugugucccaggcuggagcguacuggugcaguuacagcucacugcagccucgaacuccugggcucaagugauccucccaccucagccuccugaguagcugggacuacaggcgcaccaccacacuuugcuaauguuuauauuuuuuguagagaugggguuucgccuuguuggcuaggcuggucucaaacugcugagcucaagcaaucugccugccucagucucccacaucuacuagauuuuuuuuuuuuuuuuuugagauggagucuggcucugucacccaggcuagagugcaguggugugaucuuggcuuacuguaaucuccaccucccagguucgagcaauucuugagccucagccacccaaguagcuggaauuauaggcaugcaccaccaugcccagcuaauuuuuguguuuuuaguaguuacaggguuacacuguguuggccaggcuggucuugaacuccuagccucaagugaucugccugccuuggccucccaaagugcuaggauuauaggugugagccauucugucuguccuucgacuagcuuuuuaauggcuuuauuucccuguuuuuguggauuuaccuguuuuuguguucccaaggcuuagacaugaagaugggcuuauauguguaucccuuggucacauaacagcuaaccaugucagaucugcugguggguugggugguggcccaugauuaaacauugugaaccgugggggcagaggagcuggaagccguagaucugccucaggcauggauugcaugaucagggcccggaagcacugauuccaucuaucacucuggcucuuuccgccucauaaggggaccgagaaagggauugugugugagguaauuugaguuaucuggcauguucacguaaaggcuccggaacuuugucauuccugauguacuccaugaaaaauccugcagauuuuauuaguccuuucagauagcucugacuauuaagugaaaauaggcauuuuuaacaacaaggcgaugcaucagccugcacugggcuugacuucccgcacggcugucgcugcccuccuccugccugaugccacucacacauguuugguuuucuggacaauuaggugcagucugcagaaguugaugaauaaauuacuuuuuacuuuuuuucuuuuggucaaccuagaauaaagauuauuugaaugacuguauccuugaacuguuuugcuaggagacuggaugacaauauucgaacuguuguaagaggucagacgaacguggggcaggauggacggcaaguaaguaacucauuccuccauauuaccuaugcuccccugguuucucccggcaaccagaugaccaaaacgucgaugugcccucuugcagagcacuuuccgauugauccguuucauacauggcaggacaagacagggcaggcgcccacagcagccacgugcugucccucagugucccuuggaccaggaccgugaacuguggcaccgcucacccgaggccagaugagaacacuggggcuuccuugucuuucuccuucgugucgggcaucucuugugcccucuuuuauuuugugggcuguggcuaaaugagguugcugcauucgucagcugaguuguugggguuuugauauuuuguggcuguaaaagauaguaaccugacauaguuaccauuuccucguaccucgcuuugccagcaggcaggugacucaagauucauuaaaaaauuuuacaaguuggccgggcacagcgggcacagcggcucacgccuguaaucccagcuacucaggaggcugaggcaugagagucacuugaacccaggagccagagguugcagugaggcgagauugcaccgcugcacuccagcauggacgacaggggugagacugucucaaaaaaaaaaaaaaaaaaaaguuuuauaagucuuauuggaucuaguuaaggaggccauuggagggaaugaaguaagucuuacuggaucuaguuaaggaggcuguuggaggcaaugaagggaaaaguguguagggaggagauacucuuuaauaauugaggggccagauguuaucugugaaccauuucccuuuuuauuugauucuguucuucuguugaggcaucguauuucagaauggcuguuguaguagaaaugcugagcuugccuuucuagccguccucucuugccauguccuguccucccuuaucagcacuaacucaggucaggacugcuucuuugcaauugcuucaaugcugugauuucuccucuuugacauuuuuuaggacagcuaauuucuaaaaauguucauccugcugcccagauuuggagugggaggagcauauaauccuacgcugaaauuuccagaucucugauauuucuguuuccuucugccaguugcuuacagauauuaggagucucuuucuuuuacaucuguaguuuucccaucugucuauuuuuacuacuuuauaucacuuucuuuuuccauuuuuccacuuuauagucacuuuccauuugauagccaguuuccuuuggccuguuugugaguagcuggccuucuugucaucaucagaauuuguguguagacacauuagguuccuaaaacuguucugguuuucuggacuccuguauuuuuuuuagcccucguuaccucguuuugucuguugagguauauuucaugaagcauggcuucuuuggcagaugaggcccauguaaaugggaccuucagagggguccuacagagggacagggcagccucaagcacuccagcugcauucugcugcuuagcuguccuaaucuguguuugaucguauugucuaccucuucagacaccguaucagcucuggccacuaaaugaaauccaaggccaggcaugguggcccacaccugcaaucccaacacuuugggaggccgaggcggggagaucacuugagccuaggaguucaaggccagccugggcaacaugacaaaacccugcaucuucaaaaaguacaaaauuagcugggcauggugguggccugugccuguagucccagcuacugaggaggccgagacaggaagaucagcugagccaggaaguucgaggcugcaguaagccaucaucgcgccacugcacuccagccugggaaacagagugagacccuguuuaaaaaaaaaaagaaauccaaauuccuuugcuuggcauucaaaauucuggucuccaauuccaguuuugccuccucuuguguucugucuacacugaagacuuugugcucuacgagcaugccugugcuuucuggaccugugcuuacagacucuuuugugcuugaaaugcuuuuccuccuauuucuuuaagccgccgcauuucccaaucuuacccauccaaggaccagcucagauacuaguuucuugacgauguuuuccauggaccuuaucugaauacaccaaggaaucagaauuuugaacuggaaaggauuugaaacucaucugggccccuccccucauuuuacagaggagaaaauggauuccagugucccucgauguccuuucuccauaaaucccacagccccauucuuguacuuuucauuuggcuuuuggggucucccuugacuuaccagagaacaagucucaucccuuugauguuuguaagcuccuggaagguaagaacuguaucuuugucaucuuucuauuucacuacacauaggccacaugcaauaacauuuuauucaacugagccaggcacaauggcucaugccuguaaucucaacacuuugggaugccuaggugggaggaugacuugaggccaggaguuugagaccagccucggcaacauagcaauacacgucucuacgaaaagguaaaauaauuagcugggugugguaguacaagcuucagugagcuguaauggugccgccgcgcuccagcccggaugacagagcgagaccccauccccaaaagcaacagcaaaacccccacaacauuuuaugcaacuguauugaauauuuugucugucuaagauuguuuauuaauuauaaauaaacaaaaacauuuuaucauaaaaacaucauuuugaucagcaaguggguguuccuuaaaagugauuuagaacuugcuuugugcauuaagagucccaacuugcugcuacugggaauaguaacacugcuuguucagugugauucagccuacauuuggaauggcucacuagaagucuuacagugcaggagucauagauguuuaaaauuucaagaaugugaaaauagugagugauucaucggcauuuuuuguugggucaugcugugcauaauagauguguaucuuucaguuauuuacguuucaaccugugguucuggacucuugcaaacuagcgguauuacagagucagacccagaauucgacagucugcaggaaugucggcguucucccccaucccguauuaauagguuacagguugccgcagcagagcaggucguauuucacagagcaagaccacauuuucaagaauguuuagauagcauuucaaucugugauggaacuuuguauucgucuccuuagaauccagacagaaaggaagcccagaagaaauaacugcuuuuccugucauggccccaucugucuuuuccagcacuuuguaaugcaaacugaaguacaagcuuuuuuuuuuccaaggagcucuuggguccuguccuugucaacuccuagguaugaaagccuugcucuccagcccuggcuggcugguuugcuaaaaggagucuauuugacugcaacagacuugguggaauuacggauguuccaaaauacugaguuuuguaggucaagaggccccacguuccccucuucccuggaagagaagagaaguuugcuuucagcacucgcuuccuaagcuucugaagaacacucagaagggaguggcauauggacaaaaggagguuuucguuuuauaaauuuaaucuugauuguguuuaaccagaaccgaugugccgcuuuuaaauuuguauuuauuauuaucauguuagggacaggguccugccuuguugcucaggcuggagugcaaucauuuuucacgguaaccuugaacuccuggggccaagugauccucccaccuuagccuccgaaguagcuaggacuacaggcaugugccaccacacacagcuauuuuuaauuuuuaauuuuuuauuuuugguagagauggguucuugcuguguugcccgggcuggucuugaacuccuggccugaagugauccuccugccuugggcucccaaaaugcugagauuauaggcaugagacacuuauuauuacaagucguccccacuuaccugugggggauacauuccaagacccccaguggaugccugaaacccagagaguagcaaacccuauauaugccauauuuuuuccuauguauacauaccugugauaaauuuuagcaugcaaauuaggcacaguaagagauucaccacaauaacugaaaauaaaauagcacaauuaugacaguaugccagcaucacuccucuugugauuuggagcuguauguaauagccgagauggcugcuaggcuauacccagccuagaugugcuucuugcuucuuuguuuuuuguuuuguuuuugagucagagucucgcugucagccaggcugcagugcaguggugugaucucggcuuacugcaacuucugccuccuggguucaagcgacucuccugccucagccuccugaguagcugggauuacaggcaugcaccaccacgccuggcuaauuuuuguauuuuuaguagagacgggauuucaccauguuggucaggcuggucucaaacuccugacuucaugguccgcccgccucggccucccaaagugcugggauuacaggugcgcaccaccaugcccagcucauuuuuguauuuuuaguagagacaggguuucaccauguuggucaggcuggucucaaacuccugaccuugugguccgcccgccucggccucccaaagugcugggaugacaggcgugagccaccgcacccggcuaggugugcuucuauaucuguaaauaaggggaaaguguugacuucacauucauggugucuuaaaugacauuuuuagcagaaaaguugcuuuugaaaagcaauguuuuugacucaaaaauuauuuggggguaaggaaugauuuaaauauugaaggcauaauuaggucauuucuugagcuucuugaaguuucugaaauaccagccgcuugguuaacauucugcuaaacguuugcagagucuuuguuuuuugaccaccuucuaugugggccagcuugaacuggucuagucugugaccucuucuaaccagacgaugaugcucuuauaaaguuuauauggcacggaauccuccccauuuuuaucuguugaaaucaucagucaaaagcuuuaauuaaaugcccacguuuaaaacuuuguggaugagucaauucaacaaguacaugaugugguaugcuaugaaauuuuugcagcuucccaagaauuaaaauggauggcuugaacguaggugaaagagaggugaauagaggggcggguuagaggaagaaaaagccggcagugggaaguuucaagaguggccaacguugaccggucgucaguaagcucucagacucacaggagaggaucagccaccgaguuucugucucuucaauggagccuggcugcaauguagccauuucuuugaucagaacaagaguaagguuugggaggagaagagaauuauuacaagucguccccacuuaccugugggggauacauuccaagacccccaguggaugccugaaacccagagaguagcaaacccuauauaugccguauuuuuuccuauguauacauaccugugauaaacuuuagcaugcaaauuaggcacaguaagagauucaccacaauaacuaaaaauaaaauagcacaauuaugacaguaugccagcaucacuccucuugugauuuggagcuguauguaauagccgagauggcugcuaagugacuaauaggugcuguauucagcauggauauacugggugaaggaaugauucgugaccuggucaggacagaauuggguggugcaagauuuuaucacacuacucagaauggcgcauaauuuaaaauuuacuaauugucuguuucuggaauuuuccauguaauauuuuuggaccacagucaacuacagguggcuaaaaccucagaaagugaacugcugauaaggagggggugcuguauugcucacuccuucgcuuuggaagaaggauuagguaauuguaguacaaucuuccacccaguucaggaguccuuuguauuacaucucugacguuucauuaucuugcagaagcuuggcuacuuucagugauggggagcuugcuacuuuguugguccacaggacagacuaguucaguuuuauagcuuuaguugugagaaacuccuuucuuagacugaacugaaacagugaaauagacuucauuguaacuucuuguugaucuuaguucugccagcuggauggguguaagccuaaucccuuuuccuuacuacagcuucugaaauugaaaauggauauuauguuccuaaguguucccuuuucuaggcuaaccauucuuaguuucuucaucuuuauaaugcaauuuccagacccuuuaucauccuugcucuugauagcuguuugucagcaucccucuuaaaaugugguucccaggaguggacaugcugugucaacauauacacugagacaguugaccucuuuguucugggccgagcucauuaacuuagggacuggggguccagagugucugucaagucccugaaauuaacuguaaauuuuuguaugucuagacauauuuaugggaggaaaacuuauugauuuuucuagauuuucuaaggagucugugacucuucaaaacuuaagggccaccgauuuuagacacuguucuuccauuaccuuggauuugcugagauuuuugauuguagacauuguucuuccauuaccuuggauuugcugagauuuuuuauuuuagacacuauucuuccauuaccuuggauuugcugagauuuuuggcagccguauuacaugguuggcuucuacugaguuggcagucaccugaaacccccaggucaagagucgcaaacagauguccgcagagcugggaaaguaaccuaagcggcguaagcaggcugguguguguccacaugcauccaccagguccuaaggggauagucacaagugaauucuaaucagcuguugucacgucugaacgcagaccuggaauugccagaucuaucaguuuuucaagagcagccggaaauccggauuuucauguaacucucacaauuuuuaacuauuggcuuaguguuuuucacaaacacugcaaagggcaaacaaaacacaucugugggccaguacugucccaggucuuucuucauaugacuuucauuuaaacuuucuccaccucuguuugugcaagagagucuuugaaauugucagaccgugugugucucagcuuucguuucaucccacuaguucugcucgauuguuuaucccaucaagaucuuugggagccuugaugaccuccccacuuuaucauuagcagauuugccagacaugccuucugugucuucauucaaguuguagaugaaaaggcagaauggaguggauucagagccgugugacgugccgucagaggcuuccuguucuuccuccucacuucagcgcaaagugccagacccaaaaaacaggauuucuaccugucugugugugucguccggggcuguuucuucaucuucccaugucuugauuuucaccaaaaaaggaggcuguuaauacuugccuucuucacuuuuacauagagauaucauaaagauuaugaacuaaagcagcaaaguacauugccuuccaaggagaaaguguuccuugcuuuucuuccucaaaauuagcauauuaugcaauucaagcauuagaacgaaaauaggccgggcuugguagcuuacgccuguaaucccaacacuuugggaggcggaggugggcggaucgccugagaucaggaguuuaagaccagccuggccaacauggggaaaccugggcuuuacuaaaaauacaaaaauuagccagaugcaguggugcgugccuguagucccagcuacucacgaggcugaggcuggagaaucacuugaaccuaggaaguggagguugcagugagcugagauggugccacugcacuccagccuuggugacagagugagacuccaucucaaaaaaaaaaaaaaaaaaaaaaaaaaauuaguccagcaugguggcacaaaccuauagucuuggcuacucaggaguuugagguaggaggauugcgugagcccagggguuugagguuacagcagucuaugauggcaccucuacacugcagccuggggacccugucucaagugaaaagaacaaaaauaacugcucuccaagacugacuucccagcauggcauugaucuucauuaugugggauuuugaauuugucauugucagcucacuagaaggagacuuuauauucuuauccucccucacuuuaaauugauccuuucucucauccucucuugggaggaaaaugaagcccauugauugauaaaaauugaagaaaguaauugguauuaguauuaaagggaccacaaauaguuuggaaaaaaauggcaauugcuacuugcuucuuccuacuaaaacauaccacagcuaaagcgacugagcuuuuagaguauggccucgaaguuucccauuaguggccaagauuggcuggacauuuuuuguuucuuuucuguuauuauuuuuugcguuguacuuuucagcaugucugcaaauaacacuaaacuucaggaauugcugagguuuggacaugaccugggagugcccugaacaccgugaucuguggggcagcccuggagucggguuguuagaucagccuuuuguaggggcagaguuuugauucgggcucacagucauuucccaaccaggauuucuuacgucuagugcagaggucaagguuggcuugccuuugucaaguugaauccggugacuguucauuuugccugcuucuagagugcuacugguuguaguugaggcggggcgggcgacuguucauuuugccugcuucuagagugcuacugguuguaguugaggcggggacucauaaaauguccguuaacuguuuaacaauguagugcaacuggguuuggccucacuaccauucuucauccuguuuauugcacacaagccuuguguauuaguccguucucacacugcuaugaagaaauaccuuagacgggguaauuuauaaaggaaagagguuuaauugacucacauuucugcagggcuggggaugccucaggaaacuuacaaucaugguggaaagggaagcaaacccauccuucuucacaagguggcaggagagaggaagaaugagagcugagcgaagggggaagccucuuacaaaaccaucagaucuugugagaacuuacuaucacgugaauagaaugggagaaaccaccccgugguucagugacuucccaccaggucccuccuaugacauguagggauuuggguggggacacagccaaaucauaucaccuugauagcgcuuuuuuggcagggagacaugucugcggcauauuuggaacacuuugccacguauccucuaaaaucccucauuuuuagaaaagcuauaaggaauccaaauagcuaucuucucuccucuauguacagugaaggacugggcauuuuauuucaauucucuaaggauugguguaguuagauaucuucagugauguaacauuggauggcaucuugguaaagugaaaaaaacuugagcuuugaauuuaaauuuugucucugcuguuaucugugugaccuuggacaagauauuuaacuuuccaucugugacauggagauaauaauacguaccucaggguuaggggggauuagaauuaauauacuuuauuuuauuuauccacuuauuuauuuauuuguuuuugagacagggucuuacuuuguugcccaggcuagaguggaguggugcaaucacagcucgcugcgcccucaaccucgugggcucaagugauccucucacuucagcgucccgaguagcugggaccacaggcacaugccaccaugcgcaucuuuuuuuuuuuuuuuuugagacugagucuugcucucucuccaggcuggagugcauuggugcgaucuuggcucacugcagcuucugccuccuggguucaagcaauuccccugccucagccuccugaguagcugggacuacaggcaugugccaccacgcccggcuaauuuucuguauuuuaguggagaugggguuuccccauguuggccaggauggucucgaucuucugaccucaugaucugcgugccucagccucccaaagugcugggauuacagguaugagccaccgcaccuggcuuuuuuuuuuugagcuggagucuugcugugucacccaggcuggagugccguguuacgaucucugcucacugcaaccuccgucuccuggguucaagugauucucccugccucagccucccaaguagcugagauuacaggcgaccaccaccacgccuggcuaguuuuuauauuuuugguagagacaggguuucaccauguuggccaggcuggucuugaacuucugaucucaggugaucugcccaccuuggccucucaaagugcugggauuacaggcgugagccacugcgcccagcuaauguaauuuuuaaguauuguguagaugaggucucgcuauguugcccaggcuagucucaaacuccuggccucaagcaauccuucugccucagccuccuaaagugcugggauuacaggcaugagccaccacaucuggccuagaauaaauguauuuuaaaacaccuuuuuugcacaauguugggcucacucauguuuaguaaauggcaggaacaccagugcugcugauacacaguccacuggaauuucaguuuuccuaguuccgugcauccagguauuugucgaguuccuguggcuuuuccgucagcuccaucagcuccucuccagccccacugcugugcuuuaaagcaacuccagguuuacuuguucugaauuaucccaggccccuuacugccuucagcgugcuguucucugugaauaaaaauggcggcacagcuuaccuaugguccagaauaucugcuguggcaacagugguggucaaagguucauuucucuuguccugucuucaagaccuccauuagauguuugccuggcgugacaugcaauaucacccuauaguuaaaauaaacauuccacuugacaacagaauuuauuauuuguauuguuuuugaaauuugagacugcagauagauuuuuuuucauuucuaguuuuuauaacuuccaaauucuucuuuuuuuucuucuuagagacagggucucacucugucauucaggcuggaauguaauggcaggaucguagcucacucuagccuugaacuccugggcucacgugauccuuccaccucagccucccaaguagcuaggacuacaggugcacaccacuaugccugacuguuuuaaaacacuuuuuguagagauggaaucucacuguguugcccaggcugguuuagaacuccuggcuucaggugauccucccaccuacgcuucccagagugcuggaauuacaggcaugagccacugcaaccagccaauucucuucucucucuguuuuuuuuuuuagagacagggucucgcuccagggucauccaggcuggaguguggcgugcauagcucacugucucaaacuccuggccucaaacgauccucccaccucagacuuccaaguagguaggacuacaagugcaugucaccaugucuggcuaauuuuuuaauuuaaaaaguuuuuuuuuguagugaugggguguuccuuuauugcucuggcuggucuuggacuccuuaccucaagcgaucuuccugccucagccuccugaguggcuggaauuacaggugcaagccaccacaccuguuuccagauuuuucucaaucauacacaugcuucuuaacuugcaaugaagaauaaguucuuauucugauaaacccaucguaaguugaaaauauccuaaguugaaaauuuauuaauacauguaauuuacugaacaucauagcuuagccuaccgugccuuaaauuuauuugcucagaacacuuacauuaggcuacagucaggcaaaucaucuaacaccgagccuauuuuauacuaaaguguugaauagcucaugugaucuguugaauacuguacagaaagugaaaaacagagugguuguauggguacccaaaguaugguuucuacagaauguuucucaccuuugcaccaucguguaguaagaaaauucuguguugaaccaucccaaguugagggccguugguauauuauuuuagaagaaaaguauuuuuggaugccguauuguaaugaacagaaggaacugacaccugggucacugcagggagccuuugcugccuguucaacaccgguuuccagacccaggcucuuggaacugcagucuucccuuccuggcucucagacucaaagcugcccgcuuucuccacuccagcuguuuguguugaguacaucugucuuuuuguuuucucugucucucauugcaucucuaaagcaaggcaguuuuuacgccaagaucaucaggacuuuuacagguauugggaucuguuuuccuuuauuagucuuuuuuuuuccuuuuuuuggaaacagaaucuagcucuuguugcccaggcuggagugcaguggcgcgaucucggcccacggcaaccuccgccuccuagguucaagugauucuccugccucaaucucucgagucgcugggauuacaggcgugagccaccaugccuggcuaauuuuuuguauucuuuaguagggacgggguuuaauuauguuggccaggcuggucucgaacuccugaccucggugauucacucgccucggccucccaaaaugcugggauuacaggugugagccaccgcgcccggccaacuuguugauuuaagaaaagaaaaaaaggaaaucucugggacuuugauugggauugcguugagucuauagaucaauugaaggagaauugacaucuuuacaauauuaaaucuuccaaucuaugaacauggaauauuucuucauauauuuaggucuuuaguuucucucaacaguguguuuuaguuuuuaguauauagaucuugcucauaguuugcuagauuuauacuaaauauuuugugguuuuugguaugauuauaaaugguaucucuuaaaauuuaaauuuccaguugucucuugcuaguuguggaaauguaauugauuuuuauuuauugaccuuauauugugcagcuuugcugaacucacuuauuaguuucaggaauuuuuuuuuuguaggcuuuugggauuuuuaaaaaguagauaaucaucucaccuaugaauaaaauauuuuuugccuuauuacucuggcuaggaccuacagugugauauggaauaaaacuggugaaagugaauaguuugcuuuguucccaugauauaguuggauuuaaaucuagcaucuugcuuguuuucuguuuguucuuguacuuccuuguccuggguccacaauaugcaucuuuaucacagucauauugucacugaugucacagugaugacauuguaucacuucacauguaaugugagagucuuuucauagcaggcuucugaccucuuccucacauccucucugcauuccacucugccccacaucuuguuuuuacguauuaugaacaccaucacuguugcuauuuuugcuaauuagaguaauuaaaaauaaauuuuaaaaauauuuuuauuguuugucaguuuucaaguuucuacauuuauuuuauauuuuuagagauggggucuugcuauguugccugagcuggccucaaacuccuuggcucaagugaucuuccugccucagccuccugaguagccggaggcuauuggcgugugccaccacacccagcuauuuuauuuuauguuugaagaaguaaauuguauuguguauauguaagguguauaacauguuauaggauacauaaagacaguaaaauagccugcagagaagcaaaugaaggcauuugucaccucacauagaucucauuuuuaucuccuuagaucugaguuuuuucuguaccauauuuguucugccucaugaacuuccuuuaguguuucuuauaacacggucugcuggcaagaaaugcucucagcuuuucuuugcuugaaaaguuuuaauuuugcuuuuauuuuuuaaaaauauuuuugcuugguuuaggacucuagguuggcaguuuuguuguuuuauuuuuuuuuaguacuuuaaaaaugucagucuuugucuucuagcuugcauuguuucugagaagucaacccuuauuccucuugggaucucagcacuucuuggaucagugguuuaaugccuuucacuuaaaaaaaaauucucagccauuaucucuucaaauguuucuguuguguucucucuuccuccuagaauucuacuuacauguguuuuagaacauuuaauacuguccugcagguguuggauuuucuuuucuuuuuuccucuuuguguuucaguuuggguacuuucuauugacccaccuuaaaguucaccaauccuuuuuuugcugugucgagugugaugaggcuguugaaggaauucuucagcucugacaccauguccuuuuuucuagcauuuccauuugacucuuauaauuuccugcucucugcugcaauucuucaucuguucgugcagguaaaacaccuuuucuaccagauucuuuagcauauuauucauuguuauuuuaaaauccccuccucuguagccuaucuaauauuuauaccaaauggcuccucuuugagacagguucuguugguugcuuugucucuuaacaaugggugcuuuuccuuucuucccuuucuucuuuuuuuucuuuuuuggcguauauaugucuuaaaauuuuuuauugaaugccaggcauuuuguguagaagaggagagagugcccccauuuuuuccucaugaacacccagugaaggucuuggaaaagagccugagagugggugcaaacccaccugugcuuacacuuuccaggccucccuaccauugcgccagcccacacuuggccuuuaguaacuuguuaaaaacuuuccuucagcccucucgccugcuuguguggcacccccgucuuccuuacaugcccuucuacauggagacgguucuccuguccugucuuuccugggggagcaccuuccuucuuggauuucaggaugcuugguuaccuuuagcucucugcuagguucaagaaaaguugugguuuucaguuuccguuuuccuccuuguuaguguaagagcagcacucuuucugcuuucugcauccucggcagaagcacagcugaucagcggguuucaugcagcauauaguauggcaaguucauuaauucaauuucaaaucccacacugcagcuaauccucaagaaucuaccacuuuuugaguuuuaguguaguuuaaaaaaggcuuaucaccaaguaccugaaaagggcugcuguguuuaaaguguucuguucuaugaauugcagcugaauagacuaagaaauggguauuaaaauauuucuuccuuuucuaauuacauauaucuaugugaagccagauuuucuucauauuuucaaccaaaacagcaugucacagcacaggaauguugguaucucccacgauuccuaugcuggaacuuaaucccuauugugacaggauuuaaaagcagggccuuugggaggugacugagucacaaggggucugcccucaucugugagaucaguguccucauaaaagacuuuugaaggauggccauuugccccuuuccccaugugaggacacauagaagaugccgucugugaggaaagggcccucacugggcaccagaucuccuggugccuccaucuuggacuuuccagcuuccaggacuguuaacaauuucuguuguuuagaaauuacccaguuuaaaguauuugguuauauuaauagcagccuaaauagacaaagaguuggguauuaaaguauuucuuccuuuucuaacuacauauaucuaugugaagccagauuuucuucauauuuucaaccagaacaacagaucacaacagauucaauauggaagcguguaugggaguccagcugguguuuaucagagcagacacuaaagauuuuugcagagacaccccagcagugccacgcuucucaagaaauuuguuuuguaggccgggcgcaguggcucacgccuggaaucccagcacuuggggaggcugaggcaggcagaucacgaggucaggaguucgagaccacccugaccaauauggugaaaccaugucucuacuaaaaauacaaaaguuagcugagugugguggcaugcaccuguaggcccagcuacucgggaggcugaggcagaagaauaacuugaacccaggaggcugagguugcggugagccgaaauugcaccacugcacuccagccugggcaacagagcaauauucccucucaaaacagaaaacaaaaaacaaacaaacaaaaaaacaacuuuguuuugucuggggggaaaauauaguuauuuuucaaaaaacauguaauuuaugcuaacauguaauauauuuaucauugucauguuuaaauggauuaacagauacauauuuuuuauuuaaacuccucaguuuuaaucuccaacauugguauaugucaguagauauaaccuacauaaacccuuucaauaaauuuccaaggguauaaagagauucugaggucaaaaaguuuuagaaaugcucuuuaggaucagcuaagagugggaauggcaggcaguuuguucuugauuuuaaugacaggcacuuuacauaguguaucuguucauuugcucacucaguacauauuuagugagugccuucugugugguuggcacuauuuuaagcauugagaauuacacaaugaaaaaagcaaaagacacuucucucccggagcugacaccaaguguaauguugucuuguuucccgauucuuuugacuguuaaggagagaucuucacaaucuuggucacuaagcacuuuugccagaaaauagacguuggauuuuaucauaugcccucucagcauguacugaauauagucauagggguuuuuucauguuguugauuuguuuaaguuuuuuuuuccuucuuuuuaaaauauuuaaccuuucauaaaugcuugcugggucaucguguauugucuuuuaaauauauuguugaauccuaguauuuuuaucugggauuuugauucauguuaaaaaaugaaauuaguuugacauuuucuucuuuuugguuaucauuguuagauuuuguaucggguuuaugucaguuuuuguuguuguuauuuugagacggaaucucgcuuugucacccaggcuggagugcaguagugcgaucuugacucacugcaaccucugccuccuggguucaagcgauucuccugccucagccucccgaguagcugggauaacagacgccugcuaccaugaccggcuaauuuuuguauuuguaguagagaugggguuucaccauguuggccagauuggucuugaacuccugaccugaaaugauucacccacuucggccucccaaagugcugggauuacaggcgugagccaccgcgcccagccaugcccagcuaaauuuuuguauuuuuaguagagacgggguuucaccauguuggccaggcuggucucgaacuccugaccucaggugauccaccugccucggccucccaaagugcugggauuacaggugugagccaccaugccugaccuuugucagcuuuauaaaacaaacugggaugcuucccauuuuuugcaaccgcagagaccauuuaaauaguaaacuguuucagagagucagacuauagauaauauacccugaagucccugaagucuuugaaacaauugacccauuaucaaggucaagugccuuuugggagauugguuucuuggcagccuuuucuguuauuucugugguuauaguuacaucuuccacuucuugaguugauuuuaguaaguccuuguucuugaaaauaauuuuacucagauguuuaaguuuauucauccuuuccaauucucuguuuauauucucuuuccauucuuuuuguuuuguuuugguuuuuugagacggagucuugcucuguugcucaggcuggagugcaguggcgcaaucucggcucacugcaagcuccgccuccuggguucaagcgauucucccgccucagccucccaaguagcugggacuacagguggccgccaccacgccuggcuaauuuuuguauuuuuaguagagaugggguuucaccguguuggccaggauggucucaaucuccugaccucgugaucugcgcgccucggccucccaaugugcugggaugacaggugugagccaccgcaucuggccucucuuuucauucuuaauuuuauguuuucucuuucccacacccccaauccuagauuaaaacagccagaauuucuuuaggccuucucagaggacuugcacuuggauauauuugucaguucuccucuuuuccuguuucaguucauuacucuguaccuuuauauuuuacugcuuucaucucuguugucuuuaugcuccuucuacuucuuguuauguaagaagagcgcuuaaagguacggcuuuucucugaaugccacuuuggccacaucuccugaguguuaaaaaugaauuuuuaauggcgggggcgcgguggcucacgccugucaucccggcacuuugggaggccgaggcgggcagaucacgaggucaggagaucgagaccauccuggcuaacacggugaaaccccgucucuacuaaaaauacaaaaaaauuagccaggcgugauggcgggcgccuguagucccagcuacuugggaggcugaggcaggagaauggcgugaacccgggggguggagcuugcagugagccgagaucaugccacugcacucuaccugggcgacagagcgagacucugucucaaaaaaauauauauauauauauauuuagccaggagugguggcacaugccuguaaucccagcuacccgggaagcugagacaggagaaucgcuggagcccaggaggcagagguuguagugagccgagaucgugccacugcacuccagccuaggcgacagagcgagacucuguaucaaaaaaaauaaaaaagaauuuuuauuguuuuuauuuuuauggguuuuuuguuuuuguuauuuugagacagagucucacucugucacccagucuggagugcaguggcuugaucuuggcucacugcagucuccaccucccggguucaagcgauucuccugccucagccucccaagaagcugggacuacaggugcccgccaccauguccagcuaauuuuuuuguauuuuuaguagagauaggguuuugcuauguuggccaggcuagucugaaacuccugaccucaggcaguccgccugccucauuugaccucucaaagugcugggacuucaggcgugagccaccgggccuggcuuuuuuucucucuugagacagggucuggcugugucaccucggcuucagugcagugauaaaaucauggcucacugcagccucgaccucccaggcucaaguaauccucccaccucagccuccugaguagcugggacuacaggcacucgccaccacgccuggcuaauuuuuuuuguauuucucguggaauccggguuuugcuguguugcccagacuggucuugaacucauggguucaagcgaccuccugccucagccuuuuaaauguugggauuacaggugugagccaccacaccuggccugguuuuuuuucuuggcaaguagcuugguguaauugaugaugcuuuuaaaaauuuuauuaaauuucauuuuaguaaauauaaccuuuuucaauuuuuuauauggcuauauuuuaacagcauuagugagcuauaauucacauauaauucaucuauuuaaaguauacuguucagugguuuuugauauuacauuauuuuuuaaaccuuguaaaauauguauauaauauagaauuuauuauuuuaacauuuuuaaguguauaauuagugguauuaauuacauucauaauguacaaccaccacuaccacuauuucugaaauuuauucaucaccccaaauagaaacucuguaaacauuaaaaccauuaaguccuuccuuccccugcccacuuuccucaacuucuuguaaccucuauuuuacuuucugucucuaugaauuugccuauucugggaacuuuauauuaauauaaguggaauucuacaauauuugacccuuuguaucugguguauuucacuucuguggucuucaggauucauccacguuguagcauguaucagcacuuucuucucuuuuacgggugaauaauauuccgugguguaguuccaccacauuguguguauccauucaucuguccauggacacuuggauuguuuccaccauuuggcuuuugugaacagugaugcuaugaauauuggcauacaaauaccuguuugaguuucugcuuccgucccuuaugcuguguaccuaggaguggaauugcugggucacaugguaauuuuuaaucauugcaauauuuaaucucuuuagaaacauuuuuccauauuguucugaacuuucauagauucauucuuuccauagacucaggugcauuaacacaagcguucuguuuugucuucauuuaauuaauauagacaacauguuucugauuagcaagaaucuuaagcuuuuguauguagugccuacucauggagauguucucucccacaaaaaaaaaaaaccacccugauuuuuucuuuuauuuaguuaacuaguccagcaguuggacuguuuccuuccugaccuuagaaacgccaagucccgcuuuucugcaacaugauuauugaaaauaguuuuaggaaaauacugcgccaagaaagaacacugaaguuuauuguucuucugagccaucuccauauaaauuggcagguucuucugagccaucuccauauaaacuggcagucuucaggagccaagaaagaaggucaagcguaacucaccaucugcuuauuuccauguuagaggcagucacaaguuuaaacuagacucugcgucucaagaggaaaaugccauucaucaccacuguaacugcucuggcuaguacccaggucacucuugcuuuugauugcuaguaguuagaaaucguguaaggaaaauuccauccucaguuugaggcugugcauuagaaaaauugcggaauuacugccaacagagcaaagccuucuggauuucagguccuugauacaagaagucacugagauauguuuguacaauggaugggaauuuggcuuucugucuucauggaagaacuuggccuccuuuuuccucuucccucuuucauccacggaaacaguauuuagaagagcacagauucagcguugugguugugccgucaccauuuccauguguaagucuccauuuucaagagucuguaacuauaaaauuuccuuugcuccaauuuggacuccagggucuccucuggaaggagauuaguuuugcaaaaccaaagauaauacaucuguuuuggcuuggcguuuuguagucaucuagauuaaagcucuaaaauacaucagaaacuugucguccuccguauauuauuggaucccaugccgggguuucuaauuucuguuucuguauugcaucguagacucugaacagaugcuguguucguuucuagguauuguaugugauaccuggaauauggauguuaggcaaaaauguauuagugccacuuucauaaugacccccaauuuggaggggggcauuucuucuggagauauacuuacuaccaaguaaguuuuuuuuuuuuuuuuuuuuuugagaugggagucucgcccugucgcccaggauggaggugugaucucagcucacugcaaccuccgccuccuggguucaagugauucuccugccucagccuccugaguagcugagauuacaggugccugccaccacacccggcuaauuuuuguauuuucgguagagacggguuuucaccagguuggccaggcuggucucgaacacccaaccugaggugauccgcccgccucugccucccaaaguguugugauuacaggcgugagccacugcaccuggccccaaguaaguuugaugauucaaauucugucuuuaaagcaggagaaaagguguauuugaggggucuuuaccccaucucagaccgaauucuuaacuccugucuccuuguuguacuugagcuuuucuuguuccuagucacaagggaacggucgcgacagacagcccucuccuacuuccgugauaaccguagaauuaucagcuaggcaaagugcuacuucuaauaagucagaaauuuaaacuuuuuuuucauugaagacuuagagauucuagucuuuagagauuucugguaacuagugucuugugggcagguucuaggaccguuugucagcccuggaauuuuccagaucucuguaauuaaggauguacuguuuuaaggcugaucuguucuugauucauucacuguaagcaaagacacauuuucaguugcuuuugcagaacauaacauuuugagucauuugucuugaucuguaaugcuaauguuuuauuacacuauaaauguuuaccuugcaaaauauuguugcauauauuacuuuacuugauuuacucgauucacauguuuacaaagaugugugaauuaggccacguagaugcuguucuccccauuuuacagaugaagagauggcccgcaucaguucugugacgugcccaaaaucacacgaagcgaguuaaucacagacccagauuuucucauucgcaguaugcugcauacuuguccauacuaaauuaucuuuaaacagugacaaacauuuaaaagcagauuugggagccaccuguuuugcuguggagccuggaaggcugauucauaaggaauuucaaauaauggcagugaccauggccucauuagccagcuuggucccccucaguaugacgaagaaacuggacugagagaagaaccccagguugaagagaacucucuguguucugcacaccugugcugccgaaaauacagacaccagugaggcccuaaagagaguaagcgaaccaggaagagaaaaaaaucacacagaugaauccucgcagccugaagggcauuuggcacagaaggugucucaaaaagucagcugagggaacauccagaugucacgcaaaaggauguuuucuccugaaugaagacuuacgauauagaugagaguuaugaagugacuaaaaugagaaguaauaguaagauauggggaauuagaaugaagucaauaaccucgaacuuggcaacuggaaguccuggcuauuugggaaaaguaguccuuuguuaaacuuggacaaguuguuccuuuuaaugugccccauuuccaaaaauauugaauuucuuuaccuuucauucagcaaaagcagcagaaacuuuugcuuaaacguuuccuugucuuuugccacuuggagguguugcuugaaaugcucucauccuccgggguuaccuuucgucaaaggaagcugcaugaacgcauccgucacucgcagcuauuucagggcuagcuuguuuuaaguuaggggugauaacagauauaggcagaacuuugcaauguaaauguuuagucuuauuugggcacugcugaauuuguuuccgagccucgucuugugauuuuaauuucuggcuugucuccugaaaacaacaaaaaugagcucuuugguucacauuuucaguggcuuugguuugcagaaaucauaaauaaaaguaacuuacauggaacagaacauuuuaacaaacaaggugagaauuacuccguuugcucuuuacaguccuuugguuuuugguucacaaacuuggaaagaaaucugugcuuuaaauaaagccuucuuauacuccagguuccuaagugguguggaggaauuuguguaaacaucagugauucucaucugaugggcgccaucuggcauuugaccagggcaguccugguugaguucucggacacguagggaagcaaagagcuguagacgugcagccaucuguggcugugagaguccgacagccucugcugcuguugagcaccaucauggggagugggcugcguuguuggcauugcugaggcugggugugugagagucccgcagccucugcugcuguugagcaccgucguggagagcgggcugcauuguuagcauugcugaggcuggcugaagcaccucuguuucagcuggggauaccucguuuccauagcaacagcucucagugaugccgggguggucagcaguaacaaaagaagagacuuucucuaaagagaggcgacuugacccuugguguccacccucaguggauguggugagggcuuccguguagggcuuaucagaugugguagcacucauccauguuucugcucucuggaggaccuccuggcuuucgaaaugaugcugccguuguuuuuuuuuuguuuuuguuuuuguuuuuuuuuugcgacggaaucuugcucugugccccaggcuggagugcaguggcacaaucucggcucacugcaagcuccaccuccuggguucacgccauucuccugccuaagucucccgaguagcugggacuacaggcgcccgccaccacgcccgguuaauuuuuuguauuuuuaguagagacgggguuucaccguguucgccaggauggucucgaucuccugaccucgugauccaccuuccucagccucccacagugcugggauuacaggcgugagccacugcgcccggccgcugccauucuuuauucaucgcucuuuguaucauuuuguguauaauucagacauguauuccuuacaagcccuuuaaagauacauucccuagcuagugaucuuuuucucucaguaucuagcacaguacauguaauaggcacucacuuuuuaauugaaugaaugaacaaaagacuucaauuuuuuucuggagaaugucucauuuucagcaugguucaaagauuccauccucuuaauccaugagccguucuucugagucugccugcagauacugaacuuagccaucuuauuuacaaagcucuaaaagaugaguaacaaccucugauucuuagaggguagucucaucugaaauauccuacuccaucuaggagaugugggaauacuaauaguugccauuaagugagcacuuucugugagcugagugcuuuauaaacucauucaagacucucuugguugcagaagacaaaaaucccaauucaaacgggcuuaggcaaaagggggauuauuuggaaggauccuguugugucucguuugaagaaguucaacaagugugaccgccagaaggauagcgucucagcugggcuugucaaacagcugaagccaaagacgggaguaaagcucagagagagagagagagagagagagagagagagagagauugagauugugugagagagagauugugugugugugugugugugugugugugugugugugugugugucacccucaucaucucuaccuguaguccagccuccugcccuuccuggggaaccuagcugcucucuaacucaguuucacuucuugggacuccuaccacccgcgaaagacaaacucuuuuucccaauucucauucugguggcucacgccuguaaucccagcauguugggaggccgagguaagcgggucaugaggucaggagauggagaccguccuggccaacauggugaaaccccgucucuacuaaaaauacaaaaauuagcugggugugguggcgggugccuguaaucccagcuacucaggaggcugaggcaugagaaucacuugaacccaggaggcggauguugcagugagcugagaucaugccacgacgaagcgugacucugucucaaaaaaaaaaaaaaaaagucaugggaaaacugcuccaacgagggccuggucagcucuuggacagcagacucuguagaaacacggugaaaggaagauuucgcaugcggaggggaagaguguuggguaaacgauuccaaacauauuuucuacucucacauuccuuacuaccuuucagguagcugauagaauuugcauucuggaaauuaugaaacuacuuccuagaggauaagaggcuugacagaaaucacacaguaacuggcagagccaagguuugaaucccagucugcuaguugaaaaucccuugcuuguaacucauacagcauguugcucccucccucccucccucuuucucuuuucuuucuuuucuuucuuucuuuccucuuucuuuccugucucucuuuucuuuuuuucuuuuuccuuccucccucccuuccuuccuucuuuuugucccuucccuucccuuuuccuuuuccuuucuucuuucuuuucuuuucuuucuccgucucacucuguugcccaggcuggagugcaguggcauaaucuuggcucacugcaaccuccaccuccuaggugcaggcgauucuccugccucauccuccccaguagcugggauuacagguguguaccaugauggcuggcuaguuuuuguauuuuuagaagagacgggguuucaccauguuggcuaggcuggucucuaacuccugaccuuaggugauuugccugccucggccuccgaaagugcugggauuacaggcgugagccacugcaccuggcccagcacguugcuuuuccauauaauagaaaagggaaccagcagauagaugucaaguuggaaaacagaaaugguagcaaaauaguggaaaaaucuaauuuucuccccaguaaccgugaauaauagcaccuuauuuuuucacagaauagucuaaagccauaccagcucuucggaaaaugaacaaccuuuccuccuuccugcaguggccacaaaggggaucucgguuuaaaaucucugaaaggcugccugcggacucacaggauaaaggcagcaucauucucugauggcgcagacugcaaaauuagauggaccugagagccagagggaugcucauuucuuaaggcacugccaaugaaucagagccccucugucuacuaacguggcagacaacaguucugcaaaaaaaggaaaaagagaaagaagaaagcaggagagucugugccagguuccauacuccuuaucuuccacacgugaccuccuguggcuuugagagccugcucaccgucuccuccaggaggcaaggagaauucagaguagugguuaccauuaggaugcacagaaauacaaagaugcuggaauugguuuugcugagccuucuaggcuaauucaguggguugcuuuucaucuccuguuuacagaauuugagucuuaaaagaggagcacggcagucaccgcuuuauaacaccgucagauacaggcuguggcuccagugcccaguucaccagugcccaguucaccagugcccaguucaccagugcccaguucagaaacuccaguaggggcagauuaaacacagucgccgcuuuauaacacuuuaggaugcaggcuguguguguauagaauuugaguccuaaaaagggccacaacagucacugcuuuauaacaccuuuagacguaagcuguagcuccagugcuccguucagaaacucuagugggguagauuaaaugcagacauuuuugggagugauuaguucuguuuuuaauccacauacagcuuggaauggaaaguagccaccuuuuaauuuuuuuauuauuacuuuuuuuucuucuuuuuuuuuuuuuagauggagucucgcucugucaccaggcuggagugcgauggcaccaucucagcucacugcaaccuccgacucccugguucaagugauucuccugccucagccucccgaguagcugggauuacaggcaugcgccaccacacccagcuaauuuuuguauuuuuaguagagaugggguuucaccauguugggcaggauggucuugaucucuugaccucaugauccaccugccucagccucccaaagugcugggauuacaggcaugagccaucgcaccuggccuaauuuuuuuuuuuuuuuuaagacagaguaugucucugucacccaggcuggagugcaguggcgcaaucuuggcucacugcagccuccgccuccugggcucaagugauucucaugccucagccuccggaguagcuggaacuauaggcauguacuagcacacacagcuaauuuuuuuaguauuuuuaguagagacggaguuucgucauguuggucagacuggucuugaacuccuggccucaaguaauccaccgucagccuugcagcgugcugggauuauaggugugagcuacugcccccccggccaaccacguuuuuauuuuaaaaagugucuagggacagugccagagugauucuuucagcacauuucugauuagccagguagugaagguauuuuuguguuucuuaaaaaaaccuuaacuucuuguaggacccaugauucuuccaguugcaaaacaaucuuucuauaugacucaugaucagagguuagaugucaaauauuaggguguguguugagaauggacuugccugauagcaccagugcuucagaggaguuuuuaaacucugcaaaaugaauuauaguacauuuccccaacuucaguaccuuauuaaaacaagcaaaaguauuccagcccgaaaaaagucuggcacauaguuuaucuaucuuggagacugugacauguaagauugugugagucuuauuuguuugcuggaagaaaaaagcgauaccuucagcagagacaguucugguaggaugccagguuuaauguaagagagaaagggauagaaacccuuucucugagauaggaucaugcagacuucuucauaugugagaccuaaguguauaacuuagccccuuuuuugccuuucuuagcugcaugucauauguuuuaggguguuugucuagaacacaguagcuauggucccauuagcaugucaccauaacaugacaugaccugcaguaucacagaauuccaugugagcugugucgaaaaagaucaguccuuucuaguggucaguugccuacagaggccucuguugcacuuuuuacuccacgauugaaacuuuuuuagaauuuacugaucccauguagcaucuuggauauuagacucuguuuaagccaaauagagaauacuuacagaaagcaugaagcugugauuuugaaccacugcucaugguugggccugaaguuagaggaaugguuaugagcgcacuuauucagagcgguagccucagcaccagcacucuuacaggugcaccaugauacuuuuaaucagugggcaauauuugucaaggucccacugugccauagccuugcuuaggugcuguaggugaggugaccauaugauuuaucaccagagucacuuugagaaggagagggagcuguuaauaacuauacugaaucauaaacgcagcguguccccgguaaaccaaauggaugauuggcucagcuaugggcucuauaggagugcuguucauauccuugguccccauucuaaaggauacuuauaacccugcuaaagggcuaauacucauacacuaaaccagugguccccaaccuuuuuggcaccagcgagcaguuuuuuggaagacaguuuuuccauggaccagggagggggacaugguuucaggaugaaacuguuccaccucagauaaucaggccuuaguuagauucuguuaaggagcuugcaaccuagaucccucgcgugugcaguucacaguaggguucgcgcuccuaugagaaucuaauaccgcugcugaucugaggagggggagcucagaagaucaugcucacucacuugcccaccgcucaccuccugcugugcggcccaguucccaacaggccacggacuggugcuggcccacggcccagggcuugggguccccugcacuaaacaauucaagaacauuauguuuaaaaaaguccucuucuguaauuaacccauugcccccccccccagaacauuauguuuaaaacaguccucuucuguaauuaacccauugcccccuccgcagaacauuauguuuaaaacaguccucuucuguaauuaacccauugccccccccagaacauuauguuuaaaacaguccucuucuguaauuaacccauugccccccccagaacauuauguuuaaaacaguccucuucuguaauuaacccauugcccccccaaauaaauuucucuccugcuaaaucacucccaagcagacguaugcaagcauuucucaucuuuaaaaauuacucccuuuacgccaucuuuugcccuauuuuucuuccuuucucauagcaaaaacuucuugaaaaaaaaagucuauaccagggucagcaagcuuucuguuaagggcuggauaguaaauauuuuagccuuuacugaccauauggucucuguuguaacuauuuaucucugccauuguguggcaaaaguccccauaaacaauacuuaaacaaaugaguuugguuuaaguauuauuaaugaguuucgguccaaaaacacauuguuuacaaaaacagguggcagacguggcagacuggcuucagcccacaggccaucauuuguggccugcucugugaucacagccucuacuucaugucaucgcuguccauucccuugacugcauugagacugcucuugucaaggucaccaacaacuucccuguugucaaaaucaguagcagcugucuucauuuuuuuuuuugagauggagucuugcucugucgccuaggcuggagugcaauggcaccaucuuggcucacugcagcuuccguuuccuggguucaagcaauucuccuaccucagccuccugaguagcugggauuacaggugcacaccaccaugccuggcuaauuuuuguauuuuuaguagagacagggguuucaccauguuggucaggcuggucacaaacucuugaccucaugauccacaugaguuuuuuguuguuguuguuguuuugagauggaguuuugcucuuguugcccaggcuggagugcaguggcacgaucuuggcucacugcaaccucugccuccuggguucacgcgauuauccugucucagccuccugaguagcugggauuacaggcgccugccaccacgcccggcuaauuuuuguauuuugaguagagacaggguuucaucauauuggucaggcuggucuugaacuccugaccucaggucauccacccgcccuggccucccaaagugcugggauuauaggccugagccacugcgcccagccucuuacaugaguguuuaacaacagaaggcacaaucacucuuuccuucuccuucaaacacuucuguuuggcuucuguaacacccaucgucccugauuuuuucucaugucacuggugguuuuucucugcaucucugcuuuuuuuuauuuuagacuucugaauauuggcaugcccaagggucagcccugugccaucuuuucuucucuuguguauucugucuuccuaggugacuucuaaucuuacagacuuacauaucaucucuaaaguaaugacuucugaauuuaaaucccaaccuaucaccucucuuccaagcuccagaaucuuauguccaacuuaaugucucuacuugaucucaaguaagcuaucuuuuuuuuuggucgggacagaguuuugcucuuauuacccagguuggagugcaguggugcuaucucagcucacugcaaccuccgccuccuggguuuaagugauucuccugccucagccucccgaguagcugggaugacaggugcccgccaccacgcccaucuaauuuuuguauuuuuaguagagacgggguuucaccauguuggccaggcugucuugaacucuugaccucaggcgauccgcccgccucaggcucccaaaguacugggaugacaggcgugagccaccaugcccagcuuacugucuguauuucuaccaacacuccggucacaaccaugaaguaauuucuaagaaguuccagacuuucucuacauuucugcuuuucuucugagcccuuagcagaaucccccuuagcacucuguucacagcaauacaggcuuuuuccagccuucacuucaagacuguuccacaucuguccaucacccagcuccaaagccauguuuucagguauuuacuauagcaguagcccacuucuugauaccaguuuucuuagucuguuuuauguuacuguaacagaauaguacagacugaaucauuuauaaagaaaagagauuucuuauaauucuggaggcugggaaguccaaggucaaggggcccacaucaggcaagggcuucuuaccgcaucuucccgcggcgagggcuuucucacugcgucgucccgcggcgagcgccuucucaccaugucguccugcggcgagggccuucucacugcgucgucccauggcagaguuggaaggcaagaaagugugugcaugcacgagaaaguggcugaacagauccuuuuaucaagaacccacucccgagauaaugccauucauuuguucgugagggcaaaccccucaugaccuggucaccucguaaaggccccaccugccaacaccauugcauuggggauuauguuuccaacacaugaacuuuggggaugcauuccagccauagcacaggcacccguaacguauugcagaugggacucuucacuuccagccccgccaccaccacacacaccugccugucaagcccguccuccuccugcauucccugguucagacagugaacccuggccuuggcuuuucaaccaaaacccgggcgucauccuugguucucccucucccucaucacccacacacaguccaucagugaguccuacacauuguaccuuccuggaaacccugaaucgcucggcgucuucccgucagcaccggcugccucuucuaggccuccaccgucucguggacacugcagcaacuucucacagagcuuucacucccgcuuucccuccugccccugcacagccccuuugccacacagcagccaggacagucuuauacaaguaagccauacaucugucccuuguuuagacccuucaguggcuucucauuggcacuuagagcagaauccuuaugcuuugaggccuccgugcucuggcucgugcccaccucuccagauuauuuccagacacuucccgcugcaauauugcacuaccaccuacugucugucuuuucggaccuccaaaacaccgaggucuuuucucugucaggaucuucacauuugcuuuucucucugcugaaaauccucuuacuccaggcugggcgcggcggcucacgucuguaaucccagcacuuugggaggccgaggcgggcagaucacgaggucaggagaucgagaccauccuggccaacacggugaaaccccgucucuacuaaaaauacaaaaaauuagccaggugugguggcaggugccuguagucccagcuacucgggaggcugaggcaggagaauugcuugaaccugggaggcagagguugcagugagcugagaucacgccacuuaacucuagccugggcaacagagugagacuccaucucaagaaaaaaaaaaucaucuuacuccaaaucuacaaauucucacaccuccucauccugcaggucccgauuugugugcccuuucucaggagaccuucugugaccaccaucucccuuauucucaucacugcauaaguccuucaccacaccugucaauucaccacacuuaggaauuaucuuguuucuuuauuuuguuguuuuuccaggaucuccucccccuuacuucucaaaguaaguucauuccuugaggacagagagagagaccauacugucuuguuuaccauuggauucccaaugccuagaaucaugccugguauaugggaggcauucaguaaauacucauugagugauugaaggagugaauuaaggagaugcugacucgugccuagaacuauaacugccucaggaauucauagucuuuagucacggacaguccagugcauguggucuauacacauccguggccugcugacacgcucacagacacuuuagcuguagguagucuuuacucacggacgguccagugccuguggucuauacacgucugugggcugcuggcacucacagguacuuuagcuguagguagucuuuacucacggaugguccagugcauguggucgauacacgucugugggcugcuggcacucacagguacuuuagcuguggguagucuuuacucacggacgguccagugcauuuggucuguacacgucuguggccugcuggcacucacaggaacuuucuggucuccacaugucacaacugcccucauguugcuuccccuccuagcagaagcugcagcuguguuguaauacuuucauuguguagcaucuguccuuguagguuuuuauuucaguggaaaugcugggcucaccauuagcuuuuugcuuguuuuuuugagacaagaucucgcucagucaccaggcuggagugcaguggcaugaucacaguucacugcagccuugaccucccaggcucaaguaaucuucccaccucagccucccaaguagcugagacuacuggugugcgccaccaugccuggcuaacuuuuuuuuuugcagagaccgagucuugccauguuccccaggcuagucuugaacuccugggcucaagcaauccuccugccucagccucugaagugcugggauuacaggugugagccaccauuagcuuucugccugccugccugccugccugccugccugccuuccuuccuuccuuccuucguuccuuccuuccuuccuuccuuccuuccuuccuuccuuucuuucucuuucucuuucuuucuuuuuuucuuucuuucucuuucuuuuuuucuuucuuucucuuucuuucuuucuuucuuucucuuucuuugucucucuuucucucccuucuucuuucauucuuucucuuucuuuucuuuucuuuccuuuuggagucucgcucugucacccaggcuggagugcaguggcgcaauuucggcucacugcaagcucugccucccggguucaagcaauucuucugccucagcuuccugaguagcugggacuacaggugcgugccacugugccuggcuaguuuuuuguauuuuuaguagagaugggguuucaccguguuagccaggauggucuugaucuccugaccucgugaucugcccgccuuggccucccaaagugcugggauuacaggcgugagccacuguguccggcccaguguuccuuucuaagugcauuucauugguuuucaaauggcuuacuaugaaagucuuuaagauuuguugcaguucuggaguccccauucacgguucagguuuuuuugaaugcacaaucuggaacuuccaaguccagagcuuucccuugccccaauuuagagcuaccccugucccucugugugagucuuugcauacacccacacacagagaucuacuuguccuauuugcuguuaucaauaacauguacaguaaugacugagguagaggggaaucauuuaguuuuaaguugaaacuuugugaggaacauugguaagagucccgaguguuuaccuguucgcagccacuggacucuauaggucucuacuauuuugguccagaaaaauuguuggcauaaguacaaugaaucaggagagcuucauggaaauuucuuuugugccuagcauugauuacaguuagugacuggagcugucucuagccacuuuuuguuuuucauguauuucccuuacucuaggcgcuugaagaggcucagaaagcuauccaacaacucuuuggcaaaaucaaagauaucaaagacaaagcugaaaaaucagagcaaauggugaguucugguuucuuccuaaccuuuuugcaccaaaagaggaagugagcuucucaucuaggcauucuaauaaugagcuuuuucuaauaauggcaccuccugccaaccagagucaucugcaucucuaaagcaagcccccuaugaaugcguucagaucaauucaaggggagcugcuggucagugguggcucaccaucucugcugcccuguguuugcagcccuaguuuuaaauaggcaacuuuuuuguuuuguuuuguuuuguuuuuuggguauuuuuuuuuuuuuuuuugagauggagucuugcucugucgccagccuuggagugcaguggugcgaucuuggcucacugcaaccuccgccucccagguucaagcgauuccccugccucagccgcccaaguagcugggauuacaggcgccugccaccacgcccggcuaauuuuuuguauuuuuaguagagaaaggguuucaccauguuggccaggauggucucaaucucuugaccucaugauccgcccgccucggccucccaaagugcugggauuacaggugugagccacugugcccagcugcaacuuuuuuuuuucuccuuucugaaaauaguuuccuagucauuuuggauuuuccuuucucuaacauuucuugguauugguaucaugcauuucuccaucgagauguacgguauguagcucgaugcacgcugagaaugguccuggagccgggaggagggagggauggagggaggagggauguccccgcccaugaucuguguaugugguuuugguugaguucuccccugacaaauuugugucccccgguguugugcucagaagcuugccccgaagaccgagaauccagcauucaccuucuccuccuccaugggaggcgcugggaagugcuggauccuggguucagauucagacucaauaauguccugucugucaguugucucagaauuccagcuucuucaacuguaaaauaagaauaauggcauuugccucacaggguuguugugagaauuaaacguaugaagagcacugagcauaguccuagggaccuggauuuucugugguccuuccccaagggugcaccacacccagcagcacccaggggcccucguccuucaccaaggaugcaccacacccagcagcacccaggggcccucguccuuccccaagggugcaccacacccagcagcaccaggggcccucaaagcgugaagaucagcgagaguauccgaugcugcuuuugcuggaguugauugcauuuauugauauccuuaugaugcuaaucuguguucuggaguaugcuuccucuuccaaccgaggggguuugcagugacaguuuacucccaaguuaugagaugucuuauuuuaaagcagcuugcuuuccuggacagugcugugcugaagggaggaagaggugggagugaggggagaagugaucuuuguugagcucuuucagugccagcagugugcugguuccuuugugucagcacucuaauuuagcccucaccacaaccuuaugaacuaggauuuauguucauuauuaucuuugcgauuacccaucuuauagaugagaaaacugagacucagugaggcugagaaacuuguucuaggaugcaucguuggugagugguagagcugggguucagcccuagaucugucugacucuacaaccucccauuucaugcucuacccguuuucgcagcccgugggcaacaguugaggcaaaucaacuaugggcauucugucucacagguggucucguguaagucaguugaggcgaaucaaccaugggccuucugucucgcagaugaucucguguagguuugaccugaguaccccuggugugcccugccauugauggcuuuguuuagggaaaaaucagugguucaguuugucuagagaaacacaggcugugggauggggagugacgggagauccugggaauaaagagaccagucagcuccagugcagagcagugagggccugaacaaggaguagagagaagggauagagucuugagaugaagcagagggagaauauuuaggacauagagagaagggauagagucuugagaugaagcagagggagaauauuuaggacauagagagaagggauagagucuugagaugaagcagagggagaauauuuaggacuugaugcagggaccaggaagagucauagaugaugugacuuugaacacagugguuaaagaccccugaugcagccgggcacgguggcucaugccuguaaucccagcaguuugggaggccaaggaggggggaucacuugaggccaggaguucaagaccagccuggccaacauggcaaaaccgugucucuacuaaaaauacaaaaauuaaccaggcgucguggagcacaccuguaaucccagcuacucuggaggcugaggcagagaaucgcuugccugggaaguggaggcugcagugaaccaagaucgcacuacugcaguacagccugggcgacagagcgaaacucuaucucaaaaaauaaaaaaauaaauaaauaaauaaagacucccuauguuagacugaagcuaaaaacgcuggaagagauacagagauuuuuuuguaggaaaaaggaugcugauuucagaguugcaagugggugaucagguuacagggccaaucuucagccuucuauaucuaauuuauuauaccacuccugauuuauuuauuuuuauuuuuuuugccccaaauuuaaguauuugguaaaguggugguggucuuaaccuuuuuuuuuuuuuuuaauucauuggaaacagagauuguuuggagguuacaggagagaaggcuugauggggaaguccccaugaaagaggcuuuuuauagcuaagauccagguaaggcuugcaggaucauagguguggaauugagcugugcaggucguaaccuguaugaguucaccuagggugaucagacccugaaagagcagggcacacgaacucacggccgagugucucacuucagugggauguaucuauccacgaacucacggccgaguuucucacuucagugggauguaucuauccacgaacucacggccgagugucucacuucagugggauguaucuauccacgaacucacggccgagugucucacuucagugggauguaucuauccacgaacucacggccgaguaucucacuuuagugggauguaucuacccacgaacucccugccgaguuucucacuuuagugcgauguaucuauccaagaacucacggccaaguuucucacuuuggugggauguaucuauccacgaacucccugccgaguuucucacuucagugggauguaucuauccacgaacucacggccaaguuucucacuucagugggauguaucuauccacgaacucacggccgaguuucucacuucagugggauguaucuauccacgaacucacggccgaguuucucacuucagugggauguaucuauccacgaacucacggccgagugucucacuucagugggauguaucuauccacgaacucacggccgaguuucucacuuuagugggauguuaucuauccacgaacucacggccgagugucucacuucaaugggauguaucuauccacgaacucccugcugaguuucucacuuuagugggauguaacuauccacgaacucccugccgaguuucucacuuuagugggauguaucuauccacgaacucacggccgaguaucucacuuuagugggauguaucuauccacgaacucccugccgaguuucucacuuuagugggauguaucuauccacgaacucacggccgaguaucucacuuuagugggauguaucuauccacgaacucccugccgaguuucucacuuuagugcgauguaucuauccaagaacucacggccgaguuucucacuuuagugggauguaucuauccacgaacucccugccgaguuucucacuuuaaugaggauauaucuauccacgaccucaacggccgaguuucucacuuuaaugaggauguaucuauccacaaacucacggccaaguuucucacuuuaaugaggacguaucuauccaugaacucauggccaaguuacucacuuuaaugggauguaucuauccagugacuacaguauuuguguuugguauccagggcacucccuuccuuccagguaucacagaaccugggcaaccaaauugcuauuaagaaacuuucgcuaugugcaccggaagacaaagguccucuuuuccuugccuaaugcagccauggcucguggugccaagaagcaucugaagcggguagcagcuccaaagcauuggaugcuggauaaauugaccgguguguuugcuccucguccguccaccaguccccacaaguugagagagugucuuccccucaucauuuuccuaaggaacagacuuaagaagauuugcaugcagcgguucauuaagaucgauggcacgguccgaacugauauaacauacccugcuggguucauggaugucaucagcauugacaagacaggagagaauuuccaucugauccgugacaccaaagguugcuuugcuguacaccugaggagaccaaguacaaguugugcaaagugagaaaaaucuuugugggcacaaaaggaaucccucaucuggugacucaugaugcucgcaccauccgcuacccugaccccucaucaaggugaaugacaccauucagauugauuuggagacuggcaagaugaccgauuucaucacguucgacacuggcaagccauauauggugacuggaggugcucaccugggaagaguuggugugauccccaacagagagagguacccgggaucuucugacgugguucaugugaaagacaccaguggcaacagcuuuggcacucaaguuuccaacauuuucacuauuggcaagggcaacaaacgauggauuucucuuccccgaggaaaggguauccgccucaccauugcugaagagagagacaagagacuggcggccaaacagagcagcgggugaaaugguccgugggugacauguuagaucuuuguacguaauuaaaaauaauguggcaugauaaaacacacacacacacacacacacacacacacauuucuuagucagcauggaccaagaaacacaguggaugauuucaccuggguguuaguaaaguuggggaauuuuuccaacuucucuauugaauaugcuuuucuggugacugaaauauacuugcauucccagagacagcuucucuucucuuggaccugcugaaacaacacugucaggcucuuacuccccaaauugccuucucacucccugaagacugcuccugcccuccuaguaacuuacauguuaagcguauguuacagagcuuauauuucaaucuucuugagauuugaaagucuucuuugcuggaagcucaggcccucauuccauuaguaaagaccgucugaguaccuaguacugacugauagguguuuuauauggcccagcggcuucaucaccagaaggcacacuuuccucaccuuguucaaggaaaggugcugugcuuaccuccucuguccugugugcucaauacugaauugcuguuuggaucauuucauuugggguaaaaaaauaaaguucauuucaugcucacaacugaagguuuuauaacccugaguaaaguccaaagagaugccacauuaaauuuuaaaugccugguuggaaauuauuuuuauuuuguauugugagaauguuugcuaaccugagauuuuucccugcuucaucugcauucguuucuuacagagcuacuugcagaaguguuuuacaucuuucuugaccgucuuccuuucuuucuugugguuuuucaauguuuaggugaaagaaaucacccgugauauuaagcaauuagaucacgccaaacgccaccugaccaccucaaucaccacacugaaccaccugcacaugcuggcaggaggugucgacucccucgaguaagcaaugccaacuuucucuuuuggggccacgggaaauguaucgcauagagaaaaugguguugucgccuauuuacuucucagccaggaaagucucaccauccugccccacuuucugcaaauuggcuucaaguguucagucaccauuuuugcuuugugcccucugguguucagaaccuaacaaacacuggcagcuagucaaaaggggaccccagaagccuuucaggacgacuccaagaauauggcccaucuucaggcuguggcucuguaccaucaaggcagacagagugacacagggccauauucacuccaggcagacagagugacacaggcccauaugcacuccaggcagacagagugacgcgggcccauauucacuccaggcagacagagugacacaggcccauauucacucccugcugcuucugccucagcagguuuccugcuugcguugggcugaguugcacugucauggaagagacccuaugagacagaacucaaucauucaaaccacuuuuuuuuauaaaguagauuuccguuuggcuuguagagggaaugauacaucagaacauuagaaauagagaaggaagagcuggugauuuacuacaaaggagcaaucuaaagccuccuuuacuagcaagauucugacacuccagcucaccucuguggcccgucucaggcuggggacucccccugcuccagccucagugugauuccguauguggacagggaaagcgcaucgucauagaaacugagaugcagcauucaaaguccugggugggggaagugggagagugccuugagggaaagaggaggaggggcgggccccuuccugaccucucuagguauuggaugagcuccagggaugccugguccacucuccugugagcagugagagcagcggccagagggaggccagagggcggucacauuuguuccuucgugggguggucgguguccaccaaaccaucagaccaggcagugguaagacugggcggugguaagaccaggcggugguaaaaccagguggugguagcaacggaacaccuuggcuugaacuugauccugucuuuuucuuuuuucuuuuuuuuuuuuuuuuuugaguuggagucuggcucugucgcccaggcuggagugcaguggcgcgaucuaggcucacugcaagcuccgccucccggguucccgccauucuccugccucagccucccgaguagcugggacuacaggcgcccgccacuaagcccgguuaauuuuuguauuuuuaguagagacgggguuucgccguguuagccaggauggucucgaucuccugaccuugugaucugcccgccucggccucccaaagugcugggauuacaggcuugagccaccgcgcccggccaauccugucuuuuucaaugcuucuuauggaaaaucauaaauuacaaauuuaaugaaauaacccaacccuaaugaaaaauuuagaucuaauaguuuauauuuccucccuguguguaacuugauuuuaucagcauccuuuuauuuaagcgucauuaaccuuagcaguagggaaaguagaggucugugauacagacgccuuagaaccuacagauuucaguuaauagguaaagugcugcucuuuguguauuuuuguuuuuguuuuugagacggagucucccacugucacccuggcuggagugcaguggcacgaucucgggucacugaaaccuccgccucccagguucaagugagucucuugccucagccucccgaguagcugggauuacaggcauccaccaccacgcccagcuaauuuuguguauuuuuaguagagacgguguuucaccguguuggccaggaugaucucgaucucgugacuucgugaucugcccgccucggccucccacaguguggguaugacaggcgugagccaccucggccucccacagcgcggggaugacaggcugagccaccgcgccuggccgcacccuuuguguuugguuugcucauaggcuguaauccucagauaguaacaucccuaccccgguucucugucccaagcuugcuaaucccauaauauccaacccaaauucuaaauucaucgucuucccagauuccccuccccacaccaaaugagaauucaucacucacacauucuuccugccguagcacauaauuuguacuucuguuuagaacauaguucauccuuuuugauacuaguuagauguguacuugacucucucccuuacuauauggugucaccuugaggauuuggaccagauccuguuuuuuccucccacaacgcacagcagcuuauauacucagugcucagcgaacguugauucagcugaguugauaucuguuugagagcuagcguggguuguucugugucuguaucuugcgucuuuaguguuuuucuagacuuuuaaacuuauucuuuccuugcagagccaugaccaggcgaagacaauacggagaaguugcuaaucuccuucagggugugaugaauguccuggagcacuuccacaaguauauggggauuccgcagauccggcagcuuuccgaaagguaaacugucaccagagggaaaguauauggggauuccgcagauccggcagcuuuccgaaagguaaacugucaccagagggaaaguauauggggauuccgcagauccggcagcuuuccaaaagguaaacugucaccggagggaaaguauauggggauuccacagauccggcagcuuuccgaaagguaaacugucacuggagggaaaguauauggggauuccgcagauccggcagcuaaacuuuccaaaagguaaacugucaccggaagaagugaucuugcuuucagaaaaggaccuggugcuaggaagugcuuaagcacuuagcucagcguguucacugcagagucuuagugugugaaggaauaucagaugcuaccugaucuaacugucuggugcagacguucccccacuuuaccccuucccaugucuuccaaagcugccugugguagauaguuacaguuguauauauggacaacucucaguuguccccauuugugagagaaacuguucuagguaucuauuucuuuguaacaaaccagcacaaaacuuaguagcuuaaaacaauaauuguuuugcacguauaauuuggccuggcucggggaccagcucaucccugcuccgugcagcauuagccgaggcagcucaggaggggacuggagaaugcauuggcucacucucauggcuggcuccuuggugcuugcugucagcugggagcuuggccaggccguugcugggauucuuuguugucuuccacgggcugcuuggacuuccucacgguaagguggcugguuccaagaaugagcgucccaagagaaccaagccuuggaaauuucauagcaucacuucugccauagucacaaggcugcuaagauucaagaggaaggaacauagucuucucccacccacuaacgggaggaaugucaaagucacauuguuacaaaaagcaugugggaugggauagauugcuguggcggucuuuagaaaauacagugagccacggccggguaugguggcucacaccuguaaucccagcacuuugggaggccgaggcggguggaucacccgaggucaggaguucgaggccagccuggccaacauggcgaaaccccgucucuacuaaaaauacaaaaauuaucuggacaugguggcaggugccuguaaucccagcuacucgggaagcugaggcaggagucacuugaaccugggaaguggagguugcagugagcugagauccugccauuguacucuagccugggcgacagggugagacucaaaaaaaaaaaaaaauacagugaaccacaaaaacuuuagauacgauaaaaagaugacuuuccccccaaccuuauucuuuccuucuuauugcuguugaguuuuaaucccagauucagauccaguggaaaggaaaguaauuucucagagcgaaggaggaugaggauuccaagggaggacgaggaggaguugaugcaccaccuuuucuguuagaaggaggggcaggaagaacacugagaaggcagagaccgucacaauugacaaauucuaaccuuccuugcagcaaagaagaaaugaaggcguuguuacugagcagcagcuacguuucugacucugccuucuuaauaaggcccgaaugcuacaggcuucuuuguuuuccuuaaguuuccuuauuuguaauuauauaaguaauacacauagacuuuaaaaaauagagacagggucucacucugucacccaggauggaguguaguggcagaauuacugcucacugcagcuuggaacuccugggcucaagugauccucccaccacaguuucccaagcagcugggacuacaagcacgcagcaccucacccaacuaacuuuguuacuuuuuuguagagacagggucucacucuguggcccagggcuggucuugggcucccagugcaucgggguuacaggcgugagccacugcaccugguuccacaucuucuauuguuuaaaaaggucaaauauguauacaggugaaaccuaaguucccuuuaccuagacuucagaaucccauuguuguccucagaggugguaauuguuaucaguuuaauggcuaucacugcggauuuguguguguguauuuacguaaaucuguaguuuaauggcuaucgcuccggauuuguguguguguauuuacauaaaucuguaguuucaguggcuaucgcucuggauuuguguguguauuuacauaaaucuauaguuuuaauccuaucucuccggauuuguguguguauuuauauaaaucuauaguuucaguuaauggcuuuguuuuugcuuuguuuuguuuuaacuaaaugguuucaugccuuacgcuuuauucuaaaaacugcuuuuuguuuucaaccacauguauuuuagauauuuuuuuucucaucaguauguauaaaccugcuucauucucuggaauugaugcacagaaccccauagcgugacauaccacagauuauuucaccauuuugguagcacuaggucguuguuucuaauucuuaaaauaugcccccuuuugcacauaugcaaguauuucucugggacagauucuggguuauagguuuguauacauuuaaaauuuuaguagcuacugcccauuugcccuccagcaaagcuuuauauacuuguaguacgaucuguacuguaugagagcacccuuacccucagcaacacuugauauuguuguuuuucauuuuuaucuaucuuaugguugaaaacgguauccgguuccuuuaauuuucauuuuccuuguagcuaguaagauuaguguuuuguuuuguuuuuuugagacggagucuugcuguguugcccaggcuggagugcaguggcguggucauagcucacugcaaccuggaacuccugggcucaaaccauccuccugccuccaccuccugaguagccaggaauacaggcaaauaccaccaugccuggcugauuuuuaacauuuuucuguagaggugggaucuucuuauguugcccagguuggucuucaacuccugggcucaagugauccuccugccucauccucccaaagugcugggauuacaagcgugagccacuguaccuagccccaguugucuucuuccucuaaacacucaugaguuucucauacucuaagaaauuauucuccuuuauuccuuucuuugaguagucucuacaacuuggucucugcauucuuuccuuguggaauucuuguuacgugaacguuggaucuucuagaucugcugccaugucucuuaauuuuccuuucaugcuuucugucucuuuguccuuuugaacugcuuucugaaagaauuccucaacccagucuuccuauuuuaauuuauucuucacuugcauccauugugcuauuuggcccagcuguugaauuuuuauuuuaaaaauccagcuuuuuaauuuccagcauaucuagcugauucuuuucucaugggcauaauauucucaugucucucccacggaauagaaauuauguguuuguuaaagcacuggguugccuguuccauuucucuguccuacaguguacaaucuucagugccuguuccauuccucuguccuccaguguaagaucuucagugcguguuccauuccucuguccuccaguguaagaucuucagugccuguuccauuucucuguccucaaguguaagcucuucagugccuguuccauuccucuguccuccacuguaagaucuucagugccuguuccauuccucuguccuccaguguaagaucuucagugccuguuccauuccucuguccuccaguguaagaucuucagugccuguuccauuccucuguccuccaguguaagaucuucagugccuguuccauuccucuguccuccaguguaagaucuucauugccuguuccauuccucuguccuccaguguaagaucuucggugccuguuccauuccucuguccuccaguguaagaucuucggugccuguuccauuccucuguccuccaguguaagaucuucggugccuguuccauuccucuguccuccaguguaagaucuucggugccuguuccauuccucuguccucuaguguaagaucuucggugccuguuccauuccucuguccuccaguguaagaucuucggugccuguuccauuccucuguccuccaguguaagaucuucagugccuguuccauuccucuguccuccaguguaagaucuucagugccuguuccauuccucuguccuccaguguaagaucuucagugccuguuccauuccucuguccuccaguguaagauuuucauugccuguucauuccucuguccucuaguguaagaucuucauugccuguuccauuccucuguccuccaguguaagaucuucagugccuguuccauuccucuguccuauaguguaagaucuuagugccuguuccauuccucuguccuccaguguaagaucuucagugccuguaccauuccucuguccuccaguguaagaucuucauuaccuguuccauuccucuguccuccaguguaagaucuucagugccuguuccauuccucuguccuauaguguaagaucuucagugccuguuccauuccucuguccuccaguguaagaucuucagugccuguuccauuccucuguccuccaguguaagaucuucaguuuguucagcauggcaauucuuucucuuuagcauuucucaaauguuuagugauucuuagcugaaaccucauuuuuauuuuauuuguuuauuuuuugagaccaagucucacuccaucgcccaggcuggagugcaguggcacaaucucagcucacugcaaucgccgccuccuggguuuaagcaauucuccugccucagccucccaaguagcugggacuacaggcgcccaccacccaugcccagcuaaguuuuguauuuuuaguagagacaggguuucaccauguuggccaggcuggucucgaacucuugacaccucaagugauccaccugucucagucucccaaagugcugggaugacaggugugagccaccgugcccggccuuauuuuuauuuuugacauucucuauuagucugaucaagaaugcucuuuuacugcuaccugcucgugggcgagaaaugggaauugcuacuuggcuaaguguaucacagacagcuuuuccaaagugaggggggccagaccuggagaaaccugccaggugggugucccagcagcugaucuccuaggcuuggaggcucccuggucuucuuggguguuggccgccccucuggcuacugcugaaguucucagacccagaggcccaccccugccgccugacgugagcauucacgcauucacggugugggugcagacacggacagcggccccauccugcuccugguaucgccaccuucaugucuuucauuuucgagaagcauuuuugggcagugauuuucugucauccuuccuaccaggaaguccucaggcuucuaguauaccacuuuucuugucuggauuuggauuuucaugaaaaucuuuuuauuauuucugacgcuccggggcaggaaugggagguugcaacgugugcucagugugcaucuugccgagcuuggcagaacgcuagggaaaucgccacccuuucccucauccuuccuaccccucacaccuagagccagcugaucaccuuaucagacuggacugugaggcagccaagaaagcaggcgaacaggacuuuaugagcugcaagaaagaaggagccuggauggagcaggcagauuugcugucagcggaugggggaggaggaaggcagucccuucuaccccugcucucaggaugauucagaguugaucucuuucauauucauuuguucuuuucuucauuugcaugauagauauuuacucugcauuuucuacauccuaggccccgugcuggggacugaaggcacaaagauaagaaauacacacucucugccuucaaagaguucaccauuuuuguauggagaagaaagacauuaauagaagauuccaguauaacagauguaacaaaacugguauaugcuguacaaggcauagcaggaucucagaagaggaauugauaggcugaagcaggggcugagggcaggggucauagacaaauucuguuuuaaucugaaucuuaaaagaaugggugggaucuuaccaacgugacaguaaugggggaaagaaggaagagggagucucauggaguuuggaggcagcagagggagacagggcugcauagguagaucgggucagguuuuauaugccuugcuaaauaauuuauuuuuuauuuuguggacagugaaagauuuuaagugcggggggcaugaucucacuuguauuuuguaaaagucuaguggauuauagagguacaggagucuggauaaaauaagacccuuaggaggcaguggccacgcggucacggagaugugugugggagccgaucuccaguccgugauauggauuagaaaagauaagacccuuaggaggcaguggccacgcggucacggagaugugugugggagccgaucuccagucagugguguggauuagaaaagauaagacccuuaggaggcaguggccacgcggucacggagaugugugugggagccagucuccaguccgugauauggauuagaaaagauaagacccuuaggaggcaguggccacgcggucacggagaugugugugggagccgaucuccagucagugguguggauuagaaaagauaagacccuuaggaggcaguggccaugcggucacggagaugugugugggagccagucuccaguccgugauacggauuagaaaagauaagacccuuaggaggcaguggccacgcggucacggagaugugugugggagccaaucuccagucagugguauggauuagaaaagauaagacccuuaggaggcaguggccacacggucacggagaugugugugggagccgaucuccaguccguaguauggauuagaaaaaauaagacccuuaucaggcagaggccacgcggucauggagaugugugugggagccgaucuccaguccgugguauggauuagaaaagauaagacccuuaucaggcagaggccacacggucacggagaugugugugggagccagucuccaguccgugguaugaauuagaaaagauaagacccuuaucaggcagaggccacgcggucaccgagauguguguaagagccagucuccaguccgugguaugaauuagaaaagauaagacccuuaucaggcagaggccacgcggucaccgagaugugugugggagccagucuccaguccgugauauggauuagaaaagauaagacccuuaggaggcaguggccacacggucacggagaugugugugggagccagucuccaguccgugguaugaauuagaaaagauaagacccuuaucaggcagagaccacgcggucacggagauguguguaagagccagucuccaguccgugauauggauuagaaaagauaagacccuuaggaggcaguggccacacggucacggagaugugugugggagccuaucuccagucgguauaaaggaagggguugugcauggcaggaacaugacagaacuaacuuuuauuuggcagaaaccagcauagggauucguuaauaacucaaaauggaucuguaaccuagauguaaaaccuaauucuaaaacucuuagaagaaaacgaagaccagaucuucacaccacuguauuuggcagcaguuucuuggauaugacaccaaaguccuaggcaacaaaaggaaaacauagauaaaugggacuuuaugaaaaauuuuaaaacuugugcaugaaaaaacacuaucagcaggguaaaauggcaaugcacagaaugggaagaauauuuccaaaucauuuaucugauaauggauuaauaucuagaauauauaaagaauucccagaaaucaacaacaaaaagccaaacaacucaauuaaaaaaccagcaaaggauuugaauaagcauuucuccaaagaagauaaauaaauggccaauaaacaugaaaagaugcccccguuaggacgugaagugacacugcauugugguuuccaccugcauuucuccaacaggcuuuuuagguugauguagucccacuuguuucuuuuugcuuuugcugccuguacuuuuggugggcucuuugcuuuucaacauuuguuuaaagagguaguuuuaaaaauuugaaggaacuuaauaaucacuguuauaaucacauuccugaaaaauagaaaguccaacauucuaugaauauauuucagugcuccaaacauucauuaucacauaagguugcugcaaacacaggaggauuuacuuaucuuuuaguucauuucgcaaucucuauuugcaauaauuuuguguagguuaauacagaauaugugcuauuaaguaacacuaaaaaggcugggcaugguggcucacaccuggagucccagcacuuugguaggcugagacaggcagaucgcuugagcucuggaguucaagaccagccuggacaacauggugaaacccugucucuaccaaaaauacaaaaagugagcugguguggugaugugugccugugguuccaguuacuugggaggcugaaaugggaggaucacuugagcuccggaaguggaggcugcagugagccgagacugugccacugcacuccagccugggcaagaaagcagacccgucucgggggaaaaaaaaaaauaacacuaaaaagagcacaagaggagacaacuucuuauuuuuauuuucagugcuugacuaggauuguuuuuuuaagagguacuaaacguuugagaaaaguccagacuucuuauuuuuagcauccuuucuggugaauuugcuucccuuauguuuacgugcugaugguagaaccaucuggaaaugagagaaauagcuauuuguuguaaggggcgggagauggcaggcggguuaccacccucugcauugcuuccguuucucaaauuuacugucuugcugucuguaaaguguagaagucaugugaaaaguuguguucugaaaucuuugccuguacauuugaaauaggaaguucaugagccuugauuugagcauagcuaauucuuccaacuacccuucuggcaaaugcuuccaugcuuaauguagcauuggaggaaagaguuuuuucuuuagcaucuuuacauuucaaauccuccuggccuaagcauauccgugaaagggaauguuucuagucaucagucaguaucucccaaugaagaauggaagagccuuacauucucuugaaaaccaugaaacucuugaacgaaaauauauuuuucacagccauuucuaaccucuuauaaaugugagaaaggcuuggcaggucucaugauggagugaaaaaagaacucaaccuggaaauggacaggccugcacagcucuauggccucgacaaguuccuccugggccuccuggguugacacguaugaguguuguccucgguuuccaaguaugaguguuguccucaguugccaaguaugaguguuguccuugauuuccaaguaugaguguuguccucgcuuuccaaguaugaguguuguccucacuuuccaaguaugaguguuguccucacuuuccaaguaugaguguuguccucgcuuuccaaguaugaguguuguccucgcuuuccaaguaugaguguuguccucgguuuccaaguaugaguguuguccucgguugccaaguaugaguguuguccucgguuuccaaguaugaguguuguccucgguuuccaaguaugaguguuguccucaguugccaaguaugaguguuguccuugauuuccaaguaugaguguuguccuugauuuccaaguaugaguguuguccucgcuuuccaaguaugaguguuguccucgcuuuccaaguaugaguauuguccucaguugccaaguaugaguguuguccucgguuuccaaguaugaguguuguccucaguugccaaguaugaguguuguccucgguuucccaguaugaguguuguccucacuuuccaaguaugaguguuguccucacuuuccaaguaugaguguuguccucgguuuccaaguaugaguguuguccucaguugccaaguaugaguguuguccucgcuuuccaaguaugaguguuguccucgcuuuccaaguaugaguguuguccucgcuuuccaagugugaguguuguccucgguuuccaaguaugaguguuguccucaguugccaaguaugaguguuguccuugauuuccaaguaugaguguuguccucgcuuuccaaguaugaguguuguccucgcuuuccaaguaugaguguuguccucgcuuuccaaguaugagaguuguccucgguugccaaguaugaguguuguccucgguugccaaguaugaguguuguccucgauuuccaaguaugaguguuguccucgauuuccaaguaugaguguuguccucgcuuuccaaguaugaguguuguccucgcuuuccaaguaugaguguuguccuugauuuccaaguaugaguguuguccucgcuuuccaaguaugaguguuguccucgcuuuccaaguaugaguguuguccucgguugccaaguaugaguguuguccucgguugccaaguaugaguguuguccucgcuuuccaaguaugaguguuguccucgcuuuccaaguaugaguguuguccccaguugccaaguaugaguguuguccucaguugccaaguaugaguguuguccuugauuuccaaguaugaguguuguccucgcuuuccaaguaugaguguuguccucgcuuuccaaguaugaguguuguccucgguuuccaaguaugaguguuguccucaguugccaaguaugaguguuguccucgcuuuccaaguaugaguguuguccucgguuuccgaguaugaguguuuuccucgcuuuccaaguaugaguguuguccucgcuuuccaaguaugaguguuguccucgcuuuccaaguaugaguguuguccucgguugccaaguaugaguguuguccuuggugaucucagaagugucucauggggucacucaagauucuaggcugagauucuuuauggugucuguuuggaacuguagcauuugacuaauuaacccugcuguuuagaagacugugguuugggagggcgguauauuuauuugggaacuguuggggguguuuucuuugggacugucacucacaagguaacaaaagucucagggcuacuuuauccacagauaucugaacaauguucauaauuugcugucugucugugacucccccuuacgaaaagcugagaacacuuuuaggaaagggugccuuggaacagcccugcagucacguggcauggaggaugccagaaaccaccugguugacuuuccuuucugggcagcacaaugaaucuuuuguuucugaagagugacccauuugggguugccaccaugcaacaggcugaacuuacguggaugccaggaggaauuuuuguuuucccuguucucuaugaguuguaggcggacuuucacaagaauggcuaggaaaucaguugggcacaguggcucaugccuguaauccuagcacuuugggaggcugaagugggcagaucgcuugagcccaggaguuugagaucagccugggcaacauggcaaaacuccaucucuacaaaaaauacaagaauuagcugggcauggaggugcacaccuauagucccagcuacucaggaggcugagagaagggaggaucacuuaacccugggagguugaggcugcagugagccacaaaugcaccacuguacuccagucugaaaagaaaggaaugacuaggaaaucuugguaguuuggcacauauaugugcuuugcugacaguuaucaguugagcuaccucuuuguagugggaaccuuuucaugguuagaagaggaaggaguuuaaaggaaugaggccaaagauaaauucuuucaagucuguugacuucuuucuagaauccuauuuaagcaauugcuuauaaagacugaaauucacaucuuacccugaaaaugcaugggauugagguuugggucuauagauaccaucagugaugucuguaagggaauaguugcuuucaucugagucauugauagccacuucacaaacugcuauugguagaggcugggcgcagugacucacgccuguaaucccagcacuuugggaggccgagguggguggaucaccugagaucaggaguuggagaccagccuggccaacauggugaaacccugucucuacuaaaaauacaaaaaauuagccaggcgugguggcaggcgccuguaaucccagcuacuugggaagcugaggcaggagaaucccuucaacccaggaggcggagguugcagugagccgagauuaucccauugcacuccagccugggagacaagagugagacuucgucucaaaaaaaaaacaaagaaaaaaacugcuguuggaaacauugacauuuauaugcguauccuucugcuccaggauuaagcauacaucuaaccucuagccaccuguaaagccaguuagcaccguaagauggguguuguggaauaaucaguacuggagaggacacagaaucaucuaguaugggcugcuagccccacccucuuauuucacagcuauucaaaguugugacccacagagaggaagugacuugugauuaugcggcucacuaguaacauaaccagguccagccuaucucaagaggugacuuugaaaaugaagaacauggcgacauaggcaguucuaagauggcugaauaggaacagcucuagucuacagcucccagcuugaacgacgcagaagacgggugauuucugcauuuccaacugaguuaccagguucaucucauuggggcuugucggacagugggugcaggacagugggugcagcccaccaaacaugagcugaagcagggcagggcaucgcgucacccgggaagcgcaaggggucagggaauucccuuucauagacaagcaaaggugugacagacggcaccuggaaaauugggucacucccacccuaauacugcacuuuuccaacagucuuagcaaauggcacaccaggagauuauaucuggugccuggcucggcgggucccacacccacggagacucgcucauugcuagcacagcagucugagaucaaacugcaaggcggcagcaaggcugggagaggggcgcccgccauugcugaggcuugagcagguaaacaaaguggccaggaagcuggaacuggauggagcccagcacagcucaaggaggccugccugccucuguagacuccaccucugggggcagggcauagccaaacaaaaggcagcagaaacaucugcagacuuaaaugucccugucugacagcuuugaagagaguagugguucucccagcacagaauuugagaucuaagaauggacagacugccuccucaagugggucccugacccccgaguagccuaacugggaggcacccuccaguaggggcagacugacaccucacacagccacguaccccucugagacgaagucaggcagcaacauuggcuguucagcaguauuugcuauucugcagccuccgcugcugauacccaggcaaacagcaucuggaguggaccuccagcaaacuccaacagaccugcagcugaggguccugacuguuagaaggaaaacuaacaaacagaaaggacauccacaccaaaaccccaucuguacgucaccaucaucaaaaaccaaagguagauaaaaccccaaagauggggaaaaaacagcagaaaagcugaaaauucuaaaaaucagagcaccucucccccuccaaaggaacaaagcaccucgccagcaauggaacaaagcuggacggagaaugacuuugacgaguugagagaagaaggcuucagacgaucaaacuucucugagcuaaaggaggaaguuugaacccaucacaaagaagcuaaaaaccuugaaaaaagauuagacgaauggcuaacuagaauaaccagucuagagaaguccuuaaaugaccuaauggagcugaaaaccauggcacaagaacuaccugacgagcgcacaagcuucaguagccaauucgaucaacuggaagaaaggguaucagugauugaagaucgaaugaaugaaaugaagcaagaagagaaguuuagagaauaaagaguaaaaagaaaugaacaaagccuccaagaaauacgggacuaugugaaaagaccaaaucuacgucuuauugguguaccugaaagugauggggagaauggaaccaaguuggaaaacacucugcaggauauuauucaggagaacuuccccaaccuagcaaggcaggccaacauucaaauucaggaaauacagagaacaccacaaagauauuccucgagaagagcaauuccaagacacauaacugucagacucaccaaaguugaaaugaaggaaaaaaauguuaaaggcagucagagagaaaggucagguuacccacaaagggaagcccaucagacuaacagcggaucuuucggcagaaacucuauaagccagaagagagugggggccaauauucaacauucuugaagaaaagaauuuucaacccagaauuucauauccagccaaacuaagcuucauaagugaaggagaaauaaaauccuuuacagacaagcaaaugcugagagauuuuuucaccaccaggccugcccuacaagagcuccugaaggaagcacuaaacauggaaaggaacaaccgguacuagccacugcaaaaacaugccaaauuguaaagaccauccaugcuaggaagaaacugcaucaauuaacgagcaaaauaaccagcuaacauuauaaugacaggaucaaauucacacauaacaauauuaaccuuaaauguauaugggcuaaaugcuccaauuaaaagacacagacuggcaaauuggcucaagagucaagacccaucggugugcuguauucaggagacccaucucaugugcaaagacacacauaggcucaaaauaaagggauggaggaagaucuaccaagcaaauggaaaacaaaaaaaggcagggguugcaauccuagucucucauaaaagagacuuuaaaccaacaaagaucaaaagagacaaagaaggccauuacuuaaugguaaagggaucaauucaacaagaagagcuaacuauccuaaauauauaugcacccaauacaggaguacgcagauucauaaagcaaguccuuagaaacuacaaagagacuuagacucccacacaauaguaaugggagacuuuaacaccccacugucaacauuagacagaucaaugagacagaaaguuaacaagaauauccaggaauugaacuagcugugcaccaaacggaccuaauagacaucuacagaacucuccaccccaaaucaacagaauauacauucuucucagcaccacaucgcacuuauuccaaaauugaucacauaguuggaaguaaagcauuccucagcaaauguaaaagaacagaaauuauaacgaacugucucucagaccacagugcaaucaaacuagagcucaggguuaagaaacuaacucaaaaccacucaacuacuggaaacugaacaaccugcuccugaaugacuacuggauacauaaugaaaugaaggcagacaugaagauguucuuugaaaccaaugagaacaagauacaacauaccagaaucucugggacacauuuaaagcaguguguagagggaaauuuauaacacuaaaugcccacaagagaaagcagaaaagaucuaaaauugacacccuaacaucacaauuaaaauaacuguagaagcaagagcaaacacauucaaaagcucgcagaagucaagaaauaacuaagaucagagcagaacugagggagauagagacacaaaaaacccuucaaaaaaaucaaugaauccaggagcugguuuuuugaaaggaucaacaaaauugauagacugcuagcaagacuaauaaagaagaaaagagagaagaaucaaauagaugcaauaaaaaaugauaaaggggauaucaccacugaucccacagaaauacaaacuaccaucagaaaauacuauaaacaccccuaugcaaauaaacuacaaaaucuagaagaaauggauaaauuccuggacacauacacccucccaagacuaaaccaggaagaaguugaaucccugaauagaccaauaacaggcucugaaauugaggcaauaauuaauagccuaccaaccaaaaaaaguccaggaccagauggauucacagccgaauucuaccagagguacaaggaggagcugguaccauuccuucugaaacuauuccaaucaauagaaaaagagggaauccucccuaacucauuuuaugagaccagcaucauccugauaccaaagccuggcagagacacaacaaaaaaagagaauuuuagaccaauaucccugaugaacauuggcacaaaaauccucaguaaaauacuggcaaaccaaauccagcagcacaucaaaaagcuuauccaccaugaucaagugggcuucaucccugggaugcaaggcugguucaacauaugcaaaucaaaaaauguaauucaucauauaaacagaaccaaagacaaaaaccacaugauuaucucaauagaugcagaaaaggccuuugacaaaauucaacagcccuucaugcuaaaaacucucaauaaauuaggcauugaugggacuuaucucaaaauaauaagagcuaucuaugacaaacccacagccaauaucauacugaaugggcaaaaacuggaagcauucccuuugaaaacuggcacaagacagggaugcccucuuucaccauuccuauucaacauaguguuggaagaucuggccaaggcaaucaggcaggagaaagaaauaaaggguauucaauuaggaaaagaggaagucaaauugucccuguuugcagaugacaugauuguauauuuagaaaaccccaucguuucagcccaaaaucuccuuaagcugauaagcaacuucagcaaagucucaggagacaaaaucagugugcaaaaaucacaagcauucuuaugcaccaauaacagacaaacagagagccaaaucaugagggaacucccauucacaauugcuacaaagagaauaaaauccaacuaggaauuugggaauccuaggaauccaacuuacaagggaugugaaggaccucuucaaggagaacuacaaaccacugcucaaugaaauaaaagaguauacaaacaaauggaagaacauuccaugcucauggauaggaagaaccaauaucgugaaaauggccauacugcccaagguaauuuauagauucagugccauccccaucaagcuaccaaugacuuucuucacagaauuggaaaaaacuacuuuaaaguucauauggaaccaaaaaaggucccgcauugccaagacaaucuuaagccaaaagaacaaagcuggaggcaucaugcuaccugacuucaaacuauacuacaaggcuauaguaaccaaaacagcaugguacugguaccaaaacagagauguagaucaauggaacagaacagagcccucagaaauaauaccacacaucuacaaccaucugaucuuugacaaaccugacaaaaacaagaaauggggaaaggauucccuauuuaauaaauggugcugggaaaacuggcuagccauacguggaaagcugaaacuggaucccuuccuuacaccuuauacaaaaauuaauucaagauggauuaaagacuuaaauguuagaccuaaaaccauaaaaacccuagaagaaaaccuaggcaauaccauucaggacauaggcaugggcaaggacuucaugucuaaaacacuuaaagcaauggcaacaaaagccaaaauugacaaaugggaucuaauuaaacuaaagagcuucugcacagcaaaagaaacuaugaucaaagugaacaggcaaccuacagaaugggagaaaauuuuugcaaucuacucaucugaugaagggcuaauauccagaaucuauaaauaacucaaacaaauuuacaagaaaaaaacaaacaaccccaucaagaagugggcgaaggauaugaacagaugcuucucaaaagaagacauuuaugcagccaacagacacaugaaaaaaugcuaaccaucacuggucaucagagaaaugcaaaucaaaaccacaaugagauaccaucucacaccaguuagaauggugaucauuaaaaagucaggaaacaacagaugcuggagaggauguggagaaauaggaacaauuuuacacuguuggugguaauguaaacuaguucaaccauuguggaggacaguguggcgauuccucaaggaucuagaacuagaaauaccauuugacccagccaccccauuacuggguauauacccaaaggauuauaaaucaugcugcuauaaagacacaugcacacguauguuuauugcggcacuauucacaauagcaaagacuuggaaccaacccaaauguccaucaaugauagacuggauuaagaaaauguggcacauauacaccauggaauacuaugcagccauaaaaaaggaugaguucaugucccuuuuagggacacagaugaagcuggaaaccaucauucucagcaaacuauugcaaggacaaaaaaccaaacacugcauguucucacucauaggugggaauugaacaaugagaacacuuggacacaggaaggggaacaucacacaccggggccuguugugggguggggggaggggggagggauagcauuaggagauauagcuaauguaaaugaugaguuaaugggugcagcacaucagcauggcacauguauacauauguaacgaaccugcacauugugcacauguacccuaaaacugaaaguauaauaauaaaaaaaaauaagguguacauaauaauuuaauguaaaaaaaugaaaaugaagagcauggcaaggaagucuacaaaucagagacugguaauuuuuccucuuuuuugucucuggugauaccaggugcugucacaggcucugguucuccuuucugccaccucaguuccagagucaccaagaauucagaguagggaauaguuugggccagaggcucuccuuucugccaccucaguuccagagucaccaagaauauggaguagcaaauaguucgggccaggggcagagccgggcccaccagugucauugagauggccaguaguccugagaaugugacugugggugcccuggcuagcggcuggacuuccccugugaggagaacuccuuccucuucuaaccaugaaaaguuccuacuauaaguucccuguggcuuaggagggaacuggugcugugugugugcuuccaagaagaggguaggaacagggggggccugagccucuggaagcuguccugugaccuggcaccacagcaggcugugugcugccuccucgugugcgcaucacaagaagcuccgaaguacaauuuuauucuuuucucucaugucaaaguucacgcugaaggaaugucucccauugucugcuggacagcucuagacguauggcccugauuccaaucuggagguggcggcuauuccaguaauagccucgucuggaucauucuggccuccuugaaaacugacucaaaaggcuacaaacccaccucuaagagugguuuuaaaaguuuugaagauacuggaaaaaccuuggaaaguauuuggaauaagguauaauuguaaccacgccacggaaaaaacagauuguuuugggucaugccuauccccucaucugaaaaaaaaucucagcagguugccagacacuccuuagcagccaaagaaauugugguuuugagcuguugcuauuucuagaaacuucauaaaguuaauucugaaggaacaggguggagaccgagaauggaagugugcucuuuuaaggcauuuuuagcaaccagacaguauuugccucaggcucaggaagcccagcagggccugagaaucuuguuccacucucucucugcaaggcuggccggugcacgguggccaccaacaucaggcagcucgugggggaugcacagcaugcgaucgauuguggggcgugaucgauugcgggacgugauugcggggccugauccauugcggggcgugauugaucgugggguaugauccauagccgcuuuccauccuagccgcuucuccuuucugcccuugcauucaaguacacgcacaguucuugagcuccuaguacacucacggccacuguugaguacuggccuccccuuucuagcugguuuuccuugcaguuccguuuucauauucacaaacuucugaacuuaaauggucacucaguggcccucacuagugaucauuuagcaguucauuuugucacuuggcucuuuuuguuuuuaccuuagaaaacauucuuuucauuuauuuguuuaaaaacuuaacgagcuuguugguuucuggguuaacaggaaacccaaaacacugcagcugcauggauugaacuggacgugaugugaaaugaaauaagccagacacgggaagacagauuccucauguucucacucaugugggugcuaaacauuuucaaaguaaacucauggagauagcgaguagaacgcugggucccagaggcugggaggcauagcagggaggcggggaguaacugggauggcuacugggcacaaaaauacaguuagaaugauacgaucuaguauuugguagaacaauagggugacuacgguuaauaauuuauuguuuauuuaaaaauaacuaaaagauuggaauuggaauguuccuaacacggagaaguaacaaauaacuuggggugauugauaacccaguuacccugauuugaucauuauacaucguaugccuguaucaagacuucacagguaccccauaaauauauauauaaugauuauauacccauaauaauuuuuuacaaaacacccuaaaacauuauggagcccucuugccauucuguacuccaaggaguaggacagcaguuacaccaguaauccaaaguggauuuauuuguuguuguuuguuaguguuuuguuuuagagccaaggucucccucugucacccaggcuggagugcuguggugugaucauagcucaguguaucuucaaaaguccugggcucaagagauccucccgccgcagccucccgaguacaggugugugcccccgcaccuggguacuuuuuauuuuaguuuguuuuucguggagacuggaucucucuaauguugcccaggcugguuuugaaauccuggucucaagcgacccucucacgucagcuucccacaugcugggauuccaggcgugaaccacugcgcccagcuagauuuauauuugauguggaugugauucuauaacauuuucccacagcaugacuaucccccaguggaacuguauaaagauuaauacauaugaccucagguaaaggguuggccuagaagaauuuuggggauauagaagauucacccugagaauaucuuggaugccuggguccugcucaucaaccugucacuuaacuaguaugugaccucucaccucauggacgucucuguacccuuccuggccuuucucgaaagacuucagcccuuccgacccuguggaucgguguguaguuacauaaggauaugaugccaggugaugauauguucucucuuccucacagagugaaggcugcacagacugaguuaggacagcaaauccuggcagauuuugaagaagcguuuccuucccagggcaccaagguacugcuuugcguuuccccagucuuuagagaugaucaccauccuugccgagcucacgcucaccccagucaccaugugguuaucauuccagucaugcucgcuggcagcugcaaauccuucugcugcagguucaggguaaugagaccacccuggauuuuaaaugucccuaggugguggcaguuccuccucuguuuccuuccagccucagaaagagaggauuuguuugggcuuaauuugauguaggucucaaaccgucuaucuuguaugcccugucaauuccuuuuuucucauggcuguauuuaaaagaaaucuucaugccgcgguguuuuuaggauuguuacauaacuuacugguuuugguuuggugaaaagacaacuggguggagcauccaccaucuuauguaacucucagagugauauagugaggagccucacuguuacugaccauaagccugcucuucggaauucaugcccuugagcucucucugguagcagagcuguuuguguugugucugcaaagcccacagcauuucacuugggagcuguugguugcacuucucauguaacaagcugccauccugcuuggggaacugcuuuuagcuccacccuuccaacuguagcagaugccaucuuagcgccuagcaugugucggacaggaaagaacccauacgagacuuuuucucuauuguuugagcuauuucaagagaaagaauuguucaaggcagaaauauacugaagcacuuaggggcaaggagccucacccuacucgguggguagagauggggacauacauucauuuacugauccaaggaacauuuccugcaucugcucuguaauucaauaacuggaaauaucuuaauuauuuuuucuuuguguuccauaaaagaaauguaggaaguaagugggaguagcggccccagcuuuugcccaucacuuucuauaggaagcccgcuccugauuuuaaugucuucacauuuuguggcugucugcuaguaaucagaugcuuauuuguaaagcacuuuccuuggagaaccucauauuccuuagucaucugauauaacugcagggagggaguagauauuggaaagccauuaguccuauuuauuacaugaggaaaaugaaggucaaagaagugaaaagggauuguggggauauucgcucaugagaagcacugggcucuucuuaggacaagguuagccucacguguacucagcugcccguuucagguuuuuuuuuuuguuuguuuguuuguuuuuuuuuugacggaguuucacucuuuggcccaggcuagagugcaauggugugaucucagcccacugcaaccuccgcccccuggguucaagugauuccugccucagccucccaaauagcugggauuacaggcaccugccaccacaccuggcuaauuuuuguauuuuuaguagagacgggguuucuccauguuggccaggaugguuucgaacucccaaccucaggugauccgcccgccucggccucccaaagugcugggauuacaggcaugagccaccaugcccagccacucauuucaguuucuagaaguuucaggaagauguggaugaagcccaucuuuauuguuuagaagaggccugcuuuauauuuuuuuucccagauuccaccgggcagaugaaauuaaaaugguucucuuuaacaacaugccucccuuuucucuggcauagugacuucgugugugugugugugugugugugugugugugugugugguuuuuuuuuuguuuuguuuuuaguuuucuuuucuuuucuuuuuuuugagauggagucuugcuccguugcccaggcuggagugucguggugcgaucucggcucacugcaagcuccaccuuccgaguucaugccauucucuugccucagccuccugaguagcuaggacuacaggcacccgccaccacgccuggcuaauuuuuuuguauuuuuuuuuaguagagaugggguuucaccauguuagccaugauggaucucgaucuccugaccucaugaucugccugccuuggccucccaaagugcugggauuacaggcgugagccaccgcucccagccuaguuuucuuuuuaaagacuaugggcuuuucuuaaaggccuuguguuacuauuuccauuucacaagugggaauuaagauuuuuaaaaauuuuuccaaggcacaaccuaguaaacucuuuguaaaugaaaaaaucugaacccgugaacccauagguuuuggcaucuaugacuucucuaucaggucacuuucauccugaagugagaauugagaaguuaggguguucagcagaugacauaaaaaccacucagcauggaguaagucaacauuuuaaaaacucaggucucaggcagcuuauauaacacuuuagaagcguggaacuucaguugagauggguggaauuggaaagaguugacaaaaaauaaagauuuagaagaaccuuacuuaucaccuaaagucuauuauuuuucauaugaggugagcaagugcuccaaagcuacaugcauggcuuuuuagccaagccaggaguagauuccaaguguucuuuuuacuguaguccacuuagccagucauguucacucagugacguacuguaaagaaagucucagcaaaacuuuggucauugaauugcuuuugguaacaaagaccuucccgucgugaugcgucaguacagcgccugguaucuuuccaguguucgcucaggucaggaggccaguaucacagcauuuucucuuuggcugccuuucuagguaguucacuauugugaaacacaugucguggcuuggaaccugguuuuauguguuaagggagaccacacuauuuggcaaaaacauagcacuuuaagaacaggaaucccagagguuggagucagggaagaguggcacauguggagugaggcugguggcauuccaacucuuaggagagaggcugguggcauucccacucuuaggccucuucagcagcaucuugcgacaucagagaccaguggcauucugacuuuuagaucucuuucaguuuugguuugcagaaagucaaauuucccgugaucauuacugcccauuucccaaaauaucucauugcagauucacaggguaguuuuucugucgcuugcuguaaaacgaguguaaggauuccauccucgaggagcagcagguaacugacagauccagccacagcagaaagaaugagugugaaggagcaggaguaagacugacaaugcguagagauaacaaguaguggcugugagaagccaugagguuuaaagguuguuucuggcuuuucaccugguacauguuuguuuuacuagagaccaggaggacccagcaauguucuacgagaugcaugucugguugcuaauauucuagaucccaggaucaaacaggaaaucaucaaaaaguuuauuaaacagcaucugucagaguaucugguacuuuuucaagaaaaccaagaugugaguauugaccaaauaagaucagauguaacauuugaauuuuauugaaacaugagugcugucaagccuacuaauuuagaccucguauuacaugacugucugacaguguugguuguugagcugugaguccuaggggcugaguuuauaguucuuaaccauuuugaggucacugacccuuuggagaaauucagaaacaugcaccugugcauaaaauucugcauauaguuucuggaaauguauagaccccugaaggccaaucauggaccccagguuaaaaaccucuggauuuugugugugugugugugugugugugagacggaguuucgcucuuguugcccaggcuggaacgcaguggugcgaucucaguuuacugcaaccuugccucccggguucaagcaauucuccugccucccccucccaaguagcugggauuacaggcgccugucaccacaccaggcuaauuuuuguauuuuuuaguagggacgggguuucuccauguuggucaggcuggucucgaacugaccucaggugaucugcugaccucggccucccaaagugcugggauuauaggcaugagccacugcgcccagccaaaaaccucugaauuuuuaaguaaaaaaucaaguuaaaaagguagccuagauucuuuaaaaccaugagaaauacagagguugguucccuuuugcuuggcucuguguuuuugcuuguuuccuugaacugccauuucuacuucuaaccacugggguggcuuuugaucuccaccuucaccagguugccuggcuggacaaaaucgacagacgcuaugccuggauaaaacgccagcuuguggacuaugaggagaaauacggccgcauguuuccacgugaguggugcauggcugagaggauugcgguggaauuuugccaugugacaagguagaugccaguucucuacugguucugugguuaaucaaauuuucaccaucgguuccccagucucuaaugguuccauguuguccuguggauuugaugccacuuccagaccccaccagaugacuaauaucauccucguaccccacaguggccccaccagcugcucccucugcccccaucuuugcucugggacuuuccgugguguaguucuugccucaagccaucucuaccuucuccaccaacucaaggcuuauacaccagauugaccuacagugauuccucuaccccacguuuuccccuagucgguaucgcauguaucagugugcuguguauauaucccaucaucauuuuuauuuucugacuugcuagauagauaguuccauagagacaggguaguaucuaccuuaaugauauagcagacacagaggaaacauuuguugaaugaauuucccacucccaauacaguguguauagccucuggauaguucagagcuuuuauuucaagacagaaucacucugucacccaggcuggagugcugcagugauacaaucccagcucacugccaccuccauuuacugcauucaagugauucucaugccucagucucccagguagcaaggauuacagguguguguaaccacaccuggcucauuuuuguauuuuuaguagagaugggguuucaccacguuggccaggcuggucuugaagucccgaccucaggugaucugcccgcccauuuuagccucccgaagugccgggauuacaggcaugagccacugcaccuggccugcgucugagcuuuccaagcauuuuaaagaccgucuuuuguucauccucucuacguuauccaugaguguagcccaaggacagauagucucuuuauauuaaaaaaacccaaagcccaggaagguuaaaucaguauaucuaugacaaagcuaaagccagagucagacuuuuuuuuuuuuuugagacggggucucacuuugucacccagacuggagugcaguggugugaucauggcucacagcagccuugaccuccuaggcucaagugauucucccaccucagccuccugaguagcugagaugacaggugugugccaccacaccggcuaauuuuuguguguguauuuuuuguagagacaagaguuuugcuguguuguucgggcuggucuugaacuccuuuuauucuuuauuugcggcuagacuacaacaguguugguaacugguucuuauuaguuauauauuuccucccaguaguacacaguuagaucuaaugcugggugaaaaagagaaaaaaaagcccauaucuagcauaacucaaccaccuuuucccauaauccauggccgucuuuuuuauuaaaaucauggaaaguaaagucaaauugcauguuucaaacacauuguggggcaaaaguguuuuaagggauauuggcuuuucuuaaaauagauuuuaccuuuuagagcaguuuuagguucacagcagaauugagcagaagacacagagaguucccaggugcucccggccccacgugcauagucuuccccauggucggcaccuuccgccagagcgaugcauuuaucacagcucaugaaacuacacggacacaucaucauuacccagagugaugguccauaguucaugguaguguucacgcuugguguucacauacauucuguguggcuuuuuuuuuuuuuuuuaagagaugggggucucgcaguguugcccaggcuggaguacaauggcuauucacaggcaugguaauagcguaccccagccuugaacucccgggcucaggcagcccuccugcuucagccacccaaguagcugcaacuacaggugcacugagcuccauucuguguggcuguuauucuaagaaacacauugggccaggcuuggugguuuaugccuauaauccuagcauuucaggaggccaaggcagguggaucauaugagccuaggaguuugagacaagccugggcaacauggcaaaaccccaucucuacaaaaaaugcaaaaauuagcuggucaugguggcaagcaccuguaaucccagcuacuagagaggcugaggugggaggauugcuugagcccaggucaagguugcaguaggccauuaucaugccauugcacuccagcccugggugacagagugagacccugucucaaaaaaaaaaaaagaagagagagaaagacagagaaggaaggaagugaggaagggagggagggagggagggagggcgaguggaagggaaaaagaaagaaagaggaagaaaaaaaaagaaacacauugacuccuguagauuuagagaaccuuuuagcauugguuuaagaugaguugagauugucaccuucuaaaucccaauuaacaaaauaaagagugaauuccuugagaaacuguuagcuaauucuuuuuagccuacaguucagcagacuugcaaaccagcucagugagaaauggagccugggagaggcuggacguaugcuagagccagcacguuucuugugagcgccaguaccugccauuguugucucggcuaauggcaguguugcugccaagcuucuauuguuagaauuuuggcuaaaauccuacagauacaucauucucaaauaaacucagagacucuuuguuucauuuugucauuuauuugugugagaagaugguagcuuaguccuuacuaagaacucacaugucccuguucaccagcaacugagcuucugagauggaacguuugagugagagcugcacaggagcuucucgggcagggaccagcuaagcgugcuugccacuuuucccgcagggauccugucccuugcguguguuuccaggacuccugcucucuaguugaagagaugauuauugggcccucaggaagagggagggcuuuauaauucaguaauuaaugacuugugaaauuauauaggcuauauacacuaauaaaaaauuaggugcuccauauguauuauuauccaauuauuaaacuguucaaagauacaggcaacguaguaacuauguaaccaaauuacugguggcucacaccuauaaucccagcacuuugggaggccgaggugggcggaucucuugaggucaggaguuugagaccagccuggccaacauggugaaacacuaucucuacuaaaaauacaaaaaaaaaaaagaaucauuugaacccaggagguggagguuccagccugggcgacagagggagacuccaucucaaauaaauaaauaaauaaauaaacaaacaaauaaauauaaguauauauauaucauccaugaccccugauuuuuuugccugguggauaauuucaccuuaaaaaucuuguuuagaauauguauuucuauuccccagguuuuagacuaaggugguaacagaccucaggguuugaaaugaccacauacauuuuuuuuuucugaauauaagcuaaggccauuuaccuuaucucuacugaaugaaugaucagcuuguuugauaguauucuuaucucuuuguuuugaagggcagaacuugccaagauuaugcguaccagagcgaaggaaauugaagugaaauugcuucuuuuugcuauucaaagaacaacuaacuuugagggguuucuugcaaaacgcuucuccggcugcacccugaccgaugggacccugguaagaccuucccuagggagcugccacgugaaaucaguggguugggugguugggauucaggguuucacuguauggugacucuauccauuggcuucggugcuuaaccccucauugcagugauuucacugagcugcugggaaagugaugauacagaacacucuguguggauuuauuguuugucucuuacgcaguacaucauguuucuagaaugcccugucaucauuuuucuuaaguauugaucccauuuuacagacuaguaauuuugugagucagaggccuuacucagucacaaauaccuuauuucuuuaucaguuaucagauuugguuacaauuaggauauguuuuuacuuuaggguuuaccuuuuaacaucucuggugaacaaacuaggucaaugagucucuguaaaccccaaagccagguauacaggccuggggacuacgugccuccauuggaaagguggaacauaguacugccgguuaaacguuugucucuguguagucaaagaccagguccaaauuuucacuccggaaaccucuucuuuuuggucugaugcaguggcucacaccuguauaaucccagcacuuugggaggccaaggcaggauugcuugagaccaggaguucgagaccagccugggcaacauagugagaccucaucccuacaaaaaaaaaaaaauuagucgggugcaccccuuagucccaaucacuugggaggcugaggcaggaggaucacuucagcccaggaguugaggcugcagugagcuaugaugagugacagagugacacccuaucucuaaaaaaaaagaaaagaaagagaaaggaguaaaccucuucucuuuggaggcccaggcucccugcuaacacaucaaggugcucucuucagauuuccuguccacugggaaaccaagugacucuguucuaugguaauuucuguuugcaucauuacauaugcguagacauugagcuccuugaauacaggaauuguagcugacucauccgucuccucgagucgugcagaguguacacagaacccaugcaggcaggaauggaaggggaaagaagaaaggagggagggaagaagaaauccaaguugagagaaucauaccuuugaauuuucuuuagagcuagauuuguuuuuuuuuuuuaaacugcggguaacaauagagaagcaaagugauuuaguagcaaaauccuuggaccagcagucaagacuuguggucuaaucccgauucugcuguaauguagugaacugccuucccuguuaaaugagaagaaaagacuauccuuuauuuuuuuauuuuuuuguuuuuucauuuuguuuuuuagacagagucuugcucugucagcaggcuggagugcaguggggcgauaucggcccacugcaaccucugccucccagguucaagcaauucuccugccucagccuccuggguagcugggauuacaggugcacaccacuaagccuggcuaauuuuuguauuuuuaguagagacgggguuucaccauguugaccaggcuggucucaaacuccugaccucaggugaucugcccgccucggccucccaaagugcugggauuccaggugugagccaccaugcccaccuauccuuuaauaacagaauauuagggagacuaaauaagacauaaaacccaaaagccaugaagaaaaguacuaaaagguuuaacaacauaaagagaacaacguucuuuuggaaaaagagaccagaaacauaaucaagggauuaaaaaacaguugaagcugcaugacacaaacgauuaauaucuagcacauguaaagaacuccuaaaaauccauaaggaaaauacgaguaacccguuagaaaaaugaguacagagucagacagacgauugacugaagaaauucaguuggcuaauaaacaugaaaaaaaagaaaacaggauauuuuuccuacaucagguuugcaaacagaaaaaaauuacaagacuaacaguacaggauuuuagggcuaguauacagcuugauacaaccuuuuuggugcauaaauugucauuaucagaacuuucagaaauguaaauaugcauguccugucaagcaacaauuuuacaucuaaaccagaagucuaaaaaaaaauccauacauguagaggaagaugcacaaagaaagaggugaacugcagccuuaaaagcaaaaggcuuggcugugucuguaauguuuauuauugaagaugguuaaauaaauuacagugcauccauacugugagaugcuacacagcaguuuaaaagugguagaacgggggccggacgcagcagcucacgccugucaucccagcacuuugggagguauaaugucuuuuauggaaaaaguaaaaagcauguuuauguguguaaauguauaagaaagaggucuggaaaugguaacaguggaugucucuugggaaggaaguuggagugagaguagguagagaagcaaggaaauauuuuuuuccauuuacucugguauaguuuuuuuggaaauuuucuuauacaaaugcauuuacauacuuuguguguacuuuaacaaaguuauuuuucaauuguuuuaaaaugagagagaugggccaaaucagugauuuccaaauccuuucuuguaacaaaaucuaauguagaggccgggugcgguggcucaugccuauaaucccagcacuuugagaggcugaggugggaugaucacuuaaggucaggaguuugagagcagccuggcuaccgugacaaaaccccaucacgacuaaaaauacaaaaaauuagucaggcgugguggugggugcugccaagguugcgccacugcacuccagccugggcgacagagugagacuccaucucaaaaaaaaaaaaaaaauagaauguagaaucugaaacacccauagcugucaugcuuugaacauccacuuggugacccacgcuauauuaggugcguuuaccugcagucagucacugugcuucaucagccauaggaaguaggcgcugugcucauuugaaacuuacuccaggccacggagcuaauguguaagaccgugaaacugagcuacugugguugaagccgggggcaggcugggacuuguaccuggagucccacucacuuguucaaccuucaccucugccaccuucucuagcuccuacccuucugguccuaaaacccugagacuucagugcaauucccucuuugucccaugagaccagccucagagcaggugaagcgggugaaucgggcuggucuuuagacaggguggagcaggugaaucgggcuggccuuucaggcaauggacugcagagcggugguggcagcagcccaauuuugaggccagaccacaagguccugccuacuugggcucacucacgacuuuauuagaauaaaaugcagcugaaaccacaaagcacucuuuuccuacuuagcacaucaaaaauauguauacuucucugcuugcuaacuaauguucaauauugauuucuuuuuaguaacaagggaaaaaaaugggucacaaaacaggugaaaauagccuuaaagaaaaugcaggucagaaaaggaaauacuagcggggcgugguggcgcacgccuguagucccagcuacccgggaaauacuagcggggcgugguggcgcacgccuguagucccaucuacccgggaaauauuagcggggcgugguggugcacgccuguagucccagcuacccgggaaauauuagcggggcgugguggugcacgccuguagucccagcuacccgggaaauauuagcggggcgugguggugcacgccuguagucccagcuacccgggaaauauuagcgggguguggugguacacgccuguagucccagcuacccgggaaauauuagcggggugugguggugcacgccuguagucccagcuacccgggaaauauuagcggggugugguggugcacgccuguagucccagcuacccgggaaauauuagcggggugugguggugcaugccuguagucccagcuacccgggaaauauuagcggggugugguggugcacgccuguagucccagcuauccgggaaauauaagcaggcgugguggugcacgccuguagucccagcuacccggaaaauauuaguggggugugguggugcacgccuguagucccagcuacccgggaaauauuagcggggcaugguggugcgcgccuguagucccagcuacccgggaaauauuagcggggcgugguggugcgcgccuguagucccagcuacccggaaaauauuagcaggugugguggugcacacguguaguccuagcuacccaggaaauauuagcaggcgucgugggcaccuguagucccagcuacccgggaaauauuagcaggcgucgugggcaccuguagucccagcuaccugggaaauauuagcaggcgugguggugcacaccuguagucccagcuacccgggaaauauuagcugggcgugguggugcacgccuguagucccagcuacccgggaaauauuagcggggcgugguggugugcgccuguagucccagcuacccgggaaauauuagcaggcgugguggugcacacguguagucccagcuacccaggaaauauuagcaggcguggugggcgccuguagucccagcuacccagaaaauauuagcaggcguggugggcgccuguagucccagcuacccgggaaauauuagcaggugugguggugcacacguguagucccugcuacccaggaaauauuagcaggccuggugggcgccuguagucacaguuacccgggaaauauuagcggggcaugguggugcacgccuguagucccagcuacccaggaaauauuaacaggcaugguggugcaugccuguagucccagcuacccaagaaauauuagcaggugucgugggcaccuguagucccagcuacccgggaaauauuagcugggcaugguggugcaugccuguagucccagcuaccugggaaauaauagcggggccugauggcgcaugccuguagucccagcuacccaggaaauauuaguggggugugguggcgcaugccuguagucccagcuacccgggaaauauuaguggggcguaguggcgcacgccugucgucccagcuacccgggaaauauuaguggggcgugguggugcacgccuguagucccagcuacccgggaaauauuaguggggcgugguggugcaccccuguagucccagcuacccaggaaauauuaguggggcgugguggcgcacgccuguagucccagcuacccgggaaauauuagcaggcgugguggugcacgccuguagucccagcuacccgggaaauauuaguggggcgugguggcgcacgccuguagucccagcuacccgggaaacauuaguggggcgugguggcgcacgccuguagucccagcuacccgggaaauauuaguggggcgugguggcgcacgccuguagucccagcuacccgggaaauauuaguggggcgugguggcgcacgccuguagucccagcuacccgggaaauauuaguggggcgugguggcgcacgccuguagucccagcuacccgggaaauauuaguggggcgugguggcgcacgccuguagucccagcuacccgggaaacauuaguggggcgugguggugcacgccuguagucccagcuacccgggaaauauuaguggggcgugguggcgcacgccuguagucccagcuacccgggaaauauuaguggggcgugguggcgcacgccuguagucccagcuacccgggaaauauuaguggggcgugguggcgcaugccuguagucccagcuaccugggaaauaauagcggggccugauggcgcaugccuguagucccagcuacccgggaaauauuaguggggcgugguggugcaugccuguagucccagcuaccugggaaauaauagcggggccugauggcgcacgccuguagucccagcuacccgggaaauauuaguggggcgugguggcgcacgccuguagucccagcuaccugagaggcugagacaggaggaucacuuuagcccagaaggcagagguugcaaugaacugagauugcaccacugcacuccagucugggugacaaagugagacugucucaaaaaaacagaaaaggaaaggaaauaggaacagagaucccacugaaggaauccugaguuucuccugagaaguaugagguuggcuuuagcagcccccugauuccucuugcuggcucuccucucggaccuucccaagccaugcuccugccugguuucaagcguagauauauguggcacuggauucagcccuacggagaucugcccggcgacaagcaugaggguucagcauugagcacaggccccacccugggaguagcccccugagcucccacggccucuggcugggcaggguccggagagcaucaggacaggcucugugagcugguaauccagauaaccggacgggaaauaggucccagugaaggaugcuugaaugacauucuugccaagcacuuguuuugagccauucuucacccucucuggcugggcccuacuuccuggugauuugucuuuuacauuuagggagcuauaggaccacagaggaacaaauggcccuguugcaucugaggaccaggguagccugugaaccugggucugucccaggaccucuccaaggaaaaaucccccaaaggccaaaagugguaagggaacgagggcagggaaggcccuucuggacaagcugaggcagcugaacaggguaaccacguagagaccaugaaaaacugacaggagcuuacucaaguuugcaaagacaaugcuuuauuguaaaacacagguacaggacugucagaauggcaguuggccaacugucagacaccuucugucccgggaggacugggcuggggguacugguuucucagggcagcacagccccuuucugccugaacucacucggccagggccaagcuccuggccuggagcccagugucuccuggccgagguggugcucuguggugguggucaggggucagcuaggaacacuugagccuuuuuccccagcuccuuccuuuuugguuuucauauuugaaauguuuuggcagaacuggucuuuaaaucauccccucuucauuguucaguuguugcucuccucuccucucaaguuugcagaguuucagguucuaaauccuuagccagaaaagccugaugaacaccaugaguucuuucuuucccucucuauuuagucagcucuccucuccacagacuucucuaaauccuucagcuucuuuaauucaacuucguccuccuacccuauucuuugugccagguaucacgaccuggcaguuauucugcauuccaaauccugaaaauggcugucugauauccuucaaggguuuucccuuaaagauaaguuucuaggaaggcaacagaagcccuauggccacuuuacccaggugggacgggccuugaggaaucgguucacugcagcucugcugugaggagacgugaaggcugucacucuagcugauguucacacugagccugguccccaccaucaucucauugugggccgugcacgaccuucuucaccuuuauucugcgacccucaguggcagggaccuuggugaauucaucauggcuaccgaccaugcucccaacgcaaagcaccgggaaggggcugccugggcaaggccaggaguuccagcuguccugacccccagucuagcugcuggguacccugccuggagauaugcugcucccuggccccugaccccuuccccaugcuaccuuccuuucaggauacacucuuuggaaacuccuuuuuggcuaccauuuuguuucaaaauaccagaauaaauugugaaacgaaccaagguauaucuugauacccuuugauauaugccagauuuuauagaaaguuacugaauuccucagaaaggugccacaaaacagguaagaugucagccaaggagccaaaacggccagagacucucccuugcugccccucccuaggcuguacgucauccccacccuacccccacugccgccuucacuguaucauuccaaaccucuccaguccuuggugacuggcagugaaacagugaggaugagcuugagaguguggccagcucgcccggaagacaagaccugccacagcucagcuccuccugacccaucacuccugacuucagugggaugcaucauccuuggcucuuuuucaagagcugugacuucaacauuugauagaacuuuagacugaaagagccucagggacaggcuuguugcuuaaccaguuucacgauguccugugcuguaacuguuacuugaggaggugagcugccugugcuuuucccaguugccucaacuucugacccuuuaggaggaauucaagagagucuauaaauuaaaaugccuugaaauuaaaagagaaugucuggaugugauguaacuggauccauaugcauuauuagugacuugaugauuagauucaaggugagcaaaugacauucagccuucugcugaaagcagaaaagcagacuagaucggauuagcuuuuuauaacugccucacugggagguuuuuguuuuguuuuuuguuuuuuuuguaguaauaaaauuaaaaauguuccccuuuuaugcagcuggauuucccuuccucuugaccacugcauaaguugccuuuugaaacagacuuguccuuuggcuuauaggggccuuuacuuccccaguuuuuagaauuacauucuaaagauagaagcuauauggguacaauugucagccauggaauuugaguguaagagcguuugcaaaaggcucacgacucaugaaagaccacccagcaugucucacucuacacccuggucuuccggcaccugcaugagggagacuguguaaggaacaggggcagguuuuccagcucugccacagcuugaggacaucugucuccgacagugacagauucccccgccucaugcacucccuucagcguuggaaaauauuuuauggaugcuuuacuggugcuaaagaaauguauucuuccauuugaauaauauugcaagggacgauuaacuucuguuucugagaagagaauaauacagggucaggauagaaaauuuggaaauuauggcgagaauagagaagcaggaaaaaagucauccaaaucagagaugaggauuuggguauauucuuucuauauauuuuacaugguugaaauuguauuuuuuuaaauacaguuuucucugccuaguuuuuaaaauugagauauaacucaugucacgaaaugucacaugaaauuuaucguuuaaaguauacaguucaguugguuuucauauauucauaagaugaugccacgaucccagcugugcaacuccaggacauuucuguuaccccagaagaaaucccuccuuagcaggcaggacuuucaaguucucuuuccccaguccugggcaguuacgaauugacuuuugucuuuacggaugccuguuguggacacuucacauaaacggaugcuacgaugugugguuuuugugucugccuucccucccucuggacagugucugcgagccuuacccaugaugaggugugugucagugcaucauuuugauggcugaauagugcaccguugugugggugaugcacauauuguugucucuuccaucagcuguggacauucgggugguuuccacuuuuucacugugugaauacugcugugaguaucuguacagguuuucacugugugaacucacugugaauauuuguacagguuuucacugugugaauucacuauuugaauacugcuaugaauaucuguacagguuuucacugugugaacucacuaugugaauauuuguacagguuuucacugugugaauucacuauuugaauacugcugugaauaucuguacagguuuucacugugugaacucacuaugugaauauuuguacagguuuucacugugugaauucacuauuugaauacugcugugaauaucuguacagguuuucacugugugaacucacuaugugaauauuuguacagguuuucacugugugaacucacuaugugaauauuuguacagguuuucacugugugaauucacuauuugaauacugcugugaauaucugugcagguuuucacugugugaauucacuauuugauuacugcugugaauaucugugcagguuuucacugugugaacucacuaugugaauauuuguacagguuuucacugugugaauucacuauuugaauacugcugugaauaucuguacagguuuucacugugugaauacugcugugaauaucugugcagguuuucacugugugaacucacuaugugaauauuuguacagguuuucacugugugaauucacuauuugaauacugcugugaauaucuguacagguuuucacugugugaauacugcugugaauaucuguacagguuuucacugugugaacucacuaugugaauauuuguacagguuuucacugugugaauucacuauuugaauacugcugugaauaucuguacagguuuucacugugugaacucacuaugugaauauuuguacagguuuucacugugugaauucacuauuugaauacugcugugaauaucugugcagguuuucacugugugaacuaugugaauauuuguacagguuuucacugugugaauucacuauuugaauacugcugugaguaucuguacagguuuucacugugugaacucacuaugugaauauuuguacagguuuucacugugugaauucacuauuugaauacugcugugaauaucuguacagguuuucgcugugugaacuaugugaauauuuguacagguuuucacugugugaauucacuauuugaauacugcugugaauaucuguacagguuuucgcugugugaacucacuauaugaauauuuguacagguuuucacugugugaauucacuauuugauuacugcugugaguaucuguacagguuuucacugugugaacucacuaugugaauauuuguacagguuuucacugugugaauucacuauuugaauacugcugugaauaucuguacagguuuucgcugugugaacuaugugaauauuuguacagguuuucacugugugaauucacuauuugaauacugcugugaauaucuguacagguuuucacugugugaacucacuaugugaauauuuguacagguuuucacugugugaauucacuauuugaauacugcugugaauaucuguacagguuuucacugugugaacucacuaugugaauauuuguacagguuuucacugugugaauucacuauuugaauacugcugugaauaucuguacagguuuucacugugugaacucacuaugaauauuuguacagguuuucacugugugaauucacuauuugaauacugcugugaguaucuguacagguuuucacugugugaacucacuaugugaauauuuuuacagguuuucacugugugaacucacugugaauauuuguacagguuuucacugugugaauucacuauuugaauacugcugugaauaucuguacagguuuucacugugugaacuaugugaauaucuguacagguuuucacugugugaacucacuaugugaauacugcugugaauaucaguacagguuuucacuguaugaacucacuaugugaauauuuguacagguuuucacugugugaauucacuauuugaauacugcugugaauaucugugcagguuuucacugugugaacucacuaugugaauauuuguacagguuuucacuaugugaacucacuaugugaauauuuguacagguuuucacugugugaacucacuaugugaauacugcugugaauaucgguacagguuuucacuguaugaauacugcugugaauauuuguacagguuuucgugucagcguguuuccuauucuugugagaauauaccugaguggaauugcugggucacaugguaacccuaggcuuaacuuuuugaggaacugcaaacuguuuucgaagcagccacacgguuuuacauuucuacccacaauguaggaggguccaguuuccccauauccuugcugacgcgugucuccuuuguuccccuaauuauagccauucucauggguguagaguaguaucuccuugugguuuucauuugcuuuuucccauugacuagugacauugcacagcuucuuuaaagaaaugucuauucagcugggugugguggcucacgccuguaaucccagcacugugggaggccgaggugggagcaucaccucaggucaggaguucaagaccagccuggccaacauggugaaaccccgucuguacuaaaaauacaaaacuuagccaggcgugguggcgggugccuauaaucccagcuacucgggaggcugaggcaggagaaucgcuugaacccaggagguggagguuucagugagcugagauugcgccacucaugucucaaaaaaaaggaaaugucuauucacauuuuuugcccauuuuuuaguuggauuguuuuuauuguugaguuguaagaguuguuuacacauucuagauauauucuauaacuuuuuuuuuuuuuucuugagacagagucucacucuguugcccaggcuggaguucaguggugagaucucggcucacugcaaccucugccuccuggguucaagcaauucucggaccucagucuccuggguagcugggaccacaggagcgcagcaccaugccaggcuaauuuuuguauuuuuuguauuuuuuuuuuuuuuuuuuaguagaggcgggguuuugccguguuggccaggcuggucuugaacuccuggccucaagugauccacccgccucgaccucucauagugcugggauuauaggcgugagccaccaugcccaggcuuuauaacuucuuuagauauuuuaucauguaucagacauaugauuugccaauguuuucucccaucuguggguuuucacucucuugauagucauuucacaggauuuccguuuuaaugaagguuuuuuguucuugcuuguguuuagugucauauccaagaaacuguuacguaauccaaggcuacagagacuuaccuagguuuccuccuaagaguuuuauaguuucagcugcuacauuuauaucuuugauccauuuugaguuaauuuccauauuaacucacacacacauaugaaaauaugcuucauaugucacagcuuaaguuguuucucaacuacuacagaaagauuuuauucuauagauacucagugauuccccuaauuauucuuuucucguaggacccuuaguuuuuucucacuuuuauaaauagggcuauaugaauauuuuugucuacuaauuugugugugugugugugugugugugugugugugugugugugugugugugugugacggagucucacucugucgcccaggcucgagugcaguggcgcgaucucggcucacugcaagcucugccuccuggguucacgccauucuccugccucagccuccgcguagcugggacuacaggcgcccgccaccacgccuggcuaauuuuuuuuuuuauauuuuuaguagagacgguuucaccauguuagccaggagggucucgaucuccugaccucgugauccgcccaccucggccucccaaagugcugggauuacaggcgugagccaccgcacccggccuugucuacuaauuuuauaugcauuugagauuguuuuuuuccucucuucucuucucucuucucuccucuucgcugucucuuacccaaagcagugagaugauuuucuuacgacacuaguggaauuaucggcucaaguugugagcacuuucaauuucagccucugcuuuaaacaucuuucuguuccucuuccuuucuguucuuccaaaugcaguuaagauuuaaaaguagucccugcuuguuucagugcaucucacaguguuaaugugccaugccuaaugugaagggguaacucugccaaauagaaaaagcaaagcaaucugaauucuuuuuuuuuaauuacacauuucuacuucuaaguauaugcccaagggaauuaaaaacauauguucguaugucuuacacaaauguucauagcaacacuauucacaauagccaaaaaguagaaacaucaguagacaaggaauaaccaaaacguggucuguccguacaguggaauauuauucacguaaaaggaaugaagugcugauacgugcccugaccugggugaaccuuggacacaccaugccgagugaaagaagccagacacagaugucacacauuauaugauuccaucuauaggaaauacccaaaagaggcaaauccauagaggccgaugggguugggaaggggaagacugggaaguaacagcuucccaguaacagguagggguugcuuuugggggugaaaaauguucuggaauugguggugauggcugcacaaccuugugaauguccgaaaaccacugaauaguaaaucacuuuaaaauguugaguuuuaugugacaugaauuacaucacaauuuagaauuaaaggcuuuagaagauaguguaugaguuuaguuauaaaucaucuuuacucuucagauaaauauucugucaaaaaaaaaaaugagcagugggccgggcauaauggcucaugccuaaaaucccagcgcuuugggaggccgaggugggcaggucucuuacagccaggaguuugagaccagccugggccacgaagacccugucucuaaaaaaaaauuuuaaaaugagcagggcgugguagugugcacuugcauucuuagcuacucaggaggcugaggugcaagggucaccuaaguccaggaguucaagacugcagugagcugugauugcaccacugcacuucauccuggguggaagagugaggcucuguuucaaaaaaaaaaagaaaagaaaagaaaagaaaaaagcagaaauagcuauauaugccuauuaaaaacucaaauagaaaaaaaaauuuuaaauaaacaucucuucuuaacuacuguauaucccucccccuggagguauccacacuguuuaauucuuugggguauauuuuugacgcuucugcaagcacgcuugcacacauauacgcaggcuuuuuguuuuguuuacagaaaauagaaaguguugcccauguuucugaagaggauuuuauugagggccuuucaucugaucagcauuuacccacuuauauuuuucaagcuucccucuuuguucagggcuuuggaaaagaugagaaauuggaucgggaaggcacuuagggucuaguaggagaaagaagucuguacauaacuguugcaauagaagaaguggacauggcgguagcaagagaguagccccagaaaugguggacaccaagugugugaaccccugggcuugcaguccugacugucagcuaaagccccgcagccaucucuuuaaggaccaauuaggaauugggcuggaguaaagcauuuauggagugagaaaugcagaaacugaggaacuuucaucucacaagcgaaagcuuuccccucuagggaaaggaagagucuuaaauuucagaguuccuucuuugauaauucgauguguccagcuagggccucacacagggauuuguguaggcagacgagauacggauguacugcugacugaagccagacuuucccuucuugacagugaauuagacagccugacuguccuguggucugaacuguuuugaaggugcugggaauccccugugauuuaaucaguagggauuaacuugcuauaugaagaauuuugcuuuccuauaucggcuugaaaucaacugucaucauagcaaaaagaaugaauucuuucaaaauuggaagucauucacuucuuggaaauuuuuggcuuuauuuagcagccucagaguucaugaaauauguccuuugaguuacugacaaucuaaccccaaaguuguaauucucuguggccugugacagcugcaaagcaagccugagaagcgugaucuguguggcucuuagcacagaaggcugcguuaugccagugaucgcuccccacaaggacuuguucuuucaucuuagcaagucagucugagcaguaauguagcccucuaacuagcgggaaugcauauccacaccuuaggguuuuaggacuuuuaucaacagggaggagggugguaugugcguuguuguagacuggggaagaaaggagcagcuccgugugccuuuccacuuagaaagugcaaaguugaugggcccuuugcuuuuauuucuuagagagaucccaaagagacaaaguaguugggacgaggcuccacuuaugguuaauagaaauucuuuugacaagacuuuuaagccugcaugcccacguuuucugugagcugcuuuauuaagagaagcacaacaguuuugccuuguuucguagcucacccuauuaauuacugcucaaagcuuccccuugcugagccuugcccucugugccagacagcauguuaagcugcuguauauauucagucaugcauugcuuaacagcaggaauauguucugagaaaugcaucauuaguuucaucacugugcaaaccucauagagugugccugcuagaaccuacuccagcuguccccaaccuuuuuggcaccagggacugguuuuguggaagacaguuuuuccagaggugggggugggggugggagugcaggggauggggguaggggaugguuucgagaugaaacuguucuaccucagaucaucaggcauuggauucucagaaggagugugcaaccuagaccucucauaugagcagcucacaacaggguuugccuaugagaccugacaggaggcggagcccaggcagucaugcucacucacugcugcucaccucgugauaugcagccugguugcuaacaggccauggacuguggcccagggguuggggaccccuggccuacucuauuguauggcuccauuauaaucuaguggaaccgccuuguaccguggcccgucauggauggaaacauggugauguggugcaugacuguguagcucacgccugacacgcacgcaucaucccauccucauggcagcacguaacuguguagcucacgccugacacgcaugccucaucccauccucauggcagccauacgagguagguauuccuaucccuucacauugcagguaggagaacugaggcuagaaguuaaacagcauaccccaugguggaaccuggacucgaacccgggucugucagauacggagccugugcccuugccacuacacgagggugccccaucucaguuaagggcaacaucagccgugcaguugcucagaccagaaagugacugucccuucacuccuuucauucccucacccucguucucacucucucagcaaagccuccuggcucugccuccuaacugugccccaaauccgauggacacuuuuuucuaucguccaucaccagcuuaguccaguuccccaucagcccuuuccuggaacacuggcuuaguccgguucccaucagcccuuuccuggagcacuguagcagccucuuaaacugguuugccugcugucauuauaauccauuccccuacagcaguggaauauuuuuaaaauccaaauuagaucacaucacuucgcuguugaaaacuaccagcgacugcccaauugcagugagaagaaaaccgacccuuaccauggcccacaaaaggcugcgugauggggcucccgccaccccucuuaccccaggcccccaucuuccuuucugucccugacucaccaauaugaugcgacucuugccaccccucuuaccccaggcccccaucuucguuuccgucccugacucaccaauaugaugggacucccgccaccccucuuaccccaggcccccaucuuccuuucugucccugacucaccaauaugaugggacucucgccaccccucuuaccccaggcccccaucuuuguuuccgucccugacucaccaauaugaugggacucccgccaccccucuuaccccaggcccccaucuuccuuuccaucccugauucaccaauaugaugggacucccgccaccccucuuaccccaggcccccaucuuccuuucugucccucagacucaccauaugcuuuccagcgucuccaccgggucucccugcugagaacacccuuccuuggguuuugccugagcaguuccuucuuacucagcucagccgucaucuccucagagaccuuuucugaugacccuguguguagaagcacuuucccacccucauccccagcucaucccacucccugaguuuucuucucaccacuacagugccgccucucuaauccaucuuccucacuugcaucccuggugcacccaagagugccuggagcagaguggaugcccaguacaucauuguugagugagcggcagacacgugcuguucccuccgcccuccaccccucauauauuucacucugaggcauccuucagcucuggcucagacaucuuuucuuuagggacggcugcggcccucuguugcacguuuccaugacgacugcuuuuccuuccuggcccuucucacuguuugugugacuguuggauugaaggcugucucccccagcagacucuaaucuccaugagggcggaggcuggccugucuuucucacugcucuacuccuagggccaagcauaucccuuuguugaguggaugagggaaggaaugaaucacuuuuccuguacuaacuugguccacauguggaaugcaugugccacaaaugagugagcuaggagcuccuugauguccacaacuccccucauguuaauagaggacgggcaugguggcucacgccuguaauucuagcacuuugggaggcugagacagauggauugcuucaggucaggaguuucagaccagcccaggcaacauggcaaaaucccaucucuacaaaaaauacaaaaauuacuuggguguggugaugugcaccuguagucccagcuacucaggaggcugagguuggcccaugcucacucuaucccagauggugacacugagcgaguggccugugcucaccugccucagauggugccugcuucuucagggcugcccguuagguucgacuucuuccuccccucuccguuuucuugaugcuuuacaccggcgagaguagguucaacuucuuccuacccucugcguuuucuugaugcuuuacgccagcgagaguaggcucgacuucuuccuacccucugcguuuucuugaugcuuuacgccagugagaguagguuugacuucuuccuacccucugcguuuucuugaugcuuuaugccagcgagagcagagcccgggaacguucucaguccacgucacugacaucugcuguuugccaugauuuccaauaacacauuauguuuuaaaaacgaggcccaucuuuauguaauugugaggugcuguuaucaacccaauagacuuagcaauagaugaggggcauuuaguucaaaaacucaaauucugugucugucacugaaugauuuugaucaaagcuuuuaacuucaguuagcugacuugcuuuucauaucuacaaaggaccaaaagacuuagaaucauagugacucagcucaacagcauaaucccagagcccacuguuaagccaguggaaucaggagucuaaugcuauuaccuaauuuaauuuuuuuaugguuguugaagauuaagcuugguagauucccuuuauuacuauuccucucucucuaaaauaucagcagcccuuaagaagacaacucaagcuuagaaauacugcuuucuaacaagagcuguacauuuuuaaggauuuuuuuucucucauguuagguaaagaagccaaaguuuggagugugcaaaugugaaauacuugcuuggguguuagaccauauuguuuaucaccaggauaccacaaaaaccaucaucuuacuacugauuaccucgagcuaaugccaucaccacaaggcuuugucaugcaccgaggcuguaucuguccacaucacuugcauccaaguguuuuggccaaaaaauaagcaguuauuaaaugacuguuagcaguauugucuuaaaccaaaaaccagacgcagguguagugcuuuugugcaauguauuuauuuuauuguauuuuauuuuugagacggagucucgcuuugucacccaggcuggagugcaguggugccaucuuggcucacugcaaccuccacuuccuggauucaagcaauucuugugccucagccucccaaguagcugggauuacaggcgccuaccaccacgcugcuaauuuugguauuuuuaguagagacaggcuuucaccauguuguucaggcuggucuugaacuccugaccucaagugauccgccgccucagccucccaaagugcugggauuccaggugugagccacugcacccggccuuuguguaaguuuugguuuuauuuuuguuuguaauagcuucagaugguguccuggcacuuggcaaaguuauucacgcuauaguccaucugcugucccuuuuggcuuagagauuaauucagauugacccacugguauuggcuaaaauaccaaguacauuuagaaacucccucuccauuaacuucucgucuccagagagccaugccuugcccccuucccucguccccagcaccaagcagucccucuuuucuguuuguccaguuggccuccuuucugcuaaagccuucagcucccaggcauaaacaacaucucuaggugaaaacuguaaaggaauuccagagagcugccuugauucuguaguuguacuggaauuaacgucaucagugacccuuguguguaucaugugcugcuucuaggguuucacauuugauccuccagauaguccugugacuacauccucauucagcagaugaaguuacugaggcucagagaagcugggugauagggccagugccgcacgguuggagcuacagcuaccaugccuccugccugcagccuucccacuggcccauguuuccacuccgugauguauuuugaaauaguggucauauuuggaagcugagaagucgauuuucucaaggagauuucuguugugguuguuguaauggggcuuacuugggaagagacaucuguuaaucuagaacacaugagauuaguuuuguaguuuguucuugcguugaaauccaucuggcacuuugauucauuucuauuuacugaggaccugcuacaugcuaggcacugagauaggauggggaacaagacagacacaaucucugccaucauggaggccagaagggaaaagacaaauaaugggcaauugcuauauuuuaauaaaugccuggguaggagacauguagcuugguuugggaacacgugucagggacaucugacccaaaccugacagaugggaaaggcuucccagcagaacggaguuccgguuugaggacugaggaugcgugagcguuuuagccagauucgaguuggggcgggguggucggggagguugcaggaagagggaaagcacugugaaggcccggaggcaagaauguggucuggguugccucaguucuucuuuaucagauagcgugcaugacuuccuuguuggagacaccuagaaaaagcagaucaauggggaaagcuauugaauaugcucagaaaacacuucucuuucucauaucuaccuaacagaaaaagcuugagucuccacccccaucuaccaaucccuuccuggaagaugagccaacaccagagauggaggaacuggcaacggagaaaggagauuuagaucaaguaagucugguuugcgucaccacggguaaccuacccaaugugcguuucugaaaaucggucugcuugcuccagauacgauccuuuggcucuuggccacguucagagaugacagcuguuguggucuuuacagaaggccuuuaucugaaagugcauguagaaaacuccaugaaagggcagacuucccugcccacaucucugcuccugaagagccccgccuccaggacacacacaagcuucauuagccacugugguggggccaggagaguucugcucugccucauucagcaucuccugagcuugucagcugaguuuuugguuugacugucaucugguacagugaugaugagagaggcugaacaauccccgggaagccagcagcacccucggcuaggagaggccuccaugcaguguaagcugaucacuuuaggucuggaagccauuggggaggccuggaaaugucaagguggccaguggcauauuugaagaguuacuuuucagagcacacuaacacuuuaauuuccuuuggauuuuucuguccaagucuaaauuuccucucccuucauccuacagaaugguguuuuugguuaacugccauguuaugacaagggagguuagagcaauaaaucagaacguuucccuucuagauuagugaucccuguuuuuaauugucuacacuuggcugcuggaggauuauuuuacgguauuguuuugcuccagacaccaccaaaagggaggcuggcugggaggaccagcucugagaaaccuguaaccauguacuuugcagcuagcccugcauucauucuuucccagcaccacaagggcaggagccaagagagcagagcuuccaggagcaguucugaaaugaugcaaucaaaugugucuggucccuugauuaaaugauuguaauagaauggauacucacacuuuuauaguccuuugcacuuuuaaauucuuuuacaugcuuuauguuaucgucacaauuccugccucuugcuuuauaggugaugaaacugcagcucagagagguuaagugguuggcccaggguugcacagcuuggaaguggaggagcuuaaacuggaagccaggucucaaugucagaaacuagaauuccuuucccagugcuauuuuguugauggacucaugucucauugaagaguagaggacauagaacugaaucucaggaauagaaguaaaugaacaaaacugaugggacaucuugaggaggcuccaucccggagauguauuuauaggauuagaugcaguugauuuaaagccgucauaguauugacuggcauggaagaaaacaaacaguuucuuguaacuaauuaaaugcaguucucaauugcauuuugggagcagggacuaggguggaaagaaggcucuggguguagagcccaugcuucuggcauguccuccacccacacagggccaccucugcccugugagcaugcuuugcgcaggagagccauuugcagagcccugaugucucacgaaugcuaguagcugccauggucauguccgaaauugugcaguuaaacacucagaugcuugcaguguugccaggaaaaguuauucuuuucgcuagucaucucuggauguuauuaaauuggauuaagauaggccccauuaccuacaaaaucaguuuugccagguaaaauguaauuuuccuuuuucuuggaacuuuuuccuccuaugaaagcuugaaguuacuguuguaaggaccaagaccugcucauucuaagaacacagaacacugacaucugaccaguacaugggguaaagcagagucaggugcugggaaaaugcuggacucuugucggccauuaaccgacugaccaugugaccuucaguagguuauucucucuuuagacuucccuagcuugucuuuagugagagcuaaugguuuucaaacuguauuccuuggugccccaucagaugucacuguggaaguuaggaggaggccagagaccuagaucccugcgaucagagcaguuuuaucgcaagucauuuuguuuuuguuuuuuuuuuuaauuuauuuauuuuuuauugauaauucuuggguguuucucacagagggggauuuggcagggucauaggacaauaguggagggaaggucagcagauaaacaagugaacaaaggucucugguuuuccuaggcagaggacccugaggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaagaaguuuucuuaguacagaacaaaaugaaaagucucccaugucuacuucucucuacacagacacggcaaccauccgauuucucaaucuuuuccccaccuuuccccacuuucuauuccacaaagccgccauugucaucauggcccguucucaaugagcuguuggguacaccucccagacagggugguggccgggcagaggggcuccucacuucccaguaggggcggccgggcagaggcgccccucaccucccgggcggggcggcuggccgggcggggggcugacccccccaccucccucccggacggggcggcuggccuggcagaggggcuccucacuucccaguagggguggcugggcagaggcgccccucaccucccggauggggcggcuggccggguugggggcugacccccccccccaccucccucccggacggggcggcuggccuggcagaggggcuccucacuucccaguaggggcggcugggcagaggcgccccucaccucccggacggggcggcuggccgggcauggggcugacccccccaccucccucccggacgggguggcugccgggcggagacgcuccucacuucccagacgggguggcugccgggcagagaggcuccucacuucucagacggggcggcugccgggcggaggggcuccucacuucucagacggggcgguugccgggcagagggucuccucacuucucagacggggcggccgggcagaaaugcuccucaccucccagaccgggucgcggccgggcagaggugcuccucacaucccagacggggcggcagggcagaggcgcuccccacaucucagacaaugggcagccgggcagagacgcuccucacuuccuagaugugauggcggccgggaagaggugcuccucacuuccuaggugggauggcggccgggcggagacgcuccucacuuuccagacugggcagccaggcagaggggcuccucacaucccagaugaugggcggccaggcagagacgcuucucacuucccagacggggugguggccgggcagaggcugcaaucucggcacuuugggaggccaaggcaggcggcugggagguggagguuguagcgagcugagaucacgccccugcacuccagccugggcaccauugagcacugagugaacgagacuccgucugcaaucccggcaccucgggaggccgaggcuggcggaucacuugcgguuaggggcuggagaccggccuggccaacccagcgaaaccccgucuccaccaaaaccagucagguguggcggcgcgagccugcaaucgcaggcacucggcaggcugagucaggagaaucaggcagggagguugcagugagccgagauggcagcaguacaguccagcuucggcucagcaugagagggagaccguggaaagagagggagagggagaccguggggagagggagagggagagggagagcugcaagucauuuuguauugugggcuuucagaugaaauuuuuuuuugaaccagagguuuuauguaauuuaaaaaaaaaauggccgggaaugguggcucaugccuguaaucccagcacuuugggaggcugaggcaggccgaucaccugaggucaggaguucaaaaccagccugaccaacauggugaaacuauguugaaaccauacuaaacaacauggugaaaccauacuaaaaauacaaaauuagccgggcgugguggugcaugccuguaaucccagcuacucaggaggcugaggcaggagaaucgugugaacuugggaggcggagguuacagugagccgagaucacgccauugcacuauagccugggugacagagugagacuccaucucaaaagaaacaacuaaacccccuaaucuagcugauccacccaccauuucaugggcuauuacugauuaguaauaacacuuacaugccagugacuaaugccuccacccacgccaucccuuaccuccugcugcgucaccagcccuggccuugcugguggcugauuaggugggcgccccaggaucucccucuucccagaguggggugcacaacaaaagcagaccucuuggggugggggagggaccccaccagguguuaguggugaaaucagccagaggugguuggagggaaggucucugccggcucugugggugaccuaacccauuucauggcugcagucaguagccauguggcccucaagguaagggucacacccugcucacuacugcaguuuacgccucgcugcugagaagagagagggaaccugaaagaagguauuucguuuacaagagggccugagcaaucaguugccaagauauucccaaugauaaaaacugacaucugaaaggagccugagggacacugaaagcauaacagaaaggagcagaaauaaggaaugucccuucuggugauccgagcgguucgauuuaaucuguuuacauuggguaguaaugaaaggaagugggaccagcugcagaccuccucacugugacaacaguaaccuuuuauuauuccaccaaacuccaggaggaaauagcuuaaacaucuucagcuuuuggacagaauucacacacucagaacccggcccaaacauuacugcuaaaugacuuaguguaguguuuaagcugagaaucaacccuuugggcaguugcuuggugcaaagggaaaugccaguuagccaaaauuccagcaccuacuaucuaaacugagcacguucauaacguagccauaggcaggaggcagcccugcaggaaaaaaguaagaaaaaaggaaacuucaggcagucucucccauuauuccucucuugcuucagcucacuagaagugcugcaagaggacccgggugcugugguggcagggucaagggucccuccucacugcagaagagugcuguugguggggagggcagggcagggcagcgucaucugcagauagagguggaacccuggcacugccuggucaugcagcuuucugaguguccuguggggccucaucaagggcaggaccugugggacgucaucaagggcagggccuguggcagacugaacaagaugaguucguuggaauuauguagccauuuucuuuacucacuuggaaucuguauuuuauaccuaagagaugagcucuucacacuuacuccaacauaguuucuuucaaaucauauaucacuuuugugcauacauaaaaaggaaacuauaggcaaaauaaauaaagauauuucuaaaacuucuucacaugcagguccacaucuucugaaccacuuuuuaaaaaacuuuauauuuugaaauaauuaugggcucauaaauuauaaaccuaguacagcgagguacaguguacugaucucccagcguccuccaggggacagcuaacauaguagaguccaucaucaaaccaggaaauugauccagaccccuucccaucucccagcuuccuccagggggacacuagagugcaucaucaaacgaggaaauugauccagaccccuucccaucucccagcuuccuccagggggacacuagagugcaucaucaaacgaggaaauugauccagaccccuucccaucucccagcuuccuccagggggacacuagagugcaucaucaaaucaggaaauugauccagaccccuucccaucucccagcuuccuccagggggacacuagagugcaucaucaaaccaggaaauugauccagaccccuucccaucucccagcuuccuccagggggggcacuagagugcaucaucaaaccaggaaauugauccagaccccuucccaucucccagcuuccuccaggggggacacuagagugcaucaucaaaccaggaaauugauccagaccccuucccaucucccagcuuccuccgggggggcacuagagugcaucaucaaaucaggaaauugauccagaccccuucccaucucccagcuuccucgagggcagggcacuagagugcaucaucaaaccaggaaauugauccagaccccuucccaucucccagcuuccuccaggggggacacuagagugcaucaucaaaccaggaaauugauccagaccccuucccaucucccagcuuccuccagggggacacuagagugcaucaucaaaucaggaaauugauccagaccccuucccaucucccagcuuccuccagggcagggcacuagagugcaucaucaaacgaggaaauugauccagaccccuucccaucucccagcuuccuccagggggacacuagagugcaucaucaaacgaggaaauugguccagaccccuucccaucucccagcuuccuccagggggacacuagagugcaucaucaaacgaggaaauugauccagaccccuucccaucucccagcuuccuccagggggacacuagagugcaucaucaaaccaggaaauugauccagaccccuucccaucucccagcuuccuccaggguggggcacuagagugcaucaucaaaccaggaaauugauccagaccccuucccaucucccagcuuccuccagggggacacuagagugcaucaucaaaucaggaaauugauccagaccccuucccaucucccagcuuccucgagggcagggcacuagagugcaucaucaaaccaggaaauugauccagaccccuucccaucucccagcuuccuccaggggggacacuagagugcaucaucaaaccaggaaauugauccagaccccuucccaucucccagcuuccuccagggggacacuagagugcaucaucaaaucaggaaauugauccagaccccuucccaucucccagcuuccuccagggcggggcacuagagugcaucaucaaacgaggaaauugauccagaccccuucccaucucccagcuuccuccaggggggacacuagagugcaucauuaaaccaggaaauugauccagaccccuucccaucucccagcuuccuccagggggggcacuagagugcaucaucaaaccaggaaauugauccacaccccuauuucgcugaggcaggagugccuuugccucccacacaguguugcccuccagcccaugcgguguugacaaugugccauucuuuauuuauuuauuuauuauuauacuuuaaguuuuaggguacaugugcacaaugugcagguuaguuacauauguauacaugugccaugcuggugcgcugcacccacaaacucgucagcuagcauuagggcauuagguauaucucccagugcuaucccuccccccuccucccaccccacaacaguccccagagugugauguuccccuuccuguguccuuguguucucauuguucaauucccaccugugagugagaauaugcgguguuugguuuuuuguucuugcgauaguuuacugagaaugaugauuuccaauuucauccaugucccuacaaaggacgcgaacucaucauuuuuuauggcuguguaguauuccaugguguauaugugccacauuuucuuaauccagucuaucauuguuggacauuuggguugguuccaagucuuugcuaucgugaauaaugcugcaauaaacauacgugugcaugugucuuuauagcagcaugauuuauaguccuuuggguauauacccaguaaugggauugcugggucaaaugguauuucuaguucuagaucccugaggaaucgccacacugacuuccacaaugguugaacuaguuuacagucccaccaacaguguaaaaguguuccuguuucuccacauccucuccagcaccgguuguuuccugacuuuuuaaugaucgccauucuaacuggugugaaaugguaucucaucgugguuuugauuugcauuucucugauggccagugauggugagcauuuuuucauguguuuuuuggcugcauaaaugucuucuuuugagaagugucuguucauguccuuugcccacuuuuugauggggcuguuuguuuuuuucuuguaaauuuguuugaguucauuguagauucuggauauuagcccuuugucagaugaguagguugcgaaaauuuucucccauuuuguaguugccuguucacucugaugguaguuucuuuugcugugcagaagcucuuuaguuuaauuagaucccauuggucaauuuugucuuuuguugccauugcuuuugguguuuuagacaugaaguccuugcccaugccuauguccugaaugguaaugccuagguuuucuucuaggguuuuuaugguuuuaggucuaacguuuaagucuuuaauccaucuugaauugauuuuuguauaaaguguaaggaagggauccaguuucagcuuucuacauauggcuagccaguuuucccagcaccauuuauuaaauagggaauccuuuccccauuucuuguuuuucucagguuugucaaagaucagauaguuguagauaugcggcauuauuucugagggcucuguucuguuccauugaucuauccaggagaacuuccccaaucuagcaaggcaggccaacauucagauucaggaaauacagagaacgccacaaagauacuccucgagaagagcaacaccaagacacauaauugucagauucaccaagguugaaaugaaggaaaaaaugucaggggcagccagagagaaaggucggguuauccucaaagggaagcccaucagacuaacagcagaucucucggcagaaacucuacaagccagaagagagugguggccaauauucaacauucuuaaaagaauuuucaacccagaauuugauauccagccaaacuaagcuucauaagugaaggagaaauaaaauacuucacagacaggcaacugcugagagauuuugucaccaccagaccugcccuaaaagagcuccugaaggaagcgcuaaacauggaaaggaacaaccgguaccagccacugcaaaaucaugccaaaauguaaagaccaucaagacuacgaagaaacugcaucaacuaacgagcaaaaucaccagcuaacaucauaaugacaggaucaaauucacacauaacaauauuaacuuuaaauguaaauggacuaaaugcuccaauuaaaagacacagacuggcaaauuggauaaagagucaagacccaucagugugcuguauucaggaaacccaucucacgggcagagacaccacauaggcucaaaaugaaaggauggaggaagaucuaccaagcaaauggaaaacaaaaaaaggcagggguugcaauccuagucucucauaaaacagacuuuaaaccaacaaagaucaaaagagacaaagaaggccauuacuuaaugguaaagggaucaauucaacaagagcuaacuauccuaaauauauaugcacccaauacaggagcacccagauucauaaagcaaguccugagugaccuacaaagagacuuagacucccacacauuaauaaugggagacuuuaacaccccacugucaacauuagacagaucaaugagacagaaagucaacaaggauacucaggaauggaacucagcucugcaccaagcggaccuaauagacaucuacagaacucuccaccccaaaucaacucuccaccccaaaucaacagaauauacauuuuuuucagcaccacaccacaucuauuccaaaauugaccacauaguuggaaguaaagcucuccucagcaaauguaaaagaaauuauaacaaacuaucucucagaccacagugcaaucaaacuagaacucuggauuaagaaucucacucaaaaccgcucaacuacauggaaacugaacaaccugcuccugaaugacuacuggguacauaacgaaaugaaggcagaaauaaagauguucuuugaaaccaacgagaacaaagacgcaacauaccagaaucucugggacacauucaaagcaguguguagagggaaauuuguagcacuaaaugcccacaagagaaagcaggaaagauccaaaauugacacccuaacaucacaauuaaaagaacuagaaaagcaagagcaaacacauucaaaagcuagcagaaggcaagaaauaacgaaaaucagagcagaacugaaggaaauagagacacaaaaaacccuucaaaaaauuaacaaauccaggagcugguuuuuugaaaggaucaacaaaauugauagacugcuagcaagacuaauaaagaaaaaaagagagaagaaucaaauagaugcaauaaaaaaugacaaaggggauaucaccaccgaucccacagaaauacaaacuaccaucagagaauacuacaaacaccucuaugcaaauaaaccagaaaaucuagaagaaauggauaaauuccucgacacauacacucucccaaaacuaaaccaggaagaaguugaaucucugaauagaccaauaacaggagcugaaauuguggcaauaaucaauagcuuaccaacgaaaaagaguccaggaccagauggauucacagccaaauucuaccagagguacaaggaggaacugguaccauuccuucugaaacuauuccaaucaauagaaaaagagggaauccucucuaacucauuuuaugaggccagcaucauccugauaccaaagccgggcagagacacaaccaaaaaagagaauuuuagaccaauauccuugaugaacauugaugcaaaaauccucaauaaaauacuggcaaaccaaauccagcagcacaucaaaaagcuuauccaccaugaucaagugggcuucaucccugggaugcaaggcugguucaauauacgcaaaucaauaaauguaauccagcacauaaacagaaccaaagacaaaaaccacaugauuaucucaauagaugcagaaaaggccuuugacaaaauucaacaacucuucaugcuaaaaacucucaauaaauuagguauugaugggacguaucucaaaaucauaagcgcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaguuaggagaagaggaagucaaauugucccuguuugcagacgacaugauuguauaucuagaaaaccccauuaucucagcccaaaaucuccuuaagcugauaagcaacuucagcaaagucucaggauacaaaaucaauguacaaaaaucacgagcauucuuauacaccaacaacagacaaacagagagccaaaucaugagugaacucccauucacaauugcuucaaagagaauaaaauaccuaggaauccaacuuacaagggaugugaagguccucuucaaggagaacuacgaaccacugcucagugaaauaaaagaggauacaaacaaaugggagaacauuccauucucaugaguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccacaucgccaagucaauccugagccaaaagaacaaagcuggaggcaucacacuaccugacuucaaacuauacuacaaggcuacaguaaccaaaacagcaugguacugguaccaaaacaagagauauagaucaaugggacaauaugccauucuuaagauggcuccauugaggucucuggaauuuuccaccaggccacuguacccauuuuccaaguuuucugacguuauccuuuacuuuuuuucuuuuuaaaauaaugucaaacuaagagaaaaguuacaaggagcuccuaaauaucuuucuucuggauucagcaauuguuaacauuuugcuauauaacuuuauuauuuccuccccacucccccccgaccuuuagaacaauuuguaaguuguagacauaauguccuuuaccccuaaauauuuuaguauauauuucuuaagaaaaagggcauucaauucuauuaccauagaucaaaaucagaaaauuuaacauccauacaguaaucuauaauauauaggcuuuuaaagauuuucauaauguagccauuuuaaagugauaaaauauugucaguaguugggaaaguacacauaaauuaguaagucaguaaagcugaauacaaaauauacauguucaaaauuuaaaaaaaaagcaaaauauacacguugauuuuuuuaaauguuaacauucuguauuauguaaauucacauguauaauuaccagaaguuauccugcagagugugaauauuuucuucaaaagaagaaaaaaauuaaauaaaaagaauagcuauaauacuuaucauuauuauuuaauuaauaaaaagauaucuguuuguaguagccauguuuuccaaaucugaauccaugauaucuaguccuauagaguuagacaaauuaaaucacauuuuucuauucacuuaagucaucuuauugaaucaauaauaaaagauacugacuuggaauaaacaggacaagugggugaggacaccccucacaauccucauccuccaucauagauccuucaucuuaaacuaauggaaaugcagaaaaacucccaggacaucugugcacucaaguggaauucuagauccggcagauucaagcucaaucagccaggcuugugugguugugggcucaguccaaggccuggcuuuggcagugacuuccagaugauaagaguaaaaacagugcagauuguauuuauucuuaggaaggaccaaaguuucuagaaaccuugccaaaaaaugaaagacauggaacuccugaaagguaaaaagggaagaggguuaaguacaagauugaguagaugugucuaaaguugacauuuaauuuuuagugaucauuuuuuacaaaucaguuuuuacagauguuuuuaaccauugcaacguguuauuuaaaaaaaaauuuuuuuaaaggccagaaauagguaguuaucauuucugucauuagggcuuaucucuuccaguauuuauuaaaauauauaagcaguucaagaggguagaucuuauguuaaguauucuuuuuuguuuguuuguuuguuuguuuuugaaauggagucucacucugucgccaggcuggaguacaguggugcaaucucggcucacugccaucuccaccuccuggguucaagcaauuuuucuaccucagccucucaaguagcugggacuacaggcgcacaccaccacaaccugcuaauuuuuguauuuuuuuaguagagacaggguuucaccauauuggccaugcuggucuugaacuccugaccuugugauccgcccaccuuggccucccaaagugcugggauuacaggcgugagccaccgugcccagcaagcauucuuaccacaaguaauaauaaucguaacaacaggggugggaggaggcuuggggaggugguggauacacuuacugccuugaugguggugagggcuuuguggguguguacuuauccucaaacgcaucaagauguauacauuaauuauguagggcuuuuaaaaugucaaucauaccucaauaaaguggguuuuuaaaaaauaagauaugaguaguucaauuuaacaaguauguugugggugccaauuuacaugcaaauuaugauuuaguaucaaccccagcaugguguguuuggcucagggucauuuuguagacauuuggcaauagacagaauucacauuuguuaggaauagaaguaauacauaggaaaaucuuugcuuauuuuuuagauguuuggaaaggaauuaaguggcaaauauuguuuuaaaauacuugccugucauaugacuucuuuaucaguggcuuccaaguaacagccugggaaccagcgcucaucuaguguugcaguggccuaaagcaaaaaauaaagacaauauagucugccugccugccugccugucucucucucuaucuaucugauguaagguuaccaacuguccuuucuuagaaaguacugccuauaugcugcuauuuuauucuuauaaaauuuggggguauaaaauacaauuuucuggcugggcgccaugccucaugccuauaagcccagcacuuugggagguagagguggguggaucacuugaggccaagaguucgagacuagccuggccaacauggcaaaaccccaccucuacuuaaaauacaaaaauuagcucggugugguggcgugugccuauagucccagcuacuuaggaggcugagacacaagaaucacuugaguccagaaggugcagguugcagugagcugagauggcgccacugcacuuuagccugggugacagagggagacucugucucaaaaagcaaacaaaaaaacccuuuauuuguuuuuuuuuuaggaacucgugguaagaauagaaaguagcaaaauaaaguuaacaauccucuauugguuguccauucuucuuuuucuuacauuuucuuacugauggaauucaaaaaauucugggaaccauugcaggaaaauaaugguauaacagaaagaguucuaguuuaagaaaagcagacgucuacauauguguuggggcagguuagagaaccucugaguccucauuucuugagguguaaaauaguaguagucauaccuacaugaaggauuauugugaggagcaggugacauauuaguugguaucaaagugcuaucaaaaauuggauugugugaaagcacuuuuuaaauucuaaagcacuguguaaauacaaggugcuauuauuagcugggauuuaaauucuggaaaacaccagucagauagaugaugacuugcuuccagauucaaaacacauauguuauccagguagcaguaugucuuucaucguccagagcaagugaguuaugcuaacaaagcugguuuuucuucaccugccagggugaauggugaaaccaucguauuggguuacauugaguacucucuuaucugugacuuaggaaugaacuuugaaaugauguuuuuaaaaaaauucuugaacauuugcaaagaucacucaaguaugggguuuauuuuucuuuguuuuuacagccaaagaagccuaaagccccagacaauccauuucauggcauuguuuccaaguguuuugagccucaucucuacguguauaucgaaucccaagacaagugagugaggaacauucgcuguuuucugccugcauuucucgccgcucuggucaugacugggucuuaggagcgcacagcuccuuccggggcugaaagaugguuguggcaugccugugacccucccuagaaacccauuagggguauuuuuacaucuuuugaauguuaucauuaauugugucuauaaaucucagagccugaguuugccccuaauaagguccccaguggaucccuacauugggaucccuuccuauguggguguugagcccugacauauaucagcccacaaagcuuuacagugucaggcacuggguauuggaagaaagccuagucucuaauauauauguuuucaaguauaauuuauccuuuuauuuugaaauaauuuagacuuauaaaaaaguuacaaaaauaggacaaaaaauuuucacaugcccuccucagagaauguuaacaucuuacauaacaaccagaguuaccaaaaucgagaagguaauacugucccauuaaugccccuuuuucugguccaggacccaauaaucaugcauuucguugucagaucucuuugaucuuggucuccuuuaaucuugaguaguuccucaucuuuuuauucccuccccuccccuccuuuuuugagacagagucucacgcugucccccaggcuggggugcaguggugagauuaugacuuacugcauccuccaucuccugggcucaagcaauccucccacugcagucucccaaguagcugggaccacaggcacaugccacccucuauuuuuaguagagauucugucucccuguguugcccaggcuggucuggaacuccugggcucaaaugauccacccacuugagccucccaaagugcuggaauuacaggcaugagccaccuugcccagccauuccucaaguuuucuuugucuuucacgaccucaguguguacuggccagguauuuuguacaauguccucaguuuuuguuuguuuuuucuugaugaaaucaauuuugggcaagaacaccauaaaaguggcauuguauccccagugcauugugucaagaggcacaucacauugauuugucccauuauuggggacuucgauuacuugcuuuaggugguaccugccaacugucuucaaugugaaguuacuauuuuucuccugguaauuaauaaguaucuuaugggaugauacuuuguaaauauccugcucucaucaaacuuuugcccacucauuucgcaucccuugauugauuccugacggaagcguuguuucuguggcauuugccaaaugucgauugucuauuuucaucauuucuucuacauuuacuaauuggaguucuacuauauggaagaauuuucccucuccccuauuuguuuauauaucaguaugaacucauggauucugauuuuauuuuauggaucaucuauauaauacaguauaugcuuuucacguggccagguacagugggucacaccuguaaucccagcacuuugggaggccaagguaggaggagcucuugagcccaggauucaagaccagccugggcaacaugcugaaaccucaucuuuauaaauaauuuuuuuaaaaaaacuagucagguguggugaugcacaccuguagucccagcuacucgagaggcugaggugggaaaaucacuggagcccaggaggcagaggcugcaauuagccgucacuaugccacccagcuuggugacagagacuucgucucaaaagaaaaaaagaaaagaaaagcaaacaaaauauacuauaugcuuuucacaaacuuguagccuccaaauauuuuuauaaagcaucucacugcggccagguuucuucccucccacccuguuuuuaaaaaaaucccaaagacuuccaaacuaacagccgaagacuguguucgugcuccaguguccguugugugcgugagggggcauuagaaaaggaggaagacuccuccucaucccugcguccuuguccgcagccaagcccuuccacguuggaaggcagguuuuggaaaggucaagaugauuguaacgagaugacuggagacagacuggccugggcucccagaggaagccucacagucuaaagaacgcacucggaagggaccagaagguggcucccauggggagagcaacagcggcugcaggaaaguccugagggaaguucuucaggaacacacugagguucugagggaagaucucuggaaacacauuggguucugagggagcuucuuggggaaugcauuagguacugagggaaguuaucugggaacauauuagguccugagggagguucccugggaacgcauuagguacugagggaaguucucugggaaugcauugagguucugagggagguucccugggaacgcaugagguccugauggagguucucugggaacgcauugagguucugagggaaguucucugggaacgcauugagguucugaaggagguucucugggaaugcauugagguccugagggaaguucucugggaacacauuagauucugagggagguucuaugggaacccauuagguucugagggagauucucugggaacgcauuugguucagaagggaguucucugggaacgcauugagguccugagugagguucuccgggaacacauuagguucugagggagguucuuugggaacgcauucagguucugagggagguuaucugggaaugcauuagguucugauggaaguucccugggaacgcauuagguucugaggaaaguucucugggaauguauugaaguucugagggagguucucugggaacgcauuagguccugaggaagguucucugggaacgcauugagguucugagagaggucucugggaaugcauuagguccugggggaaguucucugggaacgcauuaggucgugagggaaggucucugggaacgcauugagguucugagggagguucugugggaaugcauuauguccucagggagguucucugggaacacacugagguucugagggagguucucugggaaugcacugagguuccgaaggagguucucugggaacucacugagguucugagggagguucucugggaacauauuagguucugagggaaguucuuugggaacgcauuagguucugagggagauucucugggaacgcauugagguccugagggaaguucuuugggaacgcauuagguugugagggaaguucugugggaacgcauuagguucugagggagguucucugcuaaugcacugagguucugagggagguucucugggaacacuuuagauucugagggaaguucucuaggaacgcauuagguucuaagggagguucucuggaaacacauuagguccugagggagguucucugggaacgcauuagguccugagggaaguucucugggaacgcauuagguccugagggaaguucucugggaacacauuagguucugagggaaguccucugagaaugcauggagauucugagggagguucucuggaaacgcauuagguucuaagagaaguucucugggaacgcauugagauucugagggagguuaucucggaacgcauuagguucugagggagguucucugggaacgcauuggguucuaagggagguucucugggaacacguuagggucugagggaguuucucugggacugcguugagguucugagggaaguucccugggaacacauuagcgucugaaggagguucucugggaacgcauugagcuucuguggagguucucugggaacacauuggguccugagugauguucucugggaaugcacuagguucugagggagguucuuugggaaugcauuagaugaugagggaaguucugugggaacgcauugagguccugagggagguucucugggaacgcacuggguugugagggagguucucuggggacacauuggguucugagggagguucucugggaaugcauuagguccucagggagguucucugggaacacacugagguuuugagggagguucucagaaugcacugagguucugagggagguucucugggaacacauuagguucugagugauguucucugggaugcauuagguucugagggagguucucugggaacacauuagguucugagggaaguucuccuggaacucauuaguuccugagggauguuuucugggaacgcauuagguuugaaggcagguucucugggauugcacugagguucugagggagguucucugggaaugcauuagauucugagggagguucucugggaacgcauuagguucugaaggagguucucugggaacacauuagguucugagggagggucucugggaacacauugagguccucagggagguuaucugggaaugcacugagguuccaagggagguugucugcgaauguacugagguucugagggagguucucugggaacgcauugagguccuaagggaaguucucugggaacgcaguagguucugagggaauuucugugggaacgcauuagauucugagggaggaucucugggaacgcauuuaaguucugaggaaaguucucuaggaacgcauuagguucugaggaagguuuuccggggaugcauuagguucugagggaaguccucugugaaugcauuacguccuuagggagguucucugggaacgcauuagguucugagggaaguucucugggaaugccuuagguucugagggaaguucucugggaaugcauucagguucugagggagguucucugggaacgcaguagguugugugggagcuucuuugggaacgcauuauguucugagggagauucucagggaaugcauuagguuuugagggaaguucucugggaaugcauuagguucugaggaagguccucugugaccucaggguucucagggagguucucugggaacgaauuagguucuuagggaaguucucugggaacccauuagguucugagagggguucucugggaacgcauugagguccugagggagguucucuggaaacgaauugagauccugagggaaguucucugggaacgcaucagguccugagugaagaucugugggaaugcauuagguucugagggagguucucugcgaacgcacuagcuuuuaagggagguucucuggaaacgcauuagguccugagggagguucucugggaaugcauuagguccugagggaaguucucugggaacacauuaggucuugagugaaguccugugggaacgcauuagguugugagggaaggucucugggaaugcauuaaguucugagggagguuaucugggaacgcauuagguucugugggagguucucuggguacccauuaggucuugagggagggucucugggaacgcguagaggucuugaucucugcgaaugcguugagguucugagggagguucucuuggaaugcauuagguucugagggagguucucuuggaaugcauuagguucugagggagguucucugggaacgcauugagguccuaagggaaguucucugguaaugcaucagguucugagggaauuucucugcgaacgcauuagauucugagggaggaucucugggaacgcauuagguucugagggaaguucucuaggaacgcauucuguccugagggagguucucugggaacacauuagguucugagggagguucccugggaacacauuagguccugagggagguucucuggcaaugcacugagguucugagggagguucucugggaaggaauuagguucugagggaaguucucugggaaugcauuagguucugagggagguucucugggaacgcauuagguucugagggaggaucucugggaacaccuuagguccugagggaggaucucugggaacagauugagguccugagggaaguucucugggaauucacugagauugugagggagguucucuggaaacgcacugagguucugagggagguucucugggaacgcauuagguucugagggaauuucucugggaacgcauuaaauucugagggaggaucucugggaacgcauuaguuucugagggaaguugucugggaaugcauuagguuuugagggagcuucucugggaaggaauuagguucugagggagguucucugggaacacauuagguucugagggagguucucugggaacgcauuagguucugagggauguucucugggaccgcauuagguccugagggagguuuucugguaaugcacugagguucugagggagguucucugggaccgcauuagguccugagggagguuuucugguaacccacugagauucuguuggggguucucugggaaugcauuagauucugagggauguucucugggaccacauuagguccugacggugguucucugguaaugcacugagguucugagggagguucucuggcaaggaauuagguuaugagggagguucccugggaacgcauuagguccugagggugguucucuguuaaugcacucagguucugacggagguucucugggaaggaauuagguucugagggagguucucugagaacgcauuagguccugagggugguucucugguaaugcacugagguucugagggagguucucugggaaggaauuagguucugagggaaguucucucggaaugcauuagguucugagggagguucucugggaacacauuaggucaugagggaggaucucugagaacacauugagguccugagggaaguucucugggaaugcacugagauugugagggagguucucuggaaacgcacugagguucugagggaaguucugugggaacgcauuagguucugagggauguucucugggaccacauuagguccugagggugguucuccgguaaugcacugagauucugagggagguucucugggaaggcauuagguucugagggaauuucucugggaacgcauuaaauucugagggaggaucucugggaacgcauuagguucugagggaaguucucuaggaauacauuagguucugagggagguucucugggaacgcauuagguucugagggagguucucugggaacgcauuagguucugagggagauucucugggaacgcauuagguucugagggagguucucugggaacgcauuagguucugagggauguucucugggaccgcauuagguccugaggaagguucucugguaaugcacugagguucugagggagguucucugggaccgcauuagguccugagggagguuuucugguaacccacugagauucuguuggggguucucugggaacgcauuagguucugagggaggaucuuugggaacgccuuagguucugaaggaaguucucuacaaacgcauuccauucugagggagguucucugggaacgcauuagguucugagggauguucucugggaccgcauuagguccugcgggagguuuucugguaaugcacugagauucuguuggggguucucuaggaacgcauuagguucugagggauguucucugggaucgcauuagguucugagggagguucucugguaauugacugagguucugagggagguucucugggaaggaauuagguucucagggaaguugucugggaaugcauuggcuucugagggagcuucucuggaaacgcacugagguucugagggagguucucugggaacgcacugagguucugagggaauuucucugggaacgcauuaaauucugagggaggaucucugggaacgcauuagguucugagggaaguucucuaggaaugcauuagguucugagagagguucucugggaaggaauuagguucugagggaaguugucugggaaugcauuacguucugagggagcuucucuggaaacgcacugagguucugagggagguucucuaggaacgcauuagguucugagagaauuucucugggaacgcauuaaauucugagggagcaucucugggaacgcauuagguucugagagaauuucucugggaacgcauuaaauucugagggaggaucucugggaacgcaucagguucugagggauguucucuaggaaugcauuagauucugagggagauucuuugggaacgcauuagguucugagggaauuucucugggaaagaauuaccugcuuaggaagguuuucugguaaugcagugagguucugagggagguugccugggaacgcauuagguucugagggagguucucugaaaacgcauugagguccuaagggaaguucuuugggaacgcauuauguucugagggaauuucucugugaguguguuagauucugaaggaggaucuuugggaacgcauuagguccugagggaggaucuuugggaacgcauuagguucugagggauguucucugggaccacauuagguccugagggugguucucugguaaugcacugagauucugagggagguucucugggaaugcauuagguucugagggaauuucucugggaacgcauuaaauucugagggaggaucucugggaacgcauuagguucugggggaaguucucugggaaugaauuacgugcuuaggaagguucucugguaaugcacugagguucugagggagguugccucgaaaugcauuacuuugugagggagauucucugggaacgcauugagguccuaaaggaaguucuuugggaaugcauuagguucugagggaguuucucugcgaacguauuagauucugagggaggaucucugggaacgcauuagguucugagggauguucucugggaccgcauuagguccugacggagguuuucugguaaugcacugagauucuguuggggguucucugggaacgcauuagguucugagggaggcucugugguaacgcauuagguuuggagggauguucucugggaacgcauugagguccugagggagguucugugguaacucauugagguucugugggagauucucuaggaaugcauugugguucugagggagguucucugggaacucacugaguucugacagagguucucugggaaagauuagguucugagggagguucucugggaacgcauugacguccugagggaaguucucuggaaaugcauuagguucugaaggagguuuucugggaaagcauuaggucugagggaaguucuuugggaacacauuagguucugagggagguucucugggaaugcuuuagguucucugagagguucucugggaacgcacuagauccugagcgagguuucugggaaugcauugagguccugagggagguucucugcuaagucauugagguucugagggagguucucuaggaaagcauugagguucugagggagguuuucugggaacgcauuagguucugagggagguucucugugaacgcuuuagguucugagggagguucucugggaaugcacugagguucugagggagguucucugggcacauauuggguucugagggagguucucuggaaaugcacugagguucugagggagguucucugggcacguauuggguucugagggagguucugugggaacgcauggagguccugagggagguucucugggaaugcauuagguucugaagaaauuuuucugggaacgcauuagauucugagggaggaucuuugggaccacauuagguucugugggaaguucucugggaaugcauugaggucugugggagguucucugggaacgcauuaggugcuggaggagguucugugggaaugcauuagcuccugagggagguucucugggaacacauuaggugcugagggagauucucugggaaugcauuagguucugagguauguuuucugggaaugcauugagguucugagggagguucucuggcaaugcauuagguucugagggagauucucugggaaugcauuagguccugagggagguugucugggaaagcguuagguucugagggaaguucuuugggaaugcauugagguucucagggaaguuaucugagaacgcauuagguuaugaggcagauugucugggaacacauuagguucugagagagguucucugggaaccauuuagguuugagggagguucucugugaacacauuagguucugagggagguucuuuggaaacucauuagguucugagggagguucucugggaacacauugagguucuggggugguuuuucggaacucauuugguccugagugaaguucucugagaacgcguuagguugugagggagguuuucugggaacgcauuagguucugagggagguucucugcgaaugcauuagguucugagugaaguucucugggaacacauuuagguccuaagggaauuucucugggaacgcauuagggucucagggagguucgcugcgaaugcauuagguucugagggaaguucucugggaacgcauuagguucugagaguuuucuaggaacgcauuagguccugagggaagucuucugggaccgcauuagguucugagggaaggucucugggacgcacuagguccugagggagguucucugggaaagcauuagauucugggggagguucucugggaacgcauugagguucugagggagguucccuggaacacauuagauccugagggaauuucucugggaaugcauuagguucugagggaaguucucugggaaugcauugagguucugaggaagguucucugggaacgcauuagguucugagggagauucucugggaacacauuagguucugagggacauucucugggaacgcauugagguucugagggaaguucucugggaacgcguuagguucugagggaaguucucugggaacguauuagguuuuuagggaggcucucugggguugcauuuacgcauuuaggucugauugcacuucaccccuccccuuguuuuuaaugcuucuaucaugggugagcacauucuuaguuucaaacauguuucuuaaaccguaacaguaagacaauguuucaauuagaaacuucacauggaacuguauuauucacucacgugauuuuauggacugcuucuaugcuuuucaugcccgauuacaaaguacuucauauuaaaaucucagaaaaugaacuugcccaguagcuucuccaucaucaaauggaagucuccccaucagcccaccaccaaaggcaaguugccuugccgucauuugccuugcaaagacccaguagugcccuugcucuugcccagugggcacgugcccagcaggcacaccgagguacaguggggacuucugccucuuuguccuugagagcacccugucuucuacauucacaguuugccuccaggaaguuacuaagacaccccugaggggcaggaaaaaggauugguuauuugccuauuagagucacaggucuuugaggaaccccccuggaugacucuuuucagccaaagccccaucuucucuuaacccaaauuuuucguuuuaaaaggcuuaaaaguuacuggguccaggguuuauuuuuauuuauuuauuuuugagacggggucucagugucagcuaagauggaguacagaggcgugaucaggacucacuguagccucaaccuccuggguuucagcagucuuuccuacucagccucucaaguagcugagacuacaggcacacaccaccacaccuggcuaauuuuuguauuuuuuguagagacgcaguuuugccauguugcccaggcuggucucgaacuccugggcuuaagaggucagcccaccuccaccucccaaagugcugggauuacaggcaugagccaccgcgcccagccaaggcccaggguuuaaagcacaugucugagguagccacauccuuucccaaaaccuaccugguuuaaagggucauuuuucugaguuauuguaauucuggcauccacucuuuucacauggccuugauuuauacaaaguauacucauuguucaugauacuuugggcaaggagccaggccucccuuccuuggggacucuccauuuuccugugaaaaaugaagugcuggccacuuacccugcuguuuggccucacuaggaaguuuccgcagcacuaaggaaggagcagauacugcgcaggcugugcugcuguuccugcagaauaaacacuguaacucaaaguagaaaauagaguucaaagaacuccauuuccuuaucugucaagagagauagucagacaaaauaaugcccaacgcacucguuauuaaccauuuuaaagucauagauccuuuuuaagaacccaauggaaagcaucgacgcucuugucaaaaaaauccauaucaugcacacacuauuuugaguguaauuucaaggaguucuaggaacugcuucuucccuucaaagaauccugaggcuggagaaggaacucagguggggacugguuuugugcacauuacuacuuuugcuguagcucuaacucagaaagcaugagaccauucauaacuucccagaugacagagacgcaacacagugugguggaaagagcgugggccugaucccagacauaccuagaugugaggcuucgcgcuugcuaggcugggaccuugagcaugcuccuagcuagccccucuacacugugaggaucauaaggccgaccucauggacuuuguggcgaggaggagaagagguggcauuuucaccuucagcacacaguaaauggugcucaggaacagugccugcccugccaucccucucaucuuuuucaggacuccuauguggguggguggccuugucaguguggccagauuucucuugagccuggcaugggguccaccuucucaucuccccagccucccaccugccaagggaaaguuccggcagcaucugccccagccaaaagccaaguagcaguaggaggacugcagagccaguacucagggaggaggcaggaaguggggauggccacuagcagguugggcuaagccguccuuacauccuuuaaauggcuuucucaauuuuuauuuauguucaaagaggagguuagucugucuucuacccuuggcauuuagugauuuccucuggcugacucuugcaaaagaaauuucuacauaggcacuuucuuuaccccauucuauggcguucuccaucagggaaguuacuggugacuccauaucugcccauucuccugaguucccucuaauaacuuuuguuagacuagaacucaugcuuuucuagagccuagcaucugucuguaaacuaauuaccauuguugauuauuuuauuuuauuuuuauuuuuauuuuuauugaucauucuuggguguuucucacagagggggauuuggcagggucauaggacaauaguggagggaaggucagcagauaaacaagugaacaaaggucucugguuuuccuaggcagaggacccugaggccuuccgcaguguuugugucccuggguacuugagauuagggaguggugaugacucuuaacgagcaugcugccuucaagcaucuguuuaacaaagcacaucuugcacugcccuuaauccauuuaacccugaguggucacagcacaugcuucagagagcacaggguuggggguaaggucacagaucaacaggaucccaaggcagaagaauuuuucuugguacagaacaaaaugaaaaguuucccaugucuacuucuuuccacacagacacggcaaccauccgauuucucaaucuuuuccccaccuuucccgccuuucuauuccacaaaaccgccauugucaucauggcccguucucaauaagcucuugggcacacgucccagacgcgcugggcagaggggcuccucacuucccaguaggggcggccgggcagaggcgccccucaccucccggauggggcggcuggccgggcggggggcugacccccccaccucccucccggacgggguggcugcccggcggagacgcuccucacuucucagacggggcggcugccgggcggaggggcuccucacuucucagacggggcgguugccgggcagagggucuccucccuucucagauggggcggcugggcagagacgcuccucaccucccagacggggucgcggccgggcagaggcgcuccucacaucccagacggggcggcggggcaaaggcgcuccccacaucucagacgaugggcggccgggcagagacgcuccucacuuccuagaugggauggcggccgggaagaggcgcuccucacuuccuagaugggaugggggccgggcagagacgcuccucacuuuccggacugggcagccaggcagaggggcuccucacaucccagacgaugggcggccaggcagagacgcuccucacuuccuagacgggguggcggccgggcagaggcugcacucugggcacuuugggaggccaaggcaggcggcugggagguggagguuguagcgagccgagaucacgccccugcacuccagccugggcaccauugagcacugagugaaccagacaccgucugcaaucccggcaccucgggaggccgaggcuggcggaucacucgcgguuaggagcuggagaccagcccggccaacacagcgaaaccccgucuccaccaaaaaaauacgaaaaccagucaggcauggcagcgcgcgccugcaaucgcaggcacucggcaggcugaggcaggagaaucaggcagggagguugcagugagccaagauggcagcagcacaguccagcuucggcucggcaucagagggagaccguggaaagagagggagagggagaccguggggagagggagaccguagggagagggagagggagacuguagggagagggagagggagaaggagagggagagggagagcccauuguuguuuauuuugaauuaauuucaagcuuacagaagaauuauaagaauuauacaaagagcccuuguauagccuucauccagauuccucauuaauaguuaucucccccacacacguaaugcacagacacugcaugcauuuuccuuuucuuuuuucucuuccuucuuuuucuuuuucucucuuucccuuucucuucucccuccccuccccaccccuccccucccuuccucucccuuccccuccuccuacuucagccucuagaguaacugagacuacaggcacaggccaucacaucagucuaauuuuuguuuuuuuguagagacagggucucaccauguugcucgggcuggucucaaacuccugggcucaagugaucugcuggccucccaaaguguugagauuacagacgugaaccacugugcccaaccuguacuuuuuuccugaaccuuugaauucucaaguugcagacaagauucgccacuacuccuuaauacuucaauauauauuucuuagaaacaagguuucuacauaaccacaguacaacuguccacaucaggaaauuaacguugauacaacauuacugcuuaaucccagaccccucacauaaccacaguacagcuaucaacaucagggaauucacagugauacaguauuacugcuucauccaugcucuccuccucacauuucagcaguugucccaaucugcuuguuuguuggccuguuugaauagcccuaggaucacagguuguuaguuuauuuguuugaauagcucucagaucgcagguuguuuguuuguuuaaauagcucuaggaucacagguugcauuuaguugucaugucucuuuggucuccuucaacccagaagacuaauugagucuuucuuugucuuucaugaccuugacauuuuugaagaggauuggccaauuacuuucuggaauuucccucaguuuggguuugucugauguuuccucauuauuuaugauuuaugcagaagugguccuguguuccuaggaauucauaucaggaggcacagaaugccaguuuaucccaaaacuugugaugugauguucuuuuuuuuuuuuuuuuuuuuuuugagacagagucguuucacucuauuccccaggcuggagugcaguggugcgaucuccacucacugcaaccuccaccuccugggcucaagcaauucuccugccucagccuccugaguagcugggauuacagguacccgccacugcacccagcuaauuuuugucuuuuuuuuaguagagacaggguuuugccauguuggucaggauggucuugaacuccugacuucaggugauccacccgccuuggccucccaaagugcugagauuacaggcgugagcuaccacggccagccuaugauguucguuuuuauuacuugguguagauguugucucuacuggguaucucuauuuauuaauaaguguugggagaaaccuugaaacuuuaucaauauccuuuuccucaucuuucacuuaucauguaauuuauuacuaagaugauugacaaugaugauuuuucuucuuuuuuuuuuuuuugaggcagagucuugcucugucgcccaggcuggagugcagugacauaaucucggcuccuggguucaagugauucuccugccucagccucccaaguagcugggauuauagaugcucgccaccaugcccagcuaauuuuuuuguauuuuuaguagagacgggguuucaccauguuggccaggcugguuuggaacuccugaccucaagugaucugcccaccucggccucccuagauguugagauuacaggcaugagcugccgcgcccagucaaauggugauuuuucuagcuacaucauuucuucugcguuuaucaguuggcauucuacuuuaagaaaagcugucacuucucccccuuaugucuaugucagcauggacucauggauuuuuauauuuuauucaguagguuguaggcaucacuaucucuuuuauuuuuacuguauuuuggaauaaauguauaccuauaggaaaauuucacaaauaguacagauuucuuauguuccccuucacccaacuuccccugauguugacaucuuauauaaccacagcagaguugucaaaacuggcaaguuaacauugguacauuacuauuuaauaaccugcacaccguguuugaacuucaccaguuuuuccauuagugucuguuuuuccuuccaggauuugucguuguuauuuuaguacucaaauugucccugacuuggccagugggagccucuuaaagcuggcucuucauccuuuuuacaugccacuaucauuuuuugagcaccuccuuccucucuggcacaauaaaauauacuaggcuuauccuguacuuuuguaucccagcccuggagucguccauuuccccaggcauuucuuguuccuuugguggaggaugacauuuagaaaccaaguaugcucauugcugcucggugucauugcuuccagauugccuuggcugagagagcuaagaaauguauguguguauaaacauacguguauaugucucuauagcugugugugcaccugcuucuacauauaugccucuauagcugugugugcaccugcuucuauauuagaaccugugcauuugaugcugaugccuucaauucuaaucucacaccacaggguuuauuuuagccucucccauucaacguuggcaacugccuucuacaacagugagaaauuuggguccuagcaugcucaguauauuuaccuauuugcucaguuugccuguauguaacccaucucccagcugugcucaagccacaccuuggcuccccagccccacuggccacaccagagcaacauccucagccccagcaaaaaggaagaggaagggaugcaaauuagugggaguacccuugaauuaagaagcucuagggucgggcaugguugcucgugccuguaaucccagcacccugggaggcugaggcagguggauggcuugagcucaggaguucgagaccagccugggugacaugacaaaacccugucucuacaaaaaaaagcccacaaaaauuaaccaggugugguggugugcaccuguagucccagcuacucaggaggcuggggugggaggauugcuggagccugggaggcagaaguugcaguaagcuguggucaugccacugcacuccagccugggugacccugucucaaaaaaauaaaaaaauaaauaaauaaguuaucuaacuuaauggggaucuucagcugccuugaccuugcucaccugcguugccaucuucuggcuacugucuuucucucccugugccucacugcuugacauuccaauuagaauauuguuucugugaaugcugacugcaggcccaccagagaaauggccuuggccauccauggauaaacccagucugcaauggcauauuuuuucuccucacuuuaguuuuucccucuacugauaccacucugcaacugucuucauuccuagggcauguaauuuaucaguggaacucccagcaguauuucgggaaggagguauuuccuuccuucucccuuccccuccccuccccuccccuccccuucgacaaugucuugcucuguuguccaggcuggagugcagugguggcauuauagcucacuguaaccucaaacuccugggcucaaaugaucguccucccucagccucccaaguaacuguaacuacaagcacacaccaccaugccuaacuaauuuguuuauuuuuuuuuagagauagggaucuuacuuuguugcccacacuauucucaaacuccuggccuccuccuagccaugcauggugauggacgccuguagucccagcuacuugggaggcugaggcaggagaauugcuugagccugggagguugaggcugcagugagccaugaucaugccacugcacuuuguccugggugacaaagcaauacucugucucaaaaaaaaaaaaaagaaaugugaucagauuggaucauguauucaaaacuaaugagccuuacgcauucccauugggguaacuuacauucuucuguucugugaaauacuggcuacugauuuucuaaugucucauguggcaucaaagcaugcugaugcagggugaaagauggaaggcaggggaagguuuccccaacugguuuauuucucauccacuugaaagaacaaugucagaaguaaccgaguagacauccuguagacauucuacaaaguauagaucuuuagagcuuuuugaagugaacauuuucuuuaugcuguaugaucauaauuaguuuauaaucuuacucauugggguggcucugaaauaggaagcaaguaaguaaguauccaucuucuaggggaacaggugagugaugaaaauagaaucacaucagaguuggcuggcgcguuggcucacgccuggaagcacaucagagucggcugggcgcaguggcucacgccuguaaucccagcacuuugggaggcugaggcgggcgaucacuaggucaggaguucaagaccagccuggccaagauggugaaaccccaucucuacuaaaaaaaaaagcaaaaauuagccgguugugguggugugugccgguagucccagcuacucaggaagcugaggcaguagaaucacuugaacccgggaggcagagguugcagugagcugagaucaaaccacugcacuccagccuggacaacugagugagacuccgucuccaaaaaaagcaaaaaacaaaaacaaaaaaaaacaaaaaaaacacccaugucagagcucuggucccugauuugguuggcacuaucaauuuagagauuagaaucucauaagaagaccccaggggaaucuuuugccuucuguuccauguucuccuccacugcaccggccuccaucccguuuccaccuucccacccuccauucccauccccuaggaacaaaguguggagguugaucagguaaguauguaucgagcacuagcaugaagcuucacuccacucauuggcaugacgggcgggccgggggcagcagaaccagcauaaacgucauuccuccucucagggagcuuguguuaacaggcacgaaacagaugauucuaccuccuucgccuuuuguaccaacuucaguugauagaggugacuggcuggagugcugucucaagaaggauucuggaaucacaagagagaucagugaagaaagggcuccuuguugauuagcauugccuaccguggcccaggaugggagaagauagguuauuucuuucuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgccuggcuaauuuuuuuguauuuuuaguagagacgggguuucaccguuuuagccgggauggucucgaucuccugaccucgugauccgcccgccucggccucccaaagugcugggauuacaggcgugagccaccgcgcccggccgguuauuucuugaauauauggcauccucgcacugucuaauaaaguguuaaauaaaguguugguggguggcagaugacagaaguugcagcugcugcgggugagaccuggaugagcuugaaaggggaguggacagguggugggagagcguuuuggccaggacgucacacaggcccagugaccgggaguaggccagcaggggagccguugcgaggcccacugaccgggaguaggccagcaggggagcuguugcgaggaaccucuggcuggaguguugggucagcuguggaggagaggugggagauucagugggaaagugaggcaagagagguuaugaggaacaagagugguggccaugaagcuuuccgaggucaaccaacgagauccuucccugcuuucucacuaucaccacagacagagacuuagccuaggccagaagcucuuugagggcagagugguuguaucuggauauaauagacuuucuuuuucuuuucuuucuuuuuuuuuuuuuuuuuuuuuuugagaugggguuucgcucuuguugcccaggcuguagugcaaugguacgaucucggcucacugcaacuuccgccucccagguucaagugauucuccuaccucagccucccgaguagcugggauuacaggcacccgccaccacgccuggcuaauuuuuuguguuuuuagugaagacgggguuucucuauguuggucaggcuggucucaaacucccgaccacaggugauccacccgccccggcuucccaaagugcugggauuacaggugugagcccccacguugggccuauaauagacuuucaauaacaaaagccuuugaguaaaaugucaauuuucuccuauuccugcuaauuggugguaugugugguucuugucuuuuucuuccuuaccauuauauaaauacauuuuuaaaacacagcuggauuccuauagccuuaaacggcaaccuaaaaagaugcaacaugucaggaguggugggaacccuucccauucuucacacagcacagcugugcaggcagcaguuacugcagcucugcuggauccucacaggugaugacacaauucaacggaacaauuacagggauguuugaaugggaaaucggagaaaaauugcaacucucauccccacuguggccugaggcaagucuggagcugcucauacccuguuuugguuuuuguuuuuuuuuuccagauaucaagucuugcucuguugcccaggcuggaaugcaguggugugagcugggcucacagcaaccuccgccuccugaguucaagugauucucugccucaggucucagccuuccaaguagcugggauuacaggcaugcgccaccacccccagcuaauuuuuuuuuuuuuuuuuuuucugagacagagucucacuuuguugcccaggcuggagggcaguggugcagucucagcucacugcaagcuccgccucccggguucaugccauucuccugccucagccucugaaguagcugggacuacgggcacccgccaucaugcccggcuaauuuuuuuuuuguauuuuuaguagagacgggguuucaacguguuaggauggucuugaucuccugaccuugugauccgccugccuuggccucccaaagugcugggauuacaggcaugagccacugugccuggcccacaccacgcuaauuuuuguauuuuuaguagagacgggguuuugccauguuggccaggcuggucucgaacuccuggccucaagugauccgccgccugggccucccaaaguguugggauuacaggcaugagccaccgcacccggcccacacccggcuaauuuuuguauuuuuaguagagacgggguuuugccauguuggccaggcuggucucgaacuccuguccucaagugaucugcccgccucggccucccacagugcugggauuacaggcuugagccaccacacucugcccguacccucucuuuuccuaagauuuuuuuaaaccuuugauucuggaaguucuaagaaaaaacuaaaucggaggagaaagaaaccauuauaacacauuucacaguuucucuuuguuuaggcaucugucucuugggcacauuuagguucgugaugucuaaauaugugcugacaucauaaccuuuuuguuuuuaggaaguagagugcuuaaaggcuugaagcuuagagccaggcugcuuaguuuuuaaucguggcucuccuguuuucuugcuguauuacucuggacaagguacucaacuuuucuguacuuaacucuuugaaaaugaggauaguaauaauacauacuauguaaguuuauuguaaaaaguaaaugagcugggcgcagugaguggcucacaccuguaaucccagcacuuugggaggccaagguggguggaucaccugaggucaggaugucgagaccagccugggcaacauggugaaacccugucucuacugaaaauaaaaguuagcugggcaugguggcgugugccuguagucccagcuacaugggaggcugacgcaggagaauugcuugaacccugaagauggagguugcagugggccaagaucaugccgcugcacuccagccugggccaacagagcaagacucugucucaaaaaaaaaaaaaaaaaaaaaaaaaggaaaugaaguucagugagauggguauaaagcauggacauaauaccuggugcaucucaaguguucagaaaacgaucacuaucaugauuuaggguuuuccuuuuuggagggguaaacaguacuaauaugauagaaggauuaguuucuuacuuuaguauuggagucuaggcucagcucugccacagacuuugugagaaacuuucuaggacuuaauuuucucaucuuuuagcgggaccaguaauacccuaucuugcuuacagggguuuggaguccaauaugauaaugaaaugccuugaaaaguauaaagcacaaaugucaaucgacuuagagauuagaaucucauaugucagauuuuauuacugcuguuguaggagugguggugguagugaaugaugauauugauuaaaaucgauccgauuuuaaguuuuaaaugcaguaggaaugauuacuuguggcaguaguuuauguacauugcaaacgagcacauuugcuuuacuuuucuugaaguaaaauaacauuuuugguuuuuuuuuuuccuccuaggaaccucggagagcugauagaucgguuuguggcugauuucaaagcccaggggccaccuaagcccaacacugaugaagggggugccgugcuccccagcugcgccgaccucuuugucuacuacaagaagugcauggugcaaugcucucagcucaguacuggggagcccaugaucgcccugaccaccauuuuccagaaguaccuccgagaauacgccuggaaaauccucucuggcaaccugcccaagugaguccuguucuucauagucugagugguggcaaauagaccuaaauaugggaaucuuaaggaaauccacucugaaguuguuuacuaaaccaccaagaguaucaaggaggaaagcacgcuuccugaguucccgagggccugaagcuauuuccucucugacauuccacagcugaucaagaccaucagaggaaauguccacacugacugcccacgugggcaaaucuuaccacgguggacucgagaaccaaucccauuguaugccuauuuaauuuucauggauucagcuauagauacuuggcacauacaaaaaaagugagguugugguggaaauaacugauaaauagcuuaagcaguuucacccaagccucuuuuggugagaugaugccccggagugauggguuggaggaaugaaucugcuuuuuccucauucccaguagguuccaagucccucuuguggugcacacuuccugccaugcuggacagagccuaauguuucagaugcgguaggauugggggucagcuacugcauagcuccuaauuauggggacuauuguguuauccugaggcauuagaacuggacauagccuaauguuugaagaugcgguaggauugggggcagccgaggcaggaggaucacuugaggucaggaguuugagaccagccuggcuaauauggugaaaccccaucucuacuaaaaauacaaaaaucagcugggugugguggugcaugccuguagucccggcugcucgggaggcugaggcaggagaaucacuugaacccgggaggcggagguugcgcugagccgagauugugccauugcacuccagccugggcauugcagggagacuccgcccuaaaaaauaaauaaauaaauaaauaaauuauguauaaucccacuacccaaagagaacguaacuuuuuguauauauuuuuccguucuugauagauaccuaaugugugugaucugugugcuuuuguuuguuugugucacggaauuggggcuauacugcuuauagcuuuauucccugcagcuaccguuuaacuucaucgugggagcauuuucccacguguauuagucagcaucucagcagaaaaaaauggcauacucagcugggauuaugucaguagagagacuguucacagaagugggggcaaggugaaaggagccaacagaggauuccaaagcauccagauaugaguggguagugguuacuaccauagaacucacucaguagcuggggcugccccaaaaccuguagucacaggaggaugugugauggguguuggccucuugagacacuuagggccuugggcaggaagcaugucuuaacauucgcuuauguccuccuccacaagcacacaugaguccccuugcagacuucucuuaacauucgcuuauauccuccuccaccagcacacacgagucccagugcagacuuuucuuaacauucacuuauguccuccuccacaaacacacaugaguuccagugcagacuucucuuaacaugcgcuuauguccuccuccaccagcacacaugagucccagugcagacuuuucuuaacugaaagaaacaggguagguaaccaucuuucgugcuccacacgguccuaaaugaguucugcacaucaggagauuccaagcuaaagagaggacagcucagcagccuucccuuuggauauuagaccauccuaguuaaugugacuaauggccugcugaugauucagauuaacuaaaauaggaaucaucucuuccuauuucugacggugucaagguaaggucaguaggaaaaggacucauuguaugugaauugauuugggccauguccagccuuuacuucccccuuuucuguaucuuaaaauaauguaguuuccaguucaggaagcaaauuagaaauuccaugcugacuuguuccuguuccuuuucuucagaaccacaaccagcaguggaggacugacuaucagcagccuccucaaggaaaaggagggcucagaaguagccaaguucacucuggaggagcucugccucaucuguaacauccugagcacggcagaguacugucuggccaccacccagcaggugagccauccuggcugcccacucaccaccuccuuuuccugaacccucugggcugcgucgcucggcgaguaagaauauacguccuaacauggccacagacaaccuugggucagaccaguuggccugccacagaggaaagcucaguguccagccauaaggcugcccaggcagcugucuuacagaaaggccuuguuaaaagaagacugggcaagaaaguaugacuggucaccucccuggaguuguguaagcuccucaaagggcaugaccuguuaaaaguaggucaguagcacuccaacccauaugagaaaagcaguaacaagcuugucugugcuaggacccagccuuuggugaugaugagucacagccaguuauuccaugcucagaaguguuacuaaguuaagcagaauccuuugggcuuuuaugugucuucugaaauuuacauggcauuuucaaucugccucaacaaauagccauuguuugggaugcugacguuuaggaacugggggacaggaaagggugaugccucugcuggaggcccccacauggccauaguucagcaacugauggagcagaaggaagacccagaauaaccuuugauucagccuuaaacauggaauuagaaguccuuuucacacuuggucugggauuccccugaggccaagagaaagaaaguaauuuggaaagguucugcucuucuacccacuuuguauuuauaauuuacagaugccuagaccacaagaagacagucauaaaugauaguucagacagcccagcuuggagcuccugugugccagggcagcaauauagcaggucaaauaggaagugugucuaccaaggccccucaguggcacauaagccagccagaggcagaggcagcagcacacucugccuggggaccuggucauguugaguugcgaaggucaugaccuuccaggguuuggccuuggagccacagagcaguccguuuagccccaggccacuccccagguaagauggcacuaucuguaaggaccuccaaggcagggguuccagaguucuuucaugaagaaacacuguuuaacuauuuugggugugcacagaaagaaauacgauacauguaaauaugcuauuuuaaagguaaaauaaccguaguauuuaaaaaaauaaagaucccuuuuaaucccaucauccucaaauaaucauauuagcaauuugggguauuuuuucaauuguuauucauagacauaguuuugaauguuacaaucuuaauucacuguuauauccuuuuauuguuagugucauacauagcauuagcauuucuccugucauuauaaugauaguaauaaucauaacuaucauuacagggucauuauuacuaucauuguuuauggccacauaauauuucucuuuaagggacuauaccauaaauuauuuauuuauuuauuuauuuugagacagagucuugcucugucuuccaggcuggagugcaguggccaugaucuuggcucauugcagccuccaccucccagguucaagcaauucuucugccucagccuccugaguagcugggauuauagaugcccaucaccauccccggcuaauuuuuguauuuuuuuuuuuuuuuuaguagagaugggguuucaccaucuuggccaggcugaucuccaacucuugaccuugugauccaccugccuuggccucccaaagugcugggauuacaggugugagccccugugcccggccuuguaccauaacuuauuuagcaagcaucccugaucguuguuuauagugcuucaaauuuugcuuuuuuuuugaaacagagucucucucugucacccaggcuggagugcaguggcacgaucucggcucacugcaagcucccccugccggguucucgccauucuccugccucagccucgcgaguagcugggacuacggguucccaucaccacgccuggcuaauuuuuuuuuauuuuuaguagaggccggguuucacuguguuagccaggauagucucgaucuccugaucuugugaucugcccgucuuggccucccaaagugcugggauuacagacgugagccacugugaguagcugggacuacaggcacccgcuaccacacacagcuaauuuuuuguauuuuuaguagagacgggguuucacuguguuagccaggauggucucaaucuccugaccucgugauccacucaccuuggccuuccaaagugcugggauuauaggcgugagccaccaugcccagccaaaauuuugcuuuuauagauaauccuggcaggguacaguggcucacgccuguaauccuagcauauugggaagccaagguggaaggaucgcuugaggccaauaguccaagaccagccuggguaacauagugagaccuggucuuuacaaaaaauuuaaaaguuaguugaguguggugguacaugccuguggucucagcuacuugggaagcugagguuggaggaucgcuugagccugggaggucaaagcugcagugagcuaugaucacaccacugcacuccagccugggugacagagugagacccugucucuaaaaaaaaaaaaaaaaaaaaagauaauccuuacaaagaaugucuuucugaauauagcaucuuaaauguuuugcauuaguuuucuagaacagacucuuagaaguucuagaaauaaguugaagaccauuuugaugacugaugauacaaguggccaauuauuuuuuauuuagugaaaauuguuuuuauugauuacaaaaguaauacauucuuagcaccuuuauugugaucucuaaauacaauuuuccacuaaaagaaaccagagauuccuggagaaaugacuaauuccaggucaagggcaggaaaucuacaagaugaaucagaacaucauguuacacaaaaagcaagaaaaauaucaaagacuauuagugucaucucaagaggacccagggagauauaguggguugaaguguccccccaaccccaaaauauguccaaguccuaggccuugggacauguaaaugugacuuuaucuugguaaauguaauuaaguaucucaagaugagaugguccuggauuuaggauugguggggggccuuaucuaaugacuguuguccuuagaaaggagagagagauugaacacacagagauacagggaagaaggccgugagaaggaggcagaggcuggagucagacuucuaugagccaaggaacaucaaggauugccagcaaacacccaaagcuagaagagagguguaaauaguuuuuuccucagagcuuccagaagagugggggcgcgguggcucaugccuauaaucccagcacuuugggaggcugaggaggguggaucacuugaggucaggaguuuaagaccagucucgucaacauggcaaaaccccgucucuacuaaaagaauacaaaaauuagccgggugugguggcuucucacuuggcagucucauuccccaagccucagguccccgcuucaguaucaccuccucagagagccccuccuggccaccccccuucagcagagaggcccuccuggccaccccccuucaguagguagcucccuuauuccagcacugccaaauuuauuuccuaacaccacaaaaccgaaguuacgucucggcuggcuuacuuccuuauuaucuggcgcccccauuaguuuuaaguuacaugccagaaagucuacuuuguucaccucuguucauuagcaccaaauacaaugccugguacguaauaagugcuuaauaaagaucucuugaaggaauaaaagagcccacuccugagauaauggcauuaacccaugaugaugccagagcccucaugaccucauaccucucaacacuguggcuucagggauuaagcuuauaacccauaaacuuuggagaacacaaucaaaccacagaacgauguuaugaauugcuauuguaaauaguuuuuaaaaaacauaaacuacacuuuuaaggauacuuuuacauuuacagaaaaauugcaaagaucguuuguaugguucccauauaccacuuacccaguuucccauauuauuaacauugauaugaaauauuuguuacaauuaaugaaccaauaaugauguauuauugguguugcuuuuaaauuuuauuuuccaauuccuuguugcucagauucuuuuuguuuaauauggggucucaaucuguugcccaggcuggagugcggugguuugaucacagcucacugaaaccuggaacgaaagcgauccuacccucagccucccaaguggcugggacuacacugggacuucaggcaccugccaccaugccuggccaguauuuuuuuauuuuuuguagagauagggucucacuguguugcucaggcuggucuugagcuccugggcucaagugaucuucuugccucagcccccaaagaguugggauuaccgggugagccacuggguccagccugcucagauuauuaagucucugguuucuucuuccauuucccuuugcccccucugcaaucuuuucuuaaagaaacuguguuguuugcccuguagauuuucccaaguuuuggauuuuccugauugcacccacgaguauuaauggacauuuuacuuugucucguauuucccauaaauugguaguuagauguagaagccugagcugauucagauucuuuuuuacagaaaacuacaucauaaugauguuuuguacgucugucaucaagauacauaauguuugguugcucuuugugugaugucagcagccucugaugcucaaagcccagauccauuauuccauuaggagguauaaagaaugauacucuggccgagugcaggggcucacgccuguaaucccagcacuuugggaggccgagguggguggaucaccugaggucaggaguucgagaccagccuggccaacauaguaaaacccccgucucuacuaaaaauacaaaaauuagggccgggcgugguggcucacgucuguaaucccagcacuuugggaggcugaggcggguagaucacgaggucaggaguuugagaccagcauggccaacauguggccaaaaagugaggagccuggagggcuuagaaagugggggugcggcaaagcaaggcagugggucagcagggcugagcaggccauguuucagggagaggaauaaggaagugugaaguaugaagguccugagggcgaaggacccuggugucucccagaaauuuaaaaggccaguguaacugaagccuagcaggcaagguggaaaguggcaagacggggccagaaagcugggcaggacccaauucaugguuaggaauuuggauuuuauuuucggugucauaggaagaggcugcugaagaguuuaagcaugauaagccugugccauaauuuguuuuauccuuuguaaauacacauguagauuguuuccagcuuuaugagaacaguauugaucuguuuuguucacuaaauaacucucuuauucuguuacacagccugaacaaagcgggcucucauuaaauauugguugaauuaaugaaugcugcaaaaaauacuugcauaucuuuguauguuauucuccuuauuucauugaaaugcauuucuaguugugaaauugcugguuuaggcaauauguguauuuaaaguuuugcuuuuugaauaaauugccuuccaaaaaguuuaugcuaauuuaugcaccccaacagcauuuucaaauuuaagacaaaacauugguuauucuguccuggcacgguggcucacaccuguaaucccagcuguagucccagcuacucagugcuuugggacacggagguggguggaucaccugaggucaggaguucaagaccauccuggcugauauggugaaaccccgucucuacuaaaaauacgaaauuagccggacauggugaugcacgccuguagucccagcuacucgggaggcugaggcaggagaaucacuuaaacccuggaggcagagguugcagugagccaagaucguaccauugcacuccagccugggcaacaagagugaaacuccgucucaaaaaaaaaggccaaaacauuagcuauucuuagaguuuguguaauagguuuacagugcuagauuaaucaacucccagggauaucuccaaguauuuacaagucuuggucccguuauuuuucuuugagcgccaggagcguguugaguguuucuguccccggcugucggcugaugauggcagggaccacauuucuuuuguuuaccacuguauccccaaugccuuaaugaggugcuuggcccguaguagcauucacugacuauuuuagcugguuuuacugcuacucaacaccaaagguuuccauugugggugggcaagucuguaguucauggggcagggaguaucuuaaaaucagcgucuuuucagaaugaguugaugugaauuauugaugugugguaagaaacaaguacugcacagugcuaaagggcacaggcucuggaggaaguuugauuccuggcccuaccacuucuaucuuggguaggcccccccucuauuuuucugaucuguaaaaugacgaugauaauaauagaaucuuccucauaagguuguaagauuggccaggcacaguggcucacacuuguaaucucagcacuuugggaggccaaggcaggcaggucaccugagguugggaguuugagaccggccugaccaacauggugaaaccccaucucuacuaaaaauauaaaauuagccgggugugguagcgcacgccuguagucccagcuacucgggaggcugaggcaggagaauugcuugaacccaggaggcagaggaugcagugagccgaggucgcaccacugcacuccagccuaggcaacaagagcgagucucaaaaaaaaaaaaaaaaaaaguguauggaauuaugccugaaucaucaaacgcaguaaauguuaacuauuauugugaugguacuucuuuggauaaucauuaaccgugcauccauuucuucuguuuuucaacagcuagaagaaaaacucaaagaaaaaguggauguaagucugauugaacgaaucaaucugacuggagagauggacacguucagcacguauguacccugcacacacuuacuggcugccugcccuuucuccacuacacagcagcgugcagcacguauguacccugcacacgcuugcucgcugccugcccuuucuccacuacacagcagcauguggcacguauauaccuuguacacgcuugcucacugccugcccuuucuccacuacacagcagcgugcggcacguauauaccuuguacacgcuugcucacugccugcccuuucuccacuacacagcagcauguggcacguauauaccuuguacacacuugcucgcugccugcccuuucuccacuacacagcagcauguggcacguauauaccuuguacacgcuugcucacugccugcccuuucuccacuacacagcagcgugcggcacguauauaccuuguacacgcuugcucacugccugcccuuucuccacuacacagcagcgugcggcacguauauaccuuguacacacuugcucgcugccugcccuuucuccacuacacagcagcgugccucaggcuguuggcuuuagucacuacagaaccuaagagguuucuguugggucagaaugagucccuacuggccacuaagaagaagcuucagaacugggcugccauuguaccuccucagaugcaguugcucuuuuagcuuauggggucuucauugucucacugugaagaauaaccacagagaagacauucucccuuggccauugcugaucugcccccaccuaaacccacagaaggccaggccuaccuucaguguuuuaaaguauaaaguauaaauggcuuaaauuuagccaccgagggaauaagagugugggaguggcaggggagguccguccaggaaguucuaacaguaaagucuucuuucccuguuaggaccuugugguauuuuuguuguggucaguuucuguuccacugccauuaaaugagacaggcaugggccaggccucagcuuucacaucaaccacuuauugacgaagaaucaaaauucucagcuuucacaucaaccacuuauugacgaagaaucaaaauucucagcuuucacaucaaccacuuauugacgaagaaucaaaauucucuucuuaguuuauuuccuccacuuuucuuagcuuuuuauuuucuucaguucugacuuaaacauuuuugggaagcagguucuuugggaggaagaugugaacagggauacugggguggugauuagggagacugaccgugggauucuauauccugacugggugaggacacacccagauaaaaccaggacaugaagaaagagccaagcuguuccuccgcugucauuaauuaaagcucaaacuuugccagugaaaugaugaaucugauuuuuacacaggggccugagugucagucauucagacggccguuguuugaaagggugaccacagugauuuguuugauuugcagcgucaucuccagcaguauucagcugcugguucaggaucuggaugcugccugugauccugcccugacugccaugagcaagguaaggucuugggaaauggcauccuacaaacuaacgagagcagcccaagguggcuucuacuggcccuugucuguagcuucuccaggcucaucggagcguaaaggaucagcugaggagaauggagaggccccggaguuccugaaagcacucaguuagugucgcaccugcgucaguucaguugcuuguccuuuuagaaugagacagagcaucacaguauuggaggauggcaaaaaaaaaagagacgaaguaaauguguuugaugagucuaaaggagauguugucugugguuuauuuauauuuuuuuagagacagggucucucucugucacucaggcuggagugcaguggugccaccaugacucccugcagccuugacccucugggcucaucaguccuccugccucagccucccaaguagcugagaccacaggugcaugccacuguguccaacuacuuuuuaaauuuuuuguagagcuaagagucuugcuauguugcccaggcugguccugaacuccuggcgucaagcagucuucccaccgaguccuccccaagugcugggauuacaggcaugagccacagugcccagcugagauggaucauuuuuaauuacugagcgcuaccucauguuccucucauguuccuauuuuuggcuuuuaugugccuaugccuuuuuuucccaaaugaaugucaauuccguaagugcacagaccaugucuuucaccccucuuuuaucucucauguagucuugaauaugggagauucauuuuuguuaauuaaaaaccaaucagccauguccuuuauuuacguauuaucuuugauuaguaucugacacaugcuaaaaaccuugguguggucucaccagaauggguguuuucauuagugcuuaaaguaguaacuucugacucauucuucauucuugcccacugagagguuuuuccaacuccuucugagcucuggugccaauguaagaguauuugaucagguugugaacucugguuuucuaauaucgugguggcccaucagucagcccuuggcccucaagucuccuccuuuggcacuuacugagcgcuaccucaucuuccuauuuuugacuuuuaugugccuaugccuuuuuuucccaaaugaaugucaauuccguaagugcacagaccaugucuuucacccccucuuuuaucucucuuguagucuugaauaugggagauucauuuuuguuaauuaaguuggaaaugggccuuuguuaugcuaaacccaaguaacaugcagcugcaacucuagaacuuuguagagcagggguuggcaaacuagagccugggaaccagaucuggcccacugcuuguauuugaaaauaaaguuuuauuggaauacagccauguuccuuuauuuauguauuaucuauggcugccuuuuugcaauauagugguagaauugagccauugcaacagagacuagcccacaaagcuaaaaaaauuaaauauuuacugucuggcccuuuacagaaaaaguuugccaaugucugcucuagagucauaggcucuuguagcaaauucuggagaaacaauuuaucuagguuauacuggccaguaccagagggcagugggaggaacacuaacuuuagagucagacagaccuaacuccuccaggguuuccuuugggguguugagcaaaugauucaccugucugggccaacgugacaucaucugggcccacauaccccaagugaacuguggaucucugccucccagcauugcugugaggaugaaacauggaacgggcgggucuagugccaggcacauaguaaaugcucauuaaauguuaguucccucucccucuugucaggaggaaugaccaugucacaagguuguguaagcagacauuuggucugaauuugguuuugcaguagauuguaaauauuuaacaaaaauaagauuaaaaccaaaauguaggcuuuaggguuuuaugaacugaaguggcaaguccuaaaauagcugaugucacaguuuuauucaaaaagcugaucuuuucagcaguccggugcugauggguacuuccaguauucucagcauucacaggagaacacucugagcaggcaaagugaggccaguccaucugcuuagaggauucguuuugccagcucucaugauccccucgcugcugguaagcauucucuacauccugagugggaucugugccagcugccaucucuccugaacugccacacacuucagaucggaaugcagcugccgaaagaauuuucacauucaccaaaggaagagugggauuuuuuuuuuucaauaaaaucacgguuggaagggguuuaacacugcaaguguugcuuauacgaacugucgguucguucgguggauuucccucaaacccugccccgucccacccuccacuucugccccgugcccacaccagcaaauacgaacagagaccgugccuccagaguccuuuguuuauaucauaggaaaaccacagacuugggaacgcagcagcugggaggccauuacuuuuugucugagucuucuggaguucuagcaaaauaaaauccaugugauggaaauaaacaagccaaguggucacaaauugauucaacacacauucuguguucuugaugccugcauccuguuuuguguaguuucuucuaggauuuaaaaaaacuuuugugauaaugguuauuucugucucugauucuaucauuuuugcugcugguuaaacaguucaguucagacccugcccagcacagugcugggagcugcaaggcucagaaaggcauaaacccuuggcuaagguguuuagauuccaguagcugagggcaagagauguguaagaugacagcaauacccaguaacuuuaauauaagagaugaggaaaucagugccauaagaaaaguacaaaauacacccuuuuuaaagagggaggaguucauauccagguggggaggcaaagaaggcccucguaaggaagugguguuugaaacagaugagggcgaaauucugaaugaguuugugauuaguagggcaguucaaacagggugaaaacaugaguaaagagagguuagggaagcuaaagagcuugguucaaacugccaaucucauucaacaucccaggggcuccucaggcuacuccuguacuuggacugacagaguuaagauuggaaacgagacuguccucaaggagucuauacccugcugggaagaaaacugagaacaaccaauacuguaaauaaguguaucuuauaaaugucagaaggacuguuggcuggccaaaguggaguguagucguuggauauuuccagaaggacuguuggcuggccaaaguggaguguagucguuggaugauuccagaaggacuguuggcuggccaaaguggaguguaguuguuggaugauuccagaaggacuguuggcuggccaaaguggaguguagucguuggauauuuccagaaggacuguuggcuggccaaaguggaguguagucauuggaugauuccagaaggacuguuggcuggccaaaguggaguguagucauuggaugauucugaguugacggaaggagacuuccuugacaagagggauugagccuggcaacuugguuaagucauuuuccugggagaccucauucucauggaaggcaucccauggccucuuccuugguuggcauauagagcuuucauuaucuaucucuuuacuccacugcuaggucaguuucugccgcucacuccggaguaugugcccuguucuccagucgcagccauguuuacuucccugaaugcauauugcucuuuugcggcuuccaugccuuuucucauuuuauucuuucugcccagaauuuucuuccugcuaucgucugcccaaggagcacguccuuuaagaucaaguucaaaugucuguccccauuuaaaaaccugagguauaauucauauaccacagaauucacccuuuuaaaguauacaguuggccaggagcaguggcucacuccuuugggaggcugaggagugcaaaucaucugagguuaggaguucgaggccagcauggugggacccugucucuauuaaaaacacaaaaaauuugcuggacaugauggcacacaccuauagucccagcuacucaggaggcugagguaggagaaucucuugaaccugggaggccgagguuguagugagccaagauugcagcacugcacuccagccugggugacagagugagacucuauuuuauaaauaaauaaauaaaguguacaauuuaguuguuuuuaguauauccacaaugucaugaaaccaccaccaccaucuaauuccagaacaucuucauuaccccaaaaagaaaccccguaccucucagcagucauucuacauuccccugacaaccauuagccuacuuucugucucuauagauuugccccuccugacauuuugcauaccuagaaucauauggcaugugggacaucuugugcuuggcuuucuucacuuagcguaguguuuucagggcaugugcaugguggggcaugugucagcacuccauuccuuuuuguggcugaguaacauuccaucauauggauagaccacauuuuguuuauucauucgucuauuggacguuugaguuauuucuacuuucuaauuuugaauaaugcugugaacauucauguacaauuuuucgugugaacauguuuucaguucucuucaauauguaccuaaaggccaggcgugguggcucaugcccguaaucccagcacguugggaggccgaggugggcagaucaccugaggucaggaguucaagaccagccuggccaacauggcgaaacccugucucuaauaaaaauacaaaaauuagccgggugugguagcgugcgugccuguaaucccagcuacuugggaggcugagacaggagaauggcuugaaccugggagguggagauugcagugagccaagauugcaccacugcacuccagccugggugacagagggagacucugucucaaaaaaaaaaaaaaaaaaaaaaggaucuaagggaccuaaggaauggaacugaaagagccguauggucaauuuauguuuaacauuuugagaaagugccacacuguuuucugaagugacugugccguuguaccuuuccacagcaaaguguaaggaauccaguuucuccacaucuucucccacacuuguuuuccuuuuuuaauuauagccauuuucgugggugugaagugguaucucauugugauuacaguuugcauuccuugcaugacuaauauguugaucaccuucucagaugcuacuggcgauuuguauauucucuuugaagaaaugagaauuaaauguuuugcccauuuuaaaauuggguugucuuucuguuguugaauuguaaaaguucuuuuuauaucuggauacuagaccccuuaucagauaugaaauuuguaaauauucucucccauucuguggguggguugccuuuucacuuucuugauaauguccuugauuuucugaaguugguauaucgugugugugugugugugugugugugugugugugugugugugugugugagauaucuaagauaccauugccugauccagaaucauaaagauuuacucugugguuucuucuaagaaauuuaggucuucacaaaaaagaaaaaaaggaaaaaaauguaggucuucaauccauuucgaguuaauuuuugcauauggugugaggcaaagauucagcagcauucuuuugcugaaaggauacucagcuuucccagcacuauuuguugaaacgacuauucuuuucacauuggaugaucuugauacccucguaaaaaaucaguuaaccauagaugugugggauuauuucuggacucucaguucuauuccaucuaucuguauguccacccucaggccaguaccacacuguuuggcuauaauagcuuuguaguaaucuuugaaaucaagaaguaugagucuuccaacuuuguucuuuuucaacacuguuuuggcucuucuaggucccuuacaaugucagcauuucuugccucagccagagcauauuuauuucucuuucaagacaccauaguaccuagacuaccuuucugcuuuguuauguaaucauuuuuaugucuuugucuucccuauuaaacuuugaacaacuugagggcugugucuuauucauuuuggaaacccguggcauggcacaguacuugcuuaacuguaguauucccugaaugacuuugaagguaaagagggagccagggagugggagagaaagaaccaaaggaccacaaacacacuuuugaccaaagauugguaaacaagugagacauagauaacucuacugagcagagguagccagguggagcugguagauguagaguaggaaacuuggacaacuuugugagagacgguggggucauagaaucccugaaaccuuuagguccauagcuggugcuguugaggauggagugaugcuccucaauggcaccugauagcagaagggcuucugacuucagcagguggcauccuggagccgauugaagagaugugggaaugaaggaauacgagcccgcggggguguggcccugaguccugcugcuagacaaggagagggaaaugcagagcgguaguuugcuagauucacaugcaggugcagccuucugcaggccaggccgaagaagggggaggaaaaugugaugaaagucagguggucccucugaaacucugacuuugagauuccaguaguguugcugaugaguuacagcaaaauuaacuucuagaccacguuuccuucccauaguguuauuuucuuucuuucauaaaaaaauuucuucacucuguugcccaggcuugggugcgguggcauaaucauagcuuacugcagccuugaccuccuggguuccagugauccucucacccuagccucccaaauagcugguacuacuggcgcacaccaccacaccuggcuaauuuucuugauuuuuaguagagaugaggucuugcuauguugcccaggccagucucaaacuccugagcucuagugauccucccaccucggccucccaaaaugcuggaauuacaggugugagccacugugccuggccuccauauugcuuauuuucuuagauaaccuguaugaguugauaauaaguuacuauuuacugagcacuuaccaggaauuggaacccaauuaauuucauucuaacaauaaauucaucagauggcuaugcuauuuccccuuuucacagauaaagaagcugaaacagagacauuaaaucaccugcuccagaucuuuuagcuacuugggaggcuaaggugggaaggucacuugagccugagaggcagagguugcagugagcugugaucacgccaccacagugccucuuuaugcaggauuguggcaugccauacagagagagugaguaagucuuuuuggcaaauguggcaacugaggcaaaaucagcuuaaguaaccugccuaaaaguggaagagccucggccuccuaaacugcugggauugcaagcguguugccaucgugcccgaccagauguuuuugaaaaaaggaauaaaauuuaaaucaccauaauuucaauuaguugauacauuucugucagcaugugcccaguccugguggguccacacgaguguucaugcugauaugauuaugaguucuucaagcauucaccaucaucaugguguauauucaucuccagcuuuucuugaucugacaccaggacuuuucuacaguggagaagauguguugaacagccaacccacauauuccaaucugcguugaauauuuuucccugaaaacuaaugaacuuuccuucugguaucuucuuuccuuccuuccucccuuccucccucccucccucccugccuuccucacucccucccucccucccuuccucccucucuccguuccucccuuccucccacucucccuuccuuccuucuuuccucucucccucccuuccccuguccccuccccucccuccagacucccuucccucccuccaaacuccccuccuucccucccuccuucccuccuucccucccucccucccucccucccucccucccucccuuccuuccuuccuuccuuccuuccuuccuucucuucuucauauuaugcccaaagccauauaacuuauaauagugaagcuagaaguaaaacuaguucuccugauucuggaaaaaguaguuauuuggaguguuuugguggaaauacaaaggauucuaucuuuuagauuuaaauccuacaaauccuuagaaaugaguaugucugguuaugccccuguacguaggauagagagccgugggcucccuagcaggggcuguuggucucaugguccccgccucucuccgugccuuuuccuagggcugcucacaucacucagguaaauaaauccaagucucuguucagaagcaaacacaccuaguguuuugccuauuaaugguaguuuuaggaaaaaacagaaacugaauaaauuaaauuuucuuaccgucuggcacauaauuuauauuagguuucaggauugugaacauguacccauuuaggaggcugcguuauaaucccccaaagacacuuugaaacagguagaagaguucucaagucuguucucauuuuccucagucauuaaaaugcagaucuguuucagaaggaccauggaaagccacagcuaagaaauccucaaguucacuucuacguugaaucaagacaagucuguucucauuuucauuuuccucagucauuaaaaugcacaucuguuucagaaggcccacagaaagccaugacuaagaaacugucaaguucuaccuagaaucaagacacagcuuucuuuuucauaaaaaagauuuuucccauuaugacaaaacuaaaucacuuccauuuuagaaaaaugcagauuuuuuuuuuuuuuuuuugacagagucucgcucuauccggcaggcuggagugcaguggcgugauuugugcuuauggcaaccuccgccucccagguucaagugauucuccugccucagccucccaaguagcugggauugcaggugccugccaccacacccggcuaauuuuguauuuuugguagagacgggguuucacaguguuggccaggcuggucucgaauuccuggccucaagugauccaccugccuuggccucccaaacugcugggauuacaggcauguugccaucgcgcccggucagauuuuuuugaaaaaaagaauaaaacuuaaaucaccauaauuucaauuaauugauacauaucugaauuaauugauaauuaucaguuaucgaaauuuagugauuuuuagugauagugcaaguauucuuaaaauuauaacaguagcuaaaauuuacuguggaauuuauacgugcugcgagacacuguguuaagagcauuccaugcguuaucuuucaguaauagauuauagauguuaccaucaucccaauuuuauagacgagaauacugaggcucagagaaauuagaugacuugucccggucaccccuuuagaagguugcacagugucagaagucagacuggcugacucaauuucagcaucuuaaguaccaucuuaaugaccuuuccugcuaacuuagcaguuacgcuuccuuaggcaggucacucgcuguccucaauccuguuucauccucauuuauuauuacucacaaagaggaguaauaauaccucuuucacuacaugauucauucaucaggcagcaaggucaugugaaaaugucaggcacagcaccuguuacgugguaggugcuugauaaacguuccuucagcgcccagugcguaguaggugcuugagaaacguuccuucagugcgugguaggugcuugauaaacauuccuucagccccuggugcgugguaggugcuugauaaacguuccuucagccccuggugcaugguaggugcuugauaaacauuccuucagcgccuggugcguaguaggugcuugauaaacguuccuucagugcgugguaggugcuugauaaacauuccuucagugcguaguacgugcuugauaaacauuccuucagccccuggugcgugguagguccuugauaaacguuccuucagugcgugguaggugcuugauaaacguuccuucagcgcccggugcgugguagguccuugauaaacauuccuucagugcguagucggugcuugauaaacauuccuucagccccuggugcgugguaggugcuugauaaacauuccuucagcgcccggugcgugguagguccuugauaaacauuccuucagugcguagucggugcuugauaaacguuccuucagcaccuggugcgugguaggugcuugauaaacauuccuucagugcgugguaggugcuugauaaacauuccuucagugcguaguaggugcuugauaaacauucuuucagccccuggugcaugguaggugcuugauaaacguuccuucagugccuggugcaugguaggugcuugauaaacauuccuucagugcguaguaggugcuugauaaacauuccuucagccccuggugcaugguagaugcuugacaaacauuccuucaguguguggcaggcgguugauaaacauuccuucaucucuuuggucuccaccugaugcucagugcccugcugcacuugccgaagguaccuauaaauauagcagaugcugcgggagugaaagccccaccaggcaucagagugagagugagcguguacgugugugccugaguaaagucuacagcuugaggccaacaccccggcagccucaguuaugagacuucaguugccugaaauguucccagagcccagcugucugagucuaugcucugugucucucuaauccagugaagaaguaggaauuuaaguauucacauuuucaagaaaccucuuuccaagcuuccuauagcaauaggaaaaaacaagauccacugaagcuaguuguggagcgcuguucucuggucaaaguuccugcuacaguagacucucucuagaaagagugcugaccccccagccccacuguggagcgucagucagagcacauacuuccugcccaggccgcagaagcugggcucuggggacacucugggcccugcagucucuucuuguggugguuaaacuaggucccggaggcacucaucauucuuacugucuucaaacugugucucauuuagauaguaguaccaguugaaccccaucuguauucaacucuacccaagcccccaaaacaaaaagcacaacaagaaacaauuuuaaguguagagggguaacuucuaaaugucaaaugaaaaguuuaccuggaaaaguugaggucucauuucuacugauggcuuuucaugauguuuguucuuccaaugcaagguacuguuuguuuccuuuuuugaaagaguucuuugggccaggcgugguagcucacaccuguaaucccagcacuuugggaggcugaggcaggaggauugcuugaacccaggaguucaagaccagucugggcaacacggugagaccccugucucuacaaaaaguaaaaaagaaaaaaauauauuuuuuuaauuagcugagcaugguaguguacaccuguggucccagcuacuugggaggcagagcugggaggauugcuggagcccaggaagucaaggcugcagugaacuaugauuguaccacugcacuccagccugggcagcagagacucugucucaaaaaaaaaugaaaaauaaagaguccuuugcuugaucacuauguuucauuagcgucuccuugagaaacaggccuuaccuuuaacgaaggccuaguuaagugcuuuuauucuuuuuuugggcaggguggcgggggcgggucgggggggaaguugucuagcaagcaccuuguugugggguuugggcuuuagauagaccugguugggcuuuagauagaccggguuugggcuuuagauagacuugguuugggcuuuagauagaccugguuugggcuuuagauagacgugguugucccagcugugaaauuuugugcaagauaccaaaucucuuugagcuuuuugaauuuccucaucuauaagguuguugugagaacuuagugagaucauguaugaauaguaaaugagacgacguauguuuagggccaugcaaagggaccugcgaaguucggucuuaauguagcuauccugggcaguucagguugugacccaaaccuucagucacccaugggggaugauggcaagcaucagccaucugaggcuggagugcagugguacaaucacagcucccugcagccccaaccuucugggcuccagugacccuccugccucagccucccugguagcugagacuauaggcgugugccacauuuuuaaaaaauacuaaagguaaggucaccuuuuauuguuuucuaguacuuuaaaucacuuucuuaguugacuaagcugacuuaaguuuaaaaucaugaauccacuuggccuuugcuaauacuucuuuuagcuugaccaauggagucaugacugaccagaguauuaaagcaaaucagcucuuuucacauauauuccaaaugugggcacauacugacuuggccagugaucaucaagaggaguucggugacgagcaugcggaauaaccagugggaaguugaagaaaucccaggccccugcuuggucuugcuucagagcugcuuuguaacuggugacagagcacgucgccaccuucuuucauggagggcugucauguuuagauuauuguugauaaaccguuuugagauuuugaaauauacaaagcugccagcuuggaaaguaacagucauugcuauggacaugauuggcuuugggggcaucaagcccucccaguucgcugugucuacccagaacauucugcuccgaguccugcugcagagcccaggaaaugcugacagcaccugucaauuuuggccucacccuaugagcucauuuaaaaucacccaggaugcucauuguuuggaugggucaaaucuucaaaaucaaauggaaaaagaagccucuugcguaagauaaaagauaaugaggaaaacauuucacauaaccaaagcauuagaauguuaagucacuucauauuagaccuuucuacuguuucuucauuguuuguuucuguuuuuucccaguaauaaauuagaguucuuuuuccuguguggagccugguuaugaaaccuugcauaagacucuucauguuucugggccuuggcuuucuuaucugugaaaugaagauggaggucccuuccugcuuuucugugguucuguguguacacaucccuaaagcuuuuagaauacaaauauccgcugauuugaaaaaacauuaggagucauuugagcuucccacagcuggagaaucauccacguacgaugugauucuuuuaaacaagcucucucaguauugauuuuuuccuuuccccaagagcucuguaaaaauaguguuuucuugccagagacaucagggccucagaacuacugacuuccuucuaugaacauauuauaugguuuguguuuggcuuaggaucucuuuaacagaccauccagcuccauugugagaggcugacucagcagagcccuccagaccguccagcuccacugugaaaggcugacucagcagaacccuccagaccauucccacucuucgggauuagaaugcccuucccugccagcccggggcaggcuaggagcuggugcugcacccaucuccugcaugcacccuugggggauggcacacugcagcauugccuccuucuguucccaggacucaauguugccaagugccacguaguccaagaaucccgccaguuugcuauaggugucuuccagagccugucguuagggcucagguugaagcaggucugucacuuuuguucacagcuuguucagggaccaccucggugcucucagcaauguucucuccccugcgccuggcuccuggccuguuccccacgucuccaucuuacccucugguccacccuaguguuugccagagauucucuuucccuuccccuuauugaaauccugacauaaucccaaagguuuuaggaguguaagauucuacacgcauaccucuucaaguguuuuauuauggaaauuuuugaauauauucaaaaguagaggaaacaguguggucagccucuauguaccugucacucagcuucacgaucuuauuucaucugcaccucuucccgguaacuucauauuauuuugaagcaacauccccacgugucauaucauuucuaguuuucuguguuaaagaaucccaaacuccucccaguugacuggagagaaaggugucugugaauuccccuccagguugcaugucacuuaguccagccaccucucucaucucccaggcugccggucagcuugggagucggugucccuccccguucugcugcaguccccugcuguggggcacucggcaggagaacaggauccuuuacgaguggguagcuuagcugagaagggaaggcuguuucaggcaggucggggacaaggcaggaaaaggaaagggucugggucacaccucacugucggguccgcugggcacacucgcauuuguccugaguaucagucccuacagaacgaauaagaaacuccccaggacaaaagggccugauuccugggauaccaaagcugugaccugacuuccacuccagccccucccuuccccaguaacaggcgacaccguucuccugcgagggauucaacgccucauccuuucucccuuucagaugcaguggcagaacguggagcacguuggugaccagagccccuacgucaccucugucauucugcacaucaagcagaacguccccaucauccgugacaaccuggcuuccacacgcaaguacuucacucaguucugcguuaaauuugcaaaguaaguccuggggcgugcucaucucuggguucuuguucuuuuuaauagacuuuauguuuuagaacaguuucagguucacagccaaauuaagcagcaagcacagagauuucccguguaccugacccccccaacaugcacagucuucccauuaccgacaccuccccacacacaaaguggcacauucguuacaguggaugaaccugcaucaacacgucauuaucacccggacucugacgucgcgcuggacauucccucgguuuggacaaauguacagugacguguggccgccauuucagugucauacucaacuggguuguuuuuaaaaccauacuucccaccagcauccucacaauuugaguguccccaccauccagcugcgguuuguucuggugccugcaguacugauuuuaauuuguacacaaaagaagcauaaucauaaaacuaaaucugcuacuuaaagucauaggcaacaguaacagcaguacaauugccagccacgucaaggcaaacaaaaaugaauggggccuacuguuguuuugaacugugcaggcauaagcucuccuugcccaggauuggauaauuaaaauucuuuuucagggauuucauauaugcauuuuguuucucugacuggcuuaauaaaugccucuuaaggguaggagccaucgguucuguuucuuuugagccuucuuguccucccucccccugguauuuuuuaccauggcugcuagaauuuaucuauucauacuuggacacacucuugguccgaggaaggcacuagaaauugggaugcacaagccagggagcucccuggccaaggcaggugagugcacccugagccgugugucuuccugcugugucuuguguguggccauuucugcccugaguuuugaagcgaggaaauaguuuaguucuuugccgaucaccaucuggcuuagcaccauuuuccgugauaccaggugguggugagggucagugucuccucugaccaguuaucaagcaagcauuuuggcagacuucucagggaagggcuucaggagggucagcccaggccaagcuacuguauuuggguuguucccauccaggccccagcuggugauucaggacuccaaguuucugucuucccccaaucucucccaguuucccuguaccucacaaaugaaccccucaggacuaacaauuauggagcggcuuguggugucagcuuuacuuucuaguuugucaagaaaggauagaguggacucuccagggaggcauuaauguuugcagauggcagauggaccaggaggugaaauucccucacucucugggugcucauuaguguguuagaaauguugcugauaaaucacaucgugacgcuccccauaacugcugguagaagcagugucucuguaaaaauuuacugugacucaaaaucuccaggguggcugcuccggggucucauugagcuuacguuaaagugaaggaggaguccguugacuuagccagucccagcgucucccagcucagucauaugauugagcuuacauuaaagugaaggaggagucuguugacuuagccagucccggcgucucccugcucagucauaugauugagcuuacauuaaagcgaaggaggaguccguugacuuagccagucccggcgucucccagcucagucauaugauugagcuuacguuaaagugaaggaggagucgguugacuuagccagucccagcaucucccagcaucagccucacauucucucagagcccuugaguuucauugcuaagcccagguugagugcgcugggaauuggaugcccccccucacaucuguaaucauucagccugggaucuaggaagugguuuucuguuuucauccauggugccuucucauccugcuaaaaucccgcuuaacagaggugggcuugugaggagacccuucccuggucaagggcagcagccaccaccgcccugauggcccagagaagcccuuggcaguuacccagcacauugcuugguuuuuuccccacaggacgugugucagguccucauacuccccccaucgccaccuguagacuaguauagagagccaguucaggggcacagccaaagguuuuuuuuuuuuuuuuugauacagggucccacucuguuacccaggcuggagugcaguggugcaaccacagcucacugcagcccccaucuccugggcuuaggugauucucccaccucagccuccugaauagcugggauuacaggcgcucgccacccggccuagcucauuuuucuauuuuuuguagagaugagauuuugccauguugcccaggcuggucucaaacuccugggcucaagcaguccaccugccugggccucucagagugcugggauuauaggcaugagcugccaugcccaguccggagcauguucuaaugugaagcaacuuagguuacaaagcgcugugugcacagcugccauuggucaugaguucaguuucauguugcuugucuggcucugguuuccagcacugaggaauuccuuccaaauagccccuuguuuacucuccuuccugaucacaagccaccuccagauccgaucuccggacuccaguuuccucucccucagcuuccuuucuaccccaccccugcaaaaccauagauguuuccuuuuaccucguuugcugucuuaagcaauagcagccuuuccuguugagacaucaaaauccacagccugguugaaacugcaguugaaccacaagcaacuucccucauccacugagcugauccuccucccuucaaucaaggagauaaugagacaaaucucauaauagugguugggaagauaaaaugagaagucacauauuaacuuccugguaaagugcugauaccaagcugacauucaaaaagugguagguggcugggcgcgguggcucacgccugucaucccagcgcuuuguggggccgaggcaagaggaucacuugaggccaggaguucgagaccagccuggccaacauggugaaacccuaucucuacuaaaaauacaaaaauuagcuggguaugcuggugcgugccuguagucccagcuacucaggaggcugaggcaccagaauugcuugaacccaggaggcagagguugcagugagccaagauggugccacuguacuccagccugggugacagagcgagacucugucucaaaaaaaaaaaaaaguuuaugauuuacucaaugugcauucacuugagcaucuccuaugucucagacccagaguuaaauguuuuggccugauaaacauggcccccaucuucguuugccuuaauagucaggugaagcaaaauagacauguaagcaaaugagcauaaugaacuagguuagaugugaggguggaggccugcagacuccauguagaguauggcgaaggcagcagaagaaaggcuuucuagagacgccguugaacaggaucugagaggugcguguguacugacccacaagccccuucuaggaaaggcaguccaggcgagggagcaguguaggcauuaaauagcccccagaauccugggaucugcaaguggcucaguuggguugaagcauagggaggccagggcuuagcaggaugaggcuggagacagagaaugaagaaucaaggaagccuggcccaguggcucacgcuuguaaucccagcacuuccggagcccaagggaggaggacugcuugaagccaggaguuugagcccagccugggcagcauaacgaaauccugccucuacaaaaaaauuaaaaaguagccaggugcggugccuguagcccuuacauccagucugauugggcuagcuucgaucauauucccucucaggacaaacaacagucaccaaaggaaugcugugcucugacgagcugagaauaguuagaguucacugggagucuaggaugggauccgguuuucccgggccugccagggccucauguaacuaaacaaaaccaggacuucacucagaagaaaaauaagauaaugggcaacaguggaguccacuucgauucuucauuaaaaaagguuuuuucauggagauacguggaaccuuaaaguuuuugcauuucuuuccucaagagagaauaagccuaauuugucacuucuuuuuuauccacagcuccuucauucccaaauucaucacccaccucuucaagugcaagccaauuagcauggugggagcagaacaggugagauggacguaguaucaggcauuugccuggcagcuuuuguuguagaucaagcacauauucuucuaguccagaucuacuuggcaggaauaaaauugaugauguccccuguuuggggacaguauaaugacucacccggaagguuucuuaauucguucuuccauuuauuuuuaaaaauuuuguuugaacgccuacuaaguucugggugcaggguauaacacagcaagcaccauggaaaggucccugcuccuagugcucacacuccaauaagaagaaguggcugggccgggcacagcggcucacgcuguaaccccagcauuucgggaggccugggcaggcagaucaccugggguaaggaauuugagagcagccuggccaacauggugaaaucccaucucuacuaaaaauacaaaaauuagcugggcaugggggcaggcuacuggggaggcugaggcaggagaaucacuugaacccgggagguggagguugcagugagccgauaucacaccacugcacuccagccugggugacaaagugagacuccaucucaaaaaaacaaacaaacaaaaaaacuagcaaaaaacuuggaauauuggccgggcaugguggcucacgucuguaauccuagcacuuugggaggcccaggcaggcggaucaucugaggucaggaguucgagaccagccuggcuaacauggugaacccugucucuacuaauaauacaaaaaauuagccgggcgugauggugggcgccuguaaucccagcuacucgggaggcugaggcagaauugcuucaacccaggagguggagguugcagugagcugagaucacaccacuguacuccagccugggcaacaagagcgaaacuccaucucaaaaaaaaaaaaaaaaaaaaaacaauuagccaggcgugguggugcaugccuguaaucccagcuacuugggaggcugagacaggagaaucacuugcagguggagguggagguugcagugagcucagaucacgccacugcucuccagccugggcaacagagugagacuccaucucaaaaaaaaaaaaaaaaaaaaagaauaaaucccagugaugggaggcugagaugggaggaucacuagaggccaggaguucaagaccagccugggcaacauagugcaacccuaucucucaaaaaaaauaaaacauuagcuaaaaaacgguccacaccuguagucccagcugcucaggaggaggcugaagucggaggauucuuugaauccaggcugaagugagcuaugaucgugccgcugcacugaagccugggcaacagaguaagacaccaucugccccacaaaaaaaaaaagagucuuuuaaugauuauaguaagcucagacccaaagccaauaucuucagaaaaauaucaguucauccagugcuuacauccauuauuguuauuauuuuuuaacaaacccacagccaacauccuauguuuacuuccguuuugagguguggaugagaaaaccaucugcuggaacuggaguuuuacuuaaucagaccccaggccaguucaggugggcaguaggggaguguggaucuugacaggcccagaauggggagggugugggugggaacuacagggcaacguggccccugaacgauucucacaugaguugagguuuggcugggccuguacuugcccugaugucugggccuugaaacucaagcagccauguagcugcaggcguguucacucaggcagcagaaccaucagaaucaaguuaacucagcaguguucauagacugaaacagacgcugccuccaguaguggagcagcugccauccaaacuugaacaaaagcuauggcauuggaagcuaagauuuagcccaaccucagcugugucugccuugccacaagggugccagauccuaaauuagguuuugcuuuaauacuuaugcugaaaaugggaugggagacauuuuucugcucuuuguucucugaguacuauauaaagugaguucuuuaucuuugggccccagaguccucgagcaauugcaagggcacguggaacugacccacaccaauauugaucaugcuucuugcuaguuuaugaucuucagaucauccuguuuugcagggucacuaauuauucuuaugacugcguucaccuaugaaagcuuuucuuucccuugagauuaaggauaagaggagaauguccgcugucaccauuucuaucccacguuguuguugaaguccuggcuaggacaacaaggcaaaaaauacaauauuuuuaaaagaaacaaaauauauacagauuagaaaggaggaaacuaagcugucauuuuucauggaaaauaugauuaugaguaauaaaucuaaaaggaucuacagauaaacuguuagaauauaaauuuagcaggccgggugcaguggcuuacacccuuaaucccaacacuuugggaggccgaggcgggcggaucacaaggucaagaguuaaagaccagccugaccaacacagugaaacccccgucucuacuaaaaauacaaaaauuagcugggcaagguguggugcgccuguaaucccagcugcucgagaggcugaggcaggagaauugcuugaaccugggagaacugcuugaaccugggagguugcagugagcugagauugcgccacugcacuccagccugagugauagagacuccgucucaaaaaaaaaaaaaaaaaaagaauauaaauuuagcaagguugcuggcuauaaggaaaguguuuuaaaauauauuucuauauaccagcagcaaacaauuuaaaaaugaacauuuuugagugaaauacuuuuuuuuuuugcuguauugcccaggcuggagugaguacaguggcacaaucauagcucacugcagucucaauucgugggcucaagccauccuccugccucaacuucucaaguaucugggacuacaggaauguacuaccaugccuggcuggcucuuuuuuuuuuuuuuugguagauauagggucugccucccugugucucccaggcuggucucaaacuccacccuccucagccucccaaaguggugcgauuacaggcgugagccauggcucccaggccuaaaugaaaucauuuacaauaacaucaggaaacauuaaauaccuaggaguaaauuaaaaauguacaagucuucuacacagaaaacuguacaauauuaagacacagaauccauaaagaccuuuaaaaugacaggauagcucauguucauugauaagaaagacucaaaaagaaauacauauggagucuuucugagccugcucuggcugaggaggcugcccaauaaaaaauaaauaacaauuuaaaaagcggcaaauuauuccaaaauuaaucuauagauagaauucaauccuaauuacuguaucaauuuaucuauagauacaguagaaucccagcaggggugugugugugugugugugugugugagugugugugugugaauugauaugcugauuuuaaaaguuagaugaaaauacagaagacaacagccaaaauaaucuuagaacagaauuggaggaguuaaagcucaggauaucaagacuuauugcagcaguauuguaauuagagcaguguggcacuggccccagggacaaagaggccaacagaacagaucugagcugagggauagacccacacauguguagauacuugauuuaugaccaaaguggcaucauucaaagagagucuuuucaguaaauagugcuggguaauuggauauccauaucggaaaaaaaucuugaccuuugccacacaccauauauaaaaaucaauuccaaagaggauuuggugaaauuagaacacucauacauugcuggugguaaugcaaaacgguacagccauuuuggaaaacaguuuggcauuuacauagaguuaccacagggcccagcaauuauacuccuagauauauacccaaaugaauugaaaaaggcagggugcaugguucacaccuguaaucccagcacuuugggaggcugaggcaggcagaucaccugaggucaggaguucgagaccagccuggccaacauggugaaaacccacuucuacuaaaaauacaaaaauuagcuguacaugguggugugcaccuguaacuccagcuacucgggaagcugaggcaggagaaucacuugaaccugggaggcagagauugcagugagccaagauugcgccacuguaccuucaggcugggugacagggugagacucugucucaaaaaaaaaaaaaaaaaaaagaauugaaaaaaaaauguguucacacaaaagcuuguacacaaauauucauagcagcaccauuuauaauagccagaaaguagaaacaacucaaauguccaucagcugaugauaaacaaaauguggucuauccauacaagggaauauuacucagccauuaaaaggaauaaaguacccauucaugcuacaacauggaagagccuugaaaccauguuaagugaaagaagccagacacaaaaagccaccuauugugugacucugcuucugugaaauguccagaacaggcaaauccguaaaacagaaaguggauuaaugguuggcaaaggcugagggagggggagaugggaauggcugcuaauggguaaggguuucuuucuggggugauaauguguucugaaaccagauaaugcugacagcuguacaaccuugugaauagaccuuaaaaaccacugaauuguacacuuccaaaagguaaauuuuaugguuuuugaauuauaucuccauuuuuagaaaauuaaucccagauggauuauggcucuaaaaaauaaggcaauaaagcuucuggaagauuuaauauaagacaauauguuuaugaccuuggguuaggcaaagaucccuuaaacaaaacauuaaaagcacuaaccauaaaagaaaagauugguuauuuugaguacuuaaaagacuuuggccaagugcgauggcuugugccuguaauccuagcacucugggaggcuguggcaggaagacugcuugagcucagcaguuugagaucagccugggcaacacagcgagaccccaucucuacaaaacaauuuaaaaauuagccaaguguggcacgugccuguaguccuagccacucgggaagcugagacaggaggaucaguugagccaaggaguucaagguugcagugagcuaugauugcaccacugcauuccagcccaggugacagaguaagacccugucucuaaucauaauaauaauuuaaaagagugaugauaccaaguguugguaaggauguggagcaucuggaacuuucauaugugcugguagaaauggaaguuagcccagccacauuggaaaacuccuaggcaguuagccaaacauaugccuaccccaugauccagcaguucuacucuugaguagcuuccacccuagagaaaugaggacuuuaugaccaccaaaggcaugcgcacgaauguucacagcagguuuaugagcaggaaacaagcuacagugagagagagcaggagagacgaauguucacagcaaguuuaugaagcaggcaacuagcuacagugagagagaguaggagagacgaauguucagagcagguuuaugagcaggcaacuagcuacagugagagacagcaggagaguuuguugagagggaaaggagagcauugacuggacgagagcaugaggaaggcuucagggaugccagaagugugcucugucuuccguuaggcagcaggaugugcacaugucuggauguugaucaaauggcauacgugguguuuguguacucugugaaaguuauaccuaauuuuuuuaaaaagaaaaagaaauagaacauguguccaccuuguuccaucccuccugauagccugagcugucuccccugugccaccucauugaagaauuuucuauggugggaccaauaugguucaccuaugugguuuuguucacaugguucuuugucuucuaggagugugggccuguaucuuauuuacgcaaaauuuucaucacuguugauagucaucauguccccaagaauuguaggaggcuccucgggaaguaaagggccccucucaaagauuuccauugcugggugaucagccuucacaggcauggcauacuggccacccuugcacccccacaucccaucaacaacauuagccagcccacacugccccagaaauuaucgcugaggcagaaaugaauguggcaauagccaccccuugcccaaugucucaugccuaagaagaugaauuaucaacuauuucaaaguugaaaacuagcagauuuucaugauaaaugggaccuuucugucuugucuuugcacagacagccgccaaaucugucaggcucauucccgccuuuucugacugccuugcuuuauguauaaaaccugagaccaggguuuucaccucucagugucugguaaagacagaauuuuauggugacuggccagggaaugaaagugucauaucucccuguauaugagggacacuagagaauuaugccuggugcauucaaacccuuccugucauuuaagacuguacaauuauuuaugcauauaauguaucucugggaaguagaaaaguaggaaauaucuccauaugcuuuaaaauauaaugacugauuuuuuuuuuccuaccaacaaaugaaugcuaagacauggcuuugauuuugacaaggcucucaaaauuugcuacauggaagacagaguugaguccugaaugguagucuuuaaacaaaaauuccaguuaauuaauguacagaaaauaauguaaaaaacaguaacuaacuacucagcucagcaaaauauguaacauguuuccacauuuacuuuacaucuuuuuuuuuuuuuuuuuuuuuuuugagaaaaugucucaccguguugcccagucuggaguacaauggcgcgaucucggcucacugcaaccuucaccucccgaguucaagcaauucuccugccucagccucccgaguagcugggauuacaggugugcaccaccauaucuggcuaauuuuuguauuuuaguagagauggggucucaccauguuggccaggcuggucucaaauuccugaccuuaagugauccucccaccucagccucccaaaguucugggauugcaggcaugagacaccgcgccuggcccauuuuuuuuuucuuuucuuaagagacagggucccacucugucucccaggcuggggugcaauggugccaucauagcucacugcaaccuggaauuccugggcuuaagccaucuucccaccucagccuccuaaguagcugagacuacaagugugugccacugugccugucuaaucuuauuauuuuuguuuuuguagagacaaggucucacuguguugcccaggguaaucuugaauucguagccucaagugauccuucugccucagccucccaaaaugcugggauuacaggcaugagcugccacacccugccugcuuuagaucauuuuuauguaaaguaaaucauuacaguuauugcugaagaccgcccccaugaaccccacccugcccaucucuuccuccaugccccaaaguaaacacuguccugauuuugauuuuauucucauauguguuuugauauauguguauauauucacaaaugauauaugauuuuguuuugcauauuuuaaaacuauauaaauggcauuagacauaucauuuccccacuugcuuuuuuuugcccaacuuacuauuuucugagauuuaugcauguuaaugcaugcugugugcacccauucauuuucaccucagcagcauauuccauugcacgaaugugcugucauuuguuuauucauuccacugucaauggacguguagguuguuuccaaacuuuugcuuuuauaaauagcggaugcagggaacguuuuuacaugggcaagaauuccucuaauggauauaaguauuaaugcuguguuaugggugauacacaucuccagcuaaggaaauguugcuaaauuucccccaacgugcuugaacuaacuucuacugucaccacuagucugaauuucaguguggccgugcccacacuagauuaucaaccuguuuacuucugacucugauggguguauuacgguguacauuugugaauuucagugccauggccgugcccacacuugauuaucaaauaaucuguuuacuucugacucugauggauguauuaugguguacaucugugguuuuaauuugcauuucccaguuacuaaccagguugcgugucauuucauaugccuuucgggcauuugaguuuccucuuuugugaauccgguguuaguauuguuugccuguuguugugucgcuguugggauaguuugugcuuuuccuguugauguguaggaaucuucauguucggaaccccguucccuugucaacguugcacguaucuucuccugauuuaugucuugucuuuuacuuuguuuguuucuucugauauagaugccuuucauuuuaggguaggugguucauucuuucugauguuugacauucuucuccacccauaagcaaugaaaauaaucucuguauuuucuucuucuucuucuuuuuuauuuuuuauuuuuuauguauuuauuuuuuugagacagugucuuguucugucacccaggcuguagcgcaaaccucccagguucaagcaauucuccugccucagccucccgaguagcugggauuacaggcaugcgccaccacacccggcuaauuuuuguauuuuuaguagagaugggguuucuccauguuggccaggcuggucucgaacuccugaccucagaugauccacccgccucggccucccaaaaugcugggauuacaggcaugagccacugcgcccuguauuuucuucuuaaaguuuuucuuuuuuauaucuaagaauuuaauccaccuagaaugcuuuagaggcuuguucuggguuccuccgaggaaaagcagcagucauuuccacuggaauucuggaaagugcgcuaacgccaggcucuucacgugggccuugagcaaucagugccauucccccuccuggagguuugcauacccuuuucucugagcccuuggccuuuucaacaaagcagacacuaggauaguaagaauuucuaucucuagaaauccagaaagguccaaaaugcccugcacuuugcuggcuacaguugaaugaccugcguggugcaggccuuugacuagcugcaugaaauugcucugaccuuaguguaauuccuuaccacaccuaaauuauuccacauaaaacacugacgucuuccccauguuucuaccauuguuaaaauuacaauugccauaacccuuaaguucauaguaucugucguuacuuaguuucucuuuaaucauuaauucuucuguccaaagcaaaguaaauaggaaauuggaggaugcaaagugucgcagggccugaagggucccauuucucaccuaccugauaggauuacagaaggcuuucccaaagaagcaggcaguggcagagaguacaggccuugcccugaauauaaguuuggccguuaucaccggaguugagugguggcauugggagcugucaccccacugcugccguugucugcuuggugaccaugugguuccauucuccuaagccaucucaacaggccagaguacacccuucugucuucagccauuucucugcucccugguugccaagagcagcggcggcagcagagcagggcagucagcaggagucagugugagcucgucaccaaaaccacccagggacauuuaccugggcaaccggaaauggaauuccagcuucccuuccaccuuuugucuaaccccguuaccugggcaaccggaaauggaauuccagcuuccaguccaccuuuucucuaaccccguuaccuggcaaccggaaaugaauuccagcuucccguccaacuuuugucuaaccccguccguugcaugagaugaguuuggugagcuguuaauccucuggaacuuuuucucaucuguaaaaugggaacaauaaauaacauccaggguagguaaggcuuuacucagauuaaaugugacaaaacguuccucaugucauucccggcagucagugagccuuuaggacuauggguguccuucuagauaauuggcaucccagagaaccagaacaaacaaagaggaaaagguagauuguugccaggauacaauguuuacauuuggguaaaucuccuacauccucaguaacauccagagaaauucaaaguaaaacaauaaugaguuacuauuuuuugccuaaugaauaaucaggauuugaugaguuuucagugcugauaagggugcagucugcauggcuggcagagguguaaauggguccauuccauuggaaagaucuuaaaguuuacacaaccacacacaucacagaguacugcacagccauuaaaucacgauucuucuuuagagauggggucucgccaugaggcccaggcuagagugcacuuaaaaaccuugauuuguuuuuuaaagacugcaaagaugggaaaauagaauauaaaaauuguguauauuaagugagaaaaccagguuauaaaauugaauauacauacaguaugauucugauuuaguuuuauggaggaguugugguuuguuacugaggcagggucucccucugucacccaggcuggagaguuacaguggcacaaucuugagucacugcagccucaaccucccaggcuuaagcgauccacccaccucagucuuccucaguagcugggaccacagaugcgcacccccacgccuggcuaauuuuugcauuuuuuguagaggcgggguuuugccauguugcccaggcuggucucaaauuccugagcucaagcgauccugcugccuggcccuccugaagugcugggauuacaggugugagccacggcuccuggcccccugauuuaguuuuuuauauacguacacauaggcuggcuccuugauguuguuucuccuaggugaugggaauuauacauaauuuuuuucuuuuauauuucuguuuauuuccccaauuuuuugcaacaagaauguguuacguguauaacgagaaaaacaugacucaucggcaugaguccacucggcacugggucgcuggaaggggccgguaaugcucucugcuuugcuccacagcugcugcuggacacccacucgcugaagaugguccugcucgaucuccccuccaucagcucgcagguggugaggaaggcacccgccagcuacaccaagaucguugucaaaggcaugacccgggcugagaugauccucaaggugauggcuuguguuaaaaggggccaguuauuuauuuaaucucuuuuucugagaagccuugguuuugaaagcacaggguagguccuauccucaccggccucaaagcaugguccacauucuugggcuggacuggauuuuggccucaucagauauuguugaaagucuguggauaguuauuagggcucaguaauuccuucugacaaaugaauuucuuguuggcgugggauucucuugugaucaaauguggucaagcuuggagguuaggugguugccacugugaaucaguguaugucagggaucuccgcuucucagcaggaauuucaggcacagcucucaguuacucccuuccacaucagccuuuuuggcuuucuguacucugccacuuuaaaugaacucugaacagauguuguaguaacugaaucuaaucagcaaauggauauuuuaaagccccauuuaacaagacuguacuucgagugaggaacgucugaagcccugcgcaucugccucugguuuccagcuauuuugaagaguagggaugagggcuggagaacagaugguccuguggugauguggucuuaaaagcccaggaccuguaggcucuucaggccacuuccuaaaccagaugacucagggacggcaggaguaggaaguggcagcagggccucagacaccggugggaugugggugaggaugaagcagcucauguagguaagggugaagagcucauguaggugagggugaagagcucauguaggugagggugaagcagcucauguaggugagggugaagcagcucauguaggugagggugaagagcucauguaggugagggugaagcugccucaucauguucuuucccugcugcuuacugcuggggaggagagccuguggucugggaauuaucggcagaggaugccugagugaacuccuccucgccacucuucccuucagucucaggaauucaaaacaaaucagucggcuggggaaagaaaaucagauacugcauuccagaacaaaacggaaaugaauaaggguugcagugccguuccuuuccuuuguuuguauguuaauugauaguuuaaguuagucguuacaugaaguuacagauuuuaagucuccaaaaggugaggcagcuuuggcauuuuuguuuuugcagaaauccacuuacuuauaccagcuccuuuugccacccauuucucaggaaucauaguacgucaaggcagaaggagcaaguaccguguacuggugaaaugccuggaacaggagacccucucacgcaggguuucccggaugguccugauaguuuaaaagucaccugggacuccagccaggccuacugaauuagagucuuuagaggagggccccggaaacccauacuucaaacagcagcgcagguguauuuaggauucagcaaauuuaggacauugcuguaguggcaugugaagaugagaugggccacuggggcguuucuagucuggguugcugcugcuuaaggaaaccucucagaauccauuuagcgcucggcgggcaagugaggagugaguuuuccugaagggcccgcucccgucuccuccugcgguggguagugaguuuucuugagggcccgcuccugucuccucccguggugguaguuuuccugaggggcuugcuccugucuccucccgcuguagguagugauggccccucaugaaccguuggugguguuuguugacaacuacaucaaacuucucacagacugcaacacagaaaccuuucagaagauacuggacaugaagguuugugccgggacauuugguccacaccugcucaucccccucacacucagcgguucuuaaccgggaauugggauauaaguuccgggggggcuuucucaaaaugcaugugccuggcuccacagagcaaaccggauucagagaagccucuggaggaggauggccccgggcacgugcacuucaggauucugacaggcccugcaugccccgcugagaccaccugcacagggaggauggggcaggggcagggggaugaggacaggcauguuguccuucccaccuucuugaccuguccuuucuccucugucagccgcuucuuucccuuccuuuaccuuuucuuccccucucuuuuccucccacgcuacuacccaggggauggugagucccuugaggaaacgguucauccucagccuggaguaacuaugcugucuccagagccucugcugaccccauauccagauacugcgcugucccccgugggccauucuggcccagacuucgugacgguucuguuucucucucaaccucaggggcugaagaggagugagcagagcagcaugcuggaacuccugcgccagcggcuccccgcaccgcccucgggggcagaaagcuccggcucacugucccugacggcgccaacaccagagcaagagucgucacgcauccgcaagcucgagaaacucauuaaaaagagacuguagcagcagcaaggggcccuuugcuccuggcuggagacccucagcgcccguuccccagaagcccccaaccucuccugugcuccccggcacucucacaucgucggucuucaaacuuccugggacauguggguuguuacugagucucucccaugcccugucuuacuuccugcccuaaucggagacgcugaguaagggcugggcucuaagagggcgauuuaggugaucucugguucgugaagcagaggcagcaguggaggauaggucccugagcugcccuugacucauguagccuccccauggcagucacacccucuugacacgugggccccacccguccuuuuuuuuuuuuuuuuuuuuuuuuuuugagacagagucucgcucugucacccaggcuggagugcaguggcgugaucucggcucacugcaaccuccgccucccagguucaagcaauucuccugccucagccuccugaguaucggauuacaggcgugagccaccgagcccagccccuuccuccauuucuuuacucccacccugcuccugguuucuagggaagggaaaccaggaaguucacuuggaagacguuuccuagguuuucucaucagaugaagccaugggaacgcccaggaaguccauacucucaaaccccuuucugcccacucaccuucagguccacagcacuuuccagcgucaucugaaauagcaaaggugaugugcagcaucccagugauguguuccuguguuaugagaaggagucugggguucuggaugccucaggaacagaauauggaccuuaaagaccaggcugagagccuggccuggcacgcagccugcccgccccccccgcccuuccuguccaccgcgggcucucugcagcagggcuugccgaagagacugcucccgaccucucaugucauccugcauccagagaauggcagcauaucaagccguuaacccugauucacucgguucccuugaaaccaggccucaguuaaccaugaccacagcuacaggcaaaccgcugcuguugcugccugcuuuugcugaagaaugauaucuugccaggcacggcggcucaugccuguagucgcaacacuuugggagaccaaggcaggaggaucacuugaguccaggaguuugagaccagccugggcaacauacagaugucuacaaaaauaaaaauuugcaaggugugguggcaugcaccuguagucccaacugcuagggaggcugaggugggcagauugcuugagcucaggaguuugagaccagucugggcaaccuggcaaaaccaaaaauacaaaaaauuggcugggugugguggcucaugccuguaaucacagcacuuugggaggcugaggcagguggaucaccugaggucaggaauucgagaccagccugcccaacauggcgaaacccugucucaacuaaaaauaaaaaaaauuagccgggugucauggcgagugccuguaaucccagcuacuggggaggcugaggcaggagaaucacuuaaacccgggagguggaggcugcagugagccaagauuucaccacugcacuccagccugggugacagagcaagaccccuucucaaaaaguuuucaggauagaggaaauuuccuuaaaauccauaaaacuuguaacagccguacaguaggaauaagguuuggaaaucugccuggaaaccugauuuccucauccccaccuuguuucccaacauaaccacugcucugugccccugcccucucugccaggcuuucuccccgaugccguccagcucugauccugagugucauuucuucaucggcuuccaggcuguccuugcuagcugguuugacucucacgcaucaagcgucucaaauuugagaaugcggaggagaaaagaaguguugcgagaaggagaugcggccuucaguugaggucuauuaggaaaagauuccaaauaagacaagggcggggggcggcagucgggagagcccccaggaagcccuguagaugcccccaccccagcccauggaguugcuaugguuaagcagccugagccguacaguugaaaaggggcgguggggcccaucuccaaauagcacagccaguucagccgucuguccucaacccaggagagcugggaaagccaguggacuccugcaccugguucuugucacuccuggcguuuguguacagaucaccacuucucuuuuugguucauuguugaggagucguuuuccggacggcuccaucacagcauugagcuaucaagcugcuguuuuccacaguugguggucacagccagggaaguugcugucuugauuuguuacauugucaguaauccccaaggaaccaauggaugucaguaggaguuucuguuaaaugucuccuugauggggacucaguacuguguagagacgcuguguuucucuucugggggugugcaucagaaccacuggggccuuuuaaaaucuacagaugccggccgggcgccguggcucacgccuggaaucccagcacuuggggaggcugaggcgggcggaucacaagcgcaggaaauugagaccauccuugccaauauggugaaaccccaucucuacaaaaaauacaaaaauuaccggggugugguggcgugcacaccucccagcuacuugggaggcugaggcaggagaaucgcuugaacccgggaggcaaagauugcagugagccgagaucacgccacugcacuccagccuggcgacagagugagacucuaucucaaaacaaacaaaaaaacagaugcccggagauuuugagucaguaaguuuggauggggccuggcauacagguuuaaaaguuccauagguaguuauaacguuuacaccuuguuaagaaccacugcaacagagagauuugcuuuauggaagggcuccugccacgcauuuucauacaugucuauuuuucugacucuaagcuaaaagugcgccgacacuacacuugagcuggugccaacguggugaagauucucuacugauaacagcuuucauuuuaaacuuguguugggucaggcgcgguggcucacgccuguaaucccagcacuuugggaggccgaggugggcggaucacaugaggucacgaguuugagaccagccuggccaacauggcaaaaucccaucucuacuaaaaauacaaaaaaaaaaaaaaaaaaagcaggcagguggcgggugccuguaaucccagcuacuugggaggcugaggcaggggaaucaguugaauccgggaggcggagguugcagugagccgaggucccgccacugcacuccagccugggagacagagugagacucaguuaaaaaaaaaagacuuuugguggugguggggaccaugcccaggauugggcucucuccauacugaugaggauucuucuuguuuugaugaccaacccccaagcagaagcuuuauuuauuaacaucacuucaaaaauaacguaucaaaggggcacccuaggccggguacuguggcaucacaccuguaaugccagugcuuugagaggcugaggugggaagauugcuugagcccaggacuucaagacaagccugggcaacagagugagaccccaucucuauuaaaaaauaggccgggcaugguggcucacacugguaaucccagcacuuugggaggccgaggcagguggaucaugugaggucaggaguucgagaccagccuggccgacauggugaaacccugucuuuacuaaaaauacaaaauuagccaggcgugguggugggcgccuguaaucccagcuacucaggaggcugaagcaggaggaucgcuugaacccaggaggcagaggcugcagugagccgagaucaugccauugcacuccugccugggugacggagcaagacucucuaaaaaauaauaagguaaaaggaguaccuguggaugaaagcagcagcuaacagcucugugauucagcuagaccuagauauugugcccauuccuuccccucaguccauuuucuguagccccuuuaaaaaccaaaaaacaacuuugaagucacuuuggguuuaaaauaaauagugguaauuuguauaaucaauaaagaguucacucugcucuuacugaggggacuugucugaaagcuggcuuagcgguguccaggccagagaacauccuguguggacucuuaacaaugaaacaggagccgcaauggacaagguguucugaucuccaaacccagcucagggauugaagcuaacuaccgccacuccuuccucucucgaagaacaaagagccaguacccagggcucugcccacccccgagaaggggugccugauuucuuaugucuaggguggcuccucugugcagaucagacaggacugagagcagacaagcugagaccagcaugaccaguacagggcacgcagagcgugggggcagguccgaggcugcugcucgaugcaggguaugacaccaacccuuccugaauugccaucggaugaggagaccugguucccuguugaaagaaugccaggggaaaugcugcaugugcacagcuggaaaugggguuccuucucuaggaagagcacucggaauaaccugcuggaaaugggguuccuucccuaggaagagcacucagaauaaccugcuggaaaugggauuccuuggcuaggaagagcacucagaauaaccugcuggaaaugggauuccuuggcuaggaagagcacucagaauaaccugcuggaaaugggauuccuuaccuaggaagagcacucggaauaaccugcuggaaaugggauuccuuaccuaggaagagcacucggaauaaccugcuggaaaugggguuccuucccuaggaagagcacucggaauaaccugcuggaaaugggguuccuucccuaggaagagcacucggaauaaccugcuggaaaugggguuccuucgcuaggaagagcacucggaauaaccugcuggaaaugggauuccuucgcuaggaagagcacucggaauaaccugcuggaaaugggauuccuucgcuaggaagagcacucggaauaaccugcuggaaaugagauuccuucccuaggaagagcacucggaauaaccugcuggaaaugggauuccuucgcuaggaagagcacucggaauaaccugcuggaaaugagauuccuucgcuaggaagagcacucggaauaaccugcuggaaaugggauuccuucgcuaggaagagcacucggaauaaccugcuggaaaugagauuccuucgcuaggaagagcacucggaauaaccugcuggaaaugggauuccuucgcuaggaagagcacucggaauaaccugcuggaaaugggauuccuucgcuaggaagagcacucggaauaaccugcuggaaaugggauuccuucccuaggaagagcacucggaauaaccugcuggaaaugagauuccuucccuaggaagagcacucggaauaaccugcuggaaaugggauuccuucgcuaggaagagcacucggaauaaccugcuggaaaugggauuccuucgcuaggaagagcacucagaacaaccugccugcuugagggugacagcaagugucucacacuucucgucuacuccaagucagauuccuaaaaauaaaauagagcuccaaugggcaauuuaagcaaaagccuuagaaacauggacaccugaaaugcuggccuacaugaaggguacgaugacauuuuauauauuaaauaaaaauucccaguccuguuuuaguauucaucagaauagccucuuggacccucgaaguucuacaccuuugggagauauaaauuuccuuaaaauaaagggauugcuucuuuguguaaauagcuuucauuuucuccaucuggaagugauuucugccugcauguuggagcacaaaauacugcaguuaauuaaagcauuacuggaugucauuugcuagaauguauuuccuuacugcugacagaaaacagaacagacucuaggaaagaaguagcaaguccgugacccuggccgcuccugguggcugcccuucucccuucccugacagucuaaggaagcaacgcgugggagcagaauguggccgacugagcccaguccugaccugcccaguugcaguggagccugucuguaauguuguguaaaguguuuugcuucugacuuggaacccuacuugcccugugaauuucuauccugugaaccuucccuucucuguccuuaccguucccaucacagccugcucuuccagugacggccaagugauuucucuccugcacgcaugaguccauccuguuuccuuaguagcuggauggacguuuugccaugaaaacucuuugggaagucuuguguccuuuagugauuucucuccugcacgcaugaguccauccuguuuccuuaguagcugguuggacguuuuugccaugaaaacucuucgggaaguccuguguccuuucaacaggggaaaacuggcugcggcccuuccauuaggcuccaggaucauuaccucguuuccauucuuucuuuucaacagcuccccacuuuacuagggaagccaagggaucaaccuaaugagaaaagaaccuucccuguagcccaccuggaagggcauugccugccagcuccuuccuucucaccuaugugaacaggagggaagaugccggcgauccauggaucugugggacaugaaggacguguccaucagaaaugaaagcagccugggauuggaagcauccacagaagacuugaucugcaggucuugauuuggaccuggcacuuugacaccaggcgagucacugauccccugagcauccauuuucaauauuggugagaggggauuauaaugaauauuggcugugaaggucacacaagaccgggcuauaugcacuugcucugccauaaggcagugugaaguguguucgugaucacuugugggcgggagccuguggcugucuugccuggacuggcuuuuuuaaacauggaugaguggugacaaauccugcggccgugugcaggcuacauccgcagcgagcuccgcauaucuggucuuugccuuuuuaggucaugacuguaauaucaagcuuacacgagaguuuuaaaagacugagcaguauccccuuccccuggcagcugcugcuuccguagcauuuagggauaaaccugcagacacugagaagagagcuuccucccuccuggggcugguggcgaggcugccuguuguggaaaauagggcaugucuccugugaaugcgaauugcgaggguugccaaagccucccuuccaagaaacuugcuuaggugucugguguccacagaccagacucuucucccgacagggacaaaaauucuugccugccuuucuuuuucuuuuuuuuccuuuuacuuauucuugccuuuuuucuucuucuucuucuuuagguaugaugccccccaaaaaacuaagcaagauuaacuugggacaggcaguucuaacugggaagccugagcucacaggcuguuuggauuacuuuccaauuguguuucaaagauguuuagacuuuucccaaggccagcugaauccuuauaaucagcccaaaaguuccuuucuguuucugucuguccccuuugaggguguugacucagagaaccuggggcaauaugagauguuaaaauaaaaauagcguccaacgucccgccuccugggaaugcugcucacuucauccgaggguucugggagcuucugcucagucaucaaauggaauuugcacaauugucuugccuccuguuuuggguaauuuuucaacaagugagaaauuaagaacagcuucucaacaaacuucccucuacuuccagggccaagaaaaguauuugcagugugggcugcagcuuucaggggucucaggugaaaugguggcaagaaaccccagcucccuucauguguuugccuugcgcugauggaaaaggaaggcacuucucagcugccagagaccacauuccacaggguucuucacaaaaucaagcacugcaguggaccaacuggagcagccacuggagggcuuuagaaggcaaauggaauacauaucaaaugcuauauaaagaaaacaucuguuuacacagagucccccacagccucauaccuacacccaauaucaaaugcuguauaaagaaacaucaguuuacacacagagccccccacaaccucauacccacaccgaauaucaaaugcuauacaaagaaacaucaguuuacacacagagucccccacagccucauacccaugccugucacaucuuugcacagcccuaaaggauccagagcuuuggaucagcagcuggcuagcucggaggccagaggagggugcugaggggaguggaggucaguugggguagcccugggcccuggcugcacaguccagcugcuguguggccugcaugugguaucuuaggucaugagagggccugggcaauucagugcuaucuguacauguugguggggugggaaggaaaagguaacuguguauuuacuguguccuggauacauuaucucaucggaugaaauuccugcuaaguuaagcuccguuuaguggacgggacuuggaggcucaaagaggguaagugacaggcccaaggauaugugccuagugaggggugagccaggauucgaugugugacuaguaaggggucagccaggauucaauaugugacuaguaaggggucagccaggauuucauaugggacuaguaaggggucggccaggauuugauacgugacuagcaaggggacaagccaggauuugauaugugacuagugaggggcgagccaggauucgauaugugacuaguaaggggucagccaagauuugauaugugacuagugaggggcgagacaggauuugauaugugacuagugaggggcgagccaggauuugauaugugacuggugaggggcgagccaggauuugauaugugacuggugaggggcgagccaggauuugauaugugacuggugaggggcgagccaggauuugauaugugacuggugaggggcgagccaggauuugauaugugacuggugaggggcgagccaggauuugauaugugacuggugaggggcgagccaggauuugauaugugacuggugaggggcgagccaggauuugauaugugacuggugaggggcgagccaggauuugauaugugacuggugaggggcgagccaggauuugauaugugacuggugaggggcgagccaggauuugauaugugacuggugaggggcgagccaggauuugauaugugacuggugagggguggagccagucaggauuugauaugugguuagugagggguuagccagucaggauuugauauguggcuagugaggggcgagccaggauuugauaugugacuaguaagggggugagccaggauucaauacgugacaagugaggggugagccaggauucaauacgugaccagugaggggcgagccaggauucgauacgugaccagugaggggcgagccaggaugcgauacgugaccagugaggggcgagccaggauuccauacgugacuagugaggggugagccaggauucgauaugugaguagugaggagugagccaggauuugauauguggcuacugaggggcgagccaggauuugauaugugacuaguaaggggucagccaggauuugauacgugacuagucagggggucagccaggauucgauacgugacuaguaaggggucagccaggauuugauaugugacuagugaggggugagccaggauuugacaugugacuagugaggggugagccaggauucaauaugugacuagugaggggugagccaggauucgauauguaccuagugaggggucagccaggauuugauauguggcuaguaaggggugagccagccaggauuugauaugugacuagugacgagugagccaggauuugauaugugacuaguaagggggugaggcaggauuugauaugugacuaguaagggggugaggcaggauuugauaugugacuggugaggggugagacaggauuugauaugugacuagugaggggugagccaggauuugcuaugugacuaguaagggggcgagccaggauuuggcuccagccuucauuccaacauccaugccuuuuguacuucaccagcaguuuucaaauuuaugggacaaaauuuuacauuggauucccucuauacaaaauagauaaaaguauuuuaugaauacauuuuaugaguucaaauauuuuucagaagaaaucaguaaaagcauugaaaacuauuccagcaaauaggaagcacuuuaaaccaagguuauggaugaaaauguguguguaucaaccccaguuuacuucuggguugcacagaauagagaaaucuugauuuaauccagcuaagaauuuucaaauaguauccauuuuguuuuguuuuaaacagcucuucuugcaaugguagaggcucuucaauuaaacagagaugguaacaggc

SEQ ID NO: 192273 - RNA, 6030 nt, Homo sapiens
ugcggcuguaauggcugcccccagcuggcgcggggcuaggcuuguucaaucgguguuaagagucuggcaggugggcccucaugucgcgagggagcgggugaucccuuuuuccucacucuuaggcuuccaacggaggugcguguccugcgucgcgggguccgcuuucucugguccccgcuuggccucggcuucucgcaguaauggccagggcucugcccuggaccacuuccucggauucucucagcccgacaguucggugacuccuugcguccccgcgguguccaugaacagagguaaagcgcccugauagguuugcucggaacugucauguuuuuaguauugaaagguuucuggggauacugucuuugauucuauuuuauagaaaacaauuuugaggcccugacagggaggagcagugaaaaaucucucaggagagaaauaacaguuugagugggagaaggaaacgaucuggucacaaccagagacgcucacuaaagagcaugagauugaagggccacaaaguggaacuauggcucugcaccccgacaugggaagcaaauuugauccaguaaaugcauguugggccucaucuucuuguuaagacacaguuacaccuggaaaacagcacacuuuauucuucaaacaguguccgguauuggagacuggacacaaacuggucauugcaaaauggugucauaagaagauaauauaaaaagacugggcccucucccuucuugacccuuagcccuuccucccgucccuccuucaggaaaaaaaaaaaaaaagacugggaaagcuugcagggccuucauagcacccuuaguagggugagagaaugagagcugaggaaauaucuggcuuuguguaauccagcuugcuuucauguacauucacuucucaggcacagcuauacauuauaauuacaugcaguaauuauuaagugccagguauugugcugaguuguuuuacacaauugcuagucaucaaaaaaauuauaagcugguaaguagguacuguuaauaucaacucacuuuuacauaugagaaaacuaaagggcucagggaguuacuuuauaaauuaauguaaauuaagggccaaagucucaaagucagcucuaggugacuucaaccuggugcacuaauuuuguaccccugcucccuuugugggugggcaggaacaagcacuugacaggaaauccagauuccacugugucucaugcuucuucccacuugcacauagaugagcaggauguccucuugguccaucacccugauaugccugagaauucccggguccuacgagugguccuccugggagccccgaaugcagggaagucaacacucuccaaccagcuacugggccgaaagguaugcuacacccuugaccauccuacccuuuacaucuuuuacuucuugccaugccuucaaggauggucuuggagggaucugggaccucacugagacuccuuuguuccuggcagguguucccuguuuccaggaaggugcauacuacucgcugccaagcucugggggucaucacagagaaggagacccaggugguggguaccuacaaagggaguccuugaaacaggacagagggugaagcuaagagggucucccuuaccaucagccuugaagaaaaugauggucacauucauuuaugugaggaaaggggguuucuuuucuuuuucuuuuuuuuuuuuuuugagauggagucucacucugucucccaggcuggagugcagugacgcgaucuuggcucacugcaagcuccaccucccagguugacgccauucuccugccucagccuccugaguagcugggacuacaggcgccugccaccacacccagcuaauuuuuuguauuuuuaguagagauggggucucacuguguuagccaggauggucucgaucuccugaccgcgugauccgccugccucagcaucccaaagugcugggauuacaggugugagccacugcgccuggccaggaaaggggguuuccucuuccuuuaggcaugguacaguucugucucuaccuugcccuccccugacaucuagucagaaagauuucauucucucgcucucuuuuuuuuuuuuuuugagauggaguuucacucuuguugcccaggcuggaguucaauggcaugaucucagcucacuacaaccucugccucccggguuuaagcaguucuccugccucagccucccgaguagcugggacuacaggcaugcgccaccacgcccggcuacuuuuguauuuuuaguagagaugggguuucaccauguuggccaggcuagucucaaacuccugaccucaggugauccgccugccuuggccucccaaagugcugggauuacaggcaugagccaccacgcccagccgauuucauucucuguuuacugcuuccuaaucuuccuuauauucacagucaucaucuuucucccagaucccaucaaagcagaaugguagaaaccuaaggucagccugggcgcaguggcucacgucuguaaucccagcacuuugggaggccaaagcaggcggaucacuugagaucaggaguucaagaccagccuggccaacauggugaaacccugucucuacuaaaaaaauacaaaaauuagccgggugugguggugcacgccuguaaucccagcuacucaggagguugaggcaggagaauugcuugaacccgggaggcagagguugcagugagcugagauugugccacugcacuccagccuggaugacagagugagacuccgucucagaaaaaaacaaaaaacaaaccuaaagucaauaauaguuugacugagaagggagggcaggcuccugacaucacagguagccucucucugacuucccagucauaaucuuuucuccuggggucuggguaucucacuuuccugauuuuagauucuacuugacacaccuggcauuaucaguccugguaaacagaagagguaauggugguggaauugggguggauuggcggggagguacugaaagaggguggggagauuccauuauaggggcuggaaaaccccuuuaccauaccacaucccucaucagaaaugccuuagucauaagaccuuuccugacugauguaugucugucccucaggcaucaccuggagcucucuuuguuggaagauccauggaagagcauggaaucugcugaucuugguuagguucaggaugggaaccuuaagcccaguuuacaggggucauggccuuucauuccuugguaguuuggggggcaaaagccaagcucauaccauggaaguuuuugucagggcaggaggaagagugaccauuuccuuuuccuucuuccugccuugccaucuucuaguugugguucuuguggaugucucagacaaguggacacggaaccagcucagcccccaguugcucaggugcuugaccaaguacucccagaucccuaguguccuggucaugaacaaggugagcacuacccaccugaggaaggggucuacuucccuccaaguccccuaucucugaccacacacccuuugcccaucccccauguccagguagauuguuugaagcagaagucaguucuccuggagcucacggcagcccucacugaagguguggucaauggcaaaaagcucaagaugaggcaggccuuccacucacacccuggcacccauugccccagcccagcaguuaaggacccaaacacacaaucugugggaaauccucagaggauuggcuggccccacuucaaggagaucuucauguugucagcccuaagccaggaggacgugaaaacacuaaaggucaguuagucuuggccauagccuggcccuugguuucuaccauaugaagacagcccucaaauuuccuccuggaagcaaaagugaggagaaaaguccugguugggauuaagaugcccaucuauucccucuguucccacagcaauaccuucugacacaggcccagccagggcccugggaguaccacagugcaguccucacuagccagacaccagaagagaucugugccaacauuauccgagagaagcuccuagaacaccugccccaggaggugccuuacaauguacagcagguacagagugaaggguucugggggcucucuaucagacacacaccucuacccagguguaugacugacuaaucauuugucucccuguacagaagacagcagugugggaggaaggaccagguggggagcugguuauccaacagaagcuucuggugcccaaagaaucuuaugugguaagugagacuaggcucagaggagagaucaagacuauguuaggcaggaguucuucccccagcuuggagcccugagagcaggaccauauccuucucucuuuuuuucuucuucuuuucuuuuuuuugagacagucucgcucugucacccaggcuggagugcaguggugugaucacaguucacugcagccuugacuucccacgcucaagcaauccucccgccucagcccccugaggagcugagaccagcugauuauaauuuucuuuuuuuuuuuuugagacaaagucucacucugucauccaggcuggagugcaguggcgugaucucugcucacugcaaccuccgccucccaggcucaagugauucuccugccucagccucccgagaagcugggauuacaggugcccaccaccaagcccagcuaauuuuuguauuuuuaguagagaugggguuucaccaucuuggccaggcuggcuucgaacgcuugaccucaaauuguccgcccaccucagccucccaaagugccgccugacuauccgcuaauuuaaaaaaauuuuuuuguagagaagggguuucaccauguugcccaggcuggucucaaauuccugggcucaagcaguccaugcaccuuggccuccgaaagugcugggauuaauaugcgugagccaccacaucuaacccucucuuuuuuuuauuuuuuuauuuuuuuuuugagccagguucuugcucugucacucaggcuggggugcagaggcacgaucucagcucacugcaaccucugccucccagguucaagugauucuccugccucagccucccaaguagcugagauuacaggugcccgccaccauguccagcuaauuuuuuguguuuuuaguagagacagcauuucaccauguuggccaggcuggucucgaacuccugaccucaggugaucugcccgccucagccucccaaagugcugggauuacaggcgugagccacugcgcccggccacccucucuuuuuuuuaaagaggggucgcacuguuacccaggcuggacucaaacuccugugcucaaaggaucuucucaccuuagccccccaaguagcugggacuacaggcaugugccaucauuccuggcuuccuucucuuucacauacccucagaaacuccugauugguccgaagggccacgugaucucccagauagcacaggaggcaggccaugaccucauggacaucuuccucugcgauguugacauccgccucucugugaagcuccucaagugaccacccucuacugacccucccagggcauuccagcucaagcugcuggcaggaacugaccaguucuguccuuggcuggggacccuccaggcacuggugagagacaugaacacugacuggccacuagcuggccuggcccuguugagucugcacagucccugcccagcugugucuucuguuggaagaaggaaccugccuuagcucaguuuccaggugguuccucugccuggcaccacagcuacaaagguguagcuaagaagauggcccauuggugggagcaaugucacccugccuccagcuagcuaugggcccagaguuucucccugagucgcuguugcuagcagggagauuucucuuccugcccucacuucuuucaccuugaacuuggauaagaacucgugucuccugagugagguagcgccucccaucugcuccccaauucuugaucucucccaccccaucccucuccccagucuuggauacuaauaaaauauaagcauucug

SEQ ID NO: 192274 - RNA, 13327 nt, Homo sapiens
ucauaauaaaauuauuguuuuuaucauuuuggagagagaaaauagggggaaaaucacauacauuaacaguccaugaugccaagcuccugaagaguaaaaguuucccagcuaagagggauguuucccucaguuuguuuuaucaguacuaauaaaaagcaucugccccuuuaccagcaaguccucuacucagaaagaacugacccacgcaagucugggagagugacuaguucaaaugugcagggcugaagcuuccaaacacagccacuauuuucuguuguauaucuucaucucaauggugacauggccacugcccaaggaacuuguggcagggaucccaaggugaggcagcaacagaugucugugaacauugugcguuaacaguggcucagagccucuagauucacagcucugcauggugggcuucugccuucaacaacucacugggcuucaugaagaugccuuccauggcuuuccaguaguuguucugacuuggcugggccaugccaugcaccucuuuuugcccacugauaggucgaccauauuguucuccugugacagacagcaguaccucaguggaagaguguuugaaccgcaccucaccaucucucacccaguaggguccauuacagagcacuguccagucauccagauaaucaccuucaccuuccucaccaaaagcacucacuuccuagaaaauacagaagguaguaacaucagcauggcugacaagggcuugaaaaggggugggaggcaaugggaagaaaaagaaggccaccuugaaguaaaaaaucagaggggccaggcuuaugccuguaauccuaccacuuugggaagcugagcagggcagaucacuugagcccaagaguuugagaccagccugggcaacauggugaaacgcuaucccuaaaaaaaauacaaaagaaauuagcugaggucaggaguucaagaccagccugaccgacauggagaaacccugucucuacuaaaaauacaaaauuagcugggugugguggcacaugccuguaaucccagcuacucgggaggcugaggcaggagaaucgcuugaacccgggaggcggagguugcggugagccgagaucacaccauugcacuccagccugggcaacaagagcaaaacucugucucaaaaaaaaaaaaagaaaaaaaaaaaagaaauuagcugggcaugguggcacaugccuaugguacccagcuacuacagcuaucaccuaaguccaggggaucaaggcugcaaugagcugugaucauaccacugcacuccagcuuggauuacagagcaagaccccaucucaaaaaaaaaaaaaaaauucagcugcuuuccaguguuguuauuuuauuuauuuauuuauuuauuuauuuugagacagaguaucgcucuuguugcccaggcuggagugcaauggcgcaaucucggcucaccacaaccuccgccucccagguucaagugauuuuccugccucagccucccuaguagcugggauuacaggcaugugccaccaugcccggcuaauuuuguauuuuuaguagagacaggguuucuccauguuggucaggcugguuucgaauucccaaccucaggugauccucccgccucagccucccaaagugcugggauuacaggcaugagccaccgugcccggccacuccaguguuguuuaaaccaugaaccauggaaaaagacgaaagacauaaaggacauaggaggaaaaaaauucauugcuauaagauuaugguccaugguucuuaucugagucauggcaucaaaaagaaaggaaaaaaaaaagauuaugguccaaacacuuauuuugcaauuaauacuauaauugccuuauauuuucuauuacaguguuaaaacagaauuucuuuuuuuuuucuuuuuaagaguugggauuguggccagguacgguagcucaugccuguaaucccaguaauuugggagggcgaggcgggcagaucgccugaggucaggaguucaagaccagccuggccaacaugguaaaaccccaucucuacuaaaaauacaaaaauuagccaggugugguggcaggcgccuguaaucccagcuauucgggaggcugaagcaggagaaucgcuugaaccugggaggcggagguugccgugagccgaagguugcagugagccgagauugcaccacuggacuccagccuggaugacaagagugagacuuugucucaaaaaaaaaaaaaaaaaaaaaaaaaaaacaguuaggguaucuugcucuguugcccaggcuggagugcagugccucaaguggucuuauggccucaccuccugaguagcuaagacaacaggcauauaccaccacacccagguaauuaaaaguuuuuugguaggcaacuguguugccuuggcuggccucuaacuccuggacuuaaacgauucuccccacuuggucuuuuagggugcugggauuacaggugugagccaccgugcuggcuuuaaaauacuuuacuuuuuugagacagcaucucgcucugucgcccaggcuggagugcaauggcacaaucucggcucucugcaaccuccaccucuuggguucucaugccucagccuccagaauagcugggauuacaggcaugugcuaccacacccagcuaauuuugguauuuuuuaauagagauggggguuucaccauguugaccaggcuggucucaaacucccagccucaagugauccaccuaccucagcguaguaaagugcugggaguacaggcaugagccaccacauucugcccuuaaaauacuuuauaucucuuguuauuugacuuuaaauauuacugcuucauucucuuaacuagauuuuaaaugaccugaugacaaguucaaaagggaauggacucugggagucaggcugaccuugaaucucaacuugaucccuucuucuguaaauccuuugagccuuuguuuucuccucuauaaaaugaucacaauaucaccuuacagagcaacugugagaauuaaaugagauagcaaauauuaacugagcaaaacauagcaaguuuucuacauucuuuucuuucuuucuaauaaggcagugagagagaaagcaaguucucuauauucuacuccucaucuaaaucccaucuuccuuaaggccaaauauucaguuucuauacgauggcaauuaaaaaauuacugauuauuucagaaguguguguguguguguguguguacacucuacuugauaaaauuguucccaggaggguaccaguauguaauucugauacugcuauauuuguauacuggaacugaacugaaguucaauacauggauggcagaugguaggaacaagguaucuuacuguuggagugggaauuuacaaauuagcacagggaggaggcuaggacgaucuaugugguaauggauuacagcuaaagacaucaauaagaacacuagccaggcacaguggggcaugccuguauccccagcuacuuggaaggcugacgcaagaggacugcuugagccaaggaguucgaggcucuagugcacuaucaucacaccugugaguagccacugcacuccagccugaauaacacagcaagaacccaucuuaaaaaaaaaagaaaaagaaaaagaaagcucauuuaacuuaauauauguagauacagauggcuaugcaaauaaaaauuuauagauauguaauauauacacgaguaagcacacacagguaacaauucuuuauuuuuuuaauuuuuuuuugagacagagucucgcccugucacccaggcuggaaugcaauggugcaaucucggcucacugcaaccuccgccucccagguucaaacgauucuccuaccucggccucccaaguagcugggaucacaggcucccgccaccaugcccagcuaauuuuuguacuuuaguagauacgggguuucaccauguuagccaggcuggucucgaacuccugaccuugugauccacccaccucugccucacaaagugccgggauuauaggugugagccacugcgccuggcuuacaguuauuuauucugucaagugagagggccuaaaagaaacacuccaguagcaacaagcuuacauaaggccuagaacuugguuuuaauaucauucuccaauaaaaggaagcagagcuccuuggagaaacagcugauucuaguacuggagcaagaaauaaacaagaugagccuggagcaucuuuuggugccagaaaggaaagaagugcuuuaaagugcaggcacauauacacaaaaacacaaugggauacugccaauggacacaaagccagcugaaagaauucccaauggccaaaguuggaacaauuugagcaacaaaauauaguagcauuagauuauaacgaaguauaaacuauccauaaguuuauacuaauguaaauaacugaauaaauaaauaaauuggggaaaagagacaaauccccaauauggaaaaaucccaaauaaaauauguagauauuccacccuaauguagacagaguauaacucuccagucuguaagagugaaaugcacauagugacuuucuuccaaaaagugcauggaaagggggaaaaugaaaagaauaacuuuacaggagaaaccuaacgaacaaacacuacuucagccagguaaucaagguccacaucaacagucauaaaucauaaagauaguauguaccccugauaugaugggauacaaauggcacuuuaccucugugaucuuccucccaaacccuuuauaaguccggucuaaucacaagaaaaacaaauuccaacagaggggcaaucuacaauacaccugaccagcacuccucaaagcugucaaggucaucaaaaacuagggaagccugaaaaacugucacagccaagaacagccuaaugagacauggcaaguauauguaaugugguauuuuggaauggaaaaagaacauuagguaaaaacuaagggaccgggcacggaggccucacgccuguaaucccagcaguuugggaggccaagguggguggaucacaaggucaggagcucgagaccaaccuggacaacauggugaaaccccgucucuacugaaaauacaaaaaucagccgggcgugguggcaggcaccuguaaucccagcuacucaggaggcuguggcaagagaauagcuugaaccugggaggcggagguugcagugagcugagaucgcgccauagcacuccagccugggacagagcgagacucugucucaaaaaacaaaacaaaacaaaacaaaacaagggaaucagaaaaaaacuauggucuuuaguuaauaaaacuguaucaauauugcuucauuaaauauagcaaauuuacccuucgaagguaagauauuaauagggaaaacugcauacaggggcuggggacagggaaggagucauuaagguguccacauccccugacaacucaaggcuuaaaacaguggcacaaggcuggguguacuggcuuaugcuuguaaucccagcacuuugggaggcugaggcaggcagauagcuugagcucaggaguuugagaccagccuaggcaacauggcaaaaccccguaucuaccaaaaaaaauacaaaaauuagccaggcaugguggcgugagccuguagugagggcugaggugggagaauugcuugagcccaggaggcugaggcugcagugagcaagaucacacuacaaccugggugacagagcaagacccuguuuaaaaacaaaaaacagugacacaaaagcaaaucuauuuuccuaauguaacuaguuagcaucauuaaaaaaaaaaaaaacacugcaaguuggaaaacauuggguuucuuuauugcagaauaucagaacuuaugauaugcugauguauacccagucugucuguccuucccauuucuugauuugguuuaguuguugucuccacuuugaccagaaacaauuuucuucacacuuauaaaacaaagccggcugggugcaguggcucaugccuauaaucccaacacuuccaggaggcagaggcggguggaucaccugaggucaggaguucgagaccagccugaccaauauggugaaaacccaucucuacuaaaaauacaaaaaucaggccaggcgcggugacuugcacuuguaaucccagcacuuugggaggccgaagugggcagaucacaaggucaggaguucgagaccagccuggccaacacagugaaaccccaucucuacuaaaaauacaaaaaaaaaaauuagccaggugugguggcacacgccuguagucccagccacucgggcagcugaggugggagaaccgcuugaacgcaggaggcagagguugcaaugagcugagaccaugccauugcacuccagccugggugacagagugagacuccaucucaaaaaaauaaaaauaaaaacaaaaauuagccaggcaugguggcaugcgccuguaaucccagcuacuugggagacugaggcaggagacuugcuugaacccagaggcggagguugcagugagccaagaucaugccacugcacugcagccugggugacagagugagacugcgucucaaaaacaacaaaaacccacacaaaaauagagccauuuccccaggucugcacaaaagagaacaucuacaccuagaaaagaaacauuuaagaaccaagagaucaaacaagcacccacugaguaaugcagagcagcaacaauccaucgaaagccaccucaccugguuuccagaaagaggugaagugaaguggugacuauggagguuucggccaguguugacaugugucagccggaugggcuggccacacuugauggggguuccccucucacacacuguggcacucuucccccguauccuccaguaacuguugcugucauccacagagguuacaccugucacugacugcugcccacuaccugcaguuaagaaaagaaaggcaacucucuuucucugccauggacaacaugcucagagacagaagcuugagugcgcucaagauucaccuucaccuguaacccaccaccaugaccaaggaagacacgcugcuggagguguaauggauauuaauacugcucuacaagagacugaagaccgcccucagccaugauggccuagcagguggaaccugcaaagcugccaaagccuuagacaagggccaagcccaucuuugcgugcuugcauccaaaugugaagagccuauguaugucaagcuagggguggcccuuugugccgaacaccaaaucaacccaauuaagguugaugaccuuaagaaaccagagacauggcuaagccuuuguaaaacugauagacaaggaaaacuuuguaaagugguugguugcaguugugucacagugaagggcuacagcaaagaauuucaggccaaggaugugacuguguacuucaaaugcaagaaauuaacaaauaaauuugguacccauuccucaaaaaaaaaaacagcaagugagcucagccucacccuucuugccuauggccaauauugugccgugucauuaaacagguaagaagggguggggagaaaaaugcuaugcuuggcaauauuuuuucuucuacaacauuaaaauauuuauaaaaaauacaaaucauacugggcgugguggcucacgcuuguaaucccagcacucugggagugaaacuugaccucccaaagugcugggauugauggugagccacugugcccagccuuuuucuucuuuuaaauaaaaaaaaaauuuuuuaggcugggugugguggcucacaccuguaauccuagcacuuuuugggaggcugaggcaguuggauugcuugagcccaggaauucaagaccagccugggcaacauggcaaaaacccaucuuuacuaaaaauacaaaaauuagcuggguguggugguggcagccuguaaucccagcuaucugggaggcugaggugggagaaucgcuugaacccgggagguggagguugcaaugagccaagaucgcgccacugcccuccagccuggaugacagagccagacuccgucucaaaaaaaauaaauaaauaaacuguguccacguaauacuaguuacuauaugauaaaguauacuuaaggguaugucauaucagaaaauucuaagaauuugcaucaaaggauauccaaggcacaaaucuaugugaguuuuuugaggcacaggcagugguaaccuauacacacuagccuggauagccccuaaugugucuaaucacauaauuuuaacauguuuguaauauuauucauguucauuaacuauuaugauaaaaauuuuuguauuucacaauuaaaaugagacuauguugccaacuuuaagcagccauuacagcucccaacucccauaaguggucaauuauuauaaacguauuauuuaagcaaggcacgguggcucacgccuguaaucccagcacuuugggaggcugaggcaggcagaacacaaagucaugaguucgagaccagccuggccaauauggugaaaccccgucucuacuaaaaauauaaaaauuagcugggcguggucgcaugugccuguaaucccagcuacuugggaggcugaggcagaagaauugcuugcauccgggaggcggagguugcagugagccgagaucacaccaccgcacuccagccuagguggcagggcaagacucugucucaaaacaaaaacaaaaacaaaacaaaaaauguauccuuggaggucuggcacaguggcucaugccuguaauccaagcgcuuugggaaggugaggggaggaucccuugaguccaggaguucgagacuagccucagcaacauagcaaaaugcagucucuaaacguacauauauauauauguauuuuuuuuuuuugauacaggaucccucuugucacucaggcuggagugcaguggcacgaucacagcucgccacagccuugaccucccaggcucgggugauccuccuaccucagccucccaaguagcugggauuucaggcgccugccaccacaccuggcuaauuuuucuauuuuuuguagagauggguuuuugccauguugcccaggcuacucucgaauuccugggcucaagcaauccaacugccucagccucccaaagugcuaggauuacagaugugagccaccacacccagccuaaaaaaaaauuuuuauauuuaaaagaaaaaaaagaagcugggcacaguggcucaccgucaaucccagcacuuugggaggucaaggugggcagaucgcuugagcccaggaauucaagaccaagccuaagcaacugacaaaacuccaucucuacaaaagaugcaaaaaauuaaucaggugugguggggugcacuuguagucccagcuacucaggacgcugagaugugaggauugcuugagcccaggaggucaaggcugcaaugagucguaauugugucacugccaguuacacggguaaauguagccaacuaucagcuccuuucaugacuuuauuauaucuuuuuucagaaaaggcaaaccaagucucccuuccuacuucugguuacugccuuacagcucucuggguccucacagccacgcuucacuaaaccauggucuacauuuugucuccuacauuuucugcuuucuauucaaccguucacuucuuccuccaaauccuuauaccuugggauuauccaaaguucuaugccuggccuucaucuguuucuaccuguaguuuuuuuuuuuuuuuuuaguauuuauuguucauucuuggguguuucucggagagggggauguggcagggucacaggauaauaguggagagaaggucagcagauaaacaugugaacaaaggucucugguuuuccuaggcagaggucccugcggccuuccgcaguguuugugucccuggguacuugagauuagggaguggugaugacucuuaacgagcaugcugccuucaaguaucuguuuaacaaagcacaucuugcaccacccuuaauccauuuaacccugaguugacacagcacacguuucagagagcacgggguuggggguaagguuauagauuaacagcaucccaaagcugaagaauuuuucuuaguacagaacaaaauggagucuccuaugucuacuucuuucuacacagacacaguaacaaucugaucucucuuucuuuuccccacauuucccccuuuucuuuucgacaaaaccgccaucgucaucauggcccauucucgauggucgcugucucuucggugcuguuggguacaccugcagaaaggcugucacuucacacuuggaagacugcacagcggccaggcagaggcgcuccucacuucccagacggggcggccgggcagaggcacuccucacuucccagacaggguggccgggcagaggagcuccucacuuaacagacuggguggccgggcagaggcgcuccucacaucccagacgaugggaggccggacagaggcgcuccuccccucccagacggggcggccgugcagaggcgcuccucacuuccuagaugggacagccaggcagaggugcuccucaacucccagacgaagggcggccgggcagaggcgcuccucacaucccagacaaugggcggccgggcagaggcgcuccucacuucccagacaggguggcggccgggcagaggcgcuccucacaucccagacgggguggcggccaggcagaggcgcuccccacuucccagacggggcggcugggcagaggcgcuccccacuucccagacggggcagccgggcagaggcgcuccccacuucccagacagggcggccgggcagaggcgcuccccacuucccagacggggcagccgggcagaggcgcuccccacuucccagaugggguggcggccgggcagaggcgcuccucacaucccagacagggcggccaggugcuccccacuucccagaugggguggccgggcagaggugcuccucaccucccagauaaugggcagcccacuucccagaugggguggcagccgggcaaaggcacuccucacaucccagauggcgcggccgggcagaggcgcuccucacuucccagacggggcggccaggcagaggcgcuccucacuuccuagacagggcggccaggcagagacgcuccucacaucccagacagggugauggccgggcagaggugcuccucacuucccagacgggguggcggccgggcagaggcccuccucauaucccagacggggcggccaggcagaggcgcuccucacaucccagacgaugggcggccaggcagagacgcuccucacuuccuagacgggguggcggccgggcagaggcuguacucuuagcacuuugggaggccaaggcaggcggcugggagguggaaguuguagugagccaagaucacaccacugcacuccagccugggcaacacugagcacugagugagcaagacuccaucugcaaucccagcaccucgggaggcugaggcaggcagaucacucgaggucaggagcuggagaccagcccagccaacacggcgaaaccccgucuccaccaaaaauacgaaaaccagucaggcauggcggcgugugccugcaaucccaggcacucggcaggccguggcaggagaaucacgggagccccaggcagggagguugcagcgagccgagaucacggcaguacaguccagccucggcaacagagggagaccguggaaagagagaagagacaagagagggagacggagagggcuaccuguaguucuuaaacaauuguugagggucaggacaaaagcauuuguauuuuuaacaaguuucuccaguuauucaaauuaaucccagauagagaaucacaguucauucugggcaauuucaucuacaacccugacaucuucaaccacagucuguacaagauguuauauuuaauguuguaucucaggcucagcacagaucccuuuucugagcuccggacugaaccugguucccaaaucuggcuguccaucagaaccaccugaagagcuuuuuaaaccuacagauugcuacugccaagccucuguccaccuccacucuaauucaguagauccaaaguaggaaaccaaaacaaaguaaaaaauaagccugacaacaugguagguguucacugaaugggugcuagaauuauuaagacaucgcagugaugauaacucauguccuugccuagucugacugaucagauggguuuugggaaucaugaaccagacuagcccaccugacagaacucuuuccucccucagcaaacagcaucaucagucauucaagacaaaaaucuaccagcuaucuuagaugccucucacaucucacuagcugaccuucauucuuuuuuuuuaacuuuaucuuuuuuuuucaggcagauaagacuuucuuuuuuuagucuguuuuuauuauauuguaauuuucuugacugauuaucaccaccgaaucuccuguauguaguacaauucuagccauguaguaggaacucauuaagaccuaugcugaaugaauccacaaauaauuuauuacuaaacauuuuaauuucaaacgcuaaaaaaaaaaaaaaaaaaaagcaguuuucucugcaauuccugucacugcuccaaguuucuuacaagaaggagguuaagguuuggguagaagggggccaaagauggaaacugaggagcaaguguaagaugcagaagagcuggaagacaaaggguuguagucaacgagugagcucuuggaguuuaaaguuucacagacaguacuuacuguaacuuuaaaauuucagacacagcacuuacuguaauuuucuugucucuaaagcaggcuuugaaccuggauagauuuggauagaaccccgacuuugucauuugcuaacugcaaggcuuugaauaaacgauuuaauuucucugcgucuguuuccucaucugugaaaugaggauaacaauacuguccaccuuacaacaauguuaauaaucggaaaaaggacauagguaacgugccuggccuguagcucaccaaauauuaggugguguugcgauuaagaugccuuagaacaauucaguucuccgacucucuagaccugaggaaccuucccagggaaccccuaacuuucccagaccacacugucagauauucuauaggccccgccccuccagagccuccgaguccucccuagcccacccgagcccgguccccagcauuaccugacccauagcgcacgucgugugagugcagucggacguuguggcgcguauugaguagcuucaccacggagccgcaaguaacgacacccaggcuggacgcucccacagcgcuccacaaaccccccaacaacagcagagguacuacagccauccuaacuguaucgcggagccccaaaucuucgaagaaaac

SEQ ID NO: 192275 - RNA, 11250 nt, Homo sapiens
ggacgcggccggguggggcggcacgcccgccgcgagcaccuccaguucugccggcuucugcgcgccggggccgccucuccuuccgccggugccgcggcgccucauggaagccccggaggcggcggaggggggccugcagcgcggggcccggagggcagccggcgcccgaagccagggugcacuuccgaguggcgagguucaucauggaggcagguaaccgcggccgggggaggccaggacaggcggcgccgcggcccgcuucgcggagcgggcccggcuggccaggccggccuucuggagugcucaccguagcagaggccgggaagcccugcucggggcugaggaccuccgccuuugcgccgcgcccggugugcugagcagugagccgcgagguauccccauggcguggaccggugugcaggcccuaggagaggacguggccggguugggccuccagcgaggcggagaccggcccgggcgcccgcagcucugcgcagugcgccacgccuucugccggcacccgcggcccugcacuccgguagacuuuauggcgcuuagucgcgcggagccuuuuggagaacgcuguccgaggguuccugucacuccggggaccuaggcugcuugcagcuccuguuccgaacccugccaggacauccacaguaguguugggcuccgcgcuucccaggcgaggugauuaagcuaagaucucuguagaaacaucguuuccauccagccaucaacaguauuuuuuuuuuuuucgagacggagucucgcucuguuggccaggcuggagugcaguggcgugaucucggcucacugcaaccuccgucucccggacuaaagcaauuauccuuccucacgcuuccgaguagcuggaauuacaggugugugccaccguacccggcuaauguuuguauuuuuaguagagacgggguuucaccauguuggccaggcuggucuugaacuccuggccucaggugauccaguugccucgcccucccaaagugcugggauuacaggcgugagcuaccucguccggcccaucaacaguaucuugauaggagauacuguuaguuggcggguaguuauuuccuaccuuuacugcuugggggagaaggguugggcagaugugcuuucuacccaaggugggcggagagucugaggacugcugcaggacuguucaucccagugauauguaaauuuacuguaauuugcaagaagaguugcaaaguuauuauuagggaaggauggcagugacaccucaucugcuaccgucugcucggaggguccguguaaauugggguuugcucuguaaaacaaagcuuggaaggucaugucaguaacagcaccuuaucuggcaucuccuggaaugaggggucccagguaggaauugucuuuauauaacaaguuuagaccuucugagggacuucuuuauaaaauguauuacacaauccuuuguccuuuguaggaggcuaaauauugauuucccaaagaugucccuauccuaaucccuggaaccugugaaugucaucuuauauagcaaaagagauuuugaagaugugauuagagaccuuaagaugggagaucauccuagauuaucuggguguaaccacacccauccuuauaaggcaaaggcaggaggagucaccgucagagaaggccacgugaggacagaagcagaguuagaagcuuugaagauggaggaaggggccagcaaccaaggaaugcagcccuccucuagaagcuggaaaaggcaaggaaacauucucccauggagccuccagaaggagccagcccugcuuagacguugaucuuagcuuucuaggcuaguuuuggacuucugacuuccaggaucggaggaguauaaauguguguuguuuaaguggcugaauuuguggugauuuguugcaguagcccuagggaacugaucuaccuucuuaggcagaggaugcugacugucauuucaugguugauugucgguuguucuucgccuuucuguuuuggccuaguggaugucauuuaaccuugucuugugaacccuggugguugugaauuuguuuugguucugugcaccagggcagugauuuucuuaggagccauucagggaugggcuggggaugggcuuuaaccccuaaguagaauccacugaauccugcucugguguuuugaguuuuguucaccuuaaaaauuuuuuucuuucucuuuuuuguagagacagggucucacucuguugccuaggcuggucucgaauuccugggcucaagcaauccuucugccucagccucccaaagugcugggauuacaggcguaaaccagcaugcccagcccacuuuucaaugugcugguguccuucccuggugccuggcuguggccauaaacauugccuuuucucugcaaugcaagugguuacucuuggcagucacgcugcuugcuuugcucaccucuucuaaccuguggacuacgaaaccagugcucaguguaaucuuucacugugacuucaggacuuguggcacccacgaggccguuucuuuucugucgucguagcuguggggugggcgacuucuagcuagcuguuugcuaaggugaacccagacacacaacagcauauaguccuuuuccaggguuuugcagaagcugcuaugccaguugcuaacugagcgguccucggaacccuuguuucccagagcguggucuauagaccccugacaugggcaugaccuggggcuugucagaaguggagaaucucagagccgcagaccuacaaaaggggaagucugcauuugaacaccauccccaggggcuugggucacccacuagagucugagagcccaguaagagacccagcaggagccacuggcucugcuggaaguucuuagccuuguccaaguaggguuguaccugcuagggcccauuccaauggcuccccucacuggagcagugagccagcgcuggauugaaguccucucuugccugcuuucucuccgcaggugucaagcuagggaugcgguccauucccauugccacugcuugcaccauuuaccauaaguucuuuugcgagaccaaccuggacgccuaugacccuuaccugauugccaugucuucaauuuacuuggccggcaaaguggaagagcagcaccugcggacucgugacaucaucaauguguccaacagguaauggcauuuggcugggcuccugaucuccacccggugggggggacgggcagggaaggcuccuauggggcccugcccaccaggugccagcaauggagcuuggaaggaaguaccuggauggccuugaaccaggcagggccagaaacaguagcagcaaacgugagaaggagccugaugucagaggccaguggggucugugagagaaacgcugggccagauuauggggagccucgaaagcuggauggagggcagaggcggggcuucagcagagggagcuuggagaggcaugucaaagaagauucuguggaagucuuagacagggauggcugcaggcagaagagcuugccugcagcgggagggugcagacccagccaggugguaggucccaguugcuuaggagccucgcccugcuguggguguggcgugggcauggcacagccggcccaagcagguguguuccugcuggggcagaaugcagggucuucgccaaggcgagggaaagacggucugggaaauacaaaacugagaaauguucacuuuuuggaguauaucauucccaugagaggcuuaaacauguuccuuggauggcuggacgugguggcucacgccugugaucccagcacuuugggaggccgaggcggguggaucgcuugagcccaggaguucaagaccagccuggucaacauggugaaaccucgucucuaccaaaaauacaaaaauuagccgggcgugguggcgcaugccugugguuccagcugcucggguagcugaggcgggaggaucgcuugagcccaggaggucaaggcugcagugagcuguggcugcaccacuguacuccagccugaaaggcagagcaagacccugucucaaaaaguaaaaaguaaaaauaaguuaaaaaaauacguuccuugggcccagagugagagccccgggcauugccaccucaggugaugaagacucccuaaugccgggcugaguauaacaggaagcacaaccgacuuggcaugcucaagcuuccgguuccucuggagccaucgccaacagccagucuuugcacuugacauuuugcugaaugauagcggacagcccaucuggcuaaaacuaggagcuggcuucuuuccucuguugguuacuguuuucauucucuacacuagauguggagaugaagaauuuuuguauaaaaacccaaauaaaaugacccuccaugaaucugcagauggacgauguaguuugcaucuggacauugugugacuuaagcaauuugagccauccagugcucaggagacugcccuggcugcugaagcauugccauuucucugcgcagguacuuuaacccaagcggugagccccuggaauuggacucccgcuucugggaacuccgggacagcaucgugcagugugagcuucucaugcugagaguucugcgcuuccaggucuccuuccagcauccacacaagguacauacuggggaacuggugccuguuuggagaggcucaagccauggucucuguucuuuaucccaaaagugcaucccaucucauacucgagagcacagcacagaaggagagcagggcugcggcugggaacugggucuccuggcucuguguuuguggcuggguuggccgcccggccucucccgucccaccccuguggguuuucucagccaauucucauuucagcuucugccuuucugccugcucaccugugggcgggguccgugcugcccgcugaagcuguggcagcuccugugguccauauagauggugugcacgcugggccucggggaagcaggcugguuuugugaccggccagaguccccguccccaggggaugcugugaugccucggagcacgccuccagcucagcugugcuuaggaagccauggggaaagccaaaucgcuugagucaagcagcaugcuuuaacuucuaggaaugugugagucucaacagaagaaccauuucaaacagcaguaaaagggaaaaguggaacgcuuaggcgacuggcacacgaugcucugggcaccgcagcuccaugcacgggcagcucagaaggcuggccggagacagagauggaggaguugugguuuggggcucugggcuaggaguuucauucuuuuucaucggaacucuuccugagaucauuguagauucccaugcaguugugacauguacccuuagcccagucucccccagggguaacacagccaggaugccaaaaccaacacaguccacuggcauccucacuuccacuuguauuccuguguguauauuuuucuguuccauuuuaucacgacuccguucacggaccuaccaccacagccaaggugagagacgguuccacccgcaugggcccuucguguugccuuuauaaucuugccuccagccuuccacacucccaccucaguaccuggaaagcccuggucugggauuucugcgcaguagugucuuagugggcagaaugcuugcugagcauccugggggaaggugggagaugcccugguggcugcaggguggaguugucaaggcgacagggcuuaggaaagagcagcacucagaccucaaggggugugugaucugugcccagauggggaacugauagcuugguguggcugggagccugccagccccuuccccuccuuccagucagggcugggguggaaaguaaccuauguaucccuccugcauggugugcuggggucacacgcauguguguuccagacuguccagagagcucgcagcaucugucuuauugugugagguucuggcaaaaugucaguguucugagagcaggagcuggcagcugggcugggaggucauuuggauguuguggccgaggacagcaugugcccuuggcagcaggccagaugcauggggagcagcaccuucuguucugcccaugaagagggugcuuuccggagcaccaggccccgaggaauuucaugguggccagagcgggcccugugguggagagggacugugguggggguggcccucguagguuucccuagagcugggucuggagggugagagugggcaggugcauacggugagcugguuucaggcagagggcucagcaagugcgaaggcccuagaugggguuugcuggaaggcagggugggaucggcaggagauggggccagcagaaggccuuggggcuucuuccugagggacauggaagcugcuggaggguuggagcaggugcugauaugauuaugucagcaugaggagagcagcuggugggccuaaaggcugacacacgugucuuugcaguaccugcuccacuaccugguuucccuccagaacuggcugaaccgccacagcuggcagcggaccccuguugccgucaccgccugggcccugcugcgggacagcuaccauggggcgcugugccuccgcuuccaggcccagcacaucgccguggcggugcucuaccuggcccugcaggucuacggaguugaggugcccgccgaggucgaggcugagaagccgugguggcaggugagguggcugcuuggcacacuggacgugcccccuuucccucuggaagucucuguauugcagugcucaccaaauucuauuaauuauccaugaagaaagauacgggcugcuggggaacauggaagcucgaaaguacccuguugcgauggccugggacaggcucucccccucggcacaguugccauuuaggggucccggaugucgaacaggagugcuggccuccaccgacgucgccggugucccgggaggaggguugccccagcggagaaccgcuuuuacugaauugagugggaacuugacugugaucacagguuacuaaaccuggcuucccaucagaaacaucuggggugcuuuauggagagggcuggauggcuagguaggugacagcuagcuggcuaguugacagacaccuggauggauaggggagagagcugaugggcaggguggcgggugauugauagguauuaauagguagaucauggaggguagaugguggaacucuguaggccugugcauaggacagcuuuccagguggcuggugcuguucugcauagagguagcccugccucucuucccuggcccgugugccuuguggaagaccacagcauuugcugauuuuugcguguuuauuguguaaucucguauccccagucagcugugagugccugaggcugggcaucucuuccccagucucccgcgccucccuggcaccaaagcgggugcucaugugucuuugaacccaugcacccauguucccagucucaagccggaagcacccuguccccaaggcagugugcagguggugcagggccaucuguguagacaguguugccccacgcucgggcugcucagggacuuucacauaauguggcugccucgugcucaggguuggacucuggggggggcaaacacccucuggggacaucugguggguguggcccuggcccugggcugccuggcuaugcugcaucugucuuccuuucugcucugucuucugcgcuugcucguaaaccucaccugguguggcaguaccaccugcgucccaugcucagccccucccagaggagugcgagcccagguaacccugcacagccaggaagcagcucuaccagcaaguuguuugcuggcggcccagacucacccagucaucguucagacugggaagaaguuacccuuugugggguguggaacuucuguucagccagcucuucuuaaaggcucugcuaaacuugaccugaccuuugccucccagcucggggcugugcaccagaagcuuccggaauccaggugccuccugugggcuggcggggugcgagggccugaucccccaugaugagugagauccugggaggccucacccacccgggugcugcagagcucacggccuggcuuuugaaacccuuucuuccuugugugcucucggcugccacuucuuacggugacuccugucacuuaucugccacgggcucagcauggcagcuugaugugcuucccuggagaagccugccugcacucugacuugccagaugagcagggacaguagcggggucagaaaugaugcaggucgucacgcaaugcugcugaaacuuccacguccagagccacaccgagugcccuccauccccuuguuccugagcagaaggagaaccugccucuuuccagccacugcugcuuuuugucuuauaagcagauggacugcccucaaaaaggcagaguccccagaggccagcagugucuccuccuaggacuugggucugugucucuucugcugucaggugccccaggguugccaccuguucuggacuguuacauuuaauuguggugacauagacaucaccuaaauuguaccacguucaccauuuuuaagugugcggcccagggacggaagcacauucacggugcugugcagccaucaccaccauccagccgcagaaauuguucaucuucccaaacugaagcucuggccccguucaaccccaacuccccacccccaagcuccuggcacccaaccuuccacuguccucuacagaguucacggcucuccuuugaggccccucacaggaguggaauccuacagugcgggccuuucugugacuggcuucuuuugcugagcacaauguuggagcccccgucucagaauguccuuucuuuugauggcugaaucauauuucauggccugcauggaccauaugauauuaacauauucauccaucgauggaugcaggcugcuuccacguuuuggccuugcuuuuuuuuuuuuuuuuuuuuuuuuuuaauagagacagagucucacucuauugcccaggcuggaguacaguggcgcaaucucagcuuacuacagccuccaccuccuugguucaagugauuguccugccucagucuccuaaguaacugggauuacaagugccugccaccacaccuggcuaauuuuuguauuuuuaguagagacgggguuucaccauguuggccaggcugaucuugaacucgugaccuccagugauccacccgccucggccucccaaagugcugggauuacaagcgugagccacuaugcccagccccugaauguuuuuuaaugauugcuucugagcuuggggucuccaggagcacacaggucauggaccccagcaagcaagugugcauuucugaaguauuuguuuuucacccagagcccaggguaagacagcuaugcuuccugagucaggacuuggagggcguccaggucaccaucuccuaccugagguuguaggccacagaggaaccuaggguucuuugggagcauucagcagggguggacguagguccaguucuugccuugacuuggcccaaggccuugaucugauugguacauugguuccccaggcagcaagcucuggcacaggguggcuacagacgcagcaucugaccaaggucuugcugcuuuacuuacuauuucccuuaucauuggggaucccgaagagcacccuggggcucagugcugugccgggagggcucggaacucagaaaagcugucacacucccaguuccgguuuauuacaaggaaaggacacagguuaccgugagcgaaggcucagggcgcacagggcgggcuccaggagagaccaggcgugagcuucagcggcuccucgcccaggggaguugugcagacggcaccuguuucuuucggcaacagugugggacagcgagcacggagucacaaccgggaagcucaucccagccauggcggccaggguuuccgugggagguggugggcugcaugggcauggagcgccugcguggccaacccuggucacuugggcugcagccaccagagaucuggcugggacucuguggcccaaggcccucaccauaaaugaugugguuagcacagaccgccuggcaguccaguaaaccaagacgcucacacggggcaggauuuucuaggggccuagagguuauccuccaggagccaggcagaggccagaccugccuuuggaagguacaggguguggaccccagccuguggcguggcccugggcugcaacccuccugccaugggccccgaggauguccuucgccgucuugcgagugcuccugcacguggcgguccggacuguggaguggguccacaugcuccccaggggcuggguuaggguaggcgugggguccggguacuuagccugccuguggcugcacagggacugccacccucuccucuugccaguguccgcagagacccuggaccugagggagucccgggcaggaggcaggagccugugcucuggacccagcuguguuaccaauucccuguaugacguuggacagguccccuccucucugagucagaagaucaccaaggccuguuccaucuggaauguucucggccuuguaaaguguuuggccucaacgggcuggaauuaaacuggcuuugcaggagagcuacugucuuccuacauagccaagucccugugccccuccccugcccaugaaaugugauucucugcuuagugacaggugccuuguuuaacauagagggagucuaacuggaaccuguuuuccuucuucuuucuagguguuuaaugacgaccuuaccaagccaaucauugauaauauugugucugaucucauucagauuuauaccauggacacagagauccccuaagguccuggcccaggccugcccaaagagaagcccaggauggucggcugccuggggacauugucaccacgucgccaugacggcugguccccacaggaccagcugggaggacugguugugcugcuggagaagggcuggagaaggcaauggcaugcugccgcuuugccagucccuagaagucgcggugcaggugauggugggagccgcgccuccagcgggcaggccgggaguguacugugugcagcugacccaaggcagccacaucugcguuuguccuuugagaggacuuugacuacaauacaggcaugacaucaaugaaaggaaagucaugaaaucgaugagacugaaucccuacggauuucuuaaaagccagauuuguagggagaaugaaugugcaacguggcugaaaucuauuuuguguaauaaaaggugauacaagucaa

SEQ ID NO: 192276 - RNA, 282751 nt, Homo sapiens
aaucucuagcucgcucgcgcucccucuccccgggccguggaaaggaucccacuuccgguggggugucauggcggcgucucggacugugauggcuguggggagacggcgcuaguggggagagcgaccaagaggcccccuccccuccccggguccccuuccccuaucccccuccccccagccuccuugccaacgcccccuuucccucucccccucccgcucggcgcugaccccccauccccacccccgugggaacacugggagccugcacuccacagacccucuccuugccucuucccucaccucagccuccgcuccccgcccucuucccggcccagggcgccggcccacccuucccuccgccgccccccggccgcggggaggacauggccgcgcacaggccgguggaauggguccaggccguggucagccgcuucgacgagcagguaaccggcccguggcgggcgggaggugggagcggaguggggguggggacagaguaggugaggggagguaggagcggccgccucccccgcggcugccucaggcucuggaggaaaggaagggaagggaagagaagggaaggggggauaaguggggguggccaaggcgggaggugagggguaggaggggacagcugggagcuugggcacccuuucccuccuaagucgggggguggggccuugucccugaccagccuccgacccuccauccccuuuaucccagcccuuccgcuuggaaauggggaugagugaccugggggcgccuuuaggggcgcgccaucuggauuuaauaauuacccccuuacuuuuguuuuugagcagagguggguaacguuuagggguucucucuuccucuucccuccgugacccuccuaacuggggacgagcgaacccuaaggccugucuuauauacccucaauaggagaacgauaacauuccgccccucccccaguuucuucagcuuccucuccuggagggggaagagcagaagaaagcaaggaaggcacagguuuucuuacuuucugcuccaucgucucauccugccccgagagcuucaagugcacacucacugcacaucuuugugaugcccuacaacgucgucccccauauccugaugacacagacugccuuuuuuuuuuauugccguuugcaguggaaaccgugguucugaaauaucuuccccuuccuugauaauugcagucucuuccccccccccuuuuuuuuuugccagcggucugaggaugugaugcauucucgagugagaauguuggggaguaaaggggagaagggugaaaggaaagugagaaacugcuucagagccaccgacaacagagcaaagccagcugggaugugguccuggagcggaucauucugcuaguguuugugguuguuuuugacucucuccugguugacaagagaacuuucauugagaauauuugggaugaaaaaaaaguuuuguagcuugaggaggugacuuuuuaucgccugaguuucacacaauaaauccuggggcugauuagaauaaaugcacacauagccuuuugucaguggaaauugguuuaacuuuguguugcuguagguaguuggggaugguuuaagggaugcuuucugcagcugugggugcagugggcuuccugugaugggggaauuguuuaagauugagucaaccuauuuuguuuacuggauauaaugguaaaacauuaugggagcugaaggggugggggaagagcucuucuguuauuugaugcauaaacauuucuuuacgggacucagcguuucagaccuaccuggaaaauaucuuggaauagacagaggaaguugagaagaagcuauguagauaaaauagaguuaugaagcugucagagacuugaaggaauuguuuuauccauucguaugcuuccagacccaaaggcaucuaaacuaaacuacuaauccaucugaaguauaauguuacugcauauaaaagauuacauuauugauagagcguuagauuuaaaacuugguagaaaagacucuguaauuuuaagaaaggauuuaaaaggcacauagaagacuuccaaagcugaaccuuguggacagcagaaucuggauguaggaaauugaaggauccacgccgcaauucuccuuaaauuuuaaaaauuaaaaauuuuuuucaguuuuuucuuaauuuuauuuuuuuacuucuuaccuguucaucucuaggcuuauuugccauauuggaaaaagauacuuaagagaggaaugauuuugggcugggcgcgguggcucacgccuguaaucccagcacuuugggaugccaaggcagguggaucaccugaggucaggaguuugagaccagccugaccaacauggagaaaccucgucucuacuaaaaauacaaaaauuagcugggcaugguggcgggcgccuguaaucccagcuacucgggaggcugaggcaggagaauugcuugaauccgggagguggagguugcagugagcugagaucacaccacugcacucuagccugggcgacagagcgagacucuugucuccaaaaaaaaaaaaaaaaaaaaaggaggaaugauuuugauuauauacccaguaaagcaagaaaguguuucuccuucugucccuagcuuuaaaagaccuuaaggcuucguuguuuguuaugcauauuguggaaucaaacucaccaccaucuguuaaaaauuaaggacauuaguuuuuaaaacagcauuuuucugcauuccuuauguuguaauuaagagaaagauauauaggagagauuauuccucacuuuuuuuuuuugagacaaggucuugcucugucgcccacgcuggagugcaguagcuugaugucgguucauugcaaccccugcuucccacauucacgugauucuccugcuucagucucccaaguagcugggauuacaggugugcaccaucgugccuggcuaauuuuuguauuuuuaguagagacggggguuucaccauguuggucaggcuggucuugaacuccugaccucaggugaucugccccccacccccugcucggccucccgaagugcugggauuacaggcaugagccacugugccuggccuauuccucacauuuuucucuuagaaaguuaaagucucugaccuugagauacaaaaauguaaggguuuucaguguuuaacauaagguacuuauauauauuauauauaguauauauauaaaauaaauuaauauauuaauuuauuauauaagugauaaauguuuaauucaaauuagaguucaccuuacgguugaaaaugucuuuuagucagaaaacugaggcaugggaagguuaagugacauagaucuaauaagagcuucaguaugaaaaguagugaaugcuugaccaucagggagauacuuuuccuaaguaucccauaaaauuuguucuaauccauuaaauauauuuagaagacuuuauuuuauuuuuuuuauuuuugagacggaguuucaugauucuugccuaggcuggagugcaaugaugcgaccuuggcuuacugcaaccucugccuccuggguucaagugauucuccugccucagccucccaaguggcugggauuacaggcgccugccaccacuccuggauaacauuuguuauuuuuaguagagugcugagauuacaggcgugagccaucgcuuacauuuuuauugaggggagaaaaagcccugcauguacugagagauaguuguauaagaaucuuaagaguuggccgggcgcggcggcucacgccugugaucccagcacuuugggaggccgaggcgggccgaucaugaggucaggagaucgagaccauccuggcuaacacagugaaaccccaucucuacuaaaaauacaaaaauuagcugggugugguggugggugccuguagucccagcuacuugggaggcugaggcaggagaauggccugaaccugggagguggagcuugcggugagccgagauugcgccacugcacuccagccugggugacagagcgagacuccaucucagaaaaaaaaaaaaaaaaaaagaaucuuaauaguuucaacuguuuauaaaacuuuugaauuuuggauuauauuaucuguacuuugcuuuacugggcccagggggaguuaagcuuuccuucuuauuacagcuaagaguuugccuguuggaccacuuaacgcccccagggagcaugugcaugucuaaagauggcaacucuguuuaugauugcuguuuugguuggauuucuaauauucggugugauuaaagcagaaaugcauuucuagccacugcugauuacagacauauugcacucugauggguaucgcuuagcaacuuagugcaguagacucaguuaaaagaaguggaugugugccauauugacauuuugagcucacauucuuguggguaauauaaaauuccuuaaccugauaauauugcagcuaaaccuaguauuuagggucuaaguugaaugaguauuaccaauuuuagaaguaaucaccuccuugguuagggaaaugacaguugcacagguggacagccagaaagcugaauguuaucaguuaaaucuuacaucucuccuuaaccugccuucguggugccaaauagcaaguuucuaauugaaacugacaaauuguagguguguagcuuuuuuuuuuuuuuuuuugagacagaguuucgcucuugucuccuaggcuggagugcaauggggagaucucagcauacugcaaccucugccuccuggguucaagccauucuccugccucagccucccaaguagcugggauuacaggcgcccaccaccacgccugccuaauuuuuguauuuuuaguagagacggggguuucaccguguuggccaggcuggucuccaacuccuggcuucaggugauccaccugccuuggccucccaaagugcugggauuacaggcgugagccaccacgcccggccauguguagcuuuuaauugugguucauuaacccaguuucuaagcaaauuagaaccuucuguguaucuccccuaguucuguaugccccacugguuccuguagagcuuuauuucugaagggaaguaugggaaaacuauggauauuugaacuaaaaaaaaaaaaaaaagaauuaaaaagaacuccaucccaaaaugauuuguuguaaauauguucauuuaaagcaauuauauuuuccauaucugaucaagcaaaaguaguacauaaaagccaaaaaacccaauuuaaagaauauguuauggaauaaacucugauuuuagagguuguaguagcauauuuguuguucucauacauugaguguucaucugaauguacguugaauaugcggugagugauucacaguauaaaaugauuggcaaguaucuucgaaauuacaaaccacauacugauuagacaaauagauuugcaaaacugaagcuuuuuggauuuaaaaaauaucuccuagccucauucuucaagccugguguguaauuuuuauaaggccuuauaguaguugaaaaugaguacucuuuuauggugacgaauucuuuauggugagugagaaauaaugcuuauucuuccaauuuuaguauauguggugcugaaucgagcacaauaaugcuuauucuuugcuucggaauuuuuuaauuuauuauuauuguuauuuuaaauuuuuauuuauuuauuuauuuugagauggagucucacucugucgcccaggcuggagugcaguggcgcgaucucagcucacugcaacgucugccuccuggguucaagcgauucuccugccucagccucccaaguagcugggacuacaggcgcaugccaccacgcccagcuaauuuuguauuuuuaguagagacaggguuucaccgugcuagccaggaugggucugaauuucuugaugucgugauccaccugccuugacuucccaaagugcugggauuacaggcaugagccaccgugcccggcccggaauucauccuuuagaaagauuucuuccagcuguuccucaguucucugcacucccuuacacuuuccaccuuaucugucugggaacuaauuuagucuuuauguuggcugcuuucuuuucacuuuucaggcuaagauuuccuuucucuuggaaaucagacguuuacuugguccugcagcucucucucuguggaccagucuuuuuuguuguuguuguugccagauacucaccgccucuacuguuuauccacccauuuccuuuauaacucugaaaaguagcuccugccucugcuugauugcuguuuucuugaaagugauuacuucuggcaaaacauaguggucauugcuuaguuguaaugccacugugauguuccacuccccccggaaaccaaucucuuccaguucccaagacacaauacuuuucuacugaauuggaguuccuuagcgggggucuuaguuuuguucugcuauucagugccuuugucccuauccuagccauuagcuuuccuauagauccuugauuuccucaucuguugaaaaagaaauggcuagaaaaucuuuuagauucuuucaaguuuaaauauucgaugauuuuaauauucuaacagcaugucucugugacccagcagucuauugggagcugaccccacuugauuuaccaaacucuuucccauuaugccucugcaugcaccuauguuccaggcaggucaccucagucucuucuguguguaucaugcuucuucccacuucuuggccuuuauuucugccagucucugccugaaugcuuuaauuccuccuuugugcuuuucuaauuccuguccauccuucaauguucagcucagauuucauuuuuuuuuuuuccccaugagguuguuucagacuaaacucugcuaucucacuucuugguauccuuguuaccuggaguuuuacagaaccacacaguaaguuuucuuccuuuaggaggauuguuugaacacagcuuggcuuuguuuucuuuuuuucuugucuuuuuaucaaauggagugcauacuuucugaaaagcaaagaacgcuauuugaauucucuucuagucaccccagugcccagcacagucuuaaacacacagaacauugauggaauguuuuucauaugauuccugguugaaggguagacuggcuaaauaaaaaaagugguacuuuuggcuuuguuuuacugaauuuuacuuccauguuugcaauagccuaggucugauaagugauauuuuaacuaggaaugaguaagaaaauuagcauaaagaaggaauuuauacauauuuauauuuccucccauagagcaaacauguuuuuugaaucagguuucagaucugaucaacuacuuuuguaauuuuggauuugucacuuacuguuaggauauuuugcaauggugugauagaauaugaaugugaagcacuuugaaaagucuaaaauuuuucuaauauaagauuuauauguuuucuuuauagcuuauuauuauuauuauuuuuugugugugugacagagucuugcucugucacucaggcuagagugcaguguagcuuauuacugauuauuguguuuucauuaaauaagggagaguaggccaggugcgguagcugaugcuuguaaucccagcacuuugggaggcccaugugggaggacugcuugaggccuugaauucaagaccaggcugugcaacauagugagaugcugucucuaaaaaaaauuaguugggugugguggcaugugccuguagucgcagcuacucaggaggcugaggcaggaagaucacuugaacccaggaguucaagcauacagugagccaugauugugccacuguacuccagcuucggugacagagugagacccugucuuccaaaaaaaaaaaaagagagcgugacuagucucuggauauuccuuuguauguaccuuggccaauauauaccuuacuuuaguauccauugacaaguucucuuuuuucuucuucuucauuuuuuuuuuuuugagauagagucucgcucuauugcccagguuggagugcaguggcacgaucucagcucacugcaagcuccaccuucuggguucaagcgauucuccugccucagccucccaaguagcuggcauuacaggcacguacuaccacaccuggcuaauuuuuguauuuuuaaaagagacaaggguucgccauguuagcuggucucaaacuacugaccucaaacaauccaccugccucagccucccaaagugcugggauuauaggcauaagcuguggugcuggucuaauauuguuacauuuuauuuuaaauguuccuguuuuuugcccuacucuuuuuauuugacuuuuuaaccauuaggaaauuagauucuuuucucaaaucugcuuuauuauuauuauuauuuugagacaaguucucgcuuucucgccuaggcuggaguguagugguacaauuuuggcucacugcaaccucugccucccggguucaagugauucuccugccucagccucccaaguagcugggauuacaggcgugugccaccacacccagcuaauuuuuuuguauuuuuaguagaggcaggguuuuaccauguuggcuaggcuggucuugaacuccugaccugaggugauccgcccgcuucagccucccaaagugcugggaucacaggcuugaaccaccgugccuggcccuauuuuuguauuuuuacuauagacgggguuuugccauguuggccaggcuggccucaaacaccugccucagccucccaaagugcugggauuacagaugcaagccacugcaccuggccuuaagucugcuuuuaaaaaauguuuuggcugggugcgguggcucaugccuauaauucaagcuuuuuggggggcugaggugggaggaucacuugggccucagaguuugagaccagccugggcaacagagugagaccccaucucuacaaaaaguaaaaaaaacaaauaaaaaaaaaaucagccagugugcauugguugaaaguaaagaaaagaaaaaaaacagacaaauuagccaagugugguaguauaugcuacuugggaggcugagucaggauugcuugagcccaggaaauuaaggcugcagugaggcaugauugcaccacugcacucuggccugggugagacccugucucaaaaaaaauuuuuuuuuuuaauauggagaaaguauuuuuguuuuucguuuuuuauuuggguaccggccacugcacccaaccaaacauuuuguccuuaaacaaaaguuuaagucauauaauacaguaguaagaaugccuuauuuuuuacaucuuuguucuuuaaauuacucagauugcuauggggcauuuuuguuguagcuuucaaauuugguauucugggguucuauguagacucuauauuguugcauucuaacgacauacuuuuaaggauaagcagcguauuaauuaaaaauguguuuuccacuuguguuccuuaggucugcguauauuuuggagguguguguguauauaagucaagggacaggagguaucggaaggcucuaaaggaaguuuaaggaggagaauauucuauagaaguggaaggggagauuuguggucagcuuaaacuguuaaaaggcuugggaucaauaccgaagcagaauaugagcaucuuaaucuguuucuuugcaaaggauugacuuguauuuauaaaagcauuggcuuguuucaucugacaucuuuuaaaguaccccauuuucuugggggcgggaagggagagaugagaccauuuguuuugaucuugaaggacagaaaagugguuuuacguuguagugacugugaauuaaguuuaaggucucagcaaguuguaaauuucuguaucauacuaugugguagagccuucaguaaacagaguacucucagguguuuaaugcuauaggauauaaacuauaacugcuguuuauaguacccucgcuaaauucucuuaaaggcaauccauuugaccacuucaaauguuauaugccugugauauauaguuauauucucugcauauaacugguuuuuaaaaauuguuuauuauucauuuauuuuagaagugaggucucucuuuguuccucaggcuggagugcaguggugugaucauagcucaccauagccucgaacuccugggcucaagugaucucccaccucccgaauaucuaggacuaugggcgugcgccaccauaccuggcuauuauuuuaauuuuuuucguagagacagugucuuguuauguugcccaggcuggucucaaacucuuggccucaagcagucuucccaccuggcuucccaaagcacuggaauuacaggcgugaacuacugugcuggguccugaguggcuuuugagccacugacuauaucaucaaaaagcuucuguugagacaaagccucaagcuaguguggaguucauccuacuaaaaugaagaauuggcauuauguucuaaaacuuuacauauucuuaccauaaaugguacuaauuacuuugcaguagcaguaacuugaggugcaaacuuccagauugcauauuuucuuuaaaccauagucuggcacucacgguuuggcuuaggguugccacugcaguccacaagcugucgccugcccuuauucauauuuuauagcuuugaaugucuuauuccauugaacuucagauaacuuuuuuuuuuugagauggaguuuugcucuuguugcccaggcuggagugcaauguugugaucugggcucacugcaaccucugccucccaggcucaagcgauuuuccugccucagccucccaaguagcugggaugacaggcaugcgccaccaugcccagcugauuuuguuuuuuuaguagagacaggguuucaccauguuggucaggcuagucuugaacucccaaccucaggugauccuccugccuuggccucccaaagugcugggauuacaggcaugagccaccgugcccggcugagaacuuaacuuuuucugaugaaauucuuuccugcuccaccuaacucccgugucccacccccaccagcagagugguauaucuagcacaagaggcaugaaauuaauuuaguaaauagcaggacuacuagaaacuuuuaaggauuauuuaacuuauuuuuaaucaaaauuuuauacucagauaaugaccuuuugggaaguuaugucucuuaaugaucucaaguggugacacuuuucuguugacacgguuucucuuggguaguucucauaguaguuugggcaugagaaaacaacuuuuaccacuuuagacuugugagggcagccuacuauguaguaaaagaaaaagcuuuugauugugcaacuugcaguguggucuuggggaagucucuuaaccucucugaacaucaguuuucuauauuuucauguguaaaaugggcaugauacuuacccuucucacaucaugggcuuguuuaaugacuuagguaugaaucuuauaugaaaggaagcuguaaacagucauaaaaauguauuagcaucugugcaguauuuuuuuucuauccauucuuuauaauuuggugguuauuauuucuacucuacaugagaaaaaaguuacagaggcaaaacauguucacaaucauaugauuauauaauuaacugaguuaaacuagaguauggaugucuugacccuuagaucacuaucuuuccaauaaauaguuuuaaaagucuaaauuuuacuaacagguaguacaaauaugcaaaaugagggauguaugauugcuucuucacucgaagaugguauauuauguuuuuccuuuuaaguucauguuagaguaucugaaucuuuucaaguugguuagauguuagaaauagauguaaauuuuaagcauuauauauccuugauuucauuauguauuauucuccuggucacuuuaucaaaacuucuucagcuguuagaaguuguaacauuguuucccuuuuauuuaguuauauaauacacuuauuguacauucuuaagugggagaauagaauuugugagaauaccaacagaaauacacauacagcuauaaauaugagauuaugauucuuucauguuggcauugcacagucuauuuuuguaaaguugguuuuuauauucuaagaacauuuuacuuagaguuugauuacauuugaggcaaacuuuucaacuuugguaguauuugaaugaagauuccuggaugugguuuuuuuaauuguuacaucuacuuuuucaguuuuucuuuuucccuauaacaacccucaaauccuucaucuugucuuuuggaguauuuuuuucuauccuccugucuuuaucggugccuucuauuccugucccaccuugggucugggaaaaugugccuuuaugcuccaugugagucuucuuccuuuuggguaaugagugcggagggaaaaaaagcacaguauuucuuucccuguuauguuucaguuuuuggccucugauaagugaaucuggaguagggaaugacagugauaguagguuuuguuuuagucauauauuggcgacaaagaucaacgaagaccugaagcucuuguuccucucaugacacaaacuacccacaggugcaugccaccaugccgggcuaguuuuuaaauuuuuuguagagacgagguuucgccaucuugcccaggcuggucuugaauuccuggacucaagcgaucuucccacuucggccucccagagugcugggauuacaggcaugagccaccgugcccaaccgagauucugucucugaaaaaauaaauaaauaaauaaaauaaauacauaaaaauaaaauaaaaacauuugaagacaucuuaaguacacccuagauucccacccccaccaaaaaauuucauucauucuucaaccauuucucaaagaacauguuuucaagacaccucacuauccuaauuguuuuccuuuuggugcaaugguggucaguacucaggcauaccauuuuuuaucuuuccucccaauguuguaugagggcauuauaugaaacuuaaauggauuuaaaaaugcugagcuugcuggacaugguggcucacaccuguaaucccagcacuuugggaggugggggagggaggauugcuugagcccaggaguuugagaucaaccuggacaacacagcuaguaugcacaaaaaaauaaaaaaaguagcuaggcgugguggugcaugccuguagucccagguacuugggaggcugaggugggaggauggcuugagcccaggagguugagccugcagugagugguguuugugcuacuacacuccagcaugggugacagagugaaacucuguuaaaaaaaaaaaaaugcugagcuucagguacaguauauuuuugguaugcauuugauuaccaguacaguauaccuaucaaaaauguuaauucacauguuuuaaaauaaaaaguuuccaacauaaaaguagagaguuuuuuuuuuuuuuuuuuuuuuuuuuuucugagacagagucucacucuauuacccaggcuggaguguaauggcacgaucuuggcucacugcaaccucugccucccaggcucaagccauccucucucucagccucccgaguagcugagaucacaggugcacaccaccacgccuggcuaaauuuuuuguauuuuuuguagagacaggguuuugucauauugugcagguuggucucgaacuccugaccucaagugauccacccgccucagucucccaaagugcugggauuacaggcgugagccacugcacauggccuagagagauguuauaaauuaauccuuuuguauccauuacucaauuucucccuagucuuauuucauccguauuccuacccauuuccugcucacuaccucuuuauuauuuuaaagcaauccuauauaucauuucagcgugauuuauucuuauacugacuuuaagagcuguguaauauaaaaacaacucaauuaggaaucagaagacuugacuuuaagucuuaacuuucuacuggaaugaguuaacaggggggcaagccaagcuguaugagcccugaauuccuaauauguugaagagaguaacacgugguggaggggacauaauguuaccugcacuuuuucacagggaucuaugagaaucaaagauaggagguaauaugcaugaaaguauuuugucuacucuaaacucaaaagcaaaagugcuuuacaaagguaagauuuuauuaguaaaugcugcuucccuguauaagugcuaacaacucaugccuaaucagucuuagaauuaucuggaugcugacauuaaauuaaguccauaguauuaaaaucacccuuucaccuuuacccacucuuggauuuugacaauugcaacaacauuuucucauucccaaucuggcuccuguuacuuuucaugacuucugcaaguucacugaccacauuucucuuaccauauuucuaaauuuucaucuguaucuuggauucauguacacuugagcucagguaaaacagggaggugggcucuucaugcuuuauguaucuaaguucugaugacucucagcaaugcuuuuuuucagauuugaagaucauuuucuuuuuuuucuuuuucuuuuuuuuuucuuuuuugagucacugucacccaggcuggagugcaauggcgcgaucucggcucacugcaaccuccgccucccagguucaaacgauucuugugucucagucuuucgaguagcugggauuacaggcaccugucacgaugcccggcuaauuuuuguauuuuuaauagagaagguguuucacuguguuguccaggcuggucucgagcucguaaccucaggugauccucuugccucggccucccaaagugcuaggauuacaggcgugagccaccaugccuuggccucauuuuauuuucaacuagaacaauuagaaauaaaaauugaguugaauaguucugcuuuuaaugaccuauuggugcuggaaucauggacucuagugauucuuguucuucuuuccucaucuuuuugauccuaauguauuuuaaaagccuuuacauauuuuugucuuuaacauuucuaguuauucugaacuuuuguuuuaacucuucuguuaauuuauccauuguguguaguguguauuuuuucuuaaauguccuuauaaauacugagcugugggggaggggagaggaggagcaacuggugcaggcacgcuaguuucuuuagaaaugucagcucugccagaucacuuaagacuuguuaaaaguacagauuuccuggcucuacuaaacaucgugugauuucuagaggucccaggucauuuuugacauaaagcuggguuuguaaaccacugcugugugauauacagggagaauuuaauuucugggugguauuuaauaggucacaguacagucauauauaucacugcaacaaguuagaaaaccacaauuggaugaacuuuaaaaaucaauacuaaaaaaaauauuggagagcuauggauguaaugaggacuagaugaauuagaauuccagaaauagaagagaucuuuauaggugagcagaggauugcugacauuugcugauucuggacacacacugaaggaaaaggaaacuagagaggaagugcauuuuacuaaaacugcaacauaucccuggcccaguucaauuccugauuggacugaggugaucagccuaucuuaucccuuuugccuaauagaggaaauagacagcucuuacugaggagauauauucugggguuucuaugguucuuucguuuauaauacuaucauacuauuaacuauucuagagaugugaaaggguggaaaaauucaagagaaaaauaaaacuuauagaagcagacucagaaaauugaaguucaucagacaaagacuuauuuuaaaauaacuauaauauacuuaagaaaauaaaggaaaauacggagaaaauggaugaaaauuuucauagagaauuggaauccacagaaagaaaccaaaugaacauucuaggaaucaaaaacacaacguugguugcuuaaggucuuuauuuguaguuuaauuagaaacuuuggcgcaggacucuaggacacuccaccucccccucauucuuuacuguucuuaaaaaacaaaaacaaaaacaaaaaaaacccagguaaauuuaauguauacuauuuaaguuccacgagagcagggccuaugucuguuuuguucguuguuguacucccagggcuuaguauagugcaugccacauuaaaaaacaaaacaagacagaacaaaaucuuccuuaacaccaccaucacaaacccccccauuaauaauuaauugacauuaaucugaaauuaauuauucauuguaccgguucaguagcagacuauacacagcagaaggcaagacuagagagcuuguggacagaucaauagaaaauaucuagauaaaagcacagaaaaaaaaaaaagaauggaaagaguagaacagagccucugagacauguggaacauuaguaaaaagucuaauguguaauuggagacccaaaaguagagagauuagcauggaagcaaauacuugaagagguaaugauaaaauauuuucccaaacugaugaaaggcaucaaccuauaaauucaaguaguuuagcaaaccccaagcaggaugaacacaaagaaaacuacacuuagcauaucuuaauggaacuguugaaaaccagaaacaaagagaaacgcuuaaaagcagccagaagaggggaaaaaaggcacuguguucaaaggaacgauauaauacaacugauggcugacuuuuuaauacaacuguggaaacugggaaauaacagacauuuuuuaaauguuggcaaaaaaaccugccaagcuagaauucuaccuucagcagaaauauccuucagacaagaaggcgaaauaaagacauuuuuagacaaucaaaagcugacaauuuaugaccagcagaccugcacuguaagauuacugaaggaaguuuuuuaggcagaaugaaaauaucucaaauggaaguacaaaacuguaggaaauaaugaagagcacacacucggguaagugugugaguaaauagacaagaccuauugccucuuguuuuuauugcuguuuuuaggaacuuuauugcuuuuugcuauucuagaauaauagaauuuccacagcuuuuagguuaagguaaaauugccauccaaucaauaaacugcacauauuuaaaauguauaauuugaugaguuuugauauacauauaagccuuugauaccaucaccacaaucaagaugaagaacauauauuaccggcaaaaguuuucuccagccuccuuauaauccauuccuaccuccaucccaucccuagggaacccuugagcuguuuuugucucaguggauauaucauaaguuguuuauccauucacuuguugauggauaacugaagacaacucaaauuuucaccauuacaaauaaaguugucuugaagauucauauacaugacugucauuucucuugaguaaauacaaaggaguagaaauggguggaucauaugguggauguauauaauaauguuacaggauauuauauucuguaauauuuuaagaggccaccaagcuguuccuaaagugauuguaucaucuuacagcaguauaugagaguuucaguuguuccacaucuuugccaacacuuauuuaaccuuuucuuuuaaauuacagccauccuaguggguaugaaguggugucucauugugguuuugauuugcauuucccuaaugacucaugauauugagcaucuuuucaugugcuuauuuaccaucugaauauuuucuuuggugagcuguuuaucucuuuugcccauuuuuaaaaaauuggguuuuacuggaguuuucagaauucauaauauaugcugaauacaaguucaucagauaaaugauuugcaagucuucuaguuuuuccuuguuuuuuuguucucaaagucuuucaaaagcagauguucuuaauuuuucugaaguccaccuuaucaauuaaaaaauagaucauguuauugguauaucuaagguaucuuuuucuaauauaaggucacaaauuuuucuccucuguuuucuguagaaauuuaggauuuauacuaacguuuguggcucauuuuuaguuaauuuuuguauuugugcuaugugccuguuaugccaauaccacauagucuuaacuauaaaagagcuuaacuauauaaacuauaauaaaauaucaagucagguaguauaaguccuccagcuuucuuguuucucagaauuguuuugacuagucuaggucuuuuguuauccuuguaugguuucggauuggcuugucaauuucuauuaaaaagccaguuuugauagagauucugcugaguccauggaucaacuuugggaagauugccaucuuaacagguauuguuuuuuaguuucaauuuuugauuguugcuaauauauagaaauacauggauguuuauugaucuuguuuguuuuuauuuaggccauagauuuuuuucuuuuucuuuuuaaagacagggucuugcucuguccccuaggcuucauagcucacuucagccuugaacuccugagcugaagugauucucccaagaagcuaggacuacagguacaugccaccacgcucggcucauuuucuuauuuuauagagacaggaucuugcuguguuucccaggcuggucucgagcaccuggccucaagcuguccucucgccucggcuucccaaagugcaugagucacugaacuuggccaggccguaaauuguuuugagacagggucuugcucuguugcacaggcuagagugcaguggugcaaucauggcuuacugcagccuugaccuccugggcucaagugauccuuccaccucagcuuccucaguagcugggacuguaaacacucaccacgaugccuggcuaauuuuuguagagacaggguuucaccauguuggccaggcuggucucaaacuccugaccuuaggugauccaucugccucggccucccaaaguguuugaccacucagccuuuauacagauauuucaucuucuuuacaagaagaaaaacacucuaagcucuugccuaaaaagaugaaaauguucuuuguaaaaaugaggauguccuuacccucuucccaaaaugaggagcagagucucauaauuguauugauuucugggggacauucacacuaucuauuucuaggcuguguuaauuaugccucaaauucauaguuccuucugaauauccuguuaccuagggacuaaauuguaaaguuaaccuuuaauaaaguuugaauaacauagagaagaagagggaaggaauugauuuauaaacuugcccguuucccuguaauaaggaagaaaauauguauagcugcuguagaccuugcuucuguaacugguugagagauuguaguucauauuuauaacuacuucugcuguacauuccauguuuccuuuguucucauucaagaucucagcuggugggguaaccuaaaucuucauuaauaaagaauauggcuuugggaggcugaggcggguggaucacgaggucaggagaucgagaccauccuggcuagcacagugaaaccccguuucuacuaaaaauauaaaaaauuagcugggcgugguggcggguaccuguagucccagcuacucaggaggcugaggcaggagaaucgcuucaacccaggaggcagacguggcagugagcugagaucacaccacugcacuccagccugggugacagagugagacugucucacaaaaaagaauaaaaaaaaaaaagaaaaaaagaccaugggccggacaugguggcucacgccuguaaucccagcacucuggaagcugaggugggcaggucacaaggucaggaguuugagaccagccuggccaacauaguaaaacccugucucuacuaagaauacaaauauuagcugggcgugguggcaggcgccuguaaucccagcuacuugggaggcugaggcacaagaaucacuugaacccgggagguggaaguugcagugagccaagaucacaccacugcacuccagccugggcgacagagcaagacucugucucaaaaaaagaaaaaaaagaauacaaaucuuuggugguccugcuucaugugugugcaugccuguggcugugguuuuccauuaaguuuugcucuuauauauauagguuuagaaaaacauuucagggaauccucaggguuccagacauaguccucuuuguccccauuauguagcaacaguacaguaucaccuaguaauaggacugaauuacaucagcuaauagaauaacccccuucuuugacuguugauguagugcggugguucuuaggacaguuuuaccucccaggggacauuuggcaaugccuggagacauuuuuaauuguuaugacuuucgugggggugggggaaugcuacuggcaucuaguggguagaguucagggaugcugucaggcauccugaaaugcacaggacagcccccaagaguagagacugauccaguccaaacugucaguagugcuaagauugagaaauucugauuuagugguauggaggcaguggucaugagguaguuguuacuuccaguucaguggaacuguguggaaucauucccugcuugggaaccaaggccuccaauccagcagauaucaaagucguagguacuugaaacaaaacuucugcuaauggaauuuuuaggaauaauagaggaacuacuucuacuugugccccuugauucucaggccuuuguauucuagcuauggggaaaacaauauuguauauugcucauugauccacuguaacugagugagucuucaguaguccauucuguuagaccagcugcuucugggugauggaguaugugguaagaccagugauuuccaaguuccauaacccauuccugcauaacccuuuuucugugaaaugaguaccuugaucaaagucuuguugaguaguauaccuugaugaugaacaaggugucgcccauguccuugauggugaugcuggcagaagcacuguaggcagggaaugcauauucauauucagaauauguuggugccagugaggacaaauucuuguccccuccauguauguagaguuuuuguuuuguuuucuuuuuuuaagguaugguauuauccacugucauuaauauuuuggagcauuuuacuuccacauuaaaaaagaucaaaauagguaauaauuaucugaccaagaaauguuuuaaauaaauuguagacuuaugacagcuauaucaucuaucuaaaaaccuuggaguaacuguaaaauagugacuuuugaacuguagacuuuacucaugcagauaucucacuaauuuuguugaaaucuaccagauagaaauccauuguuauggguuguaugguugaaaacuuuuuaggcugucauuuguuucaagauacagauugacucgguauacuuuaacauuucucauaguuggccaaauuuagguaaaacuauuuaauuucauugaacguuuuagggaaaaugccugaauauuaauagagauaggaugaauuaaauuaaagaacuuacccuuugaaaaauugccaggguuagcaauuuuuaugcuaacccugcauaaaaauugugcguggugguguguggagugguguauauguuucagagaaauaauauaaauguucagauaagaguaucugcguaaucuaacuaggaccugucuaaccuaccugcuuaaggauagaggaaaucuugagagacuugaaauugaagaacuuaaaauuuuaagucuucccuuucaaggcccuaucaaaacaucaugaccacaucuuugaaauaguuacuuuuaucacucaauauaguuagaaaauuuuauuuuuagaacuccaaaaucauuuuauuuuauuuuauuuauuuauuuuuuucgagacggagucuugcccugucgcccaggcuggagugcaguggcgccaucuccgcucacugcaagcuccgcaucuugguuucacaccauucuccugccucagccucccgaguagcugggacuacaggugcccgcccccaugcccagcuaauuuuuuuguauuuuuuuuuuuuuuaguagagacaggguuucgcuguguuagccaggauggucucgaucuccugaccucgugauucaccuuccucggccucccaaagugcuaggguuacaggcaugagccacugugccuggcucauuuuauuuuuauuauuauuuuuugagauggagucucacuauugcccaggcuggagugcaguggugcuauuuuggcucacugcaaccucugccuccugaguucaagcaauucuccugccucagccuuuggaguagcugguacuacaggcgugccgccacgccuggcuaaauuuuuguauuuuuaguagggaugggguuucaccauauuggccaggcuggucuugaacuccugaccucaguugauccuccugccucagccucccagagugcugggauuauaggugugagcuaccgugccugaccuccaaaaccguuuuuauuaauuauauucuuuauuaaguauauguuugauaaagacaagcauuuuuccuuuuuucacuguuacauucuuucuguuuagaauagugauuugcggccaggcgcgguggcucaugccuguaaucccagcacuuugggaggcugaggcagguggaucaugaggucaggagaucaagaccauccuggcuaacaggugaaacccugucucuacuaaaaauacaaaaaaaauuagcugggcgugguggcgggcuccuguaguccuagcuacucgggaggcugagacaggagaaugacgugaacacgggaggcggagcuugcagugagccaagacugcgccucugcacuccagccugggugacagagcaaaacuccaucucaaaaaaaaaaaaaaaaaaaaaaaaaaaaaaaggaauagugauuugcacauagaagggacucaauaaauauuuguugaaugaaugaauauaugaaauaaaaucuuccaugcucuugaagagaaguauuugucaugugacuggucuuauauggcagaaugucccuuguuuaccauuccuauucccuucuaaccaaaucaugauauguauuuuuagguauucuuuggcauuucuuuuugaacaccuggaaaaaugcuaaaauaugguuuaaaacucaauguuugugaauuaggcuguuaggugcagccugacuuaagggauaagggcugaauuauagagaaauugaauuaugcuuucaaauaugguacgcauaugaaaguaauacaugguuguuuuuuaaacuagguuaaaugugguaaaugcacucuuuuaauuuaguguuuuauuaaauuuugguauauguuguguuauaagcauaaaaguuucugaaagaauuuuugugccuagaaauugugggaauuguugcuuucuuuaacuuuugauuugaaacaaucacaaauuacacuggauucuuaaaaauguuguaggaucuuuagggagcucaacugcaguccagaugcugauuuuuuuuuuuuuuaauacuuuaaguucugggauacacgugcagaaugugcagguuuguuacauagcuauacucgugccauggugguuugcugcacccaucaaccugucgucuaccuuagguauuucuccuaaugcuaucccuccccuaaacccccaccccgcaacaggcccagugugugauguuccccucuguguguccauguguuuucauugcucaacucguacuuaugaaugagaacaugcaguguuugauuuucuguuccuguguuaguuugcugagaaugaugguuuccagcuucauccaugucccugcaaaggacaugaacucauccuuuuuuauaguugcaugguauuccaugguguguauauaccacauuuucuuuauccagucuauaauugaugggcauuuggguugguugcaagucuuugcuauugugaacagugccgcaauaaacauagguguacauguguauuuauaguagaaugauuuauaauccuuuggguauauacccaguaauuggauggcugagucaaaugguauuucuaguuguagauccuugaggaaucgccacacugucuuccacaaugguugaacuaauuuacacucccaccaacaguguaaaggcauuucuaugucucucucucuuuuuuuuuuuucuugagauggagucucacuguguugccaggcuggaguguggagugugguggcaugaucuuggcucacugcaaccuccgccugccagguucaaguaauucuccugccucagccucuccacuagcugggauuacaggugugugccaccacacccagcuaauuuuuuguaucuuuaguagagacagcguuucaccauguugggcaggauggucuugaucucuugaccuuguaaucugcccgccucggccucccaaagugcugggauuacaggugugagccaccgcgccuggccuuaagaguuccuguuucuccaccuccucuccagcaucuguuguuuccugacuuuuuaaugaucgccauucugacuggugugagaugguaucucauugugguuuugauuugcauuucucuaaugaccagugaugaugagcuuuuuuuccuguguuuuuuggcugcauaaauaucuucuuuugagaagugucuguuuauauccuucguccacuuuuugauggguuuuuuuuuuuucuuguaaauuuaaguucuuuguagauucuggauauuagcccuuggucagauggagagauugcaaaaauuuucucccauucuguagguugccuauucacucaugauaguuucuuuugcugugcagaagcucuuuaauuuaauuagaucccauuugucaauuuuggcuuuuguugucauugcuuuugguguuuuagucaugaagucuuuccccaugccuguguccugaaugguauugccuagguuuucuucuaggguuuuuaugguuuuaggucuuauguuuaagucuuuaaucaaucuugaguuaauuuuuguauaagguauaacaaaagggcccaguuucaguuuucugcauauggcuagccaguuuugccaacaucauuuauuaaauagggaauccuuuccccauugcuuguuuuugucagguuugucaaagaucagaugguuauagaugugugguguuauuucugagguaucuguucuguuccauuggucuauguaucuguuuugguuucaguaccaugcuauuuuguuuacuguagccuuguaguaugguuugaagucagguagugugaugccuccagcuuuguucuuguugcuuaggauugucuuggcucuacgggcucuuuuuugguucccuaugaaauuuaaaguaguuuuuucuaauucugcaagaaagucaaugguagcuugauggggauaguauugaaucuauaaauuacuuuguguaguacagccauuuucaugauaucgauucuuccuauucaugagcauggaauguuuuuucauuuguuuguauccucuuuuauuuccuugagcagugauuuguaguucuccuugaagagguccuucacaucccuuguaagguguauuccuaaguauuuuauucucuuuguagcaauugugaaugggaauucacucaugauuuggcuguuugucuguuauugguguauaggaaugcuugugauuuuugcacauugauuuuguauccugaaacuuugcugaaguugcuucucagcuaaaggagauuuugggcugagacgauaggguuuucuaaauauacagucaugucaucugcagacagagacaguuugacuucaucuuuuccuauucaaauacccuuuauuuuuuucucuugccugauugcccuggccagaacuuccaauacuauguuguauaggaguggugagagaaggcauccuugucuugugccgguuuucaaagggaaugcuuccaguuuuugcccauucaguaugaguauaccuauguaacaaaccugcacauucugcacauguaucccagaacuuaaaguauuuaaaaaaaaaaaaaaucagcaucuggacugcaguugagcucccuaaagauccuacaacauuuuuaagaauccaguguaauuugugauuguuucaaaucaaaaguuaaagaaagcaacaauucccacaacuucuaggcccaaaaauucuuucagaaacuuuuaugcuuauaacacaacauauaccaaaauuuaauaaaacacuaaauuaaaagagugcauuuaccacauuuaaccuaguuaaaaaaaaacacaacaaccauguauuaguuucauaugcauaccauauuugaaagcguaauucaauuucucuauaauucagcccuuaucccuuaagucaggcugcaccuaacagccuaauucacaaacauugaguuuuaaaccauauuuuagcauuuuuccagguguucaaaaagaaaugccaaagaauaccuaaaaauacauaccaugauuugguuagaagggaauaggaaugguaaacaagggacauucugccauauaagaccaguuacgugacaaauacuucucuucaagaucauggaagauuuuauuucauauauucauucauucaacaaauauuuauugagucccuucuaugugcaaaucacuauucuuuuuuuuuuuuuuuuuuuuuuugagauggaguuucgcucugucacccaggcuggagugcagaggcacaaucuuggcucacugcaagcuccgccucccguguucacgccauucuccugucucagccucccgaguagcugggacuauaggcacccagcuguggguuuguuauaaauagcucuuauuauuuugagaugcucuccaucaguaccuaguuuauugagaguuuuuaucaugaagggguguugaauuuuaucaaaggccuuuucuucaucuauugagauaaucgugugguuuuugucauugguucuguuuaugugauggauuacauuuauugauuuacauauguugagccagccuugcaucccagugaugaagcugacuugaucaugggggauaagcuuuuugguguacugcuggauucgguuugccacaauuuuauugaggauuuucacagaugcugaauuuuuuucugggaagaauuuacuuugacuuuuucauccuacaaaaauuauucugguucugaaggaugcagguguuucaauggugucccauuaauauccccaggcuuagcacaguucuugcuugguuauaauaggcaauuaaguguugaaugaaugaaagaauuuuaacuuuauucuguggguucagggagcuguugaagaguauuaagcaagugaguggcaugcucacauguucugaagaguguuuccugguagugauauagaagauggauuugaagggacaguaaaggcaagaauaauaauuaagaaauuguuauaauagggaugaucugagccaggguacucauuauaggaaauuaggggcaaccuugucaugagauuuguuuaggagaugaaauuggaaggcuucagauggaugauagggguaaggaggaaaggaggagauuuaagugaauaagaguugaggagagggaggaguuguaaaugacaaguuucuuguuuauuguuuugaauaaaggggaaaauuguuuucaguuauucauaaaggacuuaaaaaugggcuuugaucccaaaaguuguuuugaaguuauuuccugcuuuaucuuuggagacccuucuucccacccccacaucaaagcaaaugcccucaacugcuuuagaugcagucuugcauugaaauagguaucacauuguuuuauuuugcuugaaugggugcuguuggcuuaaacaucuaauugcaucugcuuugucuucuuuaguugugucuacuuaugggccaaaagagcauuucuaccucuguaauuucauuugcauauugguuuucagauaaauugaagauuaauuauaugaaguauaugguuuguaaucucaauugaaggugaauuuuuuauuuuccugguugaauauaauggaaucauuuugguauggagaagaaaugguuaaaaauagaccagugggucaucucagugugaaagucaagaggacuucuaggcuuaagccugguagcuaaauuucuguuggcucuacccucuucaugaugaguccaaguuuauuuugaucugcaucuuucuuuuuuuuaaugaaugaaauucuccuucauucagccugguaaguaaccuggccauuaguacgugacuaaauagcugaagcuucuggcuugaauuaaguuauaaacuuagcacaguggcaggugcuugaacugccauguuaaaacuagcgcauagaaucuuugccauucaaaaacuguuuucucaaucccaugaaggagaugaagccuacaugggaaucuucacugauugugcugacuuuucuucuacaauuuuuaguuuauaacauguauaguuugucaauugugcuaggauauuuuguuaauauguucuuaaaaauucaaaucccagggguaaacaucaaauaauuuaauugugccuauuugacuuuaugggagaguuaacaaccauauuuauauauaugguuaaauguguauaaucuucauucucaaucuuucagaauccuuauuuuccauuuucauuuuuagcauuagcugcauuauuucuuuauacaacuaggaaaagggauuauucagaaauuugguugauggcuuuuuauuuuguagagacagggucugucucuguuacccagccuagucucuaacuucuagucucaaguggucuuuccaccucagccuuccuaguguugggauuacaggcaugagccaccgcacuggccagauggcauuuuaaagaauaauguuaggaaaauaauuaauuuuugcaagugaagauaguugaaauguuagcuaaaaugaugaccuagaggcagcuuguuuugguaaauaucuuagucaguuuaggcugcuauaacaaaauaccauagauuugguaguuuauaaacaacagaaacuuacuucucacaauucuaaagucugggaaauccaagaauaacauuccuuuaagcaagguugaauguaccagcuugggcgauaguggcaaguagccuccuauuccauuuuguucuagaaagcauuuuuucucuuuucuauuauuuuugucucuuuauauguuuauguguuagggggagaaggagagagaauauuuuuauauuuuucuuuuggggggauauuuuuauuuuuaaauuauaaauacuucuaauuugcaaaggaucccagaaauaguugaagcugucuuuaaaccccucucugaucccauucuauccuuucuguuaacuacuauucugaaguuaauuuguacucuguccauuuuuauccuuuuauuacauauguuuguguucauaaaaaaauuacaguuuaacauuuuuacauaaaaaauguucuuguaaauauucugcaauuugcuuuuuuaaauuuuauuuuuuauuuuuaauuuuuuuuugcagagccagggccuugccuuguugccuaggcugaucucaaacuccuggccccaaggaauccucuuaccuuggccucccaaagugcugggauuauaagugugaaccaccacuccuggccuugcagcuugcuuuuuaaaccuauucuaagacuugcucccuauuuauacaugaguauuaaguuaacucauuuuaacugcacguauaauauucuauuaucaguaugucaguuuauccauuucugguauagaggaacacuuaauuuguuuucaggguuuuuuuuuuuuuugcuuguguuuuuguuuuauuauaaacaaugcuucaggaagcauauauuuguauucuugaauuuuuuuuuuuuuuuuuuuuuuuugagacagggucucacucuugucgcccaggcuggagugcaguggugcgaacucggcucacugcaagcuccgccucccagguuuaugccauucuccugccuuagccuccugaguagcugggacuacaggugccugccaccaugcgggcuaauuuuuuuuuguauuuuuaguacaggcgguguuucacuguguuagccaggauggucucgaucuccuggccucaugaucuguccgccuuggccucccaaagugcugggauuauaugcgugagccaccgugccuggccuugaauuuuuauuugacuuaaaacauacugugaaacuuguaagauuaugugaaucauguuuguacaguuuauacuuaaaaaaaaaaaaacauggugaacucuuaucaauucacagaguaaaaaacaacauucccaaugcuguggaaacaccucuauggcccaaaucacaguucuuuucuuaccauucccccuaccacuaucuugaauuguauuuuaaaauuuccuuucuuuucuuuaugucuccaugaacaauguauugcuuuguuuacuuauuuugauuuucauguaauggaauaauacuguaaguauucugauuucuuuuguaagcaucauuuuucuuuugagcguuaaucuaugguauuguaugcaguucauucaguuuuacugcuauacauuaguucauuauuuguauauauuguauauauauauauaucugggcuauugaugcacauuuggauuguuucuaguuuuuugcuauuacuaagaaugcugcuuacgaacauuguuauucaugucuuuugugcacaugcaggaauuugaaguauaugucugggagcagaauuuuucauuuuaugggguauggguuuguuuagcuuuacuaaguaaugccaaauuuuucuaauuuuuaaaaauuuuuaauuaauuuuuuuuuugagauggaguuucucucuucucccccaggcuggaguguaauggcacgaucuggacucacugcaaccucugccuccuggguucaagcgauucuccugccucagccuccugaguagcugggauuacaggagcgagcaccaugcccagcuaauuuuuguauuuuuauuagagacgggguuucgccauguuagccaggcuggucucgaacuccugaccucaagugaucuguccaccuccgucuccugaagugcuaggauuacaggcgugagccacugcgccuggccaccaaauuauuuuuuaaagugauugaaucaguugacacucccaacugcaauauagaaguauuccuauugcucuguguccuugccaaagcuuagaauuguuucuuuaaaaaauuuuauggggccgggugcaguggcuuacaccuguucaaggccagccuggccaacgugguaaaacccggucucuacuaaaaaauacaaaaaaauuagcuggacguuguggcaugcaccuguagugcuagcuacucgggaggcuaaggcaggggaauugcuugaaccugggaggcggagguugcagugagcugacaucuugccauugcacuccagccugggcaacaagagcgacacuucgucuaaaaaaaaagaaaaaaaaauuauguaucugguggguaagaaauguuguuucauuguaauuugaaucuguauuuccuugacuaccaaugagguuuaguuucuuuucggauauucauagagcauuuguguuauuuauucugugaaauguauuuguguuucuuauucugugaagugucuguauauacuuuuugcccauuuuucuguuuggauuguuuaauuuuuccugauugauucauagcaauuuuuuaugguuuuagaucuaauucucuuguuuuuugagacagggucuggcucugucacccaggcuaaagugcaauggugcaaucuuggcucauugcaaccuuugcuaggcucaagcuauccucccaccucagccucuugaguagcugggacuacagguacgcgccacugugccuggcuaauuuuuguauuuuuuguggagaugggguuuugccauguuccccaggcuggucuugaauucgugagcuccagugaucuacccaccucagccucccaaaguguugagauuguagauuugagccacagugccuagccuagaucuaauucuagauuuguguugcaaauaucuuuuccaauuuaugauuggauuaaaaaaaacuucggugauugaaauucuugaucuuacugcagcugaauuuaucagucuucuaugauuuauguuuuaaaauuuuuuuguguccuaucauuaagauaauucucuauuuucuaaaaguuguuugcuuuucacuuuuacauugaagucucuaauccacauggaaagacuuuuuuuguaaggauccacuuuuauuuuuuugccauaugauaacagauaacugauuguuccagccuauuuauugaguagugcauuuuuucuccugugaucucagugcuugcuugggugaauauuaagugucaguauaugcacaggcucaguuucuagacucucaguucggcucucuccucuagugccaguaauccacuugauuauuuguccugauugugguugcuuuauaauaauucuuaguauaaaguauggcagguccccaaaagacuuauaauaaugccuuuccauauugguuuuacagucaguuuauugauuuccgcaaaaaaugauacugggauuuugaaugguauugcauugagucuuuggaucaaguugggaagaauugauugacauuguuaugauauugaggcuuccuauuuaagaacauaauaugacuuucuauuuauuuuauguuuuaaaaaaucauuccaguuaaguuuuauaauuuucuccuuauauaaagaacuucuacauaaaaugucaguuuuuccuagaauauuuuuauuauuuauacaugauauuuaaaaaguuauauuuucugauuguauauagaaaugaaauuaacuuauauuuugucuuuauacuuuuuuuuuuuuuuuauuuaaagaaacgggguuuugcuauguugcccaggcuggucuuaaacucuuggccucaggugauccucuagucucagccucccaaagugcuaggauuacaggugugagccaccacaucuggccuguuuuugugcuauuacugacuuauaucuagauucuuugggguuaucuauguagacaguggaugaucuacaaauaguuguagcuuuguuucuuuaucuucaaucuuuuuuuuucucugugcaucuguugagggcuuuuaauguugaauaggggagaugacauugggaagcuauguguuguuuuuaauuaauauuuuuuuuguacauugaccucuucuguaccuugcacuucuguuuuguuuuguuugguuuuguuuuuggaaugcaguggcgcaaucacaguucacugcagccuugaucaccugggcucaagccaucaucccaccucagccucccgaguagcugggaccacaggcgugugccaccaugccuggcugauuuuuguauuuuuuuuuuuuuuuuuuagagaugggguuucauccuguuggccaggcuggucucaaauuccugagcucaagugauccaccugccucgaccucccaaaguguuaggauuauaggugugagccacugcacccagccccaggguuguugcuucuuuauugagcuugucacucagugccuuuuaacuggggcauuuagcccguuuacauucaagguuaguauugauauguguggaucuaauugugucaucauguuguuagcugguuauuaugcugacuuguuggcaugguugcuuuguagugucacugguuauguacuuaaguguguuuuuuuuagugucugauaauguucuuuccuuuccauauuuagugcugcuuucaggagcucucguaagguaggucugguacuaacgaauucccucagcauuugcuugccugaaaaggaucuuauuuuuccuuugcuuauguagcuuaguuuggcccaauaugaaauucuggguuggaauuucuuaucuuuaagaauguuguggcugggugcuguggcucacaccuguaaucccagcacuuugggaggccgaggcgggcagaucaugaggucaggagaucgagaccauccuggcuaacaccgugaaacccugucucuacuaaauauacaaaaaauuagccaagcaugguagcaggcgccuguagucccagcuacucgggagccugaggcaggagaauggcguaaguaaacccgggaggcggagcuugcagugagccuagaucgcgccacugcacuccagccugggugacaagagugagacuccgucucaaaaaaaaaaaaaggaauguugaauauagaccuccaaucucuucugacuuguauaguuucuacugagagguccauuguuagucugaugggcuuuccuuuauaggugacauguccuuucucucuagccaccuuuaacauuuuuuucuuucauuucugccuugaagaaucugaugauucuguuuuuuggagauuaucuuuuugugaaauauuuugugggaguucucuuuauuuccugaauuugaauguugacuucucuagcuagguuggggaaguucucaugaaugauauccugaaauauguuuuccaaguugcugccuuucuccccauaucuuucagggauaccagugaaucauauauuuagucucuuuauauaauuucauauuucuuggggguuuuguuuguuccuuuucauucuuuugucuuuauucuugucugucuucuuauuucagaaagccaaucuucaagcgcugagauucuuuucucagcuuggucuguucuacuguuaauacuugcgauugcauuaugaaauuuuuuuuuuuuuuuuuuuugagacagaguagugacacgaucucagcucacugcaaccucugcuuccuggguucaagcgauucuccugccucagccuccugaguugcugggauugcaggugccugccacuacacccaucugauuuuuuguauuuuucguagagacgggguuucaccauguugaccaggcuggucuugaaccccugaccucaugauucgccugucuuggccucccaaaauguugagauuacaggugugagccacugcgcccggccaugaaauucuuauagaguguuuuuuagcuguaugaggucguuuauauucuuuucuauacuggcuauuuugucugucagcucuguaucguuuuauuguggguagcuuccuuacauuggguuucaacauucuccugaaucucaaugauuuucauuccuauccauauucugaauucuguuucugucauuucaaccaucucaguccaguucagaacccuugccggagagcuagugcagucguuuguuuuagaggaaagaagaugcucuggcuuuuugagucaucagaguucuuguguuggugcuuugucaucuuugugggcugauguuccuucagucuuugaagucgcuguuuuuuuuuguuuuuuuuuuuuuauccuauaugaugaccuuggauguuugugguacaagguagguucaguuaacuggcuucauuacuggaggggccagggcucaucucaggacucccggaguacauggguccuccaacucugggggacuggcauugggccccagcuuuguucucugguucuuuaagguuaggaaccugcugcacuggaggggccgaggugcuccuggaccucuggucacaauacucccguggguugugccagccaaaguguaggggguggcaguggaaucaauucuuguucgcaugugccaguagcaguggcagcaaggccacagggugcuggccuccaugugggcauuggcagcaacaguggcaguaaggccagggcggggggcugcugguacacaugcacugguggugguguuagcacaggggcagggugcuggugggugcaggacugggugugcccucugugcacguucaugcuggcuucaguggccgguaagggguggggguggguccucuguuuucucugccuaguuucauguuggugcaggggcucagugcugguggggauggcacuggugggcucuguaccugccagugcucccuugacaauggccauggagggauaggcaggguguacucacgcuggcugcaguggcaugggagggugcuugcacgcaugugugcuggcggggaagggaaaacaagguacaccugugcacacgugugggcaaagcauuuggaggguggccaugggcgagugccugcaggcaaagcagcauggagcagccuucggugggaggaggguauuggcaggcucgugcuuuuccacagggaucacugugguuggagcacucugccugucagcaccuugucagugcaggagcugguauguggccccccccggcaguacugcaagcauccuggccaggcuggagccccaugagagaccagcagacugaggguacucaggucacaccacccccaccuuaugggcaagacugcccugcagaguucaggucuggcaguuccucuagggcuaaagucuccuaugggagcaagucgagccuugggggaugggcacuccuggcccuguugcacuacagaugcuccagcaccaaaaccucugagcucugcccuggcuggaguucugccccuaccacuucucuaagcagcuuucccugccagcucaaguguccuuggugguugaggggucuccuugugguggaggagucuccuucugcagggauuccagaguccccuggugagaguggguugcugcuucccuguucaacucaacugccucuucaggagucacugggggccaggaaaaagucccggugcgugguagcccugugcaggguuccuuacuucuucccucgucaguucagcaucugugucuucccucugucagcacucagugcuuucccucugaagaucugcuaagagugugccagucauccugauccucugggagauguuccuacuggcugcagcuaguuggccaucuuggagcccccucccuguggcuuuucaugauuucuaauaauuacauugauguuacauucugugggcuguucuuauugaaauguauaaauuuaacaaaucaguuguugguguaaacuugcugauauuuuguuuaggauguuuguaucuaugaguaagauugguuuguaauuuucuuauauagcuguugucuggauuucauaucaaggugauucuagccuuauaaaaucaauuggggaguuuauauaaucuauuuaaucucuguguuaacugaaguugugucuaauauuucaccccuaauguuuauuucuuuauuuuuucauguuuuuuuuucuguuuguguauuucguuuuuauuuuuuugagacagggucuuacucugucauccagacuggagugcaguggugugaucacuguucacugcagccuuaaccuccugggcucaagcaguccucccaccuuagccucucaaguagcugggacuacaggcacaugucaccaucccuagcuaauuuuuaaauuuuuuuuguagagacggggucucaccuuguugcccaggcuggucuugaacucaugggcucaaaugaucuucuuucuuggcuuccaaaagugcuaggauuacaggcgugagccacuguggcuggccucaguguauuuuuaaagacucauuucuaggccagacuuggugggucaugccuguaaucccagcacuuugcgaggcugagguagauggaucacuugaagucgagaguuugagaccauccugaccaacauagugacaccguuucuacuaaaaauacaaaaacuagcugggugugguggcagacgccuguaaucccagcuacucaggaggccgaggcaggagaaucgcuugaacccaggaggaggagguugcagugaguggagaucaugccgcugcauuccagccugggccacagagcaagacuucaucucaaaaaaauaaaaagacucauuucuuagcuuuuuaaacuuuguuuucuguuuuguuaauuuuguuguuacauuuucuuuccuuggguuuauucugcuaugcauuuuuccccuaacuuuuuaauguuacuuauuuauuuauuuuuugagacggaguuucacuguuguugcccaggcuggaguacaguggcgugaucucagcucacugcaacauuugccucccgaguucaagugagucuccugccucagccacccaaguagcugggauuacaggcgcucgccaccaugcccggcuaauuuuuguauuuuuaguagagaugggauuucaccauuuuggccaggcuggucucgaacuccugaccucaggugauccaccugcuucggccucccaaagugcugggauuacaggcaugaaccaccgugccuggccuuaaucuuauguuuaaauguggaaaaaugcacauaacauaaacguuaccaucuuaacuguuccuaaguguauaguucaguaguauuaaguacauucaccuuguuguguaaccaaucuacagaacucccuucaucucaaaaaacugaaacccuuuacucauuaaacuagaacuucccauuccuccauguucccagccacuggaaaccaccauucuacuuucuguuucuaugaauuugacuacccuggauaccucaaauaaguggcgucauacaguauuugucuuuuuauaacuggcuuguuuccguuaguguaaugucuucaagguuaauccacauugcagcauaugucagaauuuccuaccuuuuaaaggcugaauaauauucuguuauuuguguaaaccacauuuucuuuauccauucaggacauuuggguuacuuucaccuuuugguuauuguaaauaaugcugccaugaacaugggugugcagauaccacuucaagacccugcuuucaguucuuuugcauauguaccuagaaguaggguugcuggaucauaugguaauucuauuuguaauauguugaggaacuguuuuacuguuuuccauagguauaugcacuauuuuacuuucccaucaguagugcacaaggguuccaauuucuccauauccucauuuacguuuguuauuuugugucuuuuuuuuuauuuuuuugagacagagucucacucuguugcccaggcuugaaugcaguagugugaucugggcucaccgcaaccuccgccucccggguucaagcgauucugcugccuuggccucccuaguagcugggacuacuggcaccugccaccaugucuggcuaauuuuuguauuuuuaguagagaugggguuucgccauguuggccaggcuggucuugaacuccugaccucaagugaucugccugccucggccucccaaaauguugggauuacaggcaugagccacugcgucuggccuuauuucaugucucuuuuugauaguagccauccuaaugaguguuaggugguuuuaugacuuuuugguuuuuuuuuaauagagguuuuugcucugucaugcagacuagaguacaguaucaugagcauagcucacugcaucuucgaacucuuggacucaagcaaucuuccugccuuagccuccccaaagugcugggauuauaaguggaagccacuguaccuagcacguuuucugacuuuuagaguuauauuuaagcucaucaguuuugaauauuucauuugauuguaaguauucaaaguuauaaauuuauuaaaugcugcuuuaauuguauccuacaaguuucaauaauuggcuuuuuauuuuucaauuucauauuuccauauaauguuuucaauuaugauuucuccuuucaccuagaguguuucauaugaauaugaaacauguuaugguuuauauguuaccaguaauuucaaauuugaacuuagcuuuaugaccuugaacauauuuauuaguuauuuauuguuauguuauaaauuauucccaaauguagccguuuuguacaacaaacauuuauuaucacauaaaguuucuguccaucugaaauccauuaguggcugaacugaguguuucuggcucagagucuuucaugaagcugcagugacagucuuggcugggucuguaguaaucugaaggcuugacuggggguagagcauuugcuuccaaguaaauucacuuacauagcuuuuggcaggaggccucaguucuuugcuggccauuuguaagaggucucaguuccuuucuacuugggcuucuccaucuggcugcuuguaauguggcagcugacgucucccagagugagugaucugagagaaucaaaagccacauucuuucaugauccuuagaaguuacauaccuuccugcuugccguauaauauugguuaugcagaacaacccgaauaccagaugagagaggaugacacacggguguggauaucagaauguaggaauacuugcagaccaucuuggagucuggcuaccauaagcauacaguccauuuuuauaaaguuuucaugucuucuugaaaaugauauguagucccaaguucuugagugugauuuuuacauaggaguuugaucaaguuuauuaagcaguucaacucuucuaaauucugauucuuuuuugucugcuagaucuuacuacugagaaagguaaguuaggaaaucuuucacugaauuaguauguuuaugcuuuuuucuugcagaugugucaguuuuguguguguguuauuaggugcauagaggcuuacaauaucuuacaguugauuugaguccuguaucaucauguagugccccucuugaucucuaguccuuuuuaucuuaguccacuccaguuuucucuuguuucuauuugccugauagaucuuuuuccauuucuuaacuaucaauauuucugugccuguaugcuuuauguuugucucuuauaaacaguucaugggaaaccagucugaugguuuuuuuuucuucugccuggagaguuuaguucauuuacauucauugugaugacugacaucuuuggauuccuuucugccauuuucuuuuuaaaauuuaaucuaauuauuauuacuuuuuugaaacaggggucuuucucuguugcccuaacuugaguccaguggugugaucauggcucacugcaaccucugucuccugggcucaagugauccucccagcucagccuccuaaguagcuggaacuauaggcaugugccaucuugucuagauaauuaaaaaacauuuuuuuuuuuuguagggacagcaucuuacuguguuucccaggggcuagucuugaacuccugagcucaagcgauccaccugccucagcuucccaaaguguugugauuacaggugugaaccaccacccccagcucugccauuuucuuaugugccuuuuauucaacuguuucauuuuuuuaccccuugagucucagaauuuaccucuggguucauuuuacuucugcuugaagcauauucuuuagaauuucuuuugaugagggucuguugcaguaauugcucuuacuuuccuuucuuugaaaauacagggccagcgcgguggcucacgccuguaauccgaacacuuugggaggccgaggcgggcggaucacaaggucaggagaucaagaccauccuggcuaacgcggugaaacccccaucucuacuaaaaauacaaaaaauagccaggugugguggugggcgucuguagucccagcuacucaguagguugaggcaggagaaugacgugaaccugggaggcggagguugcagugagcugagauugugccacugcacuccagccugggugaaagagcaagacucugucucaaaaaaaaaaaaaaaaaaaaaggaaagaaaauacaguagucuccccgcuccccccacaaccacuuaucagcaguuuugcuuucuaugguuuguugcccacagucaacugcagucugaaaauguuaaauggaaaauuccagaaauaaacaauucauaaguuuaaaauugcaugcuguuuugaguagugugaugaaaucucacacaguccugcuucgucuuacuugggaugcaaaucaucccuuuguccaguguauccacacuguguaugguaccugccuguuagucacuuaguagccaucucauuuaucagauugacugucaugauauuguagugcuguguucaguuaacccuuauuuuauauaguaauggccccaaggaggaggagcagugacgcuggaauauuguuauaauuguucuuuuuuuaaaauuaguuauuauugucgaucucuuacugugucuuauaaauuaaacuuuuuuauaggcauguauguguaggaaaaaaacauaguauauauauaggguucaguacuaucccuggauucaggcauccacuggggcucuuggaacuuaugccccauggauaaggggagacuacuguaucuuuauuucucccuuauucuugaaugauaguuuugcuggauauauagaauucuggacaguuauguuucccucaguauguuaaagauacuauuucacuaucugucugcuaucauagccauugagaauucaguugacauaauugccuuuauuuuauaggugacauuuucucuccaguuguuuuuuuaggucuccuuuuuguuguuuguucuguaguuucaccaaaauguuuguagguauauggaucucuauucugcuuugaguuuuuggacuucuugggagugacauuuguuguugucuaacaguucuaaaaagccauuaccuucucaaauauuguuucuuuucuguauuucuauuaguuuucuucuggaacuacaauuagauguauguaauauuguuugaggcugagccaaguaguguacugugauuaaguuuacuuucugguacaacuuuuugugucuccuaaauguaaugucucauuuagccucauuuuuuucauuugcuucaguuuuuauguagcuauuguuauuucuuuccaucauuaacacguucucaguacaguuuuucacauagggucaaaccuguuaaucuguucagugugaccauuuuccuugaggauuuccucccaugcuaguguuuagaauuggcugcuugcuauaccaggugugcagcuaucauccuguguucucccuucagcaucauuuuggaaauuccuauugcuugucuccuguguugauucccuuguuuuguggaucucauucauuuacaacacaccuuccacuagcuugcuggaaaaaaaaaaaaguacaaaggagauaaauuuugagaccuugaauguuugagaaugucuuuauucuaccuuuuuugaaaaaaaaauugauaauuugucuaggucuuaaguucuaauaugaaauaauuuuuuuucucagaauuuggaaagaauuucuccauugccuuuuaguuuaucacugagauuauugcuaaccccaaugccauucugguuucuguuacguugucaucaaucuguuuauuuuuucuuuucuagaauccuuggaauuuuuuuuuauuuguccuugcuauucugcaguucaauaauaacauguugggauaccaaaugggucuuacuuaguuuagagacucuucaagucuggaaaacuucuuguguuauucucuggcaacgucuuccuaucuuauuuauuaauuuuuuucuuuuuuucacauguuggaauugauuacucauguaauguuuuacauuuuuuucuuucauggucuuucuuuuguucuuuuuuuguagaaaauaucuugacuuuaucuuccaacucuuuaauguuuucuuucuuucuuucuuuuuucuugagacagggucuggcucugucgcccaggcuggagugcaauggcacgaucucagcacucugcaaccuccaccucccggguucaagugauucuccugccucagccuccugaguagcuaggauuacaggugccuacuaccacaccuggcuaauuuuuguauuuuuaguggagacaaaguuucacuauguuggccaggcuggucucgaacuccugaccucaggugauccacccgccugggcuucucaaagugcugagauuauaggugugagccacugcaccuggccugcucucucuauuuuaaaaauagcauucuuuaguuuuuuuuuuuuuuugagucagcgucucgcucuguugcccaggcuggagugcaguggugcaaucucggcucacugcaagcuccgccucccagguucacgcaauucuucugccucagccuccugaguagcugggacuacaggcuaauuuuuuuuuuuuuuguauuuuuaguagagacgggguuucaccguguuagccaggauggucucaaucuccugaugucgugauaugcccaccuuggccucccaaagugcugggaucagaggcagcauucuuuaaauuuuuaaguauuuuuuaagauacuaauaauuuaccguauuuugaaguuuucuucucauucuucauuaucuuuuuucucaaaauuaauuguguguacuugguucuuuuucuuucauguuaauaagguuuccuuauaccuggugauucugagcuguuuucacuuuaaauaucuaaguuuuguuuguuuguuuuuugagacagucucauucucucgcccaagcuagagugcgguggcaugaucucagcucacugcaaccuccacuucccagguucaagaaauucuugugccucagccucucaaguagcugggauuacaggcaugugccaccaugcguggcuaaauuuuguauuuuuaguagagaugagguuucaccauauuggccaggcuggucugaaacuccuguccucaagugaucggccugccucggccucucaaagugcugggauuacagcaugagucauugcgccuggccuacucuuagaucuuaaauguuuuacacagacacacacacacacacacacacacacacacacacacacgguaacugugaugauggaugugucaguugaucgugguaaucauuucagaauguauacaucuauuaaauuaucauguagaccuuaaauuauuauuuuugucaauuauaccucaagcuggaaaaaaaugcagaucuacucuuaaaugugagauaauuggaagcucaugugcaugggcuaggguaaguugguggagaacuaacuuuauuguuggaggcuuucuaaauguaugucuuuucuuugaacauuaguuuguuccagaaaauauugcgugguugguugccugggaagauguaugucugauuuucggacuuggaagcaagauaaaggaaagaggcugcugguuuaugguauagagauuuucacucguuaagaaaguaacaaaguaaggaaguaggauuauuguagaaauauuauuuuacaguucaaguuuguaaaacacaggugaagguaaucguuggugggucucuuccucugagaucaccaaauuaucuguagacugguugguagacuuggagagaccacuuguucuuggacaacaguuagaagcauacugcccuaagcaguaaaaaggugauuguugagggcagcaagaggcgguguaacauaccaguucauuuuucuuuucuuagcaagcauguacuaauugccuuuuaaaacuccugaccauaggggauaaaacgauuacaagaaagauaccuucccugcucccauggaauuuacauucuagcacaacaguggauauuaaacaacguaucaucugguuauguaauuacaguaauaagaaucauguaggagaggucaaggaagcuuacugcugugggguucaggauggcaucuccgaaaguaugaauaaggaaaguggugggagaauaaaaggagaguggcagagacucagacugagagauuaauugagauaaugacaauugugggauucaaugagguguauaauguguuuagugccugguacuugugcucaguaagugcuaauuaguaguuguuuauagcaauacuguuaucuuggaugaucaaauagaagaucccuagcaaguaauuuuauaaagacaaaaauuucgugucaacucuguaauaaaacaauauauccuuagaaucaguuaucacuuaaaauccuuauuuuauagaaauuuuuguguuucaaaaguauagcuagggcaagucccccuucaggguggauacuuaaaggagaugaaaucacuucauaaaggugucugcacucccauguucauugcaguguuauuuacaagguagccaagauauggaaacaaccuaaaugucuguugauggcaaauugauaaagaaaauguguguguauguguguguuuauacaauggaacguuauucagccuuuaaaaagaaggauauucugucauuugccacaacuugguuggaccuuaugcuaagugaaauagaccacgcacaaaaagaaaaauacuauauaaucucacuuauauguggaauguuuuuaaaaagucaaguauacggagacagagaauaaaacagugguuaccuugggcaggaggaggaaggaaaugggguuauauagauaauaaaauagcagauauauagaaugaagaagucuggagagcuuauguauaacaugaagacuauaguuaauaaaacaaaacuguauuaaggauuuuuauuaaguaauuuagcugcuuguaacacuuacacacacacacauaguaacuaugauagauguuuucacuguaguaaccauuuugcugucuauacacaucccaagauaucagcuuauaaaucucauauacacagauuuuuuuuuuuaaagguauuguuggggcagggaucaggcuuaacuuugugguuguaucuguaguacccagcacagugccugacacauagaagguguuaaucuuguuuuuuuuuuuuuuagguaucugaaauacuuaccagaaauucuauucuuucagaugagagacaucuaugugauuuuagguauuaauaaaagaaauauucuuccuuuuuucuuacuacgguguugguaguggugcucuuucuucagggacaucauugauggccuuuuaguuagaauuuaaauguuauccuuucuguagccagcagggaucuguugggauaaagucuuauuuuucuuuucuugggaguaauuggugcuuucuaacuuuucagcacuuagacucacaauguauuaguuaucuauugcugcaaaacacauuacuucaaaacuuagcaguuuaaaacaacagacauuuauuaucccacaguuucuaugggucaggaagauagggguaccuuagcuggaugccucuggagcacggucucuugagguugcagucaagcuguuggcuggggcuauaucaucugaaagcuuuacuggggcaggggaugauguacuuccaaguucacucccaugauuguugggaggaggacuuaauuccguuucuugugggcuucuuccugguuuauguuuguuaccuggugucuagagcugauguauuggguacuuccccucuagcaugguuauuuucuuuguuuuuucucucauuuaggugaaaacuuaggugaauuuuaauguaaacccuacccccauuauggucuaaggggccuuuuagaaaaugaguagaauguacacagaggcaaaaauuuuagccugugaccuuuugaagaauuuucuaagugaaacuagaaacaaauuaaccauuguucacagagugcuuugcuuaauguuaugccuucuuuugcuaaauccucuuguuuguugaaaucuuacaucuuaaguugcugauaguuuguuaauagagaucauaauuaaaaggugauuauauuucuucaugcaguuuagcuuuacauuucuuccauuauacccaaagauuucuauaauauagcaagaaauguuuuuaaaaaguguuuuuccucaauugugugaaaguaauguaucuaacugaaaagaagagaaacucauaaaaguaaaaauuuuaaaaaaucaccuuauucuuaccucucaaauacaaugaccucauauuuuaaauuuugcucaagguuuuuuccuccucauucuaggcauaauuauuuucuuauauguguuucaguauuacuuuuuuugugaaaaauaugguuacaaauguggucuaauuucauuuugcacuuuaaaaauuauuaaugaggccggaaaugaggccgggcacuguggcucaugccuguaaucccagcacuuugggaggccaaggugggcagaucacgaggucaggaguucgagaccauccuggguaacacagugaaacccugucucuacuaaaaauacaaaaaauuaaccgggugugguggcaggcgccuguagucccagcuacucgggaggcugaggcaggagaauggcaugaacccgggaggcggagcuugcagugaaccgagaucgcgccacuguacuccagccugggcgauagagcgagacucugucucaaaaaaaaaaaaaaauuauuaaugagauggucauauuuuuauguuauuuacugaucacuuaccuuugaauugccccuuguuucuugaaguuuuuccaauaaauauucuuauuaauaggcaagacaaccugaucuguuaguuauguaaacuuuuugguagcuaauuguaugugcauucuuuuaccucccguuuguuucuuuauuagcagugucuuuuuguuauagaauuuauacauuuucuuguaagcaaauaucaguguuuuuauuauaggugcuguauguuugucuugcuuaggaaaaucuuuauuacuccaauauuauuaaauuauucuuuaguauuuguccuaauagcuuuauggcuuuguuuuuuuuaaaucacacacacacacucacacacacacacggacacacacacucuuugagacgggucuuguucuaucacccaagcuggagugcuguggcgcaauuauggcucacugcagccucaaccuccugggcucaagauauccucccaccucagccucccaaguagcugggacuacaggugcauaccaccacccccagcuaauuuuuaaauguuuuuuuuguagaaacagggucucacuuuguugcccaggcuggucugaaacuccugggcucaaguggucauccuuccucagccuccccaaagugcugguuuuacaggcaugagccaccacaccuggcagcacccauauauuuuaaaauuuaguaugaauuagucuuuucuuuuugauguggcauaauuguauugacuaauccauucuuuaccauugauuugaaauaccaccuuuauuauauuaaauuugugugugaauaugaauaucuuuucugugauugcaauuaauuuguacuuguacagauugugcuguaagagcuuaacaguauauuucaguacuuggucaugucucuuguucuuguuuuucuuuucuuuucuuuuuuuuguuuuguuuuuugagacagagacucgcucuguugcccaggcuggagugcaguggcgcagucucggcucacugcaagcucugccuccuggguucaugccauucucccgccucagccucccaaguagcugggacuacaggcgccugccacgacgcccagcuaauuuuuguuguauuuuuaguagagacaggguuucaccguauuagucaggaugaucuugaucuccugaccucgugauccgcccgccucggccucccaaagugcugggauuacaggcuugagccacugcgccuggccuuguucuuguuuuucaaaaauuucuuugguauucucacaaguuuauucuuccaaauuaacuucagaaucagcuuaccauuuuaaauaagcaccccccuucuaaaucuauuauaacaucucacuacuuucucuucuauucauauuagcuuaacuuaagcuaccauccucucuugaguaagacuguuuucuaacauacagcaacaagaggguucuuuuuaaaacauaaaucagauuaugucauuccuuugcuuaaauucguucagugccuuuuuccccugucuuuugguuaucuauugcuguauaauaagcuacuccaaagccuuguagccuaaaaacaaccauuuuauugugcucacaauuuuugggggucaggaauucaugacagguucagcugggcaguucuucuguuccauauuguguugcugacacuggagaaucccuuccauuauggcuucuucagucacaugucuggcuccucaguguuucuuggccucucucuccacaauggcgucccauucuucagaaucucugcauguggccucggcuucucacagcaugcugaucucagaguagucccauuuuuuacaugacaacuggcuucuaggaagagggaaauaaaaacugucagaccaauuaaggacuauggccuggaacuacacagugugccuuuaagccguauuuuauuggucagaauagucacuggaccugcuagaugaaaggagguagaaaaauaaauuucuuuuccuaaugagggaguggcaaaaucuuauugcgggaaagcaugugggaugagagauacuugacaguuggaaaauauaauccgugacaucgucaaauucaaaauaaauucagaguucuuaaaauggccuauaaggcuuuucaugaucugacuccugcuucuugaaucucugaccgcauccccuagauuuuccucuucguucccuuuggguuaaccacauuggcccucuugcuaggcuuugaacaugccacacccaacaucagauccauuuuacuugcaacuacugccgugaaugcucuucuuuagaucuuugcaugggucuucccguucucauucauucauucauuuugagacagggucucacucuguugcccagacuggagugcaguggcacgaucugggcucaaugcaaccuccgccucccggguucaagcaauucucccaccucagccuccugaguagcugggacugcacgcauguaccaccaugccuggcuaauuuuuguauuuuuggguuucacgagguuuccccauuuggccaggcuggucucaaauuccugaccucaugugauccgcccgccucagccucccaaagugcugggauuagaggugugaaccacuaaucccauggcuggucuucccauuuuuuuacuucauuuaggucucugcucaaaugucacaucuucagagagcuuccccugaacaccuuaucugauaaauucuugguuacuuagaacuccuuaaucuugauuuuuuuuuccuuuucauagaauuuggugcuguuaguaggagccuggggggccuaaguaccacuuuucuuccuucccugccuggcuucugagcaaguugagaaaugaguaaagguggaggccaaaauauauuuuaaaaauucuucugacuaaagggagaugaaguaaagggaacaaaagaaguaucaugaagauucucagauguccgacaugggaaacuggguagauugugguacuauuuaccaagacaggaaacaugguaggaagauuaugaauuaagcuuuggaaauguugaguuugaagugccuacaaguuauccauguggagaaaccaaauggacauuuggauaacacaucugaagcucaggagagaaguuuccauuacagauucagguuugguaguuguucuaguuuucuauugcuguguaacaaacuaccacaaacaguagccuaaaacacacaaaauuacuaucuuacaauuucugugggucggagucaaggcauugcuuagcuguguucucugcucagguucucaucagccugaaaucaagguuuugguuggggccucagucuuaucugaggcuugggguucucuuccaggcucauugguuguuggcagacgguucaggaaucuggggagacaagauuuuugggagcgccaacccagauguuuccauuccaugugucagagucuuguucuuuccuagccaggccccugaucuggacguaggagaccugcugccuuugggaguucaaccuuugaagcccaacacauacagauuuagauaucuaaucugucuguccauccauccauccauccauccauccauccauccauccauccauccauccaaucuguauaucucugagauauauaaguguaauaaaugggcgauaaucaagugcugguuuugguccuuagguuucucugcccuccugcugcaggagaggagaaucucuguguuuucagagagguucucuggcuuucaaacuuaguuuucaauuggaaguuaaucagcuuuuuuguuuuuaucuuuuuucuuugaaaucaacaucugggagugaggagcacugggcaaaugcagugcaggcccagcaccagcuuuggccaacccccacggggagccuggagcgagaaugggagccugggacaagaauggcucuucugaguugcccagaauugcgguggcugauguguccaggccuucauauugccauaucaauuagucauuugauguggguuaucuugggaaggauaugaccuugaacaggguuguuccuuguaggugaggcaaucccugaaggggcugacugacagcacucccagcauuuaagguaaguccuuuuuugaaggaggaacuggguagcaccucagugucuaccacgauuucucuguauccaccaaauggccaauuuguuuuuguuuuuuauuaucauuauucauucauggauuuaaacauauauuuagcaaacuuucuguuaaauuauguguauagaaaagggcacaaauuguaaauauacagcucaguuaaauguucacaaaguaaacacaccaguguaaccaguauccagaucaagaaauaaaacaauacugugaaucuaggaguccuccucguguuuccuuucagucacuguuuuccagggaucuauccugacuucuaaaaucauggguugaauuuagcaugguuuugaaauuuauguaacaucauacaauaugucuuguucugacuucugucugucaguauuguauuugugaaauuaagcucacaauuguaagucauucucuugcuguauauuuuuucaugguaugacuauaccaguuuuuaaaaaccauuucugcuauuaacauuuggauuguuccaguuguugggaauuauaaaacaugcugcuguaaaacauuguugugcaugucuuuuggugaacauauauacauuucuguuggguauauaucuagugaaauugcugaauguguguguguguguucaguuuuagcagauaaugccaguuuccaagguaaguacugaguuacaugccuacuaguagcuccuaagauuuccaguugcuguaauuugcuccuguuuguagaagacacagccuucgagggcuuaucacugagaacuguauuuacuaaggucuccacuagcagauucugaacucuuuuguccucucgaagcugcaaggcuuucaaauucugcuuugcuuuucagaaguuuuuaguuuagccuuuuuacccucuuccacucacugaggcauuugagauucccucacgucuucaguuuugccaaucuagcccucagugaacaccagaaucucugaugguuucuucuuccauuagagguacauugccugggaaaaaagccuuauuucucaaucuguuuuccugaccagaaucugcaaaugccccaggggaaaagcagcugcagaagauccccuuaccucauuauagcucacucuuuuuggaaucuuaguguugcuaaucccuauuccuucaguagcucucugaauucuucaaacaggugauuuuuauauuucaucuuuuguuagaaauuaaguuuguggugggagcuauuguuuugcaguaaauuauucuauccuacauggaaacaguaguauggauuuaaauauauuuaauauguuucaauaaauugccauccuuaaguguucaaauuauuacacuuuuggccagugggggccucuuuaaaauucauuccuaaccauuuuuggcuugaccguuauuagucagugcugcuaucugguaugacaagauguuccggggucauuaugucuuuuuuuuuuuuuuuuccuccagacauagaagcagccauuuccuaaaggaguccagauuccuuuuacugggaaauggucguucaagauuacaacugagugaggauuacuaugggauuggucauuagucauuacuaugggauuggucauuguuucuaggcauuuucauuggacagaaauagaaauauguuuuuuaaaguacaaaauaaaauaucuugacuucauauagauacuucuauuucaaauucaagacuacauuucuuuacuuuaccauuacuuuuauuucccaugcugaaagucuuggguuuuuagaggcacuaggagucauagaauuaaaauaccacagaauuauuuaguuccucucuuuauaccauuaaauaauuagauacauuuauaccauuaaagaauuagauacaguuuucaguugauuuguuuauuuuugauuucuagacuucuuaaaauuuuaauuuuauguuuauguaaguuacguaguucuaaaaugaaaucuacaaaaacaauauguauuccauauagaauauggauucuauccuuuucacuucuacuuucuuuucauuuccuaaaggcaaccacuaauuuuuuugagcauuucauucuucuacuguuuuguuuuguuucuuaauauaagaaacauauauuucuaucuccucccucuucuuagaugaauggaacauacuguguauauuuucuccaucuuguuuuuuuuuuaacuuaagauguguccuggagauuauucuaucauuuaaugaauuuggauucauuuuuugguuuuacguuacauuuuauacaugucuuuuauuuaagugucacuguguucauguuauuugcucuuucagcauauauaaauauauacacuuauauacauguacacacacacacauacacacacacacacacacacacauuuuuugagacagagucuugcucuguugcccaggcuggagugcaguggggcuuagcucacugcagccucugcccccuggguugaagcaauuaucaugccucagccucccaaguagcugggauuauaggcacgcgccaccauggucaacuaauuuuuuuguauuuuaguagagauggaguuucagcauguuggccaggcuggucucgauugccugccuuggccucagcauauauuuuuguauuuagaaagauuuauucagaccagcguucauacuguguaaugauaaggaauuuauuguagaaauuagauuguauacaguuuugaggggacuaagugaggugaguaucuggaauggggaauuggaggaucagaggaguccacuaaccagaucguccaaaucaaugacaauggguagauaaguuggagcuguuggggaaaucugagaagucaaauauauccagccacugaagugagauuaugaaggaggagcuugaggagggcacugugggaagcucuugccauguaagguuugucuuacaaagcccuguagguuugcacccaagcaucuggugguagguuugggcuaguauuggucagcaaagugaccacugguccaaagaaagagcuggacauggagugaaagagagagagaguaaaagcuggaacuuucugggugccucuguaucugucucucauuguauguuacugugaaaccuucagaauaauagcugcugcuucgcuuccacauuucaaacaaauuuuauacaggucgaguaucccguaucugaaaugcuugggaccagaaguguuuuggauuucacauauuuuuggguucuagaauauuugccuuuuacucaccgugaucaucccuaaucugaaaugagcauuuccuuugagagucauguuguugaucaacaaguuuggauuuuagaguguuguagguuucagauuuuucaauuagggauagacagccuguacaaauuacccuuuagaccaacucuaaccagaaccauauagugagugggaucugggaaaguaguucccagcuuaacaguuaacacaccacgcaccaccaguacaauuuguguuuuuguucuggugguuaccauuauauuaauaccuuuauaugguauucuaauuuccuucucuuuugggguggagggguauuauguguugguuuuuuacucugagcaauauugaaaugaacuagaaaccuccuuuccucaucuccuuuuucccuagcauuuuacucucaguuaauaacaagacaaucaagaaacauauucuacuauuuauaugcucucaccacccucccucuccucauuuugauaauuguauuguaucuauauuaucaaguacauaaagcagucaccuaauauacuuucucccuuauugccaccauucucaguucuuuuagaaaacacagugaugcuccggcugggcacgguggcucacgccuguaaucccagcacuuugggaggccgagguggguggauuaccugaggucaggaguucaagaccagccugaccaacauggugaaaccccgucucuacuaaaaauacaaaaaaauuagccaggcaaugguggugcaugccuuuaaucccagcuacuagggaggcugaggcaggggaaucgcuucaaccuuggaagcagagguuauggugagcugagauuacgccacugcacuccagccugggugacagagcaaggcucugucucaaaaaaaaaauaaauaaauaaauaaaaauacagugaugcuccacauaaugacauuuuggucagugauggacugcauauguaaugggagucccucaguauuauaauaugguaucauuaccuuuucuauguuuagauacacaaacaccauguguucaaguugccaagaguauucaguacaauaacaugcuguacaguuuuguacccuguauaccauauagccuagagguguggcaggcuauacuaucuaggauuguauaaguacacucugugauguucacaugacaguggaaucauguaaggacacauuucucagaacauaccccaucacuaaauauauuuaaugauuccuauuaauguggaugucuuuccaauuauucuggucaucugaagcauauucucuaguauauccuccaggaaaaggaaaagggaacaaaauuuccaggguucuugccguuuagcacaguuugucauugcuauaaaauugucucucaguaucugggacauugguuccaggaaccuccauggacggugaaaucuguagaugcucaagucccugauaugaaauggugugguauuugcauauagccuacacacauccuccuguguacuuuaaaucaucccuugauuacugauaauacuuaauacaauguaauacuauauaaauaguuguuauacacuauuauuuagggaauaaugacgaaaagucuguaccuguucaguacagacauacuaaaauuuauuuuuugaucugcaguuuguugaaugcauagauggagaacucauggauucagagggcugacuguauuugaauucaguuuggcuagauauaaaauccuugguuuauguuuucuucuuuuuuuaauuauacuuuaaguucuaggguacaugugcacaaugugcagguuuguuacauauguauacaugugccauguuggugugcugcacccauuaacucgucauuuacauuagguauaucuccuaaugcuauuccuccccccucccccuaccccacgacaggccccggugugugauguuccccuuccugugugguuuauguuuucuuuaaauaucuuaaauuuauuuuacuuuauuguuuucugacauaaaauuuugucaaagucugaugagagucuaauuuuuggguuuuuuuuguauaaauaauguccucuuucugccuguaaguucaaaagauuuuuuuuuucuuguucacggaaguucaaaauauguuaagguauuggucauucugggucacuuuuccaggugugugguaugcacauuaaagauacaguuucaaguuuuuaaaaauuucaauaauaauuucagcaaaguuuucuugaauucuaguuucuaauauccacuuuauuccauugguuugguuucuuucuuuggugacuccuguuauauguauguugaaucuucuuuuucuaucuuuuuuugucacuuuauuguaaauuuuuauuaucucguauguaauuucuuuuuuauauuacaacuuuccuccuuaguccccccuuuuuuuucaacauuuguuuacucuuaaagcauuaucuucuguguuaauuuacucuuauguaucuucugguuaguuuucauuucugaaaugauuuaucuucuaauucuuucuugaguucugucaacuuauuucuaucuguaauucuuauuuguguuauuccacaucuuuugucauuuucuuaauuucucuuggcucacuuugaaauaauaauuuacaguuuucaucuguugguggauaugucuuuuuggaaacuuugauuuucuguuguuuagacccuuauuuuuauguuuuucuguuucuuacuccuuuuucuuaauaauaacuuuacauauuauuugaccauagaacuuuucuguuggcuuauuuuuaugugaaauuaauuuuucugaauugguaggagggauuuguaggccaggauagcuuuguagcuuuaugucucuagagcuuauucuuuuuuuacuuucaugaaauaaaaaaaaaauggucucauucuuucagagaucucuuguucaucucucucuuuuucauuuuuauuuggaccuuuuuccuuuucucccuuuaccccuguuuucaguuuggaguucauucucagcaguuucuucucagugugggcuagaacugugcuguccagucagaucuaauaauuacauguguggcuacuuaaagcuaaauuuaaauaaacuuuauuuaauaauaacuuaaauaaacuuuaaacuuuugauuucuugucuauaccagcuauguuacaagugguuaauagcuacaugugacgacuaguggcuguuguauugggcauugcccauguagagcacuaucauuaccacagcaaauccuauuagacagugaugcuuuugagugugcuccauucucuugagacuuuuaucauaggccuuuuucauucaucugcaaauugcaaugagcauaacuacccucuguuuuggcuaauauuccuaaauugggcugcugugcuuuuuauuaaggaugcaguacauugggaaucuccucuugucagauccauuagacauucuccuuccaccugcuuucucuugcauagaugcuuauaccacauuaguauuuuuguuuuuuguuuuccagacacaggaucucgcucuguugcccaggcuggagugcaguggcuagaucacagcaacuuucugggcucaagcaguccuccugccucagccucuugaguagcuggauuacaggcacacacuaccaagccuagauuuuuuuuuuuuuuuuuuaaaguaaagaugaggucucacucuguugcccaggcuggucuugaacuccuggacucaagcaguccuccugccucagccucucaaagugcugggauuacaggcaugagccauugcgcauguccccaaccaguuuuguaacuauaaaugguuuguuucuauuuguucacuucucuggguuugggaaugagggaccuugucccuucauuuucauguagauauucaucaguuuguguuuuuacuagagaaguucuaguuucuuugauuuuuuuuuuuuuuuuuuuuuuuuuugagacagagucucuguugccuaggcuggagugcaguggugcgaucucagcucacugcagccuccaccugcuguucaagccauucucgugccucagccucccuaguagcugggauuacaggcaugugccaccacgcucggcuaacuuuuuguauuuuuaguagagacaggguuucaccauguuggccaggcuggucuugaacuuuugaccucaagugauccaccugccuuggucucccaaaguucugggauuacaaaugugagccaccgcaccuggccauuucucugauuuuuaugggauacuuagggagauucaccagcugcauuuuaugaaacccuaguucaagaaacauacuggaaaaggagauauggucacaaagaauaggagauguuucuaagggaaauaauaaauuaaaaugaaaguuacagugacuugugcucacugaaucuaaaacccagcugauuaaaaauuuggcaaaauaaaauuaaaaagguuaucugugcucguaaacaaaagucccauuuuuggccuuucagguuuuuuuccuccauaaucuuuauaauuaacauuacgaaguucuguaguuucuguucugcccccuccuuuacacucuaaaaaugcugccccaccccgccaauuucauuuaguauuuccuuuuuuuuuuuuuuuuuuuuuuauuugagauggagucucgcccgaucgccaggcuggagugcaguggcguaaucucggcucacugcaaucucugccuccuggguucaugccauucuccugccucagccucccgaguagcuuggauuacaggcacguggcacuacacccagcuaauuuuuguauuuuuaguagagucuggguucaccauguuggccagguuggucucaaucuccugaccucguggucugccugacuuggccuccgaaagugcugggaugagccaccgugcccagccuauuuaguauuucuuuacuaucaaaauaaucguccauuauuaacugauuuagcaaacuugggcaugccccucggucucuuuccaccuuuaguuguacuauguuaaaaaugagaaaguuauauucagguuuguuuuuuucacagaggaacauugcuagguuucucuguuagcauuagcaggguuuaauauuaacaguaaguauguccaugaugcuuuaaauacagaaugcuauuuuugagcagaguagagaugaacuucuagacaguggaacuuaacucauucacagagaaauguaaauguggucuucucauagaauauuuuuucucaugggauuugucugcuuguguucuguuaucccuucaauuguguagcugagggugcuuaucuuacugagugagucuuacuguuuuuuccccagguuuuauaguuuguucuugcuucugaacaaucagcaguuguuugccauuauugacaagaagucuagggcauagauuuucuugaucuguuuuucuuuuaauguuugaguucaauggauaagggaaacgguuguaugcauuuuauugcagacauucucugaaauaauuuuuagccacaagcaaauagcucuguuucugugagucaucauuucuucuuauauagugcuggauaaagaauucuauuuuguagauagagauuuaugacuuccagaaagaaagcugcaaaaauggaaguuuccaaagaauuuaagauuugcuauaauaaaugcuaucauauauugguguuugagaugcaaauguacauaucuguguaucauauauuggagguugauugaaaaucggaguuugagaugcaaguauagguaucugugguugaugcaguuuuccuaaaacgucaugauuuucaauggcaaguaaguuauuuauggucguuuuuaaggauaagcuguuaacguguuuuuuuuuucuuuuuuuuucagcuuccaauaaaaacaggacagcagaacacacauaccaaagucaguacugagcacaacaaggaaugucuaaucaauauuuccaaauacaaguuuucuuugguuauaagcggccucacuacuauuuuaaagaauguuaacaauauggugaguauuuggguuacuguguuuuggggaauuugcuuucuuuucuuuuugauuaaaaaguuuagaacagcauauuuugaaguauggaaagugauuuucuguggacuuuggauauaaccauuaaucuuauuuuguuuacgagcacagauaaccuuuuaauuuuauuuugucaaauuuuuaaucagcuggguuuuagauucagugagcacaaguaacuguaacuuucauuuuaauuuauuauuucccuuagaaacaucuccuaucuuuugugaccaugucuccuuuuccaguauguuucuugaauuaggauuucauagagcuuuuguggccuacacgaauugaccacaguaauccauuacacauauuuuucuuuagcaucuuguuugaauuuacuuacgguugucccagcccuaaguagaugauaaaauaugaucucauaguccuaaaauguggauugauuuuuuuaugaagauauguguuuuuucuuccuucuguaaccugugacagauucuguaguaguuacccuguuguugaaacaguuuuucucaaauaccaguuucaucaaauaauuccacuguuaaaagcucauaauuucuuucuucuucccauuuucuaaaaucgauugacguuuccuagacuucagaguacuccagcuguccucccucuguaccuuugaacauauaacaucuuuugucuuucucaagugaucccuuccucucucuaaauuccuauuuaacaucuccauucuaagcuguuucaaacuaacauacucaguucauggcaacugaucuggauuuuucuugauuaacucugaacucucugcugguguuuagcauuuauuuauuuauuuaugaaugaauaaaugaaugaaugaaugaaugacagggucucauucugucacccaggcuggagugcaguggcgcaaucucggcuuacuguaaccucccccuucccaguucaagugauuuugcugccucaggcuccccaguagcuggaauuacaggcaugugccaccaugcucggcuaauuuuuuuguauuuuuaguagagacgagguuucacuauuuuggccaggcuggucucaaacuccugacauuaggugauccgccugccucggccucccaaagugcugagauuacaggugugagccaccgcgcccagccugcauuuauaaucccaguuuguauuuguuuguauugaguugugaaacaacuucugguuauagauugugaagauuguucccccuuccuuuuuuuugagaugguccuuagguuuauuagauaauauucuaguaugacauugaaaagacaugaaguuaccuuuuugccuuauucccauauuuuagauaauuuuucucuuguucuauuuuauuuuuaacuggcauacaauaauuguacauguuuauggguacauauugauguuucaauacauauaauacauagugaucccacuaggguaauuagcauauccaucaucucaauauuuaucauuucuuuguguugggaauauugaauauucucuuguuauuugaaacuauauaauguuaacuguaggccaggcaugguggcucacgccuguaaucccagcacuuugggaggccaagacgggcggaucacgaggucaggagaucaagaccauccugucuaacauggugaaaccccgucucuacuaaaaaaaaaaaaaaaaaaaacuuagcgggguguggcggcaugugccuguagucccagcuacucaggaggcugagacaggagaauggcgugaacccgggaggcggagcuuguagugagccaggaugcgccacugcacuccagccugggugacagagugagacuccgucucaaaaaaaaaaaguuaacuauauaauguuaacauagucauucuacaguaguacagaacacuaagucuuauucuuccuauaaagcuauauuucuguauccuuuaacaaaucucuacccaccccgauucucccuacccgacccuucuuaccucuaguguccucucuucuacuuuuuacucuuuuuagcuuccacauaugagugagagcaugugguguuuaacuuuuuguucgcaucauccuugguguguuuccuuuuaagaaaguugcuuacacaauacccuaaacuuacaaaacuaauaaacuggagguguagaaaaucauuuaccuucuuuauggaaaaaauuaguauuuuccccccaaaagcaggaccauuuauaaauagguaaagagauuuacggaaagacauuuaacauuuuuuguagcuccucuguugcaguguguggggcacaguuuaguauuugcacauaugaauauguggcuguguucccaguuauauugaaauauuuuaauauuugggacccucuuuucaaaacaaaacagcauuguuauauuggcguucauuuagugcuuauuaaauaaguuuucaaaaccauagucucuuguuaauaaauacauauguaguauucauuuugaggauagugaguacuuaaaauucacuguggugcuauagcauguuuuugcuauaaaaauuaagacuuugaucauuucguggcauaaaaguauaguuaaauccccaauucaagauucugguacaggucuauaugugugucuaaauccuacauauuuuuaaagcaugaagcaaaacagcaucuuuuacuguuacaagguuaauggcagacucuaauaaaugccauuucuguuugccuuagacuuuaguuuuuaugaggauuaggauaaaaucagaaauaauauauuuaaguauaguauaaucugggagguaaaauggaagacuauuguugaucuuuuagucuuucacuuuucagauguguguugauugguagcagaaagugaaacuaacuuuuauguucugaauaucuuuucuguuagagaauauuuggagaagcugcugaaaaaaauuuauaucucucucaguugauuauauuggauacacuggaaaaaugucuugcugggguaaguaaauugaucuuaaguaggcaggcuuugugaauuugaucuugagaaugaucuuaugucccaaaguacagauguggaccaagaggacaguccuauggacuuuugucugagacauauaaauaugaguuuuguuaauauagcugaccuggugacagacaauuuuucaugagaaaauuuucucaucuuuuguaaauuaaacagauauuaaguuuacuuauaaaauguuauguuucagccacguaucugucucucagguuuuuaggaaaauauuuuaugaagagaucacuauuugauuuaacggaucucucagagaguugugggagagugcgauucagaaguccaagaguaaucuuguauuuccuccuauaugaauaugauuuuaauauucuacuuuugaaauuuauguaaaugagaacuuaaaaauuaaaccuauuaaggauagauguuaccuugagaacacuuguuuuauguagacacacaaauaugcgauagguauguggaggaggagaguaccaaacaauuauuucucugguuuccuguaaguuguuaccacaguguauuucaaccaugacuuaauuugaacuuuuucaagaguauuucuauuguguaaagaaaguauuucuauacaucauuauccuuaauucuuccuggaacaugguaagaguuuauauaaauauauaaauuaaauaccucuguuuuaaugaucugccuaauccauguguauugaaauuaacucauuucuuauguucucucuuccuuuggcucagaauucagaauuuuguuuugauucagaauugcuucccucuucacauauguugcaguucucuauagugaaacuaguugaaagagaccuuaauauaugaggacugauagugugguugagaaguguugguggaagcauugggguagggcauugaaaaaaaaauuauauugacacaacuguguaucccuagggaaggcuguaagcgaaaaaauguaagcauaauauguauauauauuuuucuuuugagacagagucucacucugcggcacaggcugaagugcaguggcacccucucggcucauugcaaccuccacuucccggguucaagcuauucucaugccucagccucccaaguagcugggauuacaggcauguaccaccaugcucagcuauuuuuuuuguauuuucauaagccauggggguucacuauguuggucaggcuaguuuugaacuccuauccucaagugauccgcccauuuuagccucccaaacuccugggauuacagaugugaaccacugugccugcccuaagcauaauauuuuaaauuuucuuauugaccguugaccauauuccaaaauuguggagacaguguuuauaaguuuucuacuuaaaaucgaaggugagcuaguuguuuuagcaugguauuuuccguuaacuugugauaugcuauuguucauguguaaaauggagugaaagagcaaaagagcuguuacauaggaugauggaacugggaagaugggcaaauuuuaaacuuuucuugaaucaguuuuuuccaguggucuuauuacuuugacugcaaauuaccaguauaucagccacacccaugacugaaugguggggcguggggucauauauugccuuguucaguuucacagcuuuucuccauuaacauuuguaauugagagguaauaaugaauguauuuuggagaaugauuaccgauauuauuggccucuguuugauuuaauacucuuugaagauagccuaauugaaaugcuaauaagugggccuaguauaacuuauguaaugcauaaaauguauauuaucuugccgugcucuacuguugaaaaauguguaugcuuuuucauuaaauuuacuauuuaaaaaguaaugcuauuuauauuauugaacaauuguuuuauuuccuucagugauuuuacagauguuucuugauucuuacuuuuaaaucaaaguaaauugaggcaguuuaagaagaacggagcucacaaguauacguuuguuauacauaguuggaauauuuaagugaaagaaaaauacuuaccaauauguuaugagugcaauuuuguagaauuugaggaaucuuaaguauuuuuguuccugugaauaugacuauuauuuaaaagauuuaauacuucuuagauuuuuauuuguuagaguuaacaucuguauuguuugguuagccuauaaacaagaaauaggcauuguaaugugaauucacagguuuuugugaagucuguuuauguacugucccuauguuucaguguauuugcaucugagagugcuuggauugcaguuacagaauugagcguagcauacaauuguacacauuuuuguucuuugccaucuugcucaguguuauuaaaauucuuauccgcauguaguuaucaagacuguuaggugaaauaguaauguggaacagcauaccuacaggauagcuuauccauugauuguguguuaauuguaaaguauauauuuacaaaguagagauuucacuguuaacaccgaaguuaucaaacuuggugucaauaacaggaccaccuggccuuauguucucauggugugauguaauauaaccuauagugaauccccuaaacuguuuaaccucaaucuaaucagaccauuagguuuaaauuuuagcuuacagaaaauauacaggccgggcaccauggcucacgccuggaaucccagcacuuugggagaucgagacaggcggagagcuugaggucaggaauccaagaccagccuggccaacauggcaaaaccccauaucugcuaaaaauacaaaaauuagccagaugugguggcacaugucuguagucccagcuacuugggaggcugaggcaggagaaccacuugaaaccaggaggcagagguuggagugagccaagauugcgccacugcacuccagccugggccacagagcgagacuccaucucaaaaaaaaaaaaaaaaaaaaaagaacgaaaauauacaauacaguaacuagaagagcaaaucaaccuaugucacuggaaaauaauuaaaucaaggauauggaacauucuguaaggcagcuggcccacuuaaagucaugggaaauaagaguggugaauaugggccaggcguaguggcucacgccuguaaucccagcacuuugggaggccgaggagggcggaucacuugaggucaggaguucgagaccagccuagccaacauggcaaaaccccgucucuacuaaaaauacaaaaauuagcugggcaugguggcgggcgccuguaaucccagcuauuagggaggcugaggcaggagaauugcuuuaacccuggagguggaaguugcagugagcugagauugcgcccuugcauagaauagugaaacuaaggaaacaucauguuguaaucggugaacuuuuuuggauccuuauugaauaaaaaugccuaugaaagacauuuugggggcaguggugaaauuugaauucagacuugguauuagaugauacaagggaauuguuuauuuuuccuugguguguuaauuguauugaaguuacauuagagaaaauucuuuuaagagaugccaaggcacauggggugaaguauucuauuuauaauuuacuuugaaaagauuucaaccaaaauaaaauuacuuugaguagguagugucuguuuuggucagucugcacaaaagcaagugugauggcucacccaggaauuuacuuaaaugucaagacagaugacacaaugcacucaucaaucaauaugaauuaagucgauucuguaauuguagaacucacagcaaacuggggauucccagggaagggcucguuuggugaacaagagagcaagcaggaaugggaggacugguaaggauggcagggggauugaacuuuaauugugauuauggggucagagauggaaccauccucuuuauuaaacuaucuauagacagauguagcaaauaugaugaaacguuaacaguuguuaaaucuaggugguguguauguaagguguucauuauuuuuguucuguguguguguuugaaaauuuucauaauagaaaauguuuacagguaaaauuaaaguuuagaauaaugugauuauuucuauuuuagcaaccaaaggacacaaugagauuagaugaaacgaugcuggucaaacaguugcugccagaaaucugccauuuucuucacaccugucgugaaggaaaccagcaugcagcugaacuucggaauucugccucugggguuuuauuuucucucagcugcaacaacuucaaugcagucuuuagucgcauuucuaccagguuaguguguaaauccacaugggacuacugaaguaauaugaauauuagaaguuuuguuuuuugucuacauaaaaauaaaaaguuaauggaaaugagguuuuuuuguuuuugagacaaguucuuuugccccucacagcagcuuugaccucccaggcuuaggugauccuccuaccucagccuccagagaaaugaguuugucugggcuugcguagaaauuuuaugcauuaauaucuuugacauuuuaauugcguaauauugugauauugauaugugcaauuaaauaagagcacuguuaugaaugugaaagucuaaauuucagauaaaaauaucugccgugagcaggcuuuaaaaaacaauacuagguaugaacuuuugguuuggcuuuuuaaacauauuaucccuuuaaaugaaacuacccaauuagauggaauaauuaaugagaguagucagaauucaaauacuuucacaacucuacccuuuaucacaagauuuuagguuaccaaaaaacaaaacaaaaacaaaaacaaaaaaaccuaagugaugugaaaacacaaggaggugaauaauugcaaaguagaauucuccagaaaguggacuacauuuuaaauguauguaaaauacugccauuuauugaguauuuauagcauuuccuuugcugucucauccucacaguaaccuugaugauacuucccucauuuuacaggugagcaaacuaauacucaaaaaaguucaggugaugugccaaauaauggaggacccaaaauuucuaagucaggcuggcuucagaauuuauauuaguuucacuauaccagauugcuucccuaucuauuuuagccacauuuugaugaaaucuguuuuauaaaauauacuucuguuuuuaaagauguaucaaaaauauaauuuaagcuuuuauugaugacucaaaaucauccugagcauuaguugugauaugcuaccuacagguggagaaauuaguauagguagugcucuaugggauagaauuauaagugacaguagcaaguagcugcaaauuguuguuaugcacaugauuugccuuucuaaggcaaguaaagucagauggguuauuaacuuaauuagaaacuauagcacaaauuauuuagugauucgugaaucgaagacuaauaccgaauagagaaaaacaauccucuuuguuggugccugcaucuuuggcucgucaguguuguacgaacaguggacuuugauuauucagauuuacugauuccuuuguuguuuuccagcaggugugaaagacaacauacaucaccauuugagaauuuguguuacgguuuuuugggggaauugauuaacuucagaguccugcaaucuuuuuaaucaacaaugacauuucuauaauuaagauccuaggcagcaauauuuuucaaccucaaugcaauucuugauccaaagaaaauuaaaguuuuauuuaaugguauauuauugauaaucuuggguaauauuuacaugauagaaaaauguuuucaugaaaucuuuugagcaguaacguuuuauauuaugaauaauaauacagugguugagucagcaagguaacaaacaccuagagaguaggaggguggaaaauuguauuuaauaaaaaacgcaaacccuuuucauuuaggugacugcuaggccggccuuacuauuugaaacaccuguuaaauuaaagguagaaagugguacaaaaaaacccaaaugucuuguagucuaucaaugcaugaacugccuuauagaacacaacaaaugugccaccuuggaaaauucuagaaaauuucuagucaccaaagguuuuacuuuaugggauuuugcagcauuagcacauguaaaaauaagcaacuuuuguuuauuuccugaaucuaguucacuguugccagaauagaaaccaagugucuaaaauuuuauuagcuuucagaggacagaccacucagaaauggcaucugugaaauaacauuguuucagacaacugcauuuucaguuccauuuagcuugugucagaaauaggagcugaucuuacugaaggaucacucaccuaaaagaccauuaugaugguuuaguuuagguuggaacaucuuaugcugucaucgucauaguauuaggugacuuaaaauauguguguggcuugaaugguaguucuuucuaaagauugaucuuauguuuuauauauaauagaugaaucaguaucaugaagauguuucguguuuguccauucuccccgucaauguuucuccuuuaagauuaagauuugguuuuuauauuucugaccuuuacuuuucuuuaggggaagauaggcuauagauuuauuuauuuuauguuuuugagacacagucucucucugucaccuagucuggagugcagugaugugaacaugucucacugcagccucgaccuccugggcucaagagauccucccaccucagccucuugaguagcugggacuacaggcacgugccaccaugcccggcuaguuucuuuaauuuuuuuguagagacggggucuugccauguugcccaggcuugucuugaaccccugggcucaagggauccuccugccuuggccucccaaaguguugggauuacaggaugugagcuaccaugccuggcuggcuauaaaucuuaagauagcuuuauuuuucucugggaguauaccauuuucuguggcuuauaguauuuauguagcggaguaacugcuuucuccacagaauuacuccacaaaugcaguugaucuaguuguuuuguagugagaaggugcuucagaauaucucauuugauauaccaccagaagcagaaaacucaaugacuuuaaaagucauuugguucuuuacaguuuacuauuugguuccauacaaaucuguucguuaugguuucuuacucuuuuuuuaaaaauaguuuucaguuuuuuuauaugucucugaucauuuaaaacguauuuuacguucucuuuaguauuguuuaauauugauuuguuugugcugauucauucauagugaauuguuucaucucaguuuuggaauccuugauugcaaaguuaucuuuaguguggccuguauuuucuuugagaauccuuguagccuugggcugagggaguguucuagugaugguuuugcauuugcauuugccaggugcccaguucuggagcuauuuuuuucuuaauuucucagucccagccuguaugggcaguauaaauuugaacccuaaacucuuagaagguaaacagcucuaggugacuuuuuucacuuuauccaaaguuuaggcagagcaguuaagcuucuuugugcugguagguuuuuuucuuuuuuucuuuuuguggggagugggggcggcagggggagugcauuguucuuucuaguucauguuuuaugcagggcccaaguuagaauccugaauuauuaggguacaaggcguuuauauccagucuccauguggauguuaagccccaagcuccuagguuaaggagaucaaaaaccucacucaucuuuccuuuguugcagggcugggucauguacuugugcacuuaacucucugguuuucaguuuucuucuucuuuucuggaccuauacauuuaaaauaucuuucaguaugccuagacuuucuagcuguuuuagugauagguuuucuacuguucauuucuuuugcucagacuacgcuuuauuugauuucucugcuucggaaaugauguuuaaccuucacaaaauaccugcucucuauaaggguaccagacuauaaaagggacaaaauuuuucucccauuuuucacaaacaaccacaagagucaacuuuucagaaguugguauugcugaucuaugauguuguguuuucugaggagccguacuccauauuucuacgcucuuugcagcagcuguggaauuuuuagcauugaggacaaccucauucccagcuugaaaugcugagcuuuucuuacccugaugauaggaagagaguucauguaagugcuuagaauaguuguacuguuagcuguagucuaauuaaagcuaaagugagugaaacgagaauuugagaaggaagaauaggauugauuacauucuuaucaacugaagguuuagugugaugauuaauaacuccuuugcaaauugcacuaaaugauugaaauucaaguuaauacauauaaauuauaagaccauauaguauuugugccuuuucaccauaucucuauugcugcauuuauaaaaguuuacaauuuaauugugcugcuuauauuuuuuaugucuauuaauaugaauaaugaguaugccucauuagguagcaugauuuaauagauuagcaauaccaacuuuugaaaaucugagugcugugguuguugguguaaaauggaagaaaaguuuaaugccuuuuauuaacauuuaggcuaagugaauuucuuuuaucaguuuaaaaauaucuacauauuuguuaaguguuaaauguuucuacguuugugauaacuucauauucaacauaggagaagcugggguuuaaacagauauuccuguccuuauaagcuuauguucugugaaguagggauauuaagcaaauaauuacauaaauacauguacaaacugugaaaagugcaaugaaaaaaggcuuacucgguuuucaaauacaaaguaaauguacccugugaauauaaaguuucauucguguuucaaaaaucuaguugauaaaaguagaaguuaguaaaaucaaguuuacuuauuauaguuuuagucuuaauucaaauuauacuuuuacuuguaauuggaaauaugaauuuuuaaaacuauucauuguggaaaaauggaaaaauacacauagaauaguacuucaaauccccaugcaucucuuacucugcuuuaacuguuucuggcaugcuaugguuucucuucuucccuuuucaguaauuuaaagcaaaccccagacaucauuucaccuguaaauauuucaguauauaucucuaauaaauagauuuuuaagcauuuaacuauaauauugucauaccuaucaagaaucauaauuccuuaauaucaugcauugccaaauuuguggguuuuuucauuaucucagaaauggcuuuuuuguuuuguucaaauuaagauacaaauaggaugcguacuuuggaauugguugauauuucuccugagccucuguuaaucaguaucauuucuucauuucuucaccuugcucuccauuuuuucccaugcuguuuauuuguuggacugcguuauuugccuuucuacauucuguauuuggguuucauuggauucacguucauuuggcuggggggggacaagaauacuuuacugaugaugcuaugugguuccuaaugaaucacaucaggaaacauguccuauuauugacuuuuaauguuaugaucagugauuggauuucgauguuaucagcauuauguauucauuauacaguuucccauaaauuuuuccuaauguuuuuaguaaucacugaugaucacugccuggauuccacuucauugggggcugcaaaaugaaacguuuucuauucugucauucauucuuuauuuuaaaauugugacuucuaugaaagauuuuugcuucauuguguguuuaguuaucuugcaauacaguccauguagggaaugcaggauacagacuugacuuccauuauucguuaucagaaugaguugguacccuaacaguugcgaaagguuacccaugaaguuuuuucuuucaauauuauaacaggcuuguguguuuuaauuuauuguauguguuuccauuguagacauaauucuuuugauccucagauuaucccauuuuugacaguugagaugccuaaagugcauaccugugugauauuugacaugguucugauaguuguugauaguuuccuguuuucaagcccaaggugaccugcccucaccuuguauaucucuugcccccauccuggaauuaacuaauuuucccaaagaacccuggccgaaagucggcaauauuuagacaccucaaucuuaaggauaaggaugcuacgaugcuacguuuacugaauuaucaugguuucuuuuaucauaucccuuguuuguuauguuccuuuagguuuuuauaagaaauauuuauugccuuauuuuuauauaugucuuuacucuuaugaacucaucuuugggggaagaaucuguugaauucagaauuuagggauacccgaagacuuuuuuuguuuuuguuuuuuuuaagagauagggcccacucuguuacucaggcugaaguacaguggugugaucacagcucauugcagcuucaaacuucuaggcucaagagauccuccucccuuagccuccugaguagcugggccuauaggugugugccaucaugcccagcuaauuuuuguauuuuuuuuagagaugaugucuugcuauguugcccaggcuggucuugaacuccuggccucaagugguccuccugccuuggccuccugaagugcugggauuacaggugugagauaccacaccuguccccuaauacuuaauuugauaaguuaauuuugguuuuuacuuuuuagguuacaggaauuaacuguuuguucagaagacaauguugauguucaugauauagaauuguuacaguauaucaauguggauugugcaaaauuaaaacgacuccugaaggguaaguuuaaauguauaauauaucugaaaaaaaucacugggucaaaaacuaguaucaugaauguacuaauuauauuaauugugcugaacuagaacaccaaacuggauuuuauaaugacauuuccuugugaaauaaccaguaauacaaauggguaauuauuuuucaaucuuugaaaauaaugcaguagagaaaaugagcauuuuaaaucuuggcaauggaaaguuuugcuuaacuacaauuuuuguuuucaauacagagaaugcaagggugcuauuauuucauuuuucuggaauuugaucucucaaggguggcuauagguuauagaagcuaucuguuuagcuauuguagcacuuuacaaagauugucuguaguaggauaucaaaguuuuauugcagaauggaacgaggagauugugauguuauggugagaggaugaauugagccagagauuucauuucugacauuucuguuuucagcucucuacugacugacuuuauagcauuacaaagucccuuaaccuuccauugccgguuuugucuccuuguagaacaugucaguaguaguuccacauggggauauuauaacaccuaauaugugacuuuaaagcuugggaaguacuuuacaugauuauguggauugaaauaaacgaucagaaggaauugagauauguucuguaguaagcagugauguguuaauguaaaucagauaccaaugaguauucauaaacugaguaugaucugaaggaauugagauaaauucugugguaagcagugauguauucauguaaaucagauaucaaugaauauucauaaacugaguaugaauaucuaaauuucauuuuacaaaaaaauguuuuuuaguuuuuggcauuauuagacccuggcuaauuuagauaugaaaccguauacaguucacacauauuuuuauuuguaacuuaaggaauugucaaacaauaauauuuuuaauaucugaccuaaaacagauugaauuauauuagcuucagaaacaucaguucugcaauguaguuuucaaaauacguguuuuuguuuucuuaauauuuccuuuaaacucaauaacuaucucaccagagauguaaaaaggcaauaccuauauaaaggaauaauauaaagcuguguucuauucauauuacccuuguucauaauuuaugauuuuaggucauuaccauugugaaaccaagcaacaauuaauucaguaacuuuaauaaaggaaaauauaggggugauuuuagcuguuaugccaagauacaaacauguggacagcaauuauuuuagauuauaauaaaccaccauugaauuaauaguugagauuugcaagauuuugauaucuauuauuaagcguugagcaguugagaaacugaaugguaaaauuuagagaucucuaugaauuaaaguuaagaaguauuagugggauuuuaugauuuuucauaacuauucagugauguuuuggaaacaagucuaguccagguugccugugaauagcuguuuaaaacaauagaaauguucaauccguaauaauuaacugaaaugucucuucuguccaaauaagagaaacuaauugaauguguggauaaaugacuuucuuuuauacugaaguaacuuucccaucgaaugcggcucccucaugaacauaaauuuagaguauaugcugauaaauauauaaaguauaaaaccgauauuaaauaggccagcaaaauauggcucuuggugacagugguaaaaggaaugcacccuuucaguaaugaguaguaaagguaguaauguguuuuaaauacaacucaacaagccuuuguugagaaacuauguauaagaagccaugcuaagugcugggauuacaaaaauuaauaaaauauggaaucugucccuaaggagcucauggcaugguuuaugagacaagugaugucauuaucaaguuauuugcagaaaaaaacuaugauaaacucaaauagggugaguguaaagugagagaggaaguauauauuuguuugaggggaugagagaugagcaagaugugaagguacaagaauaggucagaucauuuuaauaaaaauauggccaggccugguggcucacacauguaauccccacacuuuggggaagccgaggcaggaggauugcuugagccagggcaacauagagagacccccauauauacaaaaaaaaauuagcugggugugcugacacgcaccuguagucccagcuacuugggaggcugaggugggaggaucacuugagcccaggaagagguugagguugcaguaagcugugauugugccacugcauuccagccuggguaacagagugagauccugucucugucugucucucugucucucugucucucucucucucucucucuuucucucuuucucucgauauaccuaucuguauauagauauaucaaucgauauguguauauccagaucugucuauagauauaucuguaucuugauagauauaucgagagagagagagaaacauuuguuauauuuucagucugcaccgggccuugcgcuaugcaguuugcaugccuuuucucaucaauucuuacaauaacccugugacgcaauacuaguauuaauauuaucaucucuuguguagaugaggaaacugaggccucaguaaauuuucaaagucacagagcuaguaauuguucaguaaagauugaguucacaucugcucgucucuagaaccuagauacuugacugcugcacuguugugcuuaugaguuacgaagcuuuauuuuaguggcccugggaagugauagaaaggcuuugagguagagaauaccuuaaucaguauuuuauuuuagauauaccccuuugcuugaaauuugcaggauggcuugguagaggguuaccugaacuucugggacuugguuaugcaguaauauaagugaaaaauaaugagaguuguggagauccagaugauggauugggguaggguaaggauggggaccaguuugauagguauuuaaagaaguggaggcugggcgcaguggcucacaccuguaaucccagcacuuuguuaggcuaaggugggcggaucacugagguuaggaguucgagaccagccuggccaacauggggaaacuccgucuccauuaaaaauacaaaaaaugggcugggcgcgguggcucacgccuguaaucccagcacuuugggaggcugaggcagguggaucacgaggucaggagaccauccuggcuaacacggugaaacacugucucuacuagaaauacaaaaaauuagccagucguaguggugggcgccuguagucccagcuucuugggaggcugaggcaggagaauggcaugaacccgggaggcagagcuugcagugagccgagauugugccacugcacuccagccugggcaacagagugauacuccgucucuaaauaaauaaauaaaauaaaauaaaaauacaaaaaauuagccgggugugguggcacgugcccauaaucccagcuacucggguggccgaggcacagcagaaucgcuugagccugggagauggagguuguagugagccgagaucacgccauugcacuccagcuuggacaacaagaccgaaacuccaucuaaaaaaaaaaaaaaagaaauggaauacauagcauuugauagucaauuuagauauaugagguuagagagauaucaccaaauauuacagaauaagcugguuagagcagaaaagggaaggaaagguugauggcagaagagaggguuugaccaggaaaaugauaaauucaguuuuagaucuucugaguuugagguaucaguaggauguccaacaagaaacuuguagaacugaaagauacuuuggcuuugagaguagauuaugguauauaacacauuuaagaugucauaaagguaaaguuguugcuaaagagcacugugaagaguaaugucauuauuuggaaaucaguggagggugagagcaaagagaauucaaagggguacuuuuaaaaacugauuuggagaguuacuuauuugcaaguccagaaaaaagacucaucucucucuuagacacuuacauagauguaauaaaaaccuuuaucccuucauuaaaagucaacaggagaaguucuuugccgagggaccauugccaguaaaaucgcuuauagacaggucauuuuuuccaaacauaaaucuuuuucuagauguggacaauaaacuuaaagaagaagaaauuaaaauacccaauauauuuauauggagaaauguuuacuguuacuugcguuaaaaugcagucuacuauuuugaacacuccaauuagcaaaauaaagaaaaugaacauacuuuuaugaugacaaagauaggaugaaggcacuuucguaugcugcuuggugauagcagcauuuggcccaacccuagugaaaggcagcuugguaaucuuuaucaagggcccuaaaaauauucaucucuuugacuggacacuucuagagauuccuuaucuuaaauaagcagugaugugggaaaagauguugauaugaaaauauuuguuaauguuauuuauaauagugaaauaacagaaauaaccucaguguuaaaacuggaaaacauuaaauaaccagucacuuaauacagugacuuaaauauuaugaggggcaucaaagcauacugaaaagaccuugguuuuaaagcccaauucaaucauuuauuagaucuguaaccuuagacacacaguuuguucaucuguaauacucugaaaacauuaagauucaaaaagaauuaaguguaucauacuaaaaauacaugauauguuuuaauaguuuguguaauaguuacuauugcauauagagccaucaaaaauaggccaggcacaguggcucacaccuguaaucccagcacuuugggaggccuacgugggcggaucaugaggucaggaguucgagaccagccugacgaacauggugaaaccccaucucuacuaaaaauacaaaaauuagcuggguguaguggcgcacgccuguaaucccagcuacuggggaggcugaagcaggagaaucgcuugaaccugggagacggagguugcgugagccaaaauugugccauugcacuccagccugagcgacagagcaagacuccaucucaaaaaaaaaaaaaaaaaaaaaaaaagaguuuuuacugauacagaaauaauuagggauacuauggaaaagaacagguuugauacagcuuauaugaucucaguuauguuaaauauauuuguuuucuacaugcauaggaaaagugguagaaguaaaaccaccagauguuaacugugauugucucugaaugauagaaucauugaugguuuuaaaaauuucccauaaacaccugugcuuuugcuuuuuuuuuuuuuuuuuuuuuuuggacagagucuugcucugucgcucaggcuggcaugcagugacaugauuauaguacacuguagccuugaaauccugggcucaagcuaucuucccacuccugcuuucgaaagugcugagauuauaggcgugagccaucgggccuggcccuguauauguuuuccaaauuuuuuaauuauacuuuaaguucugggguacauguguagaacaugcagguuuguuacauagguguccaugugccauggugguuugcugcacccaucaacgcaucaucuaccuuagguauuuuuccuaaugcuaucccuuaccucagcccccaccccccgacaggcaccgaugcgugaugguccucucccuguguacauguguucuuaugguucaucucccacuuaugagugagaacaugugguguuugguuuucuguucuuguguuugcugaaaaugaugguuuccagcuucauccaugucccugcaaaggacgggaacuuauccuuuucuaugucagcauaguauucugugguguauaugugccacauuuucuuuauccagucuaucauugaugggcauuuggauugguuccaagucuuugcuguugugaacagugcugcaguaaacauacgugugcaugugucuuuauagcagaaugauuuguaauccuuuggguauauacccaguaaugggauggcugggucaaaugguauuucuaguucuagauccuugaggaaucgccacacugucuuccacaaugguugaacuaauuuacacucccaccaacaguguaaaaguguuccuauuucuccacauucucuccagcaucuuuucuuuccugacuuuuuaaugaucgccauucuuacuggcgugagaugguaucucauugugguuuugauuugcauuucuguaaugaccagugauaaugagcuuuucuuuauauguuuguugucuucuuuugagaagugucuguucauauccuucaucuacuuuuuaaugggguuguuuguguuuuucuuguaaauuuaaguucuuuguagguucugguuauuagcccuuugucagauggguagauugcaaaaauuuucucccauucuguagguugccuguucacuccgaugguaguuucuuuugcuaugcagaagcucuuuaguuuaauuagaucccauuugucaauuuuggcauuuguugucauugcuuuugguguuucagucaugaagucuuuccccaugccuauguccugaaugguauugccuagguuucuuucuaggguuuuuaugguuuuaggucuuauguuuaagucuuuaaucuaucuugaguuaauuauuguauaagguguaaggaaaggguccaguuucaguuuucugcauauggcuagccaguuuugccaguaccauuuauuaaauagggaauccuuuccccauugcuuguuuuugucagguuugucaaagaucagaugguuguagaugugugguguuauuucugaggccucuguucuguuccauuggucuauguaucuguuuugguaccaguaccaugcuguuuugguuacuguagccuuguauaguuugaagucagguagugugauuccuccagcuuuguucuuuuugcuuaggauugucgugguuaugcgggcucuuuucugguuucauaugaaauuuaaaguaguuuuuucuaauucugugaagaaagucagugguaguuugauggggauagcauugaaucuauaaauugcuuugggcaguacggccauuuucacgauauugauucuuccuaucgaugagcauggaauguuuuuccguuuguuuguguccucucuggcuggcaucuggcaggugccccucugggacaaagcuuccagagguaggaacacgcagcaaucuuuguuguuccgcagccucugcuggugauacucuggcaaacagggucuggaguggaccuccagcaaacuccagcagaccugcagcagaggguucugccuguuagaaggaaaacuaagaaaggaauaguaucaucaucaacaucaaagaccaaagguagauaaauccacaaaaaugggaagaaaccagugcaaaaaggcugaaaaaaaaacgagcacgccucuucuccuccaaaggaucacaacuccuuaccagcaaaggaacgaaacuggacaaagaaugaguuugacaaauugacagaaguaggcuucagaagauggguaauaacaaacuccuccaagcuaaaagagcauguucuaacccaaugcaaggaagcuaagaaccuggaaaaaagguuagacgaauugcugacuagaauaaccaucuuagagaagaacauaaaugaccugauggagcugaaaaauacagcaugagaacuucgugaagcauacacaaguaucaauagccaaaucaaucaagcagaagaaaggauaucagagauugaagaucaacucaaugaaauaaagcgagaagacaagauuagagaaaaaagagugaaaagaaaugaacaaagccuccaagaaauaugggacuaugugaaaagaccaaaucuacauuugguuaguguaccugaaagugauggggaggauggaaaaaguuggaaaacacucuucaggauauuagcaggagaacuuccccaaccuagcaaggcaggccaacauucaaauucaggaaauacagagaacacuacaaagauaauccucgagaagagcaaccccaagacauauaaucgucagauucaccaagguugaaaugaaggaaaaaauauuaagggcagccagagagaaaggucggguuacccacaaagggaagcccaucagacugacagcagaucucuaggcagaaacccuacaagccagaauagagugggggccaauauucaacauucuuaaagaaaagaauuuucaucacagaauuucauauccaggcaaacuaagcuucauaagcgaaggagaaauaaaauacuuuacagacaagcaaaugcugagagauuuugucaccaccaggccugccuuacaagagcuccugaaggaagcacuaagcauggaaaggaacaacugguaccaaccacugcaaaaacauaacaaauuguaaagaccaucuaugcugugaagaaacugcaucaacuaaugggcuaaauaaccagcuagcaucauaauaacaaauucacacauaacacuauuaaccuuaaauguaaacgggcuaaaugccccaauuaaaagacacagacuggcaaauuggauaaagagucaagacccaucacugugcuguauucaggagacccaucucacaugcaaaguuacacauaggcucaaaauaaaggguuggaggaagauuuaccaagcaaauggaaagcaaaaaaaaguaggguugcaauccuagucucugauaaaacagacuuuaaaccaacaaaaaagaucaaaagagucaaagaaggguauuacauaaugguaaagagaucagugcaacaacaagagcuaacuacccuaaauauauaugcacccaauacaggaacacccagauucauaaagcaaguccuuagagaccuacaaagagacuuagacucccacacaauaauaaugggagacuuuaacaccccacugucaacauuagacagaucaacgagacagaaaguuaacaaggauauccaggaguugaacucagcccugcaccaaguggaccuaauagacaucugcagaacucuccaccccaaaucaacagaauguauauucuucucagcaccacauugcacuuauuccaaaauugaccacauaauuggaauacaacacuccucagcaaaugccaaagaauggaaaucauaacaaagacucucagaccacagugcaaucaaacuagaacucaggauuaaggaacucacucuaaaccacacaacuacauggaaacugaacaaccugcuccugaaugacuacugggaagauaacaaaaugaaggcagaaauaaagauguucuuugaaaccaaugagaaaaauacacaacguaccaaaaccucugggauacauuuauagcaguguguagagggaaauuuauagcacuaaaugcccacaagauaaagcaggaaagaucuaaaauugacacccuaacaucacaauuaaaagaacuagagaagcaagagcaaacaaauucaaaagcuagcagaggacaagaaauaacuaagaucagagcagaacugaaggagauagagacacgaaaaaccuuucaaaaaaucaaugagucuccugaccucgugauccgccgccuuggccucagugaaaccccaucucuacuaaaaauacaaaaaaauuagccgggcaugguggcaggcaccuguagucccagcuacucgggagccugaggcaggagaauggcgugcacccgggaggcagagcuugcagugagccaggaucgugcaacugcacuccaaccugggcgacagagcaagacucuguuuaaaaaaaaaaaaaaaucaaugaauccaggagcugguuuuuugaaaagaucaacaaaauaaauagaccacuagccagacucauaaagaagaaagagaggagaaucaaauagacgcaauaaaaaaugauaaaagggauaucaccaccgaucccacagaaauacaaacuaccaucagagaauacuauaaacaccucugugcaaauaaacuagaaaaucuagcaguaauggauaaauuccuggacacauacacccucccaagacuaaaccaggaagaagucgaaucccugaauagaccaauaacaaguucugaaauugaggcaauaauuaauagccuaccaaccaaaaaaaguccaggaccagauggauucacagccagauucagcuagaggaggagcugguaccauuccuucugaaacuauuucaaacaauagaaaaagagugaauccucccuaacucauuuuaugaggccagcaucauggucauaccaaaaccuggcagagacacaacaacaagagaaaauuuuaggcugauaucccugaugaacaucgaugcaaaaauccucaauaaaauaauggcaaacugaauccaacaagcacaucaaaaagcuuguccaccaugaucaaguuggcuucaucccugggaugcaaggcugguuucaacauaugcaaaucaaugaaaguaauccaucacguaaacagaaccaaugacaaaaaccacaugauuaucucaauagauacagaaaaggccuuugaugaaauucaacagcccuucaugccaaagacucugaauaaacuagggauugaucaaacauaucucaaaauaauaagagcuauuuaugacaaacccacagccaauaucauacugaaugggcaaaaacuggaaggauucccuuugaaaacuggcacaagacaaggaugcccucucucaccacuccuauucaaacuaauauuggaaguucuggccagggcaaucaggcaagagaaagaaauaaaggguauucgguuaggaaaagagaaagucaaauugccucuguuugcagaugacaugguuguauguuuagaaaaccccaucgucucagcccaaaaucuccuuaagcugauaagcaacuucagcaaagucucaggauacaaaaucaaugugcaaaaaucacaagcauuccuauacaccaauaacagacaaacagagagccaaaucaugagugaacucccauucacaacugcuacaaagagaauaaaauaccuaggaauccaacuuacaagggaugugaaggaccucuucaaggagaacuacaaaccacugcucuaggaaauaagagaggacacaaauggaaaacaauuccaugcucauggauaggaggaaccaauauccuguauguguuuuauacuuuuuuuugaaaaagcaaguuauuaaaagaaaaagcucacaaucauugauguccaaggcauauuugcuguuuauggaauuuuucuuuccuagcagacaacuaucgaguuuuggguuuauguuaggugucuuuaccuuucauugcuuacagauaauauuggagcaaaaguaauacguaaauggaaaguuauuuugcucugaguuguauuuguguuaacuuauucuagaguuaauuuuuaaaaauuguguuuuuuccagaaacagcauuuaaauuuaaagcccuaaagaagguugcgcaguuagcaguuauaaauagccuggaaaagguaaguuacaaccucucugguauuaaaauuuuguuuuugauguaaaauuugcuguuguuagcauccugaaucaaaaaguuaugacuugagugauaguuucacauucauuuucaggaagaauacauuguaauauuauuaugaaggaaguuagaaguuugugacauuuuauuuacuguauuacaaaaaaucacuguaaagacaugugguucuuuauuuauaggcauuuuggaacuggguagaaaauuauccagaugaauuuacaaaacuguaccagaucccacagacugauauggcugguaaggauacgauugauuuuuuuuuuuuuuuugucuuuuaaaugccuacuugugacauaaaaaccuaucaucguuuuccaaguuauuuuuguuauaaaggugcuuuuacaucuucuauugucaacuggugucaaauaggaaauacuguuuuucucuuacauuucuaaauuaggcccaacccucuuccuuuccuuggagcaaacaaaguaguuugaaaugaaggucagaucuuuagagcugugauaggaugggguguuuggcucuuuguuguagagaagcaugugcucugaagcuuuauuuuguauuuagggagauguguauaaaguaguaauauucucaccuauaauguaagacacaacugcaaggcagagaauacagacuccuggagaacuuugguaauucuuuuugggaagcuguucagucuuuguugcuuggguacaucacacuuugcauaaggcccuucacagugagacugaauacaugaucauccauucuaaaaugugagcuuuuccaggauagaucaagauagcucuucuaacacauagacaguauuacauugcuugucuacuuaccagaaugcauuuguguaguugcuuaaaugaaguuccauguuuaucuuuuaaaaauguugcccuuggguuuuuacauagugucagcuuuuacuuuaaugccagggauuuuguuccuaucuaauaaugucauuuaauauauuuuucaugcagaaugugcagaaaagcuauuugacuugguggaugguuuugcugaaagcaccaaacguaaagcagcaguuuggccacuacaaaucauucuccuuaucuuguguccagaaauaauccaggauauauccaaagacgugguugaugaaaacaacaugaauaagguaaggagggcaaaauuauuuccauuauaucuagaugugaagcaguuuauuuuacucaagguguguauuacuuuaggcuuauuauuuaagcaaaguauuucagggaaccauuuaaaugaucauuuuagguuucuuuguuugauggacuuagaagagacauacucauacauaauuuuauuuggcagagggaaaauaauaccaggcaaugaacaaagauuuaaaauaaucccuuaguuucauucuuuugucugagaagacuaaacgauaccucuguuauuauuaaacguaguuucucuaauauucacuacaaggauugcccuacuugaguucaucacuuuuauaguguguuauuugcauguacuuaggguauguguccauauagugcuacugaaauuaucuaguaacucauuuuaaguauuuuagaacaguuuucaaagaauuuugccaggaagguaaggcucucgcauauaccaucuauagugaaauuggcaccaugacaacugguaauucuaggaggcucuuaaaauuuuuuuaaauaucaccuaggugauugaaaaaaaaaagaacugaguauuaauccuaggguuuuacugaaauuucaauaugcaguuuguuuugcaaauauuuuuuuuuucauuuuuugcugcuuuuggagaaauacucuuagcuggcugaacaugagaugguuuccuucaugguuugccuguagauggagauguucagaaucagcugaaugauuuauuacuuuguagaaguauuggaccgggaauuuauacauuaaaggguaaauaaaugaaccagguaauccuugagagucugugauugcguguuacuccacuuagguguauaucucaacuuuuccauuaugaggacaccauuuuucaugguagauuguuuuggagcccuucaaaauaguagguuugaugauaaauacugagugucaacuugauuggauugaaggauacaaaguauugauccuggguguaucugugaaguuguugccaaaggagauuaacauuugagucagugggcugggaaaggcagacccacccuuaaucuggguggugcaccaucuaaucagcugccagcauggcuggaguauaagcaggcagaaaaaugugaaaagagagacgggccuagccucccagccuacaucuuucuccuguguuggaugcuuccugcccucgaacaucagacuccaaguucuuuaguuuuggaacuuggacuggcucuucuugccucuuagccugcagacggccuauugugggaccuugugaucgugcuaguuaauaguuaauauccccuuuauauaaauauucuauuacuucugucccucuagagaacccuaauagagauuuugguacaaggagugugguucuagaggaacggaguauuaaggauggaguuucuuaguuuguuuggggguuucuggaguuugcugcuuaauaugauuagacccuaaaauauuaaggacucuacuucuaauauuguggagaacacugauagucguugcugugaacuguuuagagaguuugcaaaauaaaugcauuugacacuccugauucaccgcuaaugagaggcaaggaguuuagugacccuauacauaauaauaccuuugaccauauauggagaaccaaggaacauaaugaagcugguugguugcuccuaaauucaguggacaaaguggugaaagaaaaugaugggccgggcgcgguggcucacgccuguaaucccagcacuuugggaggccgaggcgggcggaucacgaggucaggagaucgagaccauccuggcuaacacggugaaacccugucucuacuaaaaauacaaaaaauuagccgggcgagguggcgggcgccuguagucccagcuacuccggaggcugaggcaggagaauggcgugaaccccagggggcggagccugcagugagccgagauugcgccacugcacuccagccugggcgacagcgagacuccgucucaaaaaaaaaaaauaaaaaaaaaaaauaaaaaaauaaaauagaaaaugaugagcucagggauucugucuccugucuucagaagcagauacugagccucaaaucugcuaagauugaccugagugagacccuuaucuccuguagaaaaagagcugaaauugugaaaaaacaaacacaaacucuuaucaugcaaguggcugaccugcaacaaaaggugcauguacagccuaaccaggugucuacuguuaaagugugggcauugauuggaaaagaaugggacccugcaacuuggaaagggcaugugugggaggacccugaugaagcuggggacucugaguuuguaaacucugaugaaccuuuuuugccagaagaaacagcuuccccauccccaguaguggcaacauccccucccugagccaugcugccaucagccuuuccacuuuugucugaagagauaaacccugcgcugccugaggcaacaggaauggccuccccugaggcaguugccaggcaagauaauguugauucuccucagaagccacccccaacaccccuguuugcuucuagaccuauaaccagacuaaaguccuagcaggucccuagaggugaggcugagagugugacccaugaggaggugcgcuacacucguaaagaacugcuugaguuuucuaauuuauauaaacaaaucuuacuuggagagaccuuggucauguuucacuuccacaacauaugacacuggucuauuacauuaaugauauuaugcugauuggauucugugagcaagaaguagcaaacgcacuggacuuauuggugagacguuugggugccagaggaugggaaauaaauccgaguaaaacuuagggaccuucuaccucaguaaaauuucuagggcuucagggguguggggccugucaagauauucuuucuaaggugaagaauauugcugcauuuggccccuccuacaaaaaagaaagaggcacaaugccuagugggccuacuuggauuuuggaggcaccauuccucauuuagguguguuacucuggcccauuuauccagugacccaaagaacugccaguuuugagugggguccagaacaggagaaggcucugcaacagguccaggcugcugugcaagcugcucugccacuugggccauaugacccaacagauccaauggugcuugaagugucaguggcagauaaggaugcuguuucgagccuuuggcaggcccccauagguaaaucacagcggaggccucuaggauuuuggagcaaggcccugccaucuucugcagauaacuacucuccuuuugagauacagcucuugaccuguuacugggcuuugguggaaacggaauguuuaacugugggucuucaagucaccuugugaccugaacugccuaucuaugaacuggguguguucugacccaucuagccguaaagugggucgugcacagcagcauuccaucaucaaguggaagugguacauacacgaucgggcucaagcagguccugaaggcacaaguaaguuacaugaggaaguggcucaaaugcccauggucuccacucaugccaccguaccuucucucuccccaccuauacugauagccucauagggaguucccuaugaucaguuggcagaggaagagaagacuagggccugguucgcagaugguucugcacaauaugcaggcaccaccugaaaguggacagcugcagcacuacagccccuuucuaggacaucccugaagcauaguggugaaggggaaucuucccagugggcagaacuuugagcagugcacgugguuguguacuuugcguggaaggagaaauggccagaugugcgauuauauacugauucaugggcuggagccagugguuuggcuggauggucagggacuuggaagaagcaugauuggaaaauuggugacaaagagauuugaggaagagguauguggauagaccucucugagugguuaaaaacugugauguuuguaucucaugugagugcucaccaacaggugaccucagcagagaaggauuuuaauaaucaaguggauagcgugaccuguucuguggaugccacuuagccucuuuccccagcuaccccucuccucgcccaaugggcccaugaacaaaguggccaugguggcagggauggaaguuaugcaugggcuuagcaacguggacuucacucaccaaggcugacuuggcuauggccacugcugaguguccaauuugccagcagcagagaccaacacugagcccuugauaugacaucauuccucagggugaucagccagcuaccuuguugauuauauuggaccucuuccaucacggaaagggcagagauuuguccucacuggaauagacacuuacuccugauauggguuugccuauccuguaugcaaugcuucugccaagauuaccaugcaugggcucaccaaaggccuuacccaccaucaugguauuccacacagcauugccucugaccaaggcacucacuuuacagcuaaagaagugugccagugggcucaugcucauggaauucacuguuuuuguuuguuuguuuuuugagauggaguguugcucuguugccaggcuggagugcaguggcgcgaucucggcucacugcaaccucugccucccagguucaagcgauucuccugccucagccuuccgaguaccugggacuauaggugugcgccaccacgcccagcuaauuuuuguauuuuuaguagugaugggguuucaccauguuggccaggauggucucaaucucuugaccuuguaucugccccccucggccucccaaagucuaggauuacaggcaugagccaaugugccuggccacacuggucuuaaccauguucccaaccauccugaagcagcuggauugguagaacaguggaauggccuuuugaagucacaauuacaaugccaacuagaagacaguacuuugcagggcuggagcaaaguuuuccagaaggcuguguaugcucugaaucaguguccaauauaugguacuguuucucccauagccaggauucccggguccaggaaucacucaccaucaccccuagugauccacuagaaaauuuuucuucccguucuugagacauuauguucugcuggccuagaggucuuaguuccagagggaggaacgcugccaccaggagacacaacaacgauuccauuaaacuggaaguuaagauugccaccuggacacacuuugggcuccuccuaccuuuaagucaacaggcuaagaagggaguuacaguguuggcuggggugauugacccugacuaucaagaugaaaucagucuacuacuccauagcggagguaaagaagaguaugcauggagauccauuagggcgucuuuuaguauuaccauguauugccaugcccugugauuaagguaaaugggaaacuacaacagccccauccaggcaggacuacaaaugacccagacccuucaggaaugaagguuugggucacucuaccaggaaaaaaaccaccaccugcugaggugcuugcugaaggcaaagggaauacagaauggcuaguagaagaagguagucaucaauaccagcuacgacugcaugaccagcugcagaaacaacuguaauugucaugaguauuuccuccuccuuuuguuaaaaacauguuugugcauguauacaccuguacuaagaaaauaucuucauuuuauuuccuuuuucuuuuaucauaugacuuaagauuuauugacuucacaucagcauuuuaaguauuguuaacuuuuaguauuuggguugggauagguguguuucugguuguacgaaggauaauuguauuauguuaggcauaauuaugacuuuauugucuuuauuuaaagauuauguaugaucucaggagauauguauggguucaaguugacaagggguggacuugugaugguuaauacuaagugucaacuugauuggauugaaggauacaaaguauugauccugggugugccugugaggguguugccaaaggagauugacauuugagucagugggcugggaaaggcagacccacccuuaaucuggcuggcuaccaucuaaucagcugccaguguggcuagaauauaagcaggcagaaaaaugugaaaaagagagaugggccuagccucccagccuccaucuuccuccugugcugguugcuuccugcccuccagcgucggucuucaaguucuucaguuuuggaacuuggacuggcucuccuugcuccucacccugcagacagccuauugugggaccucgugaucguguaaguuaaugcuuaauaaacuccccuuuguauaaguaucuauucccuuaauucugucccucuagagaacccugacuaauacaguaggguguuuuuuguuguuguuguuuauuggaaaaauagaaauaaauaaauaagcuauagauucaguaguacucgagugaauuuacguuuuaauaaucacaacuguagcuuucuaaguguuuacugguuauuuguguaucuucagggaauugcugauuuuuccauugaauuguuugucuuuuguugauuuguaaggguauauguguacauuuuuacuugguuucauuuuuaaacuuuaugaguucuuuuuacuauauagauauuuaaaauuugcauguagucaccucagccuuguuccuuuuugucuccuagcuuuuuuggucagaucucucuucccagaagauauuauucauuuuauugagauauaauucacauaucauaaaauuuacguuuuugaaguguaaaauucagcgauuuuaguacauuaacaaaguuguacaaucaucaccauuguuucugugcagaacauuuucaucuucccaaaaagaaacccguuaguaaucacucccuguuccucucgccucacucgcagcccuuggcaaccaguaaucuaguuuuuugucuauagauuuacuuaauucuaaacuagacauuucauacaaauggaaucauucagcauguuauguuuuugucuggcaggugccaagauuuuugaaguaugcuuuuuaauuuuuuucugguauuuucuagauuuaaaaguuuagauuuuuaaaucuuucuggauuaaaaagaaaaguauuuuuuuuuuuuuuuuuuuugagacgguguuucacucuuguugcccaggcuggagugcaauggcacaaucuccgcuuagugcaacccccgccucucggguucaagcgauucuccugccucagccuccugaguagcuggaauuacaggcaugcgccaccacgcccggcuaauuuuguaguuuuaguagagauggaguuucuccaugcuggucaggcuggucucgaacuccugaccucaggugaucugccugccucgggccucccaaagugcugggauuacaggcaugagccauugcgccuggcuaaaaaauguauuuuuaaaaauguauuacaaaaaaaaaaaaaaaaaaaagcuggccaugguggcaggcuccugugaucccagcuacucuggaggcugagccggggagaauugcuugaaccugggagguggagguugccaugagcugagaucaugccacugcacuccagccugggcgacagagcgagauuccaucucaaaaaacaaaaaaacaaaaaaaauaaaauaguauucucacccuuuucuacucacauuccuucugagcugguuaguguuauuggcugguauguauccuuccagucacaucuauuuacccauauauucaaaugcaaaauauacauacguagggugguggugguuguauuuuaaaaugaaauuauuuuaugcacauuacucugcaucguuguuuaucuaagaaaauauuuuagcuguuccucaaaauaguugauagagaucugacacauuccuuucaguauuagguaacauucuguuacacuaaugagccucauuuacucagccauuucacugaauggguggauauucagauguuuucaguuuuuugacacuuagcuaagccuuaaguaaauaucuuguucauauauccuuguuaacugaugcucuuaauucuauagacuagaaucuaaaaacuagggguuccugugucaagaacauuugcauuuaaaauuuguaauaguuauuacuagauuuacauuccccaauaguugcagcaggucagaguuucauccccacugaauugccuauuuuccugcauuuuugucaggauuagcuguuguuaaaucuuuaaaauuuugccacacuaauaaggugagauaguaucucaucucagguauucuuaccuucucuuucagagguaaacugugugaugugauggauauguuauuaccuugauugugguacucauuuuagaauguauaaguuuaucagaacaucauguuguacaccuuaaauauauacaauuuuuauuuuucaaucguaccucaauaaagcugaaaaaaugucauucagaaaggaagcaaacaguagauacuagcauuaaaaauauguuguaaauuuucaagcauagaaugauaacauaagguuaggaacaagaauauguguauagauuuaaauauuuaucucugugaauauuaauccauagauacaaauguugaaggcaaguuacaaucuugaagaaaaugaaaauuauguuguguaccuauaauaugaaaauaaaaaaucacacaaaggcauauaccuucacucaaggauguauacucgaguauacauauuauuuauaauagcgcaaauuugaaaacagcccaaaugucccucagcuggugaaugaauaaaccaguggugaugccuuggaacuguggaauacuauucagcaauaaaaaggaacuacugacucggcaacauguguaaaucucaaaaauauuaugcuaagugaaagaagccagggucaagagaugacauacuauaugauuucuuaaaacuuccagagaagacaaaauucaggacagaaagcagaucaguggaugccaggagugagaguuaggggaggaaauuuauugcaaaggagcaguaggggauugauuguggugauguuugaaauguucuaugucaugaucgugguuguaguuacaugacuauucugaaaguucauauuuaauaagugauauaaaagaaaaaaguauuaauggcuuaaacauuaauuuuccaaaugagagcacuaauuaaaauucucaaguguugagaacaaagauaguaucucauuguaauuuuuauucuuuuuaagguuagugagguuugaaaacaguucauauguuucuuugccauuugcauguuuucuuuugcaggugccuguugacuuccuuuaccuauuauucuguuauguugcuuccaguuccuuaugaauucgcggaacuuuuuguauauucagagcaguaauccuacauuuuuagucuguaaauguuuuuccagucaccuguuucuuuugacuauaguaucuuuuuuuaaaaagaaauauuugaaauguacaaagaauguaacaguuucccauacugcuauuaacauuuuuauauuuugcucaucuuuugagaaauuuauauauguguccacgaaaagagucaaacucuauaaaauauuuuaagagauuuauucugaaccaaauacgagugaccauggcccgugacacagccaucaggaguuccugagaacaugugcccaaagugguugggguacagcuugguuugauauauuuuaggaaggcaugaaacaucaaucagauacauuuaagaaauacauugguuugguuuagaaaggcgcgacaacucaaagugggggcuuccaggccauaaguaaauuuagacguugucugguugacgguugaguuugucugaagacuugggauuaauggaaaggaauguccagguuaagauaaaggauuguggagaccagauuuuguugugcagaggaaucucucagcagacuucagagagagagaagguuguaaaauguuucuuauuagaccuaaaagagugccuggcucuuagucgauuaaucuccuggaucuggaaaggaaagaaggaaaacaaagggaaaaggggauucucuauagaauguggauguuuuuuccccacaggagacuuugcacggcaaauuucaagguauggcaaggaaauauauuuuggggcuaaauauuuuuuccuugucucauaauguuaugccagagucagauugaaaaguaagucacgauauauagcgucaaauaaaacccaucugaugagaauuuaugguuuguagggcaugacuuccuagaccccuuagguaggaguuugggcaaguuaaaaaaucagagcuaaguccucacauggcuuuuaaaaauugugaauaaguaauacuuccauaaauucugauuuaauuacgaaucccacuaauuucuuuuuuuucuuucccagggacagccacugcaaaggguuaaauguauauucuuccagucuagcuuuuauauuuuuaugaggauggggagauagacagauagguauauaguucaguguuucucaaaguguggucuuuagaccagcagcaucagcgucaccuggaaauuugugagaaaugccaguucuuaguuucuaacuaaauacuuaguuucucacuaaaaacagccauuuuuauuaaguccuucaggugauugugaugcacauugaaguuugagaaccauuguucaucuaggucauugucuuuaacugcuguaugguguucccuaaauugaauauaccauuuuuuaaaaaagagacuaagucuugcuauuauguugcccaggcuggucucaaacuucugggcuuaugcgaucuucuuccaccucagccuucagauagcugcaacuauaagcaugcaccaccgcacccagcuugaauguaccauauuuuaaauuccauauugucaagcauuuaaguuacuuuucuuuaaaaaauuaacguuauugcaaaggaaacaauuggcagagugaaaagacaaccuacaggaugggagaaaauauuugcaaaguauguauccagcagaggauuaauauccagaauauacaaggaacucugauaucucaacagcaaaaaacaaaacaaaacaaaacaaaacaacaacaaaaaauuuaaaaaugggcaaaggaccugaauagacauuucuuaaaagaagacagacacaugaccaacagauauauuuuuuaaaaaagcucaacaucacuagucaucagggaaaugcaaaucaaaaccacagugagauaucaucucaccccgguuagaauggcuacuaucaaaaagacaaaaaauagcaaaugcuggcaaagguguggagauaagugaacucuuaaauguggcuagugggaauguaaacuaguacagccacuauggagaacagugugaagguuccucaaaaaacugcaaauagaacuaccaugugauccaacaauucauuacuggacguuuauccaaaggaagggaaaucaguauauugaagagacaucuguacucccauguuuauugcagcacuauucacaauagccaagauauggaaucauccuaaguaucuaacaacagaugaaugcguaaagaaaauaugguauauauacacaauggaauaguauucagccauaaaaaagaaugaaauucuguauuuugaggcacguggauugaauuggaggacauuauauuaagugaaauaagccagggacagaacauuaaacacugaguguucucauucauauguggaagcuaaaaaaaaguugaucucagaaguaaaaaguagaacagaauacuacaggcugggaaggauagggugcggggaggguagggaacgauuuguuaaaggauucaaaauuacaacuagauaggaagaguaaguucuaguguuguauaccacuguaagauggcuguaauuaacaauauguuacaaaguuucaaagagcuaggaggaggauguugaauguucccagcacaaagaaaugauaagagaugauggguaugcuaauuaccuugauuugaucucuguauagcuaugaaaauguuacuauguucuucauaaauauuaauacaucaaaaaauuuaaaauuaauaauuaacaaaagauaaagggcccugaacucuaguuuuagagcugaauuguauccagucagauaguuucuauguuauuuaaauguucacuuuaaauuuggagcugaaauauauuuggaaaucuuuacuuuuaguauguucauuugugugugugagguaaacuugguuggcuauuggcaaauguauuggguagcugcuuaauaaaacauuuccuuccagugcuucagcuuucugaugcuuagaaaauauguauaauuaacauaauaugcauuaucacuuuugaaaguaacuaauuauucgaacaguuauuugugccaaauuaguaaugugaauuugggaacuaucagucuuuucuauggcccggaauaauuuaaauaauagaaauuaucugauuagauagaaaucauuguaaaaucaucaagguuaggauuuccuuugacuuuugcuuaucauuaguuuuaaagaaaaaaaauaaauugacauaauggaaauuuucacuguacaucaggaagggaauucaguggaaaaguaagcuuccuauucacucuugaccuucaguuuauacuuuuuuuccuaagucaaguacugcuacugguuucuuaugcucuuucuagaacuagccuguuuauugucuauuuaaaauaacucauuaaucaccuuuuauuugagcucccuuauggaucuguguaguuuuucugucucuuuaaaauuuuguaugcgguaaaaugcacguaacaucaaauuuaccaucuuagccauuuuuaagcauacaguuuaguagcacuaucuuucacaucguugugcaaucaaucuccaaaaccuguucaucuuccaaaacaaauucuguaucuauuaaacagcucuccguucuucccuacccucaacuccuggcaaccguccuuuuacuuucugucucucugaauuugacuaccucauauaaguggacucauacaguauuugucuuuuugacaugggcuuauuuuacuuagcauaauguccuccaguuccauucauguugccuugaaagacaggauuucauucuuuuuuuuuuauggcugaaauaguauucauccauguuguagcaugucaggauuuccuuccucuuuaaggcugagugauauauuccauuguauauauauaccaacauuuuauuuaucuaaauucaucugccaauggauuuuucaguuguuuccaccuuuuggcuauuauaaauaaugcuacugugaacauggguguacaaauaacuucaagacccugcuuuuaauucuucugaauauauauccagaaguguaauuucuggaucauaugguuauuuuauuuuugauuuuuugaagaauuucuguuguuuuuaaagucacuuuugaugguuuguucuuugcuagaaaauauauauuucaguuuuaucagugcagaguuguauauaauacuuacauauuuuguacaauuauauaaagguuauauuauauuuccauauucucauauaauuaucuuuaguauccauguuuguaacuguuuacucauuucucuuuccucauucacguuuacuauuuuauuggucuuuaaaaccuaggcuuugauuuuguuuccuagcauuuaaauuuuucuguuucauuaauuuuagcuuucauuuuauuuauacuguuauuucuugaggcaauggcuugguucaucuauuuucaguuuuuaaaaaaacuguaaaguauuuguaaggcucuaaauuuuauuuuauuuuuuaguuauaggaauuuuuaauauauucugguuauucaccccuuaugagauacauuauuugcaaguauuuucucccacucuguggauuguuguuucaucuucuugauagugucguuugauacacaaaaguuuuuauuuugaugaaauccaguuuaucuguuuuuucuuuuguugccugugcuuuuuugguaucauauacaagaaaucuuugccaaauccaauguugaaaauauuuuuuuuuccuauauuuucuuauaggaguuuuauagcuuuacuguuaaguuuuggucuuugaucuauuuugaguuaauuuuuguauaugauguaagaaaaggguccaucuucauucuuuugcauguggauaaucaguuuuccuagcaucauuuguugaaaagaccauccuuucucuauugaauggucuuagcaucuuugucaaaaauuggucauaugugugaggguuucuuucuaggcucucuauuccauuggucuguaugacugugcuuaugcuaguaccacauuguuuugauuacuguagcuuuguaguaaguuuucaaauaagaaagugugaguucuccaacuuuauucuuuuucaagauaguuuugacuauuaugcggcucuuugagauuccauaugaauuuuaggauggguuuuuccuuuuuuuuuuugagauggagucucgcucuguugcccaggcuggaguacaguggcgcgaucucggcucacuacaagcuccgccucccagggucacgccauucuacugccucagccucccaaguaucugggacuacagggacccgccaccaugcccagcuaauuuuuuuuguauuuuuaguagaaacgggguuucaccauguuagccaggauggucuccaucuccugaccucgugaucugcccgccucgaccucccaaagugcugggauuacaggcgugagccaccgcgccuggcuuuuuuuuuuuuuuuuuuugcaaaaaauaccauugggauuuugauagggauugcauugaaucuguauauugcuuuggguaauauuguuaccuuaacaaucuaggaacgugagauaucuuuccauuuauuuauguuuaauuucuuucagcaauguuuuguaguuuuuuauuaaguuuuucaccucccugauuaauuccuauguauuuuauuuuggaugcuaucguaaguggaauuguuuucuuaauuuccuuuuuguauuuuucauugcuaauguauagaaauccagcugauuuuugugugcugauuuuguauucugugacuuugaauuuauuagcucuaacagcuuguuuuugguguguaugugucaucuuuagggauuucuacauauauaucaucugugaauagacauaguuuugcuucuuucuguccaaauucaaugaauuuuccaucuuuuucuugccuacuugcucuguccggaauuucuaguauuaugccaaauagaagaagaaaaagugggcauccucauccuguuccugaucuuaggggaaaaacguucaaucuuucacuauugaguauguuguuagcuauugguuuuuaauacauggcuuuuacgauguugaggaaauuuccuucuauuccuagcuugaguguuuuuuuaucauaacagguguugaacuuugucaagugguuucucuguauugauucagaugaucauguggaguuucuucuucauucuauuaaugugguauauuacauugauuuuuucauuguugaaucaucuugugcuccuggaguaaguuucacuuggucauggugugucauccuuuuaauaggcugcugauuuuguugaguuuuucaucaguauuccuaggguguauuagucuguaguuuuccuguaguauuuuugucuggcuuugguaucgguaauguuggaccauagaacuaaugaagagaaguguucccuucucuuuaauauucuggaaguguuugagaagcauucuuuaaauguuggguggaaucaaccagugaaagcuaucugguccuagccuuuucuuugggagcuuugugauuacugauuaaucccuuuacuaguuauaguucuauuuagauuuucuauuuccucaugaguuaguuucgguagacuguguguuuguagaaauuuguccauuuuguccagguuauccaaauuguuggcauacaguuuuacauaguaucgucucauaauucuuuuuauuuuugcaaaaucaguagugucaccacuuuuuuuguuguuguugagggggugggggggauagagucuugcucuuucgcacaggcuggagugcagugacaagaucuuggcucacugcaaccucugccuccuggguucaagugauucuccugcuucagcuucccuaguagcugggacuacaggcaugcaccaccaugccuguguaauuuuugucuucuuuacaguagagauggggguuuuaccauguugaucaggcuggucuuaaacuccugaccucaagugauucgccugcuuuggcuucccaaagugcugggauuacaggcaugagccacugcaucuggccgugucaccacuuucauaucugacuuuaguaauuugguguucuuucucucugucucucuuuuauuuauuuauuuuuuuguuaaccuaucuagcuagaguuuuguugacuuuuucaaagaaucagcuucugguuuuguaauuuuucuccauuguuuuucuguucucucuuuucacucuaauuuuuauuauuuucuuucuucugcuagcuuugguguaguuuacucuuuuucuaguuccuugagguauaugguuagguuauugaaugagaacuuucuuauuuuuugaugucaguguuuacagguuuacauuuuucuuuuagcucugcauucacugcauccuauaaguuuuaguauguuguguuuucguuuucauuuaucucacguugguuucuaauuuccuuugugauuuuuuccuuugaucuauuaguuaacauucacaaauuuucacauauuugugaauuuuuuaguuuuuuuaucugcuguugguuuuucauuuccauuaugaucacaaaacauacuuuguaugauuucaguuucuuuaaauguauuaagacuuauuuuguagccuaacauaggucuguuuuggagaauguuccauguacacuugagaagaauauauugugcugguguugggugaguuuaguuuuugacauguuacauuugagcauucauuuaggagaaaagccaaaggaagacauuuguuaaugaacuguaaagagggguugacaucacaagaauagguaauuuuuuuugagaaacaaauuuagagcaacagaacagccuugaauauauucuuauuuagaaggcugaagguugaauauaaccuggaguguuagaaaaggguggaacaguuuaucauagaccagagccaagaaaguauaauauuuagacuuuaaauaucaaaaagaagauauggucagcugaauucaaaguugaaggcuaggugugguggcucaugccuguaauucuagcacuuugggaggcugaggcagaaggaucacuugagcccagggguucaagaccagcuuggccaacauggugaaauccugucucuacuaaaaauacaaaaauuagccaggcaugguggcaggcgccuguaaacccagcuacucuggaggcugaggcgggagaaucgcuugacccugggaggcagagguugcaaugagccaagaucgugccuuuguacuccagccugggcaacagaggaagacaccaucuugggaaaaaaaaaaaaaagaaguucagaaaacagcuuguuugggaaggacuguuuuuuguauuccuuuaauaauucaauaaagaaaauagaaaaaggauuuuuuuuaaauuugagaaacauuuaaaugaugaccacuacuuaaauuaugaaauugaaaaccacaaauauaaauuaugcauucuuuauaguaugaguuuuagaggcuguuaauuugcuauaauauuagcuacaucuggaauagaagaaacuucauauauuaucuuaucgcuauauuugaauucuguagaaguuauuucuggacagucuacgaaaagcucuugcuggccauggaggaaguaggcagcugacagaaagugcugcaauugccugugucaaacuguguaaagcaaguacuuacaucaauugggaagauaacucugucauuuuccuacuuguucaguccauggugguugaucuuaagguaacaugcuuauucuuucucuacuacaaacuuuaagaaaauuaaaugaauuuucuagcauaaguauuaugucaaagauaauugcuaacauuaaaguucugacucuucguugauaaguucauaggacuugcuuuuguuguuacuguguucaucagccuaaauggacugagaauaugaagaaaacaccauuuucuuaaauaagcauaaauauacagacuuggguuuaaaauaauguggcaauuagggccugaaaugaaccuauauaugguauaggaagaauuguaucagacugaugaaccacaguaugggugcuuugugcuucuucuggcagcuggauuuuacugccauuuguguggguaauguguugauguuauuacauguuaguaaagaaauacugcauggguauuuaaaggcuuuuguuuucuguugggguuuuuauagaaccugcuuuuuaauccaaguaagccauucucaagaggcagucagccugcagauguggaucuaaugauugacugccuuguuucuugcuuucguauaagcccucacaacaaccaacacuuuaaggugagagcauugguuuuuaucuaacuauauuuacugaugcuguuauccuuuauaaacaaaaagacuauagagauuaauagguucacuuuuaucgguauuucucacuauuauguauugauguucguuucaagaccuuaaaaacuuaguguuuuuuuuuuaaacuuucuauuugcuguucuuuuuggcuucauuuguauuacugaguauuuuucucauagaaauaaucugcuuuuuuuuuucuuuuucuauagaucugccuggcucagaauucaccuucuacauuucacuaugugcugguaaauucacuccaucgaaucaucaccaauguaaguccaaaagguauugcuaaauuacuaaaaaaauuuuuuucuuucuuuucuuugcguauuucuuuuuaagaaaugcacucuugguuuucaaaaagguucugaauuuagauguaugaaauaggaaaauuucuccauggugauucuauuugauaauugauaaauauuuguauuuuucauauuaagucuugaccgaagggaccauauuaaggaagauggaguuaauaagaugcuuuggaaagauuaaaucuaaaacguuuuauucagaucagaagcccuugagaaaaaugucacugaaaauacaguuuaaaauuuucaucccgaagcuuuucaaacauauuauuucagcauuugauacauugacuugccaccuuaccauuuaaguuaaaaguaauaguauuuauguuguagucuaguauagcacauugacaaaaugaugggacuauauuugaugguacuuuuaaaucuuuugauccuaaauucauucauaguguaaaauuucauuuuucuuaaacaaaaugaaauauuaacauacuuuaaaguagguauuaacaagauacaaaagcauaucagacaaaguaagugaaaucauuaaaagguacuugcgaaaccuucaacucugucugauguggagacauuaaauagacagcaaaacuaucagauuuggacuguggauuuuuaaaauucuguucuuguaauaaugaacaacccuauuuugaaaguuuucaaguguuauuuuccauuguuccacuuuuaucaaaugauacucacauuuauggguaaauugguugaugcuuuccuuccuuaaaggaggcuguaaucauugauaacuuaguauauuugaccuguuuauaaucaaauuccauuuuaagacugugccucuggugaguugaaaauaacccuucaccucauuugcccuggauguuguauuuauuuaaaauaaauacugcccauauucuauccauuccugcaguggaaaauuaacuauugauaaagcuauuuggugauacauuuaauuuuucucagcagguguuuagugagcauuuugggaggacaguccuuuguugugcaggaugccuugggcauugcaggaccuuuaagaucgucuggccucauuucauuaaaugccaguugugcugcaucuccccaucccuagucauuaugaacaaauaaacaugccugagggaaugauaccuccucccuuaguugaguaucacugaguuaaauuguagguaaaaguaacauugaauaugcuuuguuccaaaagggaaaguuuaaugaagauuguaaauaagguauguuuguauuaaaaacuuaaaaaaaaucacuguacuuuugucagcguaaugagccagggcauuguaccuucaagguuuacuuucaaggccauuaaaacaaaaagaugauuucuccccucaaguuuauguguaacucagaaauaagucauuauugcuuuuuuccgcuguggcucagaacacuaaaaauauucaaagaguggauagcuuugcauaaaugcuuaaaauuuguauacaauaaacccaaauauauacuuuuuugauacuuuguggcuaguuacuuuaauugugaaauauuuuugucuacaacugacuacauagagcacuuucaagcauggacuuggcacugcuguaaguggcugagcugcuccuuucuggguuccaagcaugccuggaguggugcuucaugcaugccucaguguacuuggugaaaguggcugugcauccucuucuacucuaaugagcacugcauguguggaggguggagugugucuguaucagagaucaaguuauaugaaaaucuguuuuuauaaagaaaaaaacuacauugaauaauuuuuaaacauuaaguaucaguaacuuuucaaugaaauagcuugaaaaggaacauaaauauuaguucaaaguaucuuuuuaaauuaugcuuuggguagugauacuuuauuauuauagauagugugggaaauuguuucucguuaggauauuuucccccuugguuugaggcuaaucgcuauugaaucugaaguacucuuuugguugaaaaggacuauuuauaaagugaauauagaaauuuaugagauugacuauuuuagaguuucauuugaagacauuuauuauggcaauauuuuugucuugaaaaaucacaugaaauuauucuuagauauuuggacuucugaucuuaaauucauucguaguguaaauuuuuuuucuaaugauucuugguucaauguaccucauaaguucucuucucccaugguucuuuagccaguccacacauuuuuuuuaaagcaucacauucucaaauaagauaaaaguuuuagugauguguauugaggguuuguguagaaguaguaagguguuuggaguucuacuuuugugaaacauacucauacucaguucauaaguacugaguuuagaucuaaaauauucuaguguuucuucuuagaaaaucuaaaauauauccacuauuugauucuuauuauaaugcagguuccuagcaguuacuaaaauaguaguuguacugucaucuuuuuuauuaugaugugccauaagagaugaauuaauaguuguaagaucuauguuauaugcauaaucuucauagacuuccuuuagguuaaauuagauauguaauugggaaauuuaaaaaguaauauacacacuuaugaaccaauuaucuuagccaucacugguacaugcuauagcugguauauuacuuauuucuguuuuuuccuuacgacaauuuaucguaauuuacauauggauaguucacauacugaaaaugagaugauugcuuucuacugagagguuguaguugaaaggaauuguuuccaaggcauuugaaaauuauuuaaaucucuuaaggaauugccacauaauuuguucauauuauguaaguguugccauuuggcuauaaacaugguauuuucaaggaaaaaaagaguaagucuacuuuaauugacugguguucaggaagggcacauuuaguaacugcucaaaauacuaaacuuuuuugccaaccacaugaugucuaguuuuucauacuuauuuuauuugaaaauguguauuuuacuuuaaaaugaauauauuaugaaaaaugaaaacuaugaaaauuacuaaaucuuaagccuaaaguuauuuuauguggugcaccugguaccacaauacgguuucaaaagcuauuaaaaaaagacacaguaauuugaauaggauguuauaugggaugccuuucuuaguuuaucaguuucugacaagaucuuacgagauguguuggguaaggaagacccuucacucaauguacuuuguuauuauucagcuuuuuguuacuuuaggcugauuaacacaagcuguauaauuuaguaaguauaaggaaaucaaguugcauugguugcuuugggcaagucaaaauugcugagaguuggaggaauccauuauacuaucagacuaaaaauugaucauuuguagaaacuagauuaaauaaaguaggaguugagggaaaaauguaaacaaccauacugucccaaaaaagcauuucuucccucccaguuuugggauuccucccugaauggaguucaguauucaaaauguguaucauaaguugguuuuauauuuuacuauccggcgaacaggauuuguaauccacaguuuggguuaagguaauauaacucgaugcuauucaaaauauucugagaauuccaagugaagaaauuaaaaugucgagacuucaauuagcuuaguuuugaauaagaaaaaaucugggacugaaaugugagagaugugaggcuauucaaucccucuuaucuacaauuugaauguauuauucuuccagauuuuuuaaauaaacaucuggaguauuauaaauuagaagccuacauuuuaggucauuuaaugcauagucuacauauguagugaaaauucauccagucaguuuuuuauuaaaugauagacuuuaaagauauagugauuuucacaauugucauuuuuuaauaauauaucaaguaauucauuuuaaaguuaaagauacacuuccaaauaaaauaggcacuaaaaacuagacaucagaguuaaacaggguaaauugaaauagaaaauacauaaaauaauuguuuaaaaaauauuucacuaggaucaguuugucuuuguuuaugguaauuguuagucucccauauaucaugucaucauugcauaucaauuuauagguuuacuuaauaguuuuauuucauuuacuaauuucauguuguaauuaucauuguugucuguaaacauauaaguaaugguuuuccacauacacuuuuaauacuguguugaaccacuaaucacuuuuaaagcuuugauaauagcauucuuaccugggaaaauauaugccauguaugcacgugugccagaaauuguaaaacauuaaacuuaaaaaaaaaaaaagaagauuggcuacagauuagcucucugaagacuuuauuuuucaaauucacuggcuaaucaucgagaaaagaugucucacaugcacaugcucauaaagugggcaauuugucucaugcucacuauuauguuuuauaauauaauauguaugaguuaguguuugaauuaaagacguuguuugaagacuuuggaaaucaugguguguguuugcauggucuuagaaaguucccgacaaaaggauaaaacuuaaaacuacagugauaaacagagcauacaacucacguaauuuuguacuuuuucuuccuauuggucuuuguuuuucucuaguccgcauuggauugguggccuaagauugaugcuguguauugucacucgguugaacuucgaaauauguuuggugaaacacuucauaaagcagugcaagguuguggagcacacccagcaauacgaauggcaccgguaagauaaaucacgaauuuugaaucucaccuccuuucuauugcauuuuuuuuagugucuuuauccuauuccugcugcuuugguuauuuuagagaauugaauggguccuucauuuccucuaaauguugugguauguuguaucuagaauauuguugaauacuagauuauguuuguuuuccacuguuuccaugaguugaacuuaacuuuucuuagauaaauuuucucacaaaacacugaaagucuuaaugaaugucaccuuuuuuuucuguuuuuaaaguuuuuuuucuccuuaaaacuuuugaacaaaaauauuuugauuagccucucacguuuuggggaugaguaagggaagcugacuccuggguuagagugaauguugcugccaaugcacauuuuagcuaauugaauggugacuauuaaacauaggaaaugaauaaaauuuagaguuuuuguauuuaaaauaaaaauauuuuguauuucaacaaauaugccuugagguuuuacaacugauaggaacuuugauacugacauuugacucuaaacuuaauaaaaagcagacuuaaaauuggguauucucacagauuauuacucuuaauauggaauuuuaaaacuccuauggaaucaauuuaaaaagauaauuauaagauuguggaagucauuuuuuugguguuuauguauagcaagaguauuauacaagagcaacucuugacauugauugguggugcuuugucuucugcuucuuauuuucuauuauuggcugcugucgcucacaugaucagaugccaaccagucacuguuuugcauggcagugggcuucuguggcuguaaguaugacccauuguaacuacaucagaaaaguccuugguuucuuugacuuuucuguguauaguuaccauuauagucacaucuugucauuucaacugaaaauauagcaugucuucaccuguugguuuuaucuaguaaguuagucauuucacaguuaggagauaauuuaaacagcuuucucccuggcaugcuucucuuuuuccaaguccccuuagucagugaaauauuuugguuuuauacaguugugguucacucuuauccaguugucaguaauuauuucugaggauuguuuaucuuagauguucaaauagagaaguuuuuuaugucauauauuuugggauuauugagccuaaaaaauauagccaaaagaucauggcaaugauguuuccuuaaguaaacuuuaaaaugcaagguuaccuuuuaguugacuuuuuguaaugccaaguacuucacuuuuuuuuaaguugaagaaauuuucaguacagguauaaguuaauuggagguaagcauaaauaauagcuguuuaaaugucauuuaauaagauauuuuuaaaaaaucuuuuaaaacuacuugaaauaaguuguuuaaaaguuauuuauugaccuguuuauuccagagaucugggaaaucagaaguuuauuugacuuuuuugcuuuaaguuuacuaccuuuucugguagaaaguuaaugaccuccaauaauaggacuuguugggggguuaauauucacuuccuauuuaacuucaauauccacuuuaccagcugcccauaauuuucugugaauaaggacuaaaaaugaaacuaaaugauuauuuugaacagagguaaaauuugauugguagucuaaauauguucucuacacuuagaaguuauuuuacuucuuagcccuaguuauaagcugauucucagagcuacauauuauuuuaccgaaaagccauaacuagagaggauuuccucuuuuggcucaaggacaccuguaauaagaauuuaguuuuuauuucuaauuauuuucugaaaauaucaauauacauuuaauuuucaaaaucauuccuaagcuguuuauguuuuugaaauguuauauguauguauauuuguacauaaugacuaaaggacagcuuuugggcugauauuaccaggagagaaaauaaauagcaaauguaauaugaaacaauuuuuagaauaagaaaauuuuagguuuugaauggcuguuaggguaaaaucucacccuucauaaacuuggugaguuaacagucagauaaccaguauggaaguauugaccuucuacucuuugccaggcaaaggugcuaaugccagggaagcauggugaacuaaacauacacagcacuuccccucaccgagauuccaagcaaaagguuuauagcuuuugcuugaaaaugucuaaugaagaacucaacaccggacacgguggcuaacgucuguaaucccagcacuuugggaggccaaggugugcggaucaccugaggucaggaggucgagaccagccuggccaacauggugauacccuauaucuacuaaaaauacaaaaauuagccaggcgugguggugcaucccuguaauuccagcuacucaggaggcugaggcagaagaaucgcuugaaccugggaggcagagguugcagugaacugagauggcgccauugcaccccaguguggacaacaagagcgagaaucggucucaaaaaaaaaaucaaacaaaaaaacucacuacagguggcauggagucuggcaacacaggcaaauauauauaauaaaugguuuacagauaauaccuaacaucagaguuuccuacuguuggcacuauuaacauuuuggacuggauaacucuguuauagggggcuguacugcgcauugugggauauucagcagcaucucuggccucuacccacuagaugccaauauucccuuuaccccccagcccuccaagucaugaaaaccaaacaugucuccaaacauuuccagaugccccuugggggacaaaaucacccccaguugagaacuacuguauuacagaguauguucaguggguugucccucauuuguauugccucaaaugauuugggacugauaaaccugagccauuagcuugcuucagaaguagcaaucuaggaguucuguugcaaaacaguaaaaguaaaauaauaucugcuucaaggcuuuacuaacacuuuguauuuuggagagacaaguuacuuguuggaaggagcuaauuauuugaaaauuuucucuucgaccaagauagaaucaugucucugucacuuacagccaucacugauccucuuucuguuggagcucuauagaauacuucugauucuuccacaagguggcccugcagauauuugaauaagguuauucuguacuccuagaauucguuuuauuuuuauaucguuuuggcauuggaagggauuuuauucuuuuagcucucucucuuuuuuuuucuucuugagacagagucccacuccgagucccacucugucacccaggcuggagugagugcagugaugcaaucuuggcucacuccaaccucuaccuuccagguucaagugaucuccugcuuuagccucccgacuagcugggguuacaggugcccaccaucaugccagcuaauuuuguguuuuuaguagaccauuuagcaccauuuugggcaggcuacucuugaacugugaccucaggugauccaccugccucagucucccaaaaugcagggcuuauaggcaugagccacugugccuggccucuuuuagcucucuuuaaaacuguauguguguuuguugggucuguuuuuauagcuaaagaaacugaagcuuaaauaaaguuauauuaauaacaaaugcaugguuaaugaacagucaaccagaguuaguucugagguuucuugacauucaguucagugucuuuaucagguucuuuaguuguccuucuucacuagcaaguuagcuugaugaaagcaguagcuuugucuggcuuaaucaacacugaaucccuaacguuugaacaacaucugauacauauugggcauuuaguacauguuugcagaaugaaugaaggaaugaauuucuuacuugaugugguuucaaaauccucguacaggccgggcacaguggcucaugccuauaauaccagcacuuagggaggccggggcgggcaggucacuugagaccaggaguuugagaccaacugggccaacauggugaaaccuugucucuacuaaaaaugcaaaaaaauuaggcaggcgugguggcaggcacuuguaguuauagcuacucaggaggcugaggcaggagaauugcuugaacccgggaggcggagguugcagugagccaagauugugucacugcacugucagccugggcaacggagcgagacucugucucaaagaaacaaaaacaaaaaacaaaaaacccuccuguuucugauuugcuucucuucuggaaagaccaaccugacaaaaauuuuuaaaauuaaaaugccauauuaagaucugauguuagugauacagauauaauacuaugauguaauaauugauaaaagcuauuaaacugcuguguuuguauacccuguuucuauuaauacaaucuaagauaguauuauuauuuuauguugacuuuuuaguuauuuaaacucuuuggcccuuuuuauaugaauguugagccauaacuucuccuuuguaccuuuguaguauuuuuuuaauauuugaaauguuugucuuagcacugauuuuacuauuugcaaacuaacaucuccugcuuucauaaaauucaaaacugccaauaacagauauaugaauuuucacaaguauuuguuauuucucaacauuuuuuaucuuaaguggcaugcuggcucaccagaucuuucuuacaugccuguuauucagucacauggucuaaauuaacaagugguuugggccuuuaauagauaucugaagacucugguucaugaauuucuucccagacaugauugccucucaucuuuggccagaucacauguaccagcuucuauuccuacuaauaccugcaauauagaagaucaacuaaugaaugaaugaauuuuuuucuuacauuucuaauuaagaaacacauugcuucuuuagcauguuuuuccucacuuucuguaacccacuaaaauuaaaagguauuugagaugaauuaaauuuauuggaauuucugaagucauacauuucauauuaggcaaccauguuggaacagaauuuacauguugauauuugggauuaagaggugacauaauuaaacuaauauagucauacaucacuuaaugacagggacaugucuugagaaaugagugcauccuuagugauucagucauugugcaaacaucauagagucugcuuacaugaaccuagaugguuauauagccugcuacauaccuaggauauauggucuagccuacugcuccuaggcugcaaaccuagacuaaacagcauguuacuguacugaauaccuuaggcaguuguagcacaaugguaaguauuuguuuauucaaacagaaaaggugcaguaacaauacaguauaaaagaaaaaaauguauaggacacuuaacacaaauggaguuugcaggacuggaaguugcugugggugagucauugagugaguguugagugcaugugaagccuaggacauuacacuacuguagacuuaaaauuuuuuuaaauuuauuuuacuuuuaauacuuuugcauuuuucucauacucaggaucuauacuguagacuuuauaaacacuacacuuaagcuauaucaaauuuauaaaaaauauuuuuauaugauaacuuuacaguagcuuuuaaaauauaaacuuuuaaauuuuuuaauuuuuugacuuguaauaacacuuagcuuaaaacacuuuguauagcuagcuguauaaaauauuuuucuuuauauccuguaaguuuuuucuauuugaaaauguucuauuuuaauuuuuauuuugaaaacuguuuuaagaucugggacacaaacauacacguuagccuaggccuacauggggucaagaucaucaaucaguguuacugucuuccaccuccacaucugcucccauuggaagguuuuuaggggaaauaacguguggagcugucaucucuugugguaacaaugccuucuucuggaauaccuacugaaggaccuucugaggcuguguuucauaguuaacuuuuuaucuuuaaguaggaguauaacaauacaaaguauacuauaguaggcugggccugguggcucacgccuguagucccagcacuuugggaggccaaggcaaguggaucaccugagaucaggagucgagaccagccuggccaacauggcaaaaccucuucucuacuaaaaauagaaaaaaauuagcugggcgugguggugcaugccuguagucccagcuacuugggaggcugaggcaggagaauugccugaacccgggaggcagagguugcaguuagccgagaucgcgccacugcacuccagccugggcaacaaagugagacuuggucucaaaauauauauauuauaauaaauacauaaaccaguaacaguuauuuauucucaucaaguauuguauacuguacauaauuguaugugcuauacuuuuuuuuuauaugacuagaagugaagauuuguuuacaccagcaucacuacaaacaauaacgcauugugcuuggacaucacgauggcuaugauacuaagugauaggaauuuuucagcuauguuacauauugucuaucauugacugaaauguuguuuuguggcauaugacucuauuuacguuuuuuggaaaugauucuuaaggaaaaauucugauaccugcucauuguucucugaucuuguguuccugugcaauggcugcaucagggaagagccauuugauaguuacacuuaguuacaucaaaguaaauaaauucguuuaaucaaaguuucagcuugaucugaggugaaacaccucaacuuagagugaggaaaaaaauacaguugaaagagagcaaacaguaaaaccagaauuuauuaaaucauuuaguaaaacauuugcuuuggggucagggggcaguuauaaaaagcaaacuauuuggaaguuuugcuauuucucuucuguagugacauucuugaguauaaaugugugcauuaaauagcuauucuuccccgcaaggacuaaaacccuucgguguucuuggguauaauaacaaaugcauauuucacuuaaacauugaggauaguucauuuguguuguagauaugcaugucugcuucuuaacuuugaaagacagccuguuuaccuggacauuuguauuauggguccacaguugguacacagucuuguuauuucuguauuauauauauguuuacauaaagacauucauucagaaucagauaguuuuguguucuuuucaaggaaaaaaggaaggagauguuuuauaauaauaggugauguuagcucuggaauauaauuguuggauuuuugguugaaaaacauuuauaauuauuuuaauucaucauaugucucuauaauugaaacauauuuucuguaaguuuaccuuucugaguucuuucuguuuuacaaauguucuucaggcaaaaugcaugcauucuguaacuuaaaagagguggagugccgucgaaggaaaaagcaaauuuuacaauuaaacuaguaaauacaaagauugccuacauguuucauuaauucuaagaagcacuuauuuuuacucuucucuaaaauugggaauguaucuuauuuuaaauggugucuuacaauugacagcaguuuuucauuccuuuugggacaucaaauaaugaugcaucuuacaauugauaauguuguagagucuaugaaauacuuguauguaugucuggggaauguuuguuaaauaaauuacccaguguguauauuugugagaacuauaggccaaaucuuuuuucccuuauguuuuuacauuuuagaaaauaguuuuuuacauagauguuuuacaaccugauacuaagcuuuuaguauuguaauagauuuucauuguuuuauuagauugauaaaaaaaaauauaaauggugcaaaaacgauuuucauuguuuuguuaagcuuaauaauacugaccuuaugcuuacuauugaguguuucuacuaauaccacacauuugguaguauaaaaaauagcuuuuuucaaagguuuuuaauaauaaauuucuuuuaaaagguuggauagcuauuauccugagucuuaugucugauaccauguuuuuguuuuguuuuuagagucuuacauuuaaagaaaaaguaacaagccuuaaauuuaaagaaaaaccuacagaccuggagacaagaagcuauaaguaucuucucuuguccauggugaaacuaauucaugcagauccaaagcucuugcuuuguguaaguauuuuuuuaugaaaugucucaaaauuaucacacuaaguuaauuggguuuagcugaaacgccaagaccuugaggauaauuuuuagcucaagagcacuuacugauccuuucugaucauaccugaaaacuaagacgucucuaagaaaacuaauguauaaugaauacuaauauaauuagaucagauucuuaauugcccuuaucauuuccuaacauuucucuuucuucuuaauuucccuaucauuaaacuaacauacuuugaugagaucucuguucucauccuauuacuaaguuauauauuauucagguauaauccugguaugggggauagaagugaccaucgaucacagugucuacaucuauacuguugguuuaaaaaaucuccagauugcuuuugccaguuuagcuuuucuaucccccuuucuuuguguuaucagcuuucuguuaucauuggcucugccuacaaauacuguauuggaaaaagaaugaggugaaaaugggugugguuaguacuugaguuagugugauuaucauuauuauuauuauuuugagacagggucuugcucugcuucccaagcuagagagcaguggagcagugauggcucacugccuucgaacuccugaccucaagccauccuccagccucggccuccccaagugcugugauuacaggcaugagcccccaugccuggcuaguagucaguuauugucauaacuacucuuacugccucagaugauauuaaauuucugagaacaucacucugguacacagaguaauuaggaacaacgcaaauaauaaaaaugagucauaaugaagugauuaacagcauggacgcuggagacuaccuacuagcuaugugauuuggaugacuauuuaaucuuucuaugccuuaguuuucucaucugauauauugggaucauaauaguuccuaucucagagauacuguuaggaaaauugaaauaguacauacaaugcuuuaggaacaaugccuggugcauaauaagcacuaaauaaauguuagcuauuauugcuauuaauaagauacaauuuaacacuaauuaaugcaccaaauguaauaguucuauauugugucuuucauaggaugacauguuuaaccuuuguugagcuucuucagucccuggagagcagcaucaagcaagguuucuuaucguuuugcucaguaacuggcuuuuuaaaaaguguuaaggugcuuucgauuuugguggcauauuuuuuaaauuacuguaauacagggaguuuguaacuacaugccuaugauuccaagaguucuaugaaacuucgugaauuuuuuaaaaauguguauuuaugaguaauuuuucuuggagaguggagaggagagaagaaggaacauucccaaaggaucagugaccccaaaagaaggccugugauacuuuaagccugaaaaacccauucaaguuugaaagucuaauuagaauaaacagaucuuuggcaugaaaaaauuccauaaaaccugucagugaaacucuauaaaaaaaugaaguucccuuucucuucauuccuuuguuauguguuacaagcuauuuguggcauuauuucaucaugaaggucacauaauacuagcaguacucuguuuacguggugauaauucacauucaaagcaggcaccaaacucaccaaugccguuucuacuaaauguugcuucaagaagaauuuaagcaaaacuugccauuuuccaaggaucauuuaaaauggaaauuauuugcuuugcugccaucuagugguuaauaaguuuucucaagguaaccauaaguacauuaaaauagaagauucguuguaaauauuugaccauuuugucuuuuacauaaaaaaucugagucuuaguaauuuaggaggaauguaggaauaauuauuaaauggucucaaucaugguauuuuuaaaguaauaugauuuugucuuccauuuuaguacucucaauuucucaagccuccuaauuacucagcuugcaucguuucuuagaucccccugaucauuucuccacacugaaguuauggcagucucuuuaaaaagcaaaucuuauuaugcccccucucagcuugaacccuuuuaguugaaauugcucuugcuuaugaagaccaaacuccaaauagaucuacagggucgugcaaaaucuuucucccaucuaccauuucuuccacauguagcauuacauuuuuugucuuccuuuacucuauucaugauggucuuccuuucagucuuucuaaccacaugccuucauaccucccuugcaguugcuuuucccucugccuagaaucugcuuacucuuaacauaguaauuccuacucauucuaagcuauugucacugcacuaaggaagccucccugagucggacacuuuuccauguuauaggcugucauagcagcauguaccuuaauaauagcucuuaugugauuugcauuuuuauacuuguugaucugauuauuucauugaugauaucuucccccaugagacuacaugcucauggaggaugggaaacacaucuucucuuuuucauuguugugucuuuggcauucaauaaaaaugauuugguuuuggaugaauuuauaugaaugucagaaaauaagcuaacgguuuugaauuacagauauauugcagugagggcuuaccuuagucauuauaauggggaaaaaucuauaguuagcaaaauaaaauaugggacacaaguugcauuggcuucauauauucuucuuuuuuuuuuuucugagacagagucucacuauauugcccaggcuagagugcaguggugugaucucagcucucugcaaccuccgccuccuggguugaagugauucuccugccucagccucccagguagcugagauuacaagcacccgccaccaaaccggcuuguacuuuuaggagagaugggguuucuucauguuggccaggcuagucucgaacuccugaccucaagcacuccgccugccuuggccucccaaagugcugggauuacaggcaugagccaccaugccuggccaaaccauauauucuugaagugcaaauauaugcuuccaaguuaagagaaacauuuuagucucuaaauagguaggcauucggcagggcguggucgcucacaucuguaaucccagcauguugggaagccgaggcagguggaucaccugaggucaggaguucgagaccagccuggccaacauggugaaaccccaucucuaauaauaaugcaaaaauuagcuagacgugguggcgcaugccuguaaucccagcuacucgggaggcugaggcaggagaaucgguugaacccaggaggcagagguugcagugagccgagaucacgccauugcacuccguuucaaaaaaaaaaaaaaaaaagguaggcauucacauuuuuacauaacguuaauuuucuuugcuuaguacacuauauuuuuccacgaugaaaaggaccgaaguauggguaucugccgaugcaaauucuagccuuugcuuuguuaccagcuguguggauuugggcaggaccuuuguaugggucaagagggcuguacaggauaaucaugcaauccuuauccaacauguauguccuuuaccuuugaucacaaucauguauaagcucaaaaccaguaaguuccaaaccagagauacguucuuuagccaguuuacuauuguuggaaaaaaaauuauuccucauauuguugauguaauuuuuaaugggaauucgugguuuuuguuuucauuaggauuuucccuggacauuauucacauuaaugaacaaguauagauguggauuaaaagaaucccuaacaaaagaaguuuugauuuaauaaaauuuuuauuuuauugagauaaaaauacuauacccacauaccauaaaauucaccaucuuaaaguuuacaauucaguuguuuucaguauauuuacaagguucugcaaccauuaccacuauguaauucuagaacuuuuuuuucuuucuuucuuuuuuuucuuuuuucuuuuuuucuuuuuuccagauggagucucgcucugccacccaggcuggagugcagcggugcaaucuuggcucacugcaaccaccgccucccagcuucaagcgauucuccugccucagccucccaaguggcugggaccacaggcgcaugccaccacgccuggcuaauuuuuauauuuuuaguagagauagaauuucaccauauuggucaggcuggucucaaacuccugacuucaggugauccacccgccacuaccucccaaaguccugggcuuacaggcgugaaccaccgcguccagccuaguucuagaacauuguuaucaccccuaaaagaaacuugguacccuuuagcagucacugucuauuucuuccuccuucuaaucucucucgauuuauuuauuuuuuuaauugaaguuuccuuuuuuuccuugcagaauccaagaaaacaggggcccgaaacccaaggcaguacagcagaauuaauuacagggcucguccaacuggucccucagucacacaugccagagauugcucaggaagcaauggagguaaggggaaaaugaauuccauguucuugaaggaaagauuguaacuauguacauucaugauguuccuuuggugugugguuucugugaguaacagguagaugucauuucuggaaaugguauguuuaugucuauacauuguuuuauaaaacuccauggagaaagaagggguuuacuugcuuuguaucacauagcaauaacauuguacaaauucugaugcuuaauaaaauaguucgagauuuucuaauugcaguugacuuuaaaauuuuuaaaaauauuauuauuaaauauuaaaaauacuaauuuuuaaauugagacauaauucacauacccucaauuuggccauuuuaaguaguucuuuuuuuuaaauuuuauuauuauuguacuuuuaaguuuuagguuacaugcgcacaaugugcagguuuguuacauauguauacaugugccauguuggugugcugcacccauuaacuugucauuuagcauuagguauaucuccuaaugguaucccuccccccuccccccuaaguaguucuuauucacacaguugugcaacuauagcuacucucuaauccauaacauuuuuaucaccccagaaagaaacuugacuccccauucccucaucccuaccaacuacuaaucuauuuucugucucuauggauuugcuuguuuuagauauuucauauaaauagaaucauagaauauguggccuuuuaugucuggcuaccuugacuuaaugcuuucaagguucauuuauguugugguaugaaucacuauuuucuuccuuuuuauugccaaauauuucauuguauggaucuguuuuguucaucuaguuaucaguugguggacguuugguguuguuucuacuuuuuagcuauuacaaauaaugcugcuaugaacauuuguguaaaagucuauauguggacauaucucuuaaguauauaggaguggaacugcuaagucgugugguaacucugucgaacuuuugaggaacugucaaacucuuuuucugaagcagcuguaucauuuuauauucccaguaacaacauaugaagguuuuaauaguucuguaugcuugcuaacacuucuuauaaugugucuuuuugauuguagccauccuaauguacauacuguacaaauguuuauacauacccaguaaaaauguuuauaaaaauauuuuagcacuuacuacguaaucauugcuuccauuuguguacauugcuauuggucccguaaauugauacauuucuuguagucuuuuuggaaggcuauuuggcaggagcuauacaaacauuucauuuuuuuaugcaaauaauucaauuucuaucacuuuaaaaaucuuaugaauauaacucaaaaggaaaaagcugcacacauagguacuuauugcucuuaauuauaauagaauauuaagagagcuuuauuuacugggaggagaauggguuaauauucaauagugagaaugcuauuuuaacuuggugagcuguuaaacauuuauuaaaacuuauauagaucacacagcaauauggaaaaauaugaaaugucaagugaguauacugcauuuauggcuuuguuaaaacauggaaaauacaaaaaaaagaaggcaauaugaaaagaaaauuaaagccuggaaaaggcuaacacauuuucuuucaauauguauuuuuaaaguuuuaucaaacaaaaauauagagaauuugucacuuaaaaaaacuagugccaguaaauuguaccacguuuuuguacaauaguagcaaaauugaauuuuaauuuguguuguuuuuccuugauaugagagcuauaaauuauauagcuuuuuaagauucucaacaauuaauugcaauuuucauuaaauaucucaaaguaauuacaauaaaaauguuugaaauaagauaauaugggucuggccuuuaaauguugauauguugaccaaggacugaaagaaauguccagagcuucacaguuucugcuggguuggggguggagggauggugggaggaaugugaauugggauuguagaauuggaguugagauaagaucaguucgaaggaagaguuuguguuuuuuuuauaucuuugaugguuuuaauuuauauaauaaucuauuuauauguuauauauuguaaaugaauuauuuaauucccguuaguguucucugagccagauuccaacuucaguucuguggucaauugaaauacuuuagaauggauaaucugcuaugaaauacugaauccauuuugcuuccucucucuugauuuugaaaaauaauugcucuuuucuguuacaagagacuuuguggcaagugagacaguuuaaguaaaaacuuaaaagauaaguaaaucuuuugcuguguguauuaauuuuggcaagccuucuuacuuggggauuagcuuuuuguuucauagaguucuuuaauaucuauugaaauuauuuuguuuguuucuuaaagcaguuuuuacaguuauauauuguuccgaauucaucauuuagcuuuauauguacaugccaguuagagucagaaugaugggaauaaaaugauuucauucugucuguauuauucccuagagguuuguguucaccagaguuucucucuuuuuaccuuuuacuauauauugaaacuacaaaugaaagagcucaauuucuuagcauuuauaaaauaaguacuccaguguuauguuuaccaaaaauguuugagugagucuucucuuugucuuucucuuuuuuaaaaaauucaggcucugcugguucuucaucaguuagauagcauugauuuguggaauccugaugcuccuguagaaacauuuugggagauuagguauauguacuuuuauuuuuuaaauucaacuuuuaaauuuuauuuuguauuuuugucuugaaauauuaacucuguaguacuuaguacauuguaaaacuuacacuuccaaagguuuuaugguuuuguauuuuauuugacuucaaauuauuagaauuucuuguuuuaacuguaagaaaaguaucacagcaauuuagaaaauaaauuuuaagaauagugcuaaauuuugucacccuaacauaaguacuguuguuugguauauuacuuuuuucagauuucaaugugguuacuacuguauuuuuaauagauuuucauaguuauaagccuagaaugauaaaauuuuguaacaauacuguuuuuucaguuuuuugaacuaugaucuuucauaaacuuucuguaauaccaaugcuuucgaugaaugaauuaauaauggacaccugcuuagaagaaaaaaauguaugcagaauuuuguggucugcuuccuagauuauacaaaucauuacauuuuaaugagcaugaagucaccacacggaggaaaauguaaauguguaaaccucaaguuugccauuaucuuauaagaaugggugugcuaaguuacuuggcagcugaauuaaaccuuacucuagaguagugcuguccacuaguaauauaaugagaaccccauauguuaaaaacuuuuuuacuuacuacauuaaagaguaaaaagaagcagguaaaauuaauuguaauuauguuuuguuuaacccgguguauauuaucuauaauuucaacauguaaucaauauaaaaguuauuaaugacauuucauucucuuuuuuuuaauaaagucuucaaacuuuggugugucuuuuauacuuacagcacaucucaauuugaacaagccacacuuaaagugcucaauagccacguguggcuggcuaguggcuaccauguuagacagugcagcucuggaguagggaucaggaaacuuuucucuaaaaggccagauaguaaauauuuuagggcuugugggucauauaguuucugucauaaccauucaguucugccuuuggagcaugaaaguggccacagacaugugaaugaacgggcauggcuguguuuaacuaaaacuguauauuuacaauagcaagugauaggcuagguuuggccuguggaugguagcuugcagacccccacuguggagcacuggguuuauaggcagucucugcugugcaugugguuuauuguuucuucuuaugucuacuacaaggaugagauacauggauagaaacacugggaguuuaaugaaacauagggggcuuauagauaaauacuugcuuuuuuucuauaaccuguagacuuauuuccuuugauuauaaugcuauugacacuuugauaacuguuucucuaaaaccuuacaagaaaaacuaagcuucucuaaacuuguauucauuaugggagaaugccauucuuaugucugguuauaucugcauuagguuauugaugaugcuaguaacaaugaacuuuauguuacugcagcucacaaaugcuuuuuuacaucugcaagaaauuaacuagucaucaaaugcuuaguagcacagaaauucucaagugguugcgggaaauauugaucugcaggaauaaauuucuucuuaaaaauaagguaagcaaaaugacauauuuaaaaaauggaagaauauuuggaaugguaauggugagagauuacuaaaguguuuuauagccaaauuagguucuauuucagcuucuccuuccucccaauguucucaaaaggaaauauguaugcagaggacaaugacuggcaaaucagcauuuuaaaaauuauucugaggcuuuggccuuagaaccacacuguugaugaauucuaguucuaguugaguuaaauaggucucuauggggcaggccuaggaaaagugggggcugcuauaaccagaguagcuugaggagcauauuguaucuuuacucuuaaguucauacauaagacauaauucauacauaaaauuuauuuuaacauauagcuucuguaauuuaagaauucuauuauggcguagauuugggaguacuugauuuaauggguuuuuguccaguucuagaaucauagcucugagaaaucguaaagaccuagaucucauggcuagacuaguccagagaauuaucuaucaagaagcaaaagggaaacaguugaggguccucaaucuagauuuauuucgauuccuccaauaaggguuucaccucuugaaaauaucaggagacuuuuucauugggguggagugaaauguuuugauucugaacuauugaaacauggugagguuguggaagauagagaagagccuuaaauuucuuuuaacauauaguuucuguaauuaaucaauuuaggaauucuguuauggccuaguuuucggaguacuugauuuaaugaguuuuuaucugguacuagaagcauagcugugaaagaccuuaaauguaugaaacucauauccuuuucaguauuuacagcuuguuauuaauaaauugucucuuuagaaauagacuaauggugaaguggguuuauucacaugugacuuauuugauauguuaauguaguggaauuuggcauuauuccaaagauacagaaagagauuagacuucagacuuucauggccucgccuaugguauaaucuccagaaugugaguaugaggaauccaguaaugaauucauagugcccugguaggcauagucacucuugugacauacuugguguauauacauaccagaguuaauuacugguccagaagaacuuaaucucaagagccaauuucugguuaucccaacauggcacaguauaaaaucuuauggaaaaaaaaucuuugucauugagaucaaauuauaguuuucauacaguagauuuauauuguugauguuuuacucauguuuaugucagacuuaauuuauauuuguagaaucuacuguuucugaugauuuagagaaugggaaacugaaagaaauuuuaaagaauuaaguaaaccuuguuuguucuaauggguuucuagugaaucuccuucaaguuggggcauagagauugagaggagagguuuuuuaggagagucucaaacaggaagacaacucaaauaaguguuuauuccucuugguugucagugcuucaguaaagcuuauuuauuuauuuuuuucuagcaggcagauagaaguuccugucacuuucuccuuuuuuacgggguaggaugugauauuccuucuaguggaaauaccagucaaauguccauggaucaugaagaauuacuacguacuccuggagccucucuccggaagggaaaagggaacuccucuauggucagcuucuucuguacuuuuucuguaucauuuuaugugcucuguuuguuuucugaaugaaauuugguaaauuucaucuagguaauauaguguaauagugaaaaacugcuuagaaucuaguucuauuacugcucuuuguggaacuuugggcaaguucuuaacauccuuguuccucaguuccucaacuuuaaaauggggacaguaauaguuccugccccagaguuguuaaagaggguuaaauaaaaggauguguaaauagcacuugacacuuacaagcuauaucugauaauuauaauuauuauaaaccuccacuccauaaaaaacccauucauaccacagaaguauagaauucguaccggcuaacaaagguacagauuuacagggauaaaaacaaaguauuuugcuucauguuaaagauaaguguuucugugauuuguguuuguguguauaauuucuuuuaaauauaaaucauauuucaagugaaaauaucacaucauuacagaagaguuuauuuuccaaaccaaaacuuuuuucauuccuaauuuuuaaugcaaccuuguuaaggaagaaacaccuaagcaguaugauauuuacuaaugucuguuuuacuuguagaauuugcauuuauuuuaucaauuauuuucuccauuucguguuuggagaauaaguaauucagaaucaaauguaucuucuacagcaauauuuaguucuuguuuaugcccuuguuucaaugagugcugcaguguacuuauuuuauuacuucccuauagcaaguagauagaauuuccuguuacuuccucuuuuuuugucauuucuaauugacugggagguacauuauauuguuacugcaguagauuuacguuaugguguuuaccuguccauguuagaaucaguuuacauuucuggaaucuggaauaggauaauaucuauuugauuugaaauugaacagaugguagcauuauguugguccagauaaucucauuucucauuuggacaagauauuuugggguuugaaaaauuccuauaaugauuaaaggaaaaagcucuugugaguuauuguaugcggagacacacacacacacacacacacacacacacacacacacacaguuuauugcauuguuagauuuuauacauaaaauuacccaaguugcaaauauaugucuuccacccuugacucucaggauagugcagcaggaugcagcggaacccccccgauuugccgacaagcccagaccaaacuagaaguggcccuguacauguuucuguggaacccugacacugaagcuguucugguugccauguccuguuuccgccaccucugugaggaagcagauauccggugugggguggaugaagugucagugcauaaccucuugcccaacuauaacacauucauggaguuugccucugucagcaauaugaugucaacagguaaaugugaauagugguuuuuuuuacucagucugccucaaagcacauggcaucugauuuugagaauguauuuaaggucacuacuuuguaaguuuacaggggaaauucaaguagcuuacuugaaauccuuuucugaacaaaguaagaugaaaauaaaaagcauuugaaauaaauuguuagucuuccacugaguuguuaauaugcuauacauuuuaaaaauaacuggcaguagauguuacuaucaguuaugauuauguaauuuacucugccuaaguuguagauagugaaguuuuacaaacauuggcguauguuuugaguaaauuguaggugggaauagcuauuuuauucuguggacauuguagaguccaagauaaguaccuuuccugugagguuagugaaaggaaguuuuuggcuuuaucauuugaagcauuugcucugcucuuccuacuccuuuuggguggagcuuaucagguucuccauuggcaggcagggcucuaagugcaguaacuugauuugcuguuguauuugcuuaggaagagcagcacuucagaaaagagugauggcacugcugaggcgcauugagcaucccacugcaggaaacacugagguaugcccuuagcaacagaaacaccccucccaggcgcccacccucaauuuggaagccucuuguuacauaugugugaucaggaauagcuuuugaaguaaauccaagauacgugcauauuacaaguauaauaucugaguauuuaauauacaucaaguuugaaacuuggcuguagcugauugauguuuagcucuagacuaaguugcuuucaagugauaauugccuucauuuuaggcuugggaagauacacaugcaaaaugggaacaagcaacaaagcuaauccuuaacuauccaaaagccaaaauggaagauggccagguaagucuguaaaguugacuuuugucuguuaacugaucugcuaaauauauguacuucacuuugauaaucuuucaagagucgcucaguaaaguaaacauauagcugugugaagacugauauuuaguugugguuuaucuagaccuguacuuuguaaugugguagcuacuagcuaugugugacuauuuaacuuaaauuuuaacauaauuaaaauuaaauaaaauuuaguuccucaaucauauaguaaccacaucgcaaguaccaguagccacauaugacaauuacuuacucuauuggacagcagagagagaaaauguuccugucaucacagaaauacugggcagcacugcuagagacuguuuguugcagagaccauuucuuuaccuuuucuugcucuuucucccuucaucaggguguuucacagaauuuucagaaaaggagcaacagagguagagauaaauuaacauggaaacaauucauuuugcuauuuuguuagguauucuaauuaaggaaugucuuaggcaguagauugaucccauagaguaaaugaaauuuuaaaauguggacaguucauucaacuauuacuauugacuauauuaucuguuacuuuggaaauuaaugaucaguuaguguuuguguguauuugauuuguaauguucauauugcucucauuauuaggugauuuauaaaaacugguuguuccuccaugguguuuuugucaugcuuaauuacaauaggaaaaaguuauauuuuuacgaagcaaauguguguaccuaauaccuuuauuuggaggggacauguagcuuuagaaugaaagcuuuuggggggauaacuguuuuauauaauuacauaccauacaguucacccauuuaaaguguccaauucagugacuguuuuuaauguauucacagaguugugcaaccaucaccacaaucaaguuuuagaacaauuucaucaauugagaaaaaaaccccguacccuuuagcuaucucugccucuaaccaccccccacccacuuucuugccucucuucccccaacgucucuagcccuaggcaaccaugaaucuacuuucugucuuuguagauuugccuauuccggauauauucuguaaauggaauuauagaauaugugggcuuuugugauuagcuucuuucacuuagcaugauguuuccaagguucauccaugugaaaucaaaacuuuuuaaaagaaauuugacacucggcugauuauauuaguguaugauaaaaauagaucaguggcucuuuaaaaauguauaugguaauuuuauggguugauuuuaauguauauuuuacauuuuuuguacuuuugucauggaagaaauguuggauaaagcauaauuugucaagucucaacuaauuaagguuuaauucaugcuuugcacaaaaauuuuguguuuaggcugcugaaagccuucacaagaccauuguuaagaggcgaaugucccaugugaguggaggaggauccauagauuugucugacacagacucccuacaggaauggaucaacaugacuggcuuccuuugugcccuugggggagugugccuccagcagagaagcaauucuggccuggcaaccuauagcccacccauggguccagucagugaacguaaggguucuaugauuucagugaugucuucagagggaaacgcagauacaccugucagcaaauuuauggaucggcuguuguccuuaaugguguguaaccaugagaaagugggacuucaaauacggaccaauguuaaggaucuggugggucuagaauugaguccugcucuguauccaaugcuauuuaacaaauugaagaauaccaucagcaaguuuuuugacucccaaggacagguaaaguguucucuuauuuuucaccuuucucuaugaauagagugacuuguuugaaauaagccuuuuucuuucagauuauuuaaauuagguacucacaguuuuuaaaaauuuccaaaaaauugcagaaagaagagucaucucaauguaggggucagcuugccucuuaggaacucugguguguaugugugccuaaggguauacgugcccuguguauggguacgagugucugcguauaucuguaugcuuauuuggcucuaugccugugggugcacuuacucuguguguuuagaucagucaguuucaucucucuagggggucugucuucugggcauugauggcaaaucauuaauguauuuguucuuucuuuagguuuuauugacugauaccaauacucaauuuguagaacaaaccauagcuauaaugaagaacuugcuagauaaucauacugaaggcagcucugaacaucuagggcaagcuagcauugaaacaaugauguuaaaucuggucagguaagcauucuacugaaauguagcagaaacauuuuaagagauaagaaaaaccucuuacacacugauacugguaguaauugauaaaauaacuggccauucuuuacugcacacaaacuagggugugacaguaagguagccagaaguuguguacguucuuuucuaaauaaauaucuuauuguuuucaaacuuacauuuaauucguuuuacuugaugacuaaaguauuuagaaugccuucucuuuugucuauaucugauaauuuuuuuauuguuucuaugucuauauagguauguucgugugcuugggaauaugguccaugcaauucaaauaaaaacgaaacugugucaauuaguugaaguaaugauggcaaggagagaugaccucucauuuugccaagagaugaaauuuaggugaguucucaaaagagcaauguagggucuuguaaaucuuaauauguccaaugaaguacagaaaaagaguagauaugcgguuauugguagaaaggaggacaugaaaagagagcaauuuacauguuuguuuuucucuacaucucuucucaaauuucccuaagcuuugugccugugacaaugcucccuuuuucuaaaacugugcuauacuugagcuaagaauuugauucuauuuccaaucugauaccauaacuaagggccaugauggaggauaaauauccauguugcuuguucccuucuggcuuuuaugucugugauagcaguaucucuuuuauaaagucgucaugucacuuagguuaucuggcaaauuauuugcacuauaagaaaucuuacgugacuaaagguguguguguggcuucaaaaacauuguuugcuguuucucuuuucuccaccauucuauaggaauaagaugguagaauaccugacagacuggguuaugggaacaucaaaccaagcagcagaugaugauguaaaaugucuuacaagguaaaaaaagaaugaccuucaaguauuaguggguuuuacugugagaguuauaacuacuuaauuacagcuuuauacuuguauuuuguguguauuuaaacuuuugagaugucaaacuuuuguguuugaaauauguaaagaugcuaaucuuuauuacugcuuuuuuuugacugauagacuuucaguaaaauuaaaugugaaagagugauauguuugggaaguuaguguugucaguuuaugaagaauagucuacaguuauugggaaauaagauacauaaagccucagauugcauuuguguuaugauuagauagauaaagguauuauuugaggaacucauuguguugaaucuuuuuaagaaauaauugauuuccugauucaagcaccagagacagaaaaaaaaggaaguaaucaagucugcuuuaaugauacuuauugacacauaucagaaaaugauuaaacacuauggacuguauaauaagcauucacauauguuucuuugaccaagccuagcuuuauaauacagucuucucugucagggauugguuccaagaaccacuccccaaaccccugcccacaucuuacucccaugaacacuaaaauccacagaugcucaagucccugacuuaagaugucauaguauuugcauauaaacuauacacauccucccauauauuuuuaauuaucuucagauuacuuauaauaucuaauacaauauaaauguuguauaaauauuuguuauaccauauuguuuagggaauaacaacaacaaaaaaucuguacauguugaguacagaugaaacccuccuuuuuuuucccccaaauauuuucaauccaugggugguugaauccauggauauagaacucacugauacagagggcccauuguacaugcuucugauuuaagguagccauuuugccaagauuacuuuguagaaaguaaguauuaccuucuccccauuugagaugauuuuguauucugggaucugcauauuaacucaaauuauuuggguugugcuaauaauuuguuuaaugaaauagguaguuccuaagguuuauaucuguuaguaagagguuuauuugaggggaagugaaagaacuugaaagauucauggucucuaaauuuuuuuuuuuuuuuuuuuuuuuuuucagagauuuggaccaggcaagcauggaagcaguaguuucacuucuagcuggucucccucugcagccugaagaaggagaugguguggaauugauggaagccaaaucacaguuauuucuuaaguaaauuucagucaccaaaaaacauaaagcaaaaagcaaauaaagccccccaccacacaaaaaaagcaaagaaauaauacccaugacaggacuaggauaggaaaauaacuguguuuugugauuuuuuuaaagaaaguaauaugaucagugaaauuuugcuuauaauaaaacccagauugcuucauuaagucauuuacaaaagugacauugucuaagcuguuuggaccacuaauuuuauauacuaacauuaaaagugacacauuuaccagguaauauugcaucuauuugaugcuaauguuaugaaagguauacuaggcuauaucagguaaaaucauguccaacauagcacacuucauaauaagccacccuggcugauuaucgcgagagaggagagaaacaguuaacccagggccauucacaccaugcacauaugauuguuuuggaaugucugguuagcuuucuaguugauacggccuucacuauguaaaggucagucuuuuuauuucucagauacuucacauuauuuaugaaccuuuugaaugacugcagugaaguugaagaugaaagugcgcaaacagguggcaggaaacguggcaugucucggaggcuggcaucacugaggcacuguacgguccuugcaaugucaaacuuacucaaugccaacguagacaguggucucaugcacuccauaggugagaucaaaugaaaguuucauauagaaauacaaaaccuagagaacuggcauguaagagaagcaaaaauuacuucagcaaggccauguuaguaaauuugcaucuguuuguccacauuaggcuuagguuaccacaaggaucuccagacaagagcuacauuuauggaaguucugacaaaaauccuucaacaaggcacagaauuugacacacuugcagaaacaguauuggcugaucgguuugagagauugguggaacuggucacaaugaugggugaucaaggagaacucccuauagcgauggcucuggccaaugugguuccuuguucucaguggguaagugauuagaguaagcggggaagaaaagugccuggcacauagcaaauccuucagaauauauuuguucaauaaauguuuguugaaugaauugauaaaauuucagagccagaagaaagauguuuaguuaggugauuuuucagcuguagggaagugguuggcaccacuagaccugacuaguguucuguaucauuucauccuacuaaaaaauuccauuuaaacgcauuaaaaaucacugaucuacucuggugucuucauauauuugauaagguaauuagguuaaaccuaauuuuaguuaguuguugcaaugcuggaauuggaauccacgauuugugccuguuuacuaccuccaguuugcuauucuuuuccccauaaugucucauacaguuuuuuaaaaauuuaagcacuauauuugcauuugauauuaugauauuguuuauuuuaaaaacugaaagcgucauauggcuaugucucucucuuaauuuaaugaaaaauuuuccuaaaaucacaucauucuuaauacaugcuaaaacguugagacggguuguuguuccuuuccaguguuaaaaggcuauuugcuuuuuaguguaccaaaacugauuucaguuauaguaaauuaugacuaauaagguaaucuguccuuguuaacaagccuguauuuguuauaccuguacuuaaaguaaaauucaaacuccuuacccuguccuacaaggcucuaccugaucugggcccuaccucaucucuaacaucaucuuaugcuauuuucuuucuuguucaccagagccacaccagcuaccuuucugucccuccuuguuagacuuauuucugcuuuagagcacccuugcugcugccaccaccugaaaugcuucucuucugguauuuuauuuuggugagaacaccuggcaugagaucuacccucuaacagauuuuuaaguguauaauacaguauugcugucuguaggcacaaugcugcacagcagaucucuagaacuuaccuuguauaacugaaauuuuauacucauugauuagcaacagccccaaauuauugaaaccuccuugaagccuaaauuucagaaauguucaaauguuuugaaaauggauauucugaauuaucuuauuagcaucuaccuauaauuagcacugaaaauaguaauuuuuuaaauaaagaaucaguuaagggccggguguggucgcucacgccuguaaucccagcacuuugggaggcugaggcgggaggaucacaaggucgggagaucgagaccauccuggcuaacaccgugaaacccugucucuacuaaaaaaauacaaaaaaaucagcugggcgugguggcaggugccaauagucccagcuacuugggaggcugaggcaggagaauggugugaacccaggaggguugcagugagccaagaucucgccacugcacuccagccugggcgacagagcgagacucugucucaaaaaaaaaaaaaaaaaaaaaaaaaagaaucauuuaguucaaguagcuuuaauucguugaguuuuauauuaaaugacuuugagaaggaauuuucuguuaggccagaucucaccuaccacauuauuguaauccuuggaucaggcaagaauuagagagcuaugagccaugauccuggccuuuguuguuacugcuugaggauugaggcaucuuuuuauggcuaccccuauuaucuauaaauuucuucuuaucaugugauuaaacagugauuuaccauuagaucauuuuuucuugaguguaccccaaacuguuuuacuacagagaguuauaaaggaugucauuuagguaauagauagaaauuucagcccucauccuugugacccuagcuuuguauguaaaucuggcucaucucuggguucugaaugcccaauuccuuuucuuccugguuucucaaaaauccuauagucuuucuguuuuuguugugucucugccuaguauauauucaguauucgcugaguuccccgacuguaugagaagagaguagaacucuucugaucaucaaucuuauuucugcucugugcaaaugcuuguacaaaucaaacuaaauucuuugcugucaucuucuguuucugcucucuuucauuuugugauguaauuugagcugaaucuuggagauuuugucuccuaguaaagcguaggccucucuuaauagcuuuuaccgguuaauccuuggaauuaacagcuaucauagacauuguauauagucaucuaucauaaacaauguacacuguuaaaucucaggauaaauauuaaucagucaucauuugccuuaauuuagcaagugguugucaacuuuggguuuacauuuuugcuacucuuuagcuuccuaccuaagaauaaaaaugggauuguuugcacuaaccugauuuuguuuuguucucaggaugaacuagcucgaguucugguuacucuguuugauucucggcauuuacucuaccaacugcucuggaacauguuuucuaaagaaguagaauuggcagacuccaugcagacucucuuccgaggcaacagcuuggccaguaaaauaaugacauucuguuucaagguuuguaucauucauuuuguguguaugugugugcugagguaugucaaguaaugauuauguacagaaugugcagggcugauugucuucuuuuaagguaaaauauauggagcagguauaauaaacuccuauucgugcauuucuguagguauauggugcuaccuaucuacaaaaacuccuggauccuuuauuacgaauugugaucacauccucugauuggcaacauguuagcuuugaaguggauccuaccagguuugucaucuuuucacauagaaccgcuguuuuuuguuuuuuuuuuuuuguuuguuuguuuuacuaacacugcaugaagcaaggcaccuucuccccuugaucauuaaaauuaguuuuuaauuauaaaaguuauauacaaauacacguuucuuuaaugauaucuguaauuuuuuuuuaagguauccuuuuauuugccuuagauccagggacaaacuagagaaaggugucuuugacuuccaccuccagagacuguuacuaguuaagucuguuccccuguccuuuuuccaugcauuuacauauucauaugcagucacuugcaugcauacucuuuuucuaacucacuucuucuaugaugaggagugacuuaggagaagggaaagaggcuaauagguaaugcaggcugcaguuuauuuauuugucauuuuuuuaaaaauuugagacagagucucacucugccauucaggcuggggugcacuggcgcagucucggcucacugcaaccucugccucccagguucgugugauucuccugccucagccuccugaguagcugggauuacaggugugcgccaccacgcccagguaauuuuuuuuuuuuuuuuguauuuuuaauagagaugguguuucaccaucuuggccaggcuggucucaaacuccugaccucaggugauccgccugcccuggccuccaaaaauacugggauuacaggugugagccaccaugcccagcccagagugcaguuuaaaccaccauuucugugaagcuuucucugcuuguuaccagguacuacccacgaacaaagaaauaugcuuuguucugugcugugcaccaccauuguaacaauugugacgauuuaugaguuucucucuccucuagacuguuugcucuuuuacauuuuuacaucuuuauauccuuccaugaauauuuagcauggugucugccuuauagugaacauuuuauaaauauuuguuaagugaaugaauuuuaacggaauaucuuaugcuugcuuuuucuaagccacauguuaagauguucuugucugucuuucaguuaggacuuuauuuuuuacuuuuaaguucagagcuucuugaugauuguucuuccuaaauaaucauuauuuagcaacuguguaucaguugauauuuuuggcucugcauuugcugaaguaucaacuguaauaucuauucagaacuccagcacuaagccaauuuuuguuaaaauaguuaaaaacuuaaaagcaauuuuuauauuuuuauuuacuucuuauuuuuugaaauggggucucacucugucacccaggcuggagugcgguggcaccaucucggcucacugcaaccuuccugugcaggacucaagcgauucucccaucucagccucccaaguagcugggauuacaggcaugcaccaccaugcaaaauacaaaauuuuuguauuuugguagagacgagguuuugccuuguugcccaggcuggucucaaacuccuagacuaaagagauccacaugcuguggccucccaaagugcugggauuacagaugugagccaccacgccuggccaaagcaauguuuuguaaagccuuguauuuucuugccauuaagcacuuucaguuuuuuucuugacaacuucucaugucuacuuuuuuuuuuuuuuuuugcaauuuucaaguguacauaauacauuauuacggauuuuauguuaauuuugugcccuacaauuuuacugaaucuuauuauuaagcaauuuuacuuucuaaagguuaaagaauuacuuagagagugaaccagcugcuucaaauaaguuuacuauacaaagugcugugguccagauaagagaacuagauggcaaacaauauacucagguugcuuaaaaucaaacugaggcccacucugacaugucaagagcuugaaagucaacacuccuguguucacaacaugaaaaaagcuaaaaaacugaaaaucagcagcucuuagauccaucagagaauuuaaguccacuccaaaaacuggagagacagguaaauguauacagagaaucacaguuuaccaggagaagaagcugcuggagccaguaacugguaggaaagcuuagaucauaauugacgaguugcuggaggcugagcauggagugccuagagaguuaaaacuccuaggggccuagucuugcagggaccccugcaccuuuguaaguuuuaccuccagaagccucaucaggcucucauggugaagauaggagaaaaaucccuuuaugcuuugggcaggggaaggggaaaaguagccauuuuuaaauaugaccacaguguucuguuaucccuagcaaagguuugcccucaggagaaauuacuuuaccagagcuuuauuugacuuagaaguuagccaccuccagcccccucuagcguuucuguaagaagagagaaaaggcuaagaaacucuuugagucuggccugguggcucacaucuguaaucccagcacuuugggaggcugaggugggcagaucacgaagucaggagaucgagaccauacugucuaacauggugaaacccugucuuuacuaaaaauacaaaaaauuagcugggugugguggcacgugccuguagucccagcuaccaggaggcugaggcaggagaaucgcuugaacccaggagguggagguugcagugagcugagauuugcaccacugcacuccagccugggcgacagagcgagacucugucuaaaaaaaaaaaaaaaagaaacucuuugaaggucacacuuuaaggaauuuggcccaauaaaacaauggagauauaaucagauuguagaguacuucccuuccccaguaucccaguuaacggggaaacccagggacaacaaaagagacagaaauaagagcacuagaggaaaugggcgccuacaguuacagcgaacauuaaacauaaccuaacuucuaggcagauuaacagaaugccucacacuaaaguccaauuuaccucaguuccuaugacccaauacaucuugucuggcuuucaacaaaacauuacaaugcaugcuaacaaaaaaugaaaaauuagucugaggagacaaagcaagcaucagaaucagacucagauguggcaagauguauuggaacuuugaaauugucaaacugagaguuuaaaauaacuaauaugcuaagggcuuucauggaaaauggacaguguguaagaacagauggguaauguaagcagagacauggaaauuaagaaagaaucaaaagagaaggcuagagaaaaaagcuguaacagggagaauuccuuuagugggcuuaucaguagucugggcaccacugaagaaagaauuggugaauuuguaguuauaucaagagaaacuucccaaacugaaaugcaaagacaaacagaagaauaaaugaaaaugaaaauacaucaaaauuugugggguuuaauaaaagcaguugcuuagcaguguuaaauguauguuagaaaagaaaaucuaaaaugaauuaucugagcucucaccuuagaaaacuagacaaagagcaauaccuaaagcaagauggggggaggaaucagaaaucaaugaaauuaaaaauaggaaaaaaauaaugaaacgcaaagcuagaucuuuuuauuuuuuaauuuuuauuuuuuuguggguacauaguagguguuuauauuuaugggguacaugaaauauuuugauacagacauggaauguguaguaaucacuucaggguaaaugggguguccaucaccucaagcauugauccuuucuuuuuucuuuuuugagacagaguuucacucuugucgcccaggcuggaaugcaguggugcuaucuuggcucacugcaaccuccgccucccauguucaagcaauucuccuugccucagccucccgaguagcugggauuacaggugcccaccaccaugccuggcuaauuuuuguauuuuuaguagagacaggguuucacaauauuggccaggcuagucuugaccuccugacuucaggcgagccgccugucuuggccucccaaagugcugugauuacaggcgucagccaccgugcccggccuaucguuucuuuauguuacauacaauccaauuauacucuuuuagugauuuuuaaauguacaauaaguucuuguugacuguagucaccuugugcuaucagauaaccagaucucauuuauauucuuuuguacacauuaaccauccccggucuccccuuccccaccccccacuacacuucccagccucuggguaacuaucauucuacucucuaucuccaugaguucaauuguuuuaauuuuuuuagcuuccacaaauaagagagcgcacgauguuguauuucuuugccuggcuuauuucacuuaacaucauaaccuucaguuccauccguguuguugcaaaugacaggaaucucauguuuugugucugaauaguacuccguuguguauauguaccacaguuucuuuauccauucuucuguggacagacacuuagguugcuuccaaauguaggcuauugugaauagugcugcaacaaacaugggagugccgauaugucuucaauauacugauuuccuuuuguuucaguauauaccuaguagugagauuucuggaucauauaguaguuuuauuuuuaguuuuuugaggaaccuccaaaugguccuccauaguauuauacuaauuuacauuccugccaauaguguaugaggguucccuuuucucacuuuucuccuugucaccauuuguuauugcccgucuuuuggauaaaagcaacuuuagggugaugugauaucucauuguaguuuugauuugcauuucucugauaaucagugauguugagcaccuuuucauguaccuguuugccauguguauuuuguuuguguguuuguuuguuuugagacacagucuugcucugucacacagguuggaguguaguggcgugaucuuggcucacugcaaccucugccuccuggguucaagugauucuccugccacagccuccugaguagcugggauuacaggugccugccacgaugcccagcugauuuuuguauuuuuaguagagacaggguuucaccacguuggucaggcuggucccaaacuccugaccucaagcaauccacccgccucggucucccaaagugcugagauuacaggcaugagcuaccaugcccagccauggaauaucuuuuuucuuugcuuuauuuucagucuguguuuuuccuuauagaugaugucuguuucuuguaggcaacagauuguugggucauggguuauuuuuguuuguuuuuaauccauucaaucacucuuacgucuuuugauuggagaauuuaguccauuuacauucaguguuauuauugacgaggacuuacuccugcuauuuuguuauuuguuuucuggugguuuuguggucuucucuuccuccuuuucuuccuuccugccuucccuuuaguaaaagugauuuucacagaugauauguguuaauuucuugcuuuuuauuuuuugugcaucuguuguauguuuuugauuugagguuaccaugaggcuugccaauaauauuuuaugagccauucuuuuaagcugaugacaaguuaacacugauggcauaaagcagcaaacaaagaagcaaaaagaaaacuaauaaaaacucuacacuuuaacuuuaucccccuacuuuuuaacuuuuuguuguuuuuauguauaccuuauuauacugucuguaucuugaaaagcuguaguuauuuguaaaagguucaucuuuuagucuucucaagauaguaguucauaccacaauuacaguguuauaauauuuuguguauuuacuguuaccagugaauuuuguaccuucagauuucuuauugcuuguuaauguccuuuuccuuuugauugaagaacucccuuuagcauuucuucuaggacaggucuggcauugauaaaaucccucagcuuuuguuugucuaggaaagucuuuauuucuccauauaugaaggauauuuucacuggauacuguucuaagguaaaaguuuuuuuuuuuucuuuaucacuugaaauaugucaugccacucucuccuggccucuaagguuuccacugagaagucuggggccagacauauuggagcuccauuguauguuauuuguuucuuuccucuugcugcuuuuaggauccuuucuuuauccuugaccuuugggagucugauuauuaaauaccuugaguuaaucuucuuugguuuaaaucuguuugguguucuguaaccuuccuggacuugaauauugauaaauaucuuucccuagguuucauaaguucucuuuuuuuuuuuuuuuuuuuuuuuuuuugagauggagguucacucuugucgcccaggcugcagugcaauggugcaaccucugcucacugcacccuccgccucuaccuccucuuuaaggccaguaacucuuaaauuugcucuuuugaggcuguuuucuagaucuuguaagcaugcuucauucuuuauucuugucuccucuguguauuuucauauaggcugccuucaagcuugcuaauucuucugcuucaucaauuuugcuuuuaagagacucuugaugcauauuucaguaugucagcugcauuuuucgucuccagaauuucucucugguucuuuguaauuguuucaaucucuucguuaaauuuaucugauaggauuccgaauuccuucuccacauuaucauggauuuccuugagcuuccucaaaacagcuauuuugacuccucggucugagaggucacauaucgcugucucuccaggauugaucacuggugccuucuuuaauuccuucggugggucauguuuuucuggauggucuugaugcuuauggauguucauuagugccugggcauugaagaguuagguauuuuuguagucuuuguagucugggcuuguuuguacccacccuucuggggaaggcuuuccaaguauuugaaggcacuuggguguuguuaucuuaagucuuuggucacugcagcuauaucugcuuuaggggacacuccaagcccaauaacgcuguggcucuuguacacucauagcgguaccaccuugguggucuugcauaagauccuggagaauucccuggguuaucaaacagacucuuguucucuucuucucuucccuuacuuuccucuaaacaaacagagucagucucucucucugucuguguguguguguguguguguguguguguugagcugccuggagcugggggaggggcgacacaagcagcccuguggacaccagcacugggagugcacugggucuugcccaaggccugcaguacugcugccugacuaccaccuauguucacucaaggcccaaaggcucuacagucagcagguagcaaacccagccaggcuugcguccuuucguucaggcagugaguucuccguggguccagagaugccauucaggagccagagccuagaguuggguacaucagagaucuaccuagugcucuauucugcugcggcuaagcauuaagcuggcacccaagcuguaagacaaaguccuucccgcucuuccguccucuuuucucaagcagaggagucuuuucccauggccgccaucgccccaggcccauggugagugcugccuggcuaccacugauguucacucaaggcccaagggcucuucauucagcucauggugaaugcugccaguucugagucucucccuuaaggccuuggggcuccccucuaacccagggcagguccaggaaaguuuuccaggagccaaggccuggaaucugggaccccaggagccuacuuagugcccuaccccacugugucaagcugguacccaaguugcaacacagaguccccuuuauucuuaccucuucuuuccucaagcagaaggggucucucuccauagccaccacaguugguaaugugcugggucaccccugaagccagcaugucuccaagucucacccaaggcccacagcaaguacugccuggcuaucccuccugguuguucaggggccaagggcucuuuagucagcaggugaugaguucugccaagacuggguccuuccuuuuaagacagcagauuuccuucuggcccaggguuuguuuaggaguguugucugugagguagggccugaaaugggggccucaggacucugccuggugcccucuccuacuguggcuaagcugguaguuacaagacaagguccucuuuacucucuccacucuuguauuugaacagagggaaggcaucucuguuggagcuacaagcugagcugagcugccuggguuugggagaggggugauguaagcauucccuugguugcccuggcugucucacuagguccaccccaaguccacuggcucugagcccagcacagcaccaggacuuacccagaaacugcaguccuugugggccuagacugccuuucaaguuuauuuaggaccucagggcacuuuagcucuuggugguggggcuugcuggaacucagguuucaacagcugggaugggugauuuaccucuggcuaggucuguucuaaguucuccauccuugagcaccagcugagcucugcccuguguugcuuucugcuaugacagggcagcauuuaguccuaaugcaaagucccauaaucacugugcuguccgucccccaaaugcagauuuucuuugcacaccacggggccacugccaggaggugaaggaagggugguauagguaagucaagacaguuuuuccuacccgcuucagugccucuuccuuaauaugauguuaagaccagguauugugaucacuuaccugauuuucaguucuuaugaaggugcuuuuuuguauggaugguuguucaaguugguguuccaauaagggggacgaucccuggaggccuccauucagccaucuugcuccaccuccaguucucaagcuaguucuuugaaaaucaacuugggaaaaguuuuauacacaggaacacuugaauaauugaacacaaauguucauuguaguucagaauuaguagaauauucaacagguuaccauuggcaugugggaagcaagagagcacuguggcuagaagguauuguuuuagagggaaaccugaaauggacugcaguguaccugcugcuaugcugacucaaaaaaaaaauuucacaaaguaggcaauugucaggguuucuagcagucucuuugagccuuguuaaagaaauuguuaaucucauucauaccuaccaacuccuagaccuccauaucuuaagauuuggauuacuguuguagcuuaacuguucucccugcauauaauccccauauuuaggcugucucuucaauuagccacauauugcaaguucauuuuccuccucuggcuuccuaacaaccaucagccauucuccaauagauaccaaccagguguccuugugauucaguucaaccgugacacuguuuaccuggagagagcaucagauuucccauaggauaagggcugaguaagauugcuaccacuucagaugccaauuacaagccccagguuguuaccugugcuucucacaacuucaccuugaguuggauuaauuugcuagaaggacucacagaacucaggggcauacuuuacuuuuguuugccuacuuacuauaaaggauaucagaaaggauacagaugaacagccagauggaaaagaugcacauagggcaaggcaugugggaaggggcuugcagcuuccaugcugucuccaggugcacuacccuccaggcaccucuauguguucggcaaccuggaagcucuucaaacucuguucguuggguuuuuauggugaccucauuauauaggcaugauugauuaaaucaugggucauuggugauaaacucaccuucagccucucuccucuccuuggagguuggggaguggggcugaaagucucaacccucuaaucgaaacuuggucuuucuggugacuagccccgucuugaagcucccuaggaccucccagccaccagucaucucauuaucauauaaaagacacucagcacuuccagagauuccaaggguuuuaagagcaauguaucaggaaucaggagcagagaccaaauauauauuuaucacaauacccuugaauuauuguauugaguacuuaguguggaauaccuggucuauaugucuuucuccuuuuugaaaaggucaaaaggcaauuguugaauccucagcaccugauacuaagauggcagauaguagaugugcacuaaauauuuauuggauugauuaccugccgcaccuacuuucucuuucugaaauacccuuacuucuuuugucuaugcaaauucugugccuccuuuagaacucaccuguucaaugaaguauuucuugcuuugcaguccaugcuaauuucugaacucuuacuguauucauaugcugugccacacagcaaacucuaaggaaucuacagcaaugacguaaguguccaaagcauuucuguaauacguuaauuaauauagaaacaaaauuacuaauuaaccuguuaaaaacaaauauuuacucaguacuugcugugguaaggcacugugcuagucuuuaaggggacauagguaaauacuuccuucaaggagcuuacaguuuaguaagagggauaaaacacacaacagauaaguggugaguuucauaagggguguauuuugagaguucagauuaggcuaguuagagaguaaagguuuguggauuugauuacuauuggguaaaauuuaaacuacauaaaguaggcauuauuaguccuguauuauugaugagaaaaaaugacacccagagaauuuaaggauugugaccaacucauaaugauugauaacugauagagcugaaauuuaaaccuaguaagucugccugcggaaucucuuccuuuaaucacaacaucagaguuuagaggugguacugauaagaguuagcaacacugggccgggcacgguggcucaugaccguaaucccagcacuuugggaggcugaggugggcagaucauaaggucaagagaucuagaccaugccggccaacauggugaaaccuugucucuacuaaaaauacaaaaauuaccugggcguggugguggugcgccuguagucccaucuacuugggaggcugaggcaggagaauugcuugaaccuggaggcggagguugcagugagccgagauugugccacugcacuccagcccggcaacagagcaagacuccaucucaaaaaaaaaaaaaaaaaagcaauacugauuggauauggggaauaaugaaguagagcaggaaaaagugacaucagagauggccugaaugaugugauuaagaaagugauagugcuauugauaacauagagcacaugauaagacauaagaguacgaggaaaaaucaguuaauuuggggcauacugauuuuuagauaccaguggggaggggacaucuagcaguuagaaaugucagacuggaugugaaaugcaguucaagauaggggaaaccugaauggccacaaaauaucuaaaagcaugucuaaccuuaguaggaacuguggaaauagaaguuaaaaacaugagcuaccucauguuuuacucaacugcuagauuggaggggaauaagaauucuuauacaguacuaguuuuagagcuauuuggcaauaucuaguaaaguuauaucugcauauacucaauaacucagaaauuucauuuuuagguagcugccuuagagaaucucuuaugugcaagaauguucauugcaaugguguuuguaaaggugaaaaauguuuaauguucauuauaauuagagaauagauaaaucaugguauacaauagacuauuaugcaguaaagugaacuauaucuucaucuaucaacauggauaaaucucagaaacauaauguagagugaaagaugaaaguugccuuuuguuacuauugaugaaaaaaguaaagaccuacaucauucagccgggcgugguggcuuaugccuguaaucccagcacuuuaggaggccgaggcaggugggucacuugaagucgggaguuugagaccagccugaccaacauggugaaacccugucucuacuaaaaauauaaaauuagccgggcgugguggcccaugccuguaauccuaacuacuugggaggcugaggcaggagaaucacuugaacccgggaggcggagguugcagugaacugagauugcgccaucacacuccagccugggcaacgagagugaaacuccaucccccgcccccaccccccaccaaaaaaaaaaaacaccugcaucauucauauguguguguuaauuuuuucauaugggcauauacacauagaggauugugaauuggaaaaauacaugauauucuuguuuuaucuguccccucucucccccuuuuguugcuuggguauuuuaaagcauaucucagagaucauguuucuaacauauacagacuuaaacacacauacacgugcaugugcagccugaguauuuccacacaaauuaaaguuaauaauccugaauaauauaucuaagacuaguuuucuguuaaauuuuuuucaguuaucucaaaguugucuuuuuuuuuauuuuuauuuuugagauucagucuugcccuuucauccaagcuggagugcaguggugcagucuuggcucacugcagccuccaccucccagguucaagugauucuccugccucagccuccugaguagcugggauuacaggcaccugacuaauuuuuguauuuuuaguagagaugggguuucaccauguuggccaggcuggucuugaacuccugaccucaaaugaucugucagccuuggccucccaaaguacugggauugcaggcguaagccauccagcccugucaaaguugucuuuuuuuuuuuuauaguugguuguuuaaagauuccaaugaagucuacacguugcacuuggcuuaaugucuguauaagagucucuuuuaaggagugauuuuuguuauuuguuuuaaacaaaaguguuaggauuuuauuuuuauuuuuuuguagguuagaaccaucagagagccuugaggaaaaccagcggaaccuccuucagaugacugaaaaguucuuccaugccaucaucaguuccuccucagaauuccccccucaacuucgaagugugugccacuguuuauaccagguaugcuuacaguuagagauuaccauuauuaaucuaaaguuaaauuaugaagaaugcuuuaucaaagaaggaucuagcugcugauggugugugguuaacuauaauacugagucaguuuggaugaauaauacauugagaauuguuggaauugucuuugaaaaaaacuuaaauauuacuuaggcaacaguuugaaguaagagaauacuuuaaaauacuaaauuuuacuugcauugggagcaaguuuaaaaugcagugaauccauuggguaugauggauguggcugaaaugaacauauuauggauuuuuguuguugucaucuauuaaccuaaauuauuuacaggguguuucacaguugaggcgggucuccuccuugcuuuuugcauugugaauugcuugaucaucugugauuuugguuucuucauuaauguauaauuaguuugugucagguuuucccaggauagacugauuguucuguuuacuuuauguagcauauuucuuaaaagagauacugcaucaucauucagaccaaauuauuagaccuucuaacacuagcacugcaaguaaugcgucugaacucagaaaauagccauagucauggccuucuuuuuuagggaauucggucuauguucuuuuaugucuucuacuguguuuuugaauugcacauugcaguuuuaggaauuauuuauuccaagggagguccugcaaaugcauauuagccuuuuggaaacugugauucuggaagaaacauuagugggucuggaauuugggauagggguggauauaagggaaauacacaguuaucaaaacccaugucuuugugucucucucuuugcagagucaucgcagccauuugcuuuuuuagcacacggcuucaguugcuuagagacguuaacagcaucauugaaaucaccauuuuaaaagcuguuugaggcugcucuaugugaauuuuuucaccauugcuauuuuuaaagauguaucuguucuaucuguaaaaaagcuuuucacgguauacauagaugauaaaacauacuuaaccuugucucucuuaauuuaucaugacuuuucugccuuuacaaaaaggcucaaggaaacuuaggaaaauccuguauaguuuuuucaacuaguuaagucugagucuaaaggguaguuuaguuauaauaugaaacuuaauacagugaauaucuucucaaguuugggcuguauucagguuucucuuuaaauuuuauuuaguaauuguucuauugaugaaacuaggcagacaggaaauagcacauauuaaaaauagucugggucagcuucuugguuggccuaguaguaacugguuucagagagcaaguggguuucuaaaaugacagaggcuuugacuuuagcugguuaaaagugaauggggacugacuacaugauuacauggucuaggagauuguaguagaauuucuucaugugguugucauccuaaaagaaaaaucuuuuuguaucaugagcaaaguuggagaccguuuugagaccaugauucuaauaauguaaaaggaacaggucuuagcacuuauuuaguacuuaggaaauauuuaaugaagaaauaaauuucccaucccucccaccuaaguaaacaagauucuugccagcuuucacagcuaagaaaggaggaaaauagugaaaauagauuuuuaaacacuauauguggugauuauuaaacaguauguuaugcuuuuuagagcacuucacaguaaaauauccuauauuauuuuaauaacaaaccugguuuauuauguuaaaauuucacauaaaauuauuaucuuuaaaaacaugaauuaaaggugguaucagugcauuguuuaaguauuggguaaaagcauuguugaagagcagagacagcaugcuguguuguuauuaaauaaggcuuuauuuuuuaauuaguaacugguaacagggaauguuacauuuacugauuagaaagaaagauaggaaaaaagcuuuggucucaagauaguauuuuauugagucugcuucccaaaccuaguuuauuucuuuugguuugcucuuuuguuuuuauucaucuucccucuucuggcuuuuucuugccccuuugccuuuggcaguaacagaaagguaccuuccugcucuucuguguucugccuggagggauaguagucccuuugggaccuacuggggaaauguugaaagggaagugaguauauugcuagcuaauaaacuucccuggacuuuagcuccuuuuuugaguucauaucuuggccuuuaagccuuuucaaaucauguguuaaccagcucuauuacuuuauauaccuuccuuccuuaguugacuggauuaagguuauuuaagaauagccaacugugaacaugugucagauuuauaauuaaaucauuuucucauguguuguuuucacuucuccugaugguuuuaggauaaagauaaaaugauucccaaaguggauauucucguauggugagagaauucuaagaacuaauuuaugauucuaaauaaaucucacccuuuuucaguaaaucugcuucuccaaacugaaguaguuuacacacaguuuuaaggcuauaaaugauaguuauauaccacuguuacuaauacauuuguauauagucuaaaguuugaaacaaagcucugugagcuaaggggcugugucuuguuguuuuacugcuauuucccaaugccuagaaugguauuugaccuguagguacacaguaacucuuuggauggaugaauggguggguggaugaauggaugucuaacuaacuuaaagcccaaguuauggguuaugguguuggauguccagaauucccagaauaagaugccaucuauuuguggauuaaauaauucuaacaugguuuuaaaaauauuuuuaaaauaauuauucugccuaggcuaguccaaucaagagucuuuuaauuuugaaagaaaucuuuggucuagaaagagcucugagagaugaaaccaauaugugccuggaguuuuggggguuuuuuagguggcuuuuuuuuuuuuuuuuuuuaagauauuuugauaaauggucaacuguaauaugugaaaaguuuuaagcaggccuacaguuuuguucuguaauuuucucugcaguuucuucacuuuaauaauauuaaugcuucuuacuaguugagcugauaaccuucuucucccaaauguugcagagcuuuuaaccuccucugauuagaaccauuucaggaaguagccugcaaacauugaaaaauaugugaaauguuaagaguaaucuuuuuuagagagagaggucuuuaauucagaauuucuaaagugaauuuuuauauuuauccauauaauuuuuauuucuuuauucaguaggaucauaauuaaaugccagguguuggaaaaagaacuuaaagucaauugaaggauacacagagaagaauuuuacauaccaagaaaaaauuauguagacacaaauguuuuuagugugugaucuacuuguaaugaauauuuuauauuacauuucucaaaagcuaggaauuaaccaaaauguaaauauuuaauauccucaaauucacuuggagagaguuuuucugugauucauagccagaaauaguagacaugauugggucucaacauuucuugcuguuuuagugcuuggcuuaaaaauguaauaaaaauuaaaacccagaauuaaaauucauuccucaaaauucaguugauuucuaauuuuuuguugauuccauuuguguuacauuuuaugguguaauuuuauguacaagccaacauuguuuuuguugcuguauguagucggugcugugacuuguuugugcucaucucuguucuguaggcaacuugccacucccuacugaauaaagcuacaguaaaagaaaaaaaggaaaacaaaaaaucaguaaguuuggagaacuuuuuauuagcuguuucuuucaaagcaaaacaaaaaucuuuugcuguuuguuaagaauaucuucacuucagccuauuugaccuucacuguaaaaucauucuacuaauucuggcacaaaauagcuuucauuucaauuaacccuggaauuaaguuacauugaaacauucucuguguuccuuugguuugauuuaucccaaaggcaauuugugggcauuuguugcauuggauauccuuggucuaauuuuauuauuguuacuuuuuaaauuauaaaugaaugcaaagaaacuuaauuucaaggccuuaggaaacgcugacugucuucauucuugcuucuuguuugaagguaaugugagugguuucuuuucccagagaugacaguguuucuuaauuguuagaaguauauggugggaaagagucacuuucuaaaucuuaccuaaaaguugcuaaauuuuauuuuuuuacucuucauauuuuuaucuaggcagucucaggcauaauuuagauauuugugcauagauuauagaaauuuuaaugguaaaacuacuuuuaccucaaaaaaauaagagguaaaugauaagauaguacuuuugagauaaaagaaaacugaguucauauuuguagaaaaacacaucauucugcaaacauaaugugaauauacuaucugcuucuaugaacuugccuugauuuauuuaaaaggaagaaaauuaugagagucguaauuauuuucuuccagugaauggaauuuguccaaaauauaauaugcauucauuuuacauuugccauuaucugucacagugacuuaucaggcugagcccugucuuuguucauauaauccaaaugauuguagaguaagauguaaagaaaacuaaguagguaguuuucuuaaaaggguguaauuuagaauacaguguucaucugguuucaucuuucaugccuuaucuaaacuuuacauauaauaaaagcuuuauggcugggcacaguggcucauaccuguaauccgggcacuuugggagaccaaggugggaguaucucuugagcccaagaguuaaagaccagcuugggcaacauagcgagucgucucuacaaauaauuuuuuuuuuuuuuuaauuagccaggcguggugguguacuccuguagucccagcuacucgggaggcugaggcaggaggauugcuugagcccaggugguugaggcugcagugagcugugauuguaucacuguacuccaccaugagugacagaguaagacccugucucacaaaaaaaaaaaaaaaaaaagaaaacgaaaaagcuuuacauauaaguuucuaagcuguacauauaaauuaucuaagcuuuaaauauagauuuuuaaaauucaaaucaaaauuuaaauuuauagacauauacuuuuguuguguccauugaagauuuuauuuuugauuauauuaaguaaauuugccuagcuaugaucaaauugauuggauuauaaagacguuucuaaugcuucagccuucuaauucucagcauaugugaguuuaacauaauguacaccaucauuguugaaauuaauuugcugcuucuaacacucuuguucaguguuauacuaaugccauuuuguaguguaucacauaauuaaaauucaggcuuucuguguuucucuagagcauguuuucuagccuuucuaacacugcuuuauuuauuaagauuaugucuaaaauuguuucuugaaauguuuuuuuuucuacuagaguuauuuucaaaaaauuuuuuuuuaauuucuggguaacaccaaguuuuggaauguauuucucagcacagguaauacgagcuccucauggaaacaaggggaaucuaauugguaauucgagauauuuuagaguacauuccaaaguaugaagacaguauacucauaaauuuaaaauguuguuuuauggaguugugugcuuuaacaaaaccuaaugauauuuaagagcaagcugacuuucuuuuuggguguauaugucauggauuggaauauguaaaauauagagagaagaucuggcuucuaguauauagcuguguagucacauuacaaauaacuguuuauuauucucaaauauauaguguauaaugagguuuacuuugaaaguuaacugucugccuaacucagggagaaugcaguaacuaagcauauauggguaguaaugcucuugcugaaguguaguuuaugacuacaugcauucgcguuauguagucagcuuuuaccaagggaagaaaggguacauuuggcugauaacuggucucaacacacagacuggcccaaguuugaccuuuuaugcagaaugucuuuuggauccaaauuagauuuuuauggauuaaaaaaaacacuagagcauguauguauuaugagguaaaauuacauugaugucaauuaguggugaaugaaaaaaaaacaguccuuuuauaaguugacuuacgaaacuuguuauguagcauuuuuauugguuuuuaaaaucaguuuuuaguuccaaaauuauauugauucugccaucagugauacauauauuuauaugauacaugagacaguauguguuccugaggugucgauauuuuggguuuugacaugaauuauuuuuaaagauguggaagaugguaaaaguguaguacuuuucauaaaguuuacaauaugcuuuugggaaaucacucaguuuuucauuaaauucugaggcugaguaccauuaaaucagguguaaauaugagucacauuuuaaaacuucuuuguccuagagaaaaccgguaaauagcuacuuucaaagaaguauuuugucuaauugaugauaaccauuacaaauuuccuuguuccuucuccacucccagugcuucauuuuacuagcauaaaaaauaaaacaguauuuugaaagcucuccauguguuucacagcagguuaacauuuuauaaacuaacugguucuuugaaaauuaaacuauggguuuuaguuuuguaaaaacuuuuagaauuuuaaugaguuaaacguaugagaugcuaauucuuuuaaaauaaucuauuuuaaaauaauuauaaagcaguuuuuaauccuuuucccuccugcuaacucacuccuuaaaggcuuuaaaauguuauagguuucuuuugucugccuuuauuuauuuauuuauuuauuuauuuugagacagucucucugucacccagauuggagugcaguggcacgauggcucacugcaaccuccaccuccuggguuuaagcgauucuccugccuuagccuuccaaguagcugggauuacagguguggcuccaccauguccagcuaauuuuuguauuuuuaguagagaugggguuuugccauguuggccaggcugguuucgaacuccuagccucaagugaucugcccgccucggccucccagagugcugggauuacaggcaugagccaccacgcccagccagagaauugucuaagauuaaaauuugggaguuuuagaaaaccacucaguagcaaugauggucuaugaauauucuaaaauuaugugaagaauuuugugugugugaaugcauacauucauuuuucuaaccuuuaucagauuucaaagagguuccucguccccagaagguucaacaccguacuggaauagucaaagcacuggaauuuuuucuuaauuuuacaucuuucuauaguuuuagcuaaaacuucuguaucuaauucuaaauguauauauuugagcuaaaaauaaaugguauuuagguuuuaaagccauucuaauaaagcagcuauauuuagucaccuucaccaguuuccccuuauuuaaggguuaagguuguucuucaugcaauaaacacuguaacauaaagaaagcuuccugaacuauguguaguguaacugaagauggaacuauauuaguuacaacugaccucuuuuuaucaccucuuacaaauauuuucucuaaaaucuaguuuuuacuaacuuccuguuagagauuauagaaagcuauuuugagguuauaagcagugauaacacauuuaaaauguggacugcaugaagcacuacauugaacaagaugaagugaaauaauccccauuuuuuccagaguuaaucuggagucagccugucauaauuugugucauaauuuccugucauaaauuaugacaggaaauauuuauugaagcauugugaaaaaaauagcuacgugauauuccgcauguaaaucuggguccccucccaccaauauccuuugaaaugaagguuuauccuugacaucacagaauauugaguggaaugcuacaguuuuguagucacugcuacuuuaaacagcaguuuagccgcacuaagcaagaauagcuguagagauuaaaauguuacauuaaguguucuuuaaaaaugaacauauauaguauauauaaaaauguaaacugcaaaauauaauuuucaucuaugacaugauuuaaagcaggggacucuggaaagggaugggagcugaaccaguuuuauagcacucuucccgagcuaagguaccuuuuuaucuuaauguagaauguuuuauaaagggaaaaucauccauuuuaaauauuggguucacauugcuuuucaggcuggacaaccauuucuugaguucuuaaauuauuuuuauuugacagaauuauaaauugagguagacauagggguucucucuucuggugagauccuuuuuucuuuuagguccccaagaauucccaucccuccaugguuuaaauaauagguagguucuuguauuauaaaggaagcugugaagaaaaggcacuggcaguaacauuacuuguaaguaaguuuuuuuuuuucucaguaagaaucuaauauuuuauuuuguauauggcaagcauuuuuuucuuaaauucaauuguaacugguacacaacaaaauguaaauauguacuaucagguauaggauguuuugggggugugcuguugaaaauuuaguuucacguuauaaaguugaccacacuuucaugucuguuaaucuuaguaaauuaugaucaucuuugugugaaaaauuuggucugcuuucauuacucaucaaacaugcaguauaagugaugauacagugaagaucuuuuuucagguuucuucuacccaucucauccaugagguuuuucuuuccucugagauaccuuaauuguacuuuaauaugauauaagacuagaauugagaggaaacuuuauuuucucauguuuugggagaagaaaaaaauagaaauaugucauucaugaggacugauugauucagaguuuuuaugcaaaguuugaccuuugaacucuuuguuuucaugucuuuauauuaauucaaaccuuauacucaauucucaacuccuuguuuuuaggugguuagccagcguuucccucagaacagcaucggugcaguaggaagugccauguuccucagauuuaucaauccugccauugucucaccguaugaagcagggauuuuagauaaaaagccaccaccuagaaucgaaaggggcuugaaguuaaugucaaaggugaauuauuuugauaaucuagcuaucuuaaauuccccuuccaacuaaauuuucagcuuuucuuacaguacuuccucuuacauuuauauuugaaauacccuaugguuuucaguuaugugcuuuuguuuuauuuguuuauauuacaaaggaauucauuaguuagguaccugauggaccuuauuuucaugauaaaacauuuuauuauagcagaugucuuguguuaugaagaucauuuuuugcguaaucauucuagacauucugaaacagacuagaauguagacuauaggauuuuuuauuuuaaaagucauuaaacauuuuuaauauguauuuuuacauguaaauauaauaauuauauuugggaagguuagaaacacuaccuaaaauaauuuauagaaugaggaauguuugauuuuuaaguacuagcagaaauuauaucaaugagaaaauucauguuuuuaaagaaugucuuaauguauagacuucauacaauaaauaaucugauuauuuauaacccuguuuuauuguguagauacuucagaguauugccaaucauguucucuucacaaaagaagaacauaugcggccuuucaaugauuuugugaaaagcaacuuugaugcagcacgcagguaauuuucuugccacuuacucaguugcucuguuugaaucaaauauuuucgguuucacauaaauccauguaccuguuuuacaugaaguuccuguguaaguuuuuuucuuuuccugcucuaggucaagacauagcuugucuuauuuuauuuuacuauaaaagacagucaugaaauaaauuaauauuuuuuauaauuugguagugauuuucauauuugaaaaccaagagggauuuuugacaugucuaauuaaauaaaggauuugaggaugguacaauauguggacaaggaagaaguaggauucuuuuuauuuaaaacuaaaaccaaauugguaucaauaauacauaacaauguuuaauaagguuuuuuugauguuagaguauuugugauacuuaaauuuggaaguguaucuaaacuaaaauguuauucuuuaaaccaagucaaacaaacacauaagauuuuguuuaugaggaacugaacuuuaugauuuuagaaaacuuuucugcuagauuucuauaacuaguuauuucacuuuauuucucugaguuauuggucuaucuguaaaguagggauaaacucuuugccugaguuguuuuuagagaaaaaaaugagauaauucauaagaaagcgcuuuguaaauuuaugucuggaauucugcuuuucaugcagugugaaucuaauugauccucaucaucuaagcuagccuuguacaacucucucuuccaguuuaucaucauuguaguuguuacugacuuuuuuucuguuagagaaauuggaguugaaaagguauauugcugaaugacaagccauguuggaaagagagugaaugucagcauaggauucauauucuggcacucuguguacccauacaaaguuaaaaggaucaaaguuuuaauccuggcucugaccuagcaggcuauauaucuuuggggaggucuuucgucuggaccuucauuuccuuaucuguaaaauacuagccucuuuccaaaguuucauccaucuuaauuuuguuguuguuuaacuucagagccuacuuugaagcugaagccggguaucagaaauggaaagccaacuuucuccuuguccuuuuugcuuugucuaaugucaagucacauugugugaacaagcccuccauauuuguaaucuuaguuacuucacaaaguuacuucuuauaaauuuaauucaaacauaagucuggguguaucugguguugaaaauucuaaugacuuugcauuuuugaagguuuuuccuugauauagcaucugauuguccuacaagugaugcaguaaaucauagucuuuccuucauaagugacggcaaugugcuugcuuuacaucgucuacucuggaacaaucaggagaaaauugggcaguaucuuuccagcaacagguaagauuucccagucauggggauagugaacacucuccguuuaaauuuagauuaauacaauuauuggucaugaauagugcuuuuuacuuugcaucuucuuggacuaagaauuaugguuuagaaagagaaagauucuuuuuuucaaaaaaauacaaacaaaagguuaagucauauuaaauaaucaacaaaccuaccuagguuccaguggucauuauuauuauuuuuuugucagguuaagaaaucacagauuugcucuuuggguuuuuauggcuugcagauuguuauagauccaaagaaguucagauuagcguuggcauuugacucugaagaacagccaauucguaggaauucaguaauuaaaauauugucaguguuuuaauucuaugauaaacucauucgugauacucuuaaguauaugcaaauaaagcuuuauauagaaaauaccggccuggcacaguggauuacaccuauaaucucagcacuuuggguggcugaggcaggcagaucaccugaggucaggaguucgagaucaggcuggccaacauggugaaacccugucucuacgaaaaauacaaaaauuagcugggcaugguggcaggggccuguaaucccagcuacucgggaggcugagccaggaaaaucgcuugaacccaggaggcagagguugcagugauccaagaucgcacaauuguacuccagccugggccacaagagcuaaacuccaucucagaaauuaaaaaaaaaaaaaaaauacuuaaaaaucaaaauuauuaauuugggcauuguuucauuagcucuuauuagucucuuguguaacauaaauuacuugcugucccaucuaguuauauaaacuuguaaagggaccaaauuccuauguaugaagaguuccuuacaaaggaagaaugaguccaaauuauuuuuaaaugccaauaaaaaugauuagcacauucacgggaaaaguaguggacugugaagcuaaggguaagcaauugggagaugggaguuuaaaugacagggcauuuuaaucuuuuaugaauuauuaauggauugaaguagacaugguccugaggucuuuuuggugcuguuuacaaaucagcugacaguaaaaggaaaagcaaccaguuacaaguuaaagaaauguguagugcuaaaugugaacugcuaauuuuuuuucuaaguaguuugcuguaucuagggaucauaaagcuguuggaagacgaccuuuugauaagauggcaacacuucuugcauaccuggguccuccagagcacaaaccuguggcagauacacacugguccagccuuaaccuuaccaguucaaaguuugaggaauuuaugacuagguaaaguacaaccuugaaauaguugauugcuuucuuuuugguugagaaggagaguuugccaccaggccacuuguuagauaugauagaagacuaugaggaaagauguauuuaauaaucacauugccauguuuggggaauccaacuauauauuauuuauauauauaggguguguuuuauuuuauauauugauugucauaacaauaguaacaaaucauauuuuaucaucuugcuuucauaaguuuucacauuuaauacuuaccagggagugaagacaacauuauuuucaaauuauaguuaaggaaaaugcaacucaaugugaauaauugacuugccuaagauuccacaccugauucauaggucuuuugguuuuaagugcaggacuucucuacuacacuauaacauuuuucagaacccucauaaagguuaaugguuuuaaauuauuucagauuaagguucagaaaauauaguauacuucaguauugcuauaaaauuucuguggacauuuguuugaaucccauuuagugggauuuaguuugugaaugaaaagauccucauuguuagacacuuacucugugaugauacagugagaguaguuugcugaaucuuuuaaaguaccuuucacaggacuuuaugcuuaguaagugcuccuucgugucugugauuugagugcuauguucauaguauguuccaaaacagaauaaaacagaaucugaugaugagaaguuaaagauuuguauauaauaugccuugaauuguaagugccuguuguuaguuguauuacuuacaggucaugguuuuguacauauaacuccaaaccauugauacuguuaaaagaauauaugaauauaugaaagaauguauaaacauaagaauguauggguauauaguguccuuuccaaauuaauuuuuauuuuuagcucuacuagauuuuuuuuaguguaacaaauguuuauuccuauguaauuaagggcauauuuuccauacagacuauucacauuaccuaauugaaaauuauauacuacaaaaauauaauacuauuuuuaggccagacaugguggcuaauaccuauaaccccaacauuuugagaggccaaggugagagaauugcuggaggccaggaguucaagaccagccugggcaacauagugagaccuugucuuuauuagauagauagauagauagguagguagguagguagguagguagguagguagauagauagguagguagguagguagguagguagguagguagauagauagauagauaagauaagauaagauaagauagauaagauagauagauugggcacaguggcucaugccuguaaucccagcauuuugggaggccaaggcaggaggauugcuugagcccaggaguuugagaccacccugggcaacauagcaggacuccaucucuacaaauaauaaaauauuaaccaggugugaugguacgcaccuguggucccagcuaccugggaggcugaggugggaggauugcuugaggaugcagugaacugugauugcaccagugcauuuccagccuaggugacagaaugagaccuugucuauaaauaaagaaauaaguaaaaauauaaauaaguaaaaagaaauauaaguaaauauaaauauaaauaaauauaaauauaaaaaugaaugaaucaaaacaguuuuuaaauuugacaucacugaggacauccuagccauuuuucuagaaaaauauuuuuauuauuccuuuuuucugagauccuaccuucccuuacaaagcaaucuuuugugcuuuugaagauuaaguaauccaauauauauaauauacuuagcauaguaucugguacuuguaaaguaauuaauaaauguuggaucuuauuuuuguucuaaauucccacugaugcucuuggagacccauuuucuuuuuuuuaaaaaaaaugaagguagcuuuauaauauucucaguuauuuaaaaaauuauuaaauuacuugauauagaaaucuaaagaaaguuaaaaaaauuaaaaauuguuuauccucccucucagaauacuucacuuaacguuuggugaauagucucccagucauuuaucuaugcacauguacauuuguuucuccuaucaaaugauaucuagguuguuuccauuaauauuuuuaaaauucugaccugguaccagcagcaugaugggcugagcuaaugcaaucucuucccaagacauaaggcucauagaaauacuagguguaaaagaaaauauguguacuuaaaaaaauuuaggccgagugcggugacucacgccuguaaucccagcauuuugggaggccgagguggguagaucaccugaggucaggaguucgaggcaagccuggccagcauggcgaaaccccaucucuacuaaauaaauaaauauauauauaugaauuagccaggugugguggugggcacuuguaaucccagcuacuugggaggccaaggcaggagaaucauuugaacccgggaggcagagguugcagugagccgagaucgugccacugcacuccagccuggucaacaagagcaaaacuccaucucaaaaaaaaaaaaaaauuaaauuuauagcugaagcuaguuucuaagcaaauuaccuagcauacagucaguauagacagauaaauggaaaauaugaaagagguuaggagaugcagaagauaaaaugaggagguucaaaauaugucuaguagguguucccuagaaacugagcucagugagaaugggaagaaguaauauuugaaaggcuaauggauguauguuuucuagaguugaugaaugacaugaaucuugagguugaagaagcacacugagucuugagcaaacuauauaaaaauuaaaccaggcuuuaauacauaugggaacauaauauaugcuaaagcugguauucagaaucgagauuaggauggacuuucaauaaaugguuuugauaaaacugaguaaugauuuggaaaaauauuuucauaccauuuaugauaaacuuccauaaaucaaaaaaaaugagcaaagcaaggccuuuuucauccauucaaaauccauaaacuagaaaagauugauaaaaugaauuauuuaaaaaaucauaaacuucugucugggacaaaaaugucaugaguaaaaccaauccuaugguuaauauucuugcccaguaguucucuuagaauaguccuaaaagugcuuuugugguucaaagaguaauaccuugaaauuuuuggugcauguugccaaauuacccuuuagaaugccuguugcuuuuaaaauauuuuuucauuuuaguauuuuauuguuuauccaauuauagacuuuuuuacauacucaguagacaacauaaagccucauaauuacucuguuauuuuucuuuuaggcaucagguacaugaaaaagaagaauucaaggcuuugaaaacguuaaguauuuucuaccaagcugggacuuccaaagcugggaauccuauuuuuuauuauguugcacggagguaagaaauacuauguuuugggucucuuaacagaauuuuuuaaauuauagcaaauauagagagauggcaaguuugguuuuucccaguugacuuaacaggaauugaagacaaguuuacuugggagcauauagcaggguaaauagccugcguuuccuaaaaugauggucgguaucuaguagcugcuuuucauacuacccauuucauauugcuuacucuguccuacaucauuuuuuaaaauacugccugcaauggauuaauuaccaagaguuaaaaacccacaaagaaucuuuuguuuucaaguauauucugauuaaauaguacucacaacaugauaacugggaacuuuuuuuaaaggaagaaauaaaacuauaagagccuauuucugagaacuuuuaaaaauaugcuguguaagacagcaucaggaugauuuaaaaaauaauucaaaggaguggugaaaaaucucuaugaagauggugcaagggguggccuggaaaacggugcuuguucaugcugcccucaguugaggcuaguuccuagaaagccuuucuggaaauguugugagcucuuccuuaauaauagguaugaugcuugccuugcuuucccuaccauugucuuuucuuuuuugcuucauuuuaccuuccuuuugaaaacucaaucugugacguuauuuggucaguuuuacuuuuucccauuuaccaugacauacauucaugguaauugagccuuagagacaacaugauacauagagaaaccacugacuuuggaaucucaaggaccauguuuagaccuaguucugcuacucauuaguuauagacuuaaucuuuaccaguuuccugaauuuaacaguauuuaacauccaugaccauuaaguuaguagacuuacauuguuagucagcuugcuggccacagguggcaguguguaggaaacaaaucaagguugagaaauaguagagagacggugaaggaagaucaguggaagaugggaaacuugucuaauagggucauucagauagccuuaagaccaagaaguccaaaggacuggaguauuagggaaucaagaaaguaagaaaauugcauugaaccucccgccaccccccugcccuuuaacaacucuaaguaaccccugcucaccuucccaugaaaggccucucuccagcucucaucucaguugccauuucuaaauugccuaagaucauuuuaauuuucguuugcguuugagaugaaccauauuuguauucuaaccccaaccuuuaauacaaccaggauauuuuuacuuuuccguuguugucuaaguaaaaagcaaacauugguaagggagguagaagauguguuucccccucuucuuuaaaaucuuauuaguuuacaaauagcaaagauuucuggaaaacaaagcugcguuuuuuuuuuucggaaucagaaacuguuauauuuguauucccucucuguggugaucuagaaaaagcuaaaggaaagauuggaccugcugcagaucccuuagugagauucaaucaguuugguuuccaugaaaccuauugagucuuguggccugagaaugcuaagaauucucagcucugcugcuuauuagcugcauaaucuuuuuuuuuuuuuugaaauggaguuucacucuugucacccaggcuggagugcaauggagcgaucucggcucacugcaaccuccaccuccuggcuucaagugauucuccugucuuagccucccgaguagcugggauugcagacauguagaaccaugcguggcugauuuuguauuuuuaguagagaugggguuucaccauauuggccaggcuggucuugaacuccugaccucaggugaucugccugccucggccucccaaagugcugggaauuacaggugugagccacugcaccuggccuuagcugcauaaucuuagauaaguuuauuuuuccaaaucuguugcuucauauguuaaagcugggguaugugcuuauaaaaacugucuaccucuccuauaaaguguuuugugaccuauaaaguuguguaaggaguaaauuugagauuuucuuuuuuucuuucauucuuuuuuugggggauauggcacugucaguuucagauuuucaauccuuuuaguuucuuacuuagaccuacuggagcuccuccugaccuucauuuucaccuggugugaagccuagcuccaagacagaugaguacacaguauaucagagcagagcauccauuuacuccauuaugaaggucuugucugucuguaugccgucaguuuugucaaagagcacuuggguuugacuucucuuuugauauuccuguguuucuguggcuuagacuacuauguauuaaguaaugcuuuuugaauuguggauuuucuaauuuccuuaucgaugguccacagacguuucagacuugaaauguccaaaacuuaauucaguauaucuucaaaucaaccuccucuucacaccguauuucuguuucucaguaccaucaucaucccuucuaguuccccaucuagagacccuaaucauuuuaaauucuuuccucuuauugucuuucucauuguuagucaccaaaucuugguuuuaccugugagauccugggcaaucaguuaaguuguuuuaguuaggcuuuuauugcaaagcagucauuuguauuuucucaaggauaguuuuuaggaaaagcaugaauuagcgcagagccuacccagauauagagaacuagauggcuguggugcuggaacuggcuaugcucuuugacugucucucgguuuuguguucaacucuuccucaugauuuucaucuuucuguauccuuucagcuuuugccccagauaguaacccguucauuaucucaguacugcacaucugaaauuccagaaagaaaauaugauucagcuaaaaagcaucucugcuuggcagaaacuuuaauguuagguucuggccagccaguugauuacuggcugccccuauguccaguaugugcuccuggcccagcagucaugugauucaaaaugugaccacuuggcugggcgcgguggcucaugccuguaaucccagcacuuugggaggcugaggcgggcagaucaugaggucaggagaucaagaccguccuggccaacaugaugaaaccccaucucuacuaaaacacaaaaaauuaggcaggcgugguggcacguggcuguagucccagcuacucgggaggcugaggcaggggaauugcuugaacccgggagguggagguugcagugaaccaagauugcaccacugcacuccagccuggugacagagcaagacucugucuaaaaaaaaaaaaaaaaaagugaccacuuggugcuguuucuucaucaggggcuguucuuagguauguguuuuaauuuuuuuuguuuuguuuuugagacagggucucacucuguugucuaggcuggagugcaguggcacuaccauggcucacugcagccucuagcucccaggcucaaacaaucuuccugccucauacucccaaguagcugggacaacaggugugugccaccacagcuggcuaauuuauuauuauuauuuuuuuuguagagaugagguuuugcuauguugcgcaggcugggcuugaacuccugggcucaagcaauccuccugccuuggccuccuaaagugcuggaauuacagaugugagccaccacaccuggccuaauuuuuuuuuuuaguuggaccuuaauggucuaauauuacuauuacguaccuuggcaaugucuuucgaaaccauuuucccccacugcuuugcuggaacucugugucuuaccuauacuaauguagcauuauucuccuccuccuucaucaccaguugacuacuucuagguaaucuuaacauuucuucuggagccaguuuccaguagaaagcuugucugucccauugacucccuguauaaaguccaaguucuguagucaaacaugcaagguaauuuuggccuaauguacuuuucuaaucuuuuccuucuauuccauccaauauacuuaugcucuugcccugugguaagguagcauaauacaaggacauuguugcaacauuguuuauauaguggcaacaaaaaggaaaacaauagaguuguguuucaaaaggggaauuguugaauaaaugaugauacauuuacauuagggaauaaggcaauguguuaauuuugcuuguuacaagugacagaaaugcaauucaaauuuaugugugccaaaaaggaauuuauugacucauguaccuaagaaaaucaagagauguauuaguuucuugcaugacuagcugcagagcuuuaaacaguaucaucugcagaacaucugucuucucuggcucuuaacucuacuuucuuugugucgguuuuauucccaagcagcugcucccuagcuguggcugguaaugguuuguguucucccagcuuaacaaucccagaggaaaaacaccucuuucccaguuuugugguuucagcaaaagugguuggucuuacuggccuggugugagucacaugccauuccuaaggcagucacuauggcaagggggauggaauuucuugguuaucuaggccuggaucaugugccccuuccuggaaugcagugguaaagccagcccuauccaaauugcaugaacuaaaaggagggcaugggggcaggguuuucacaaaggaaaauugaauugcuguuacuagaaugaggcaaaauggauacugggcaggcagaaguagcagaaguccucuacauccagcuuuaaaaaggcccagaaagaugacucugacacuuaccuuacaagguacacgacagugugugugugcaccugcacauguguauguguagacugagaaauguaugaaaguauacauauuaacuguucacauugcuuaucucagaagugugauuggaggagauagaggaccaauuuaauauuucuguuaucuaucucuauguuguuuggcuugccaggagcauauauuguuuuuguaagaauaauuaaaaauauaaaaccccaaaguggccgggcaagguggcucacaccuguaaucccagcacuuugggaggccaaggcggggaaaucacuugggcucaggaguuugagaucagcuugggcagcauggugaaacccugucaccacggaagaauacaaaaaucagccguacauuguggcauacaccuguagccccagcuacucaggaggcugaggugggaggaucacuugauccugggaggucaagacugcauugagccgagaucacaccacuguacuccagccugggcaacagagugaggccuucucugaaagaauacauuaaaacaaaacaaaacaaaaaccccaaguuacaaagaagaguuuuccucuuaggaauauugugauaccuggcaauugcuuuuugggugguaguaguaaauaaugauaauagcuaacauuuccuaagugcuuucucugcaucaggaaacugugcauauuacauaauuucucauuuaaucuacauaauaaccuucugagauauuauuaacaauuaauugacguacguauaaacugaaacccaaacauggcuaucagaaugaucuggaacauuaaaacaaacauauccccagcccccauuuccaaaccaaaaucucaggggcagggccuuauuuauauauuuaacaggcacuccaaguguuucauuuauuacuaaaguuugggaaucucacugggucauguacuuaauucaugguagcacaacuaguaagaaucagaauucgguuucaaaccuaagccaaagcucuuaacaaaugcacuauuaauuacaugcuuauuacuauuauaauuguaugcuuggguaaaucuuuguagaugagcaugaaaaccuaaccaacaguuaugagauauauuacucuggggaaaauaaguucucgauuccaggcaucugauuuacaaaugguuuuuugaaacauaagacaagaguguacucaauauaagauaaucuugucauuggcgcaauaucauuauacauuacaaagguuagcagaauuggcaccuuuucuuagcgaaaugacauauuacuauuaacacauucaugaaauauguuaauacagaugaauguguuauuuuguagagcgcuuuaguuuaucagauuagcauuuuuugucuguuuaauaaaaaauaaaauauagaccgggcaugguggcucacaccuguaaucucagcacuuugggaagccaaggcggguagauccccugaagucaggaguuugagaccagcguggccaacauggugaaaccccucuacuaaaaauacaaaaaauuaaucgagcgugguggugggcaucuguaaucccagcuacucugggggcugaggcaggagaauugcuugaacccaggagguggagguugcagugagcugaggucaugccauugcacuccagccugggcaacaggagugaaacucugucucaaaaaaauaaaaauaaaauacaaaaacaacuucccccauaccacuccuuaucccacacccccauccucuauccccuauccccuauccuucaucucucugucacuguugcucacucgcucucucacucucaugugugugcucucucucacauacaccacacacacacacacaccccaccuacauaauuucuucucuuacaccuuuaauauaaauaucugaguuuugguucaguuuugcaaacauuuaaaaggcaaacaugguauuuugcuuguuucagcauuuaauaagguagugcauacuucuuucauauggaaggaaaacaucauauuaaguuaauauuuaaacguacacaauuauaauuugcaaaaaaaaaucaagaugauaauuucuuaaauaguaaauugaaauaaaugauauuuuccuagcaugcuugucauucagcaauaauaagaaacugagauaagaaugcaggcaguugaaguucacuucagccugagugcaaguauacacaaaacagcaaaaauauuacauagaaaauaaauguuguccauuggauugaguauggugcuaccauuugucacaguguucauauucauaguuguggcuaucuuuggggucacugcuguauucagacuugucuuggaauuuggagucaucuagggauuugaggucauuuugagauuugggcuugucccaggauuggugcuaccauuugucacaguauucauauucauaguuguggcucuuuggggucacugcucuauucagacuugucuuggaauuuggagucaucuugggacucgaggucauuuugagaucugggcuuaucccaggauugggguucauucugggauuggugcucuuccugggauuaggucuggucccgggauucaggcuugacgcaggauuggauacugccauagaauuugagguuguugauguugaaguuuguccccggaauguuaacaaacaugaagagcaggccaaucggugauagcuugaacaucauccuccucuguuucacaauaauuauauaauuuuaauugaacacuuggaucacaaauaggcaagcauauauccuuaauuguguuuaucaguacauuuguguuauguaaauguuugcuuuuucacuauuagugaacaaauuaaaagcuucccuuucuuuguugucaacaucugcugacacaagaccuauuuucuauugagggcuaccaacugaaggcaaaaacaaucccaagacugaaaaagagcuuaauuggcauuuuucuauuuaaaaaaggaaaaaaauaaaacucuagacauucaaugcaauaaauaugggggcuugagaucaguauagaguaggguaggggcaaagacugagaggcaauuugggacaguagagcaacaaaagaaauaaugaaauaaauauugguauuuucuugauuucucaugaccuuuauuccaacaauuuaagguuuuaguuuaggucacaaauuaggauauuacuucuaaauauuuacccaaagacuaaagagguuaaaccaaagcauuuccccagugcugggaugagguuuucuucauuaacaacaacaacaacaacaauaacaaacuagagaaguucauaguuuuaagauuuagaaaugaacaaaaccaacuccuucauuuugcaaaugggcucagacaaggggcauaacuuaccugagggugcauaucuaaaaaugacccaagcuagaacuuaagucugugacuuaaagcccaaauuuuaacuguagaacucuaacauauauauuaaaaguuacauuuggcucuaauauguaauugagaacauuucaaauuaauguuaccuuuugauauuuuucuuugaagaguaagaauucagucuuucuccagcgucuauggggaaucugauuucucacucacugcaugcuauuuaaauauaauuagugaggaagucauguguucuaaacuugaccugccauuugcucuuuggaaguauccaacugaguguuuccagacaacuacauauaaacagauagacuuuggcagagauuaaagaauucaaauaaaguucuaaaaucugcuugcuaauuuaaagaauccagugaauagcauuuguuauuccucuuaccauguauacauuaaugaauugcuucacuggauugacucuaacuagaugaauuuacuauuuugccugcugugauuauuaugauuuuaaaccaaguaaguguauuaaaggugucugcguuuuccuuagaacaucuguacauauguuuauagggcaguuucuacccaugguuauuuugaaguuuaaaaaauaauucaguaauacaacauuucagguauuuaauuuuugguaaauaaaguaaccuuagaaaagaaguuaaacuucauuaauaugaaacuuaagaaaaggauuacauaugaaagugauacuuuuucauacugaguuuacaaacuuuuguguguuuguguaugguuuuuuaauguauuaaaccagucaccuugaagugcauaaaguaaauuuuuugaaggaauuuugucuuuuggucagccguuuuccaugauaacuagcauauagggaaauuggguuguauucugcuaauguuuucaucauauuggccagcacacuuuaaaaauugcaggacugugaacaaugguguugacauacaaggaaauugcaacauaaauggcagaaguacaagccaguacauguuccucacuuguuuuacugugcugugaagaucauuuuuccccugaaugaauaaaccaugaauagaaccaugcuugguaaaucuuauuuauaugguacauauaauaacuucacuuaacuggagguuaauguggucagaucuaagaaguaaacaaacaaaaaaaaacuacuuggcaaccagaguagauauuaugaaucggaguacugcaguaauuuacaggaguuugucauuguccucucucugcucacuugcucauucuguggauuucuuugggggguauauaguugguaauaguaauaguaauaguaauaguaauaguaauguuucgaacuugagcaaacugugacuuauucuauuuuucuaaucuugaccuuuugaguacuacacuuacacaacucuuuauugaugcuucaaacaccucagucucaacuuguuuaaaauucagaaguuaguguuuucuccuuccuauuuuuguaucuagauauauucuucucauaaucucuugguuaauuguaucaucaccuagccaaauguuucuccaacacuggauuucucauuaucuucucuuucuuauuuaucuuaagcucuccaggccucuucaugaugauuaaguaaaauuuaaauucuauuuaguacucaaauguucccaaacaaacaauagucaauuugccauuauucaggucuucaaauacccaccaacuuuguaucuuugugcagccuccccaacuugcccaaaguguaauaauagcccccucuuauccuaaguuucacuuuccauaguuucaguuacccaugguccaccauggucugaaaauacucaauggaaaauuccagaaauaaacauaaguuggauguaucaugagguuaauaguagccuagcacugugucacagugcugcauuagucaacccacuucaucuuaucacauaggcauugugucauaucacaucaucacaagaagggcgaguauaguacaauaagauauuuugagagagaugccaugugcaugugcuuuuauuguaguauauugcuauaacuucuauuuuauuauuguuuuuaaucucuuacugugccuaauuuauaauuaaacuuuaucacagguauuucuguauaggagaaaaacacagcauauauuggguucaauacuguaauucugugguuucagguaucccugaggggucuuggaacauaucccccacaguuaaggggguacuacuguacuuuccucauucaaaauuguguuguuucuucaagcuccacucaugucagcaccuuuuauacgauccuucccuaauucuucacgucagaaucagucauuuuaguacuuuauacuuugaucagagucucauuuucacuaaagaaacuaaaucuuccaccauauucuggcuuuuuuugugguaagauaccaccucuuauuccuucuauucccucuagcuucuaauauagugaguguuuauaaagaauaggacacagggccaguuauaaagaauaggacacaggcucaugccuguaaucccagcacuuugggaggccgaggugggcagaucacgaggucaggagauggagaccauccuggcuaacacggugaaaccccaucucuacuaaaaauacaaaaaauuagccaggcuuggugguaugcgccuguagucccagcuacuugggaggcugaggcaggagcaucgcuugaauccaggagguggagguugcagugagcugagaucgcaccacugcacuccagccugggggacagagcaagacuccaucucaaaaaaaaaaaaaaaaaaaaaaaaggggcacaauaaguauuggaauucauugaaauaccuccuguuucuccaugucggagggcugguaucauuaaugaugucuaaaguaagaguuauuugguuauuugcaguuuucccuucacauuagcauaaauuuggaaggcacaggcuugaguuuaacuuucaucucuacuuuccuggcugcuguuuugagaagauuucuucauuuguacaauguggaucauaaugcacauucauaaucccuugucuguaaucugaaaccccaaauccuccaaaaaccuuaaguuuuaucaaaaaauaaaaaaguuugacaccaaaauuuauuuggugcaaaugccuuaucugcauagaugggagguuuuuagcuaucuuuguuucacuuaguguggauauuaauguugcgcugcagaaauauugaugagauugauuuuggggugcuguuccauuuucuacuggaguguuacauaauacaugauaagaauaguacuuagcauauucauguuucucuucuuccuucugggcacagcaccauaccacucuuagcauucugauaguuaggugguaccaucugacugaguucuggccaguaaaaugucaguuccaaugauguacaaucgacccuugaacaacacugggguuaggggcacugaaucuccacgcaauggaaaaucuacguauaacuuuugccuccccaaaaacuaaacuacuaauaagacuguugaucggaagccuuuugauaacauaaacagauuaacauguuuuguaaguuaaauguuguauaugcuauauucuuagagugaaauaagcuccagaaaagaaauuguuacccagaaaaucaugaggaagagaaaauauauuuacuguucucugaguggaaguggauuaucacgaaggucuucauccucuuuaucuucauguugaguagguggaggagaaagaagagggauuggucuuacuguccccgggcuggcagagguggaaguaaaccucuguauaaguggaucagcaugguucaaagccauguuguuuaagggucaacuguauaugauuuuuaagccugaugucuaacuucucaccaaucuuccauucuugcuuucuucuaucaacgccuacuagaaacagacgguucaguggagggggucuccaagacgccagaagaugguaaaaccauuagaaagcaugauuuaagagaaauuaacuuuuguugucuuagccagugauauuuugggauuauuugugacagaaauuaguucgugcugacuaacauaacuacaugcuggacaucuugccuuugccucuucaaauccacucuguucuuuacccugcuguguacccuaagaggcugaccuguguagaggguaucauugggcuccccuccuuucuggcuuucagcuggcccauagggaauacaagcggaagauuagggagaagaaagagaguaagguuaggagguauauauuuuuggcuccguuucugcagggucccagugggcuggcuacauccauccaugcaguaugguuuuuguugggugacccucuccacacaaccuacucugugucugcuuucugcuaacugcuuccugcacucacuacuucagguguaguaucacacugucucuuaagaguuuccuuaaaaccugccuucuccuuuauacauaaucucuaauaucucaguuugaauuugccaccuguuuccugcuagaaccuuaauugcuacaagcuguauguacacuguaucaucuuccuaaaaucaccaggcauggugggaugugagcuauagucccagcaacucaggaggcugauguaggaggauugcuugagcccagaaauucaaggcuacagugagcuauggauacccuaaccugagcaacagagcaagaccuugucucuaaaaaacaaaaauuaaguuaaaaaauugugucuuucuuuauauacuuacauuacuuuccguugaucuguuuuugaaauguuuccagaacugucuucccucacguauugauucuuccaaaauucuuaagaaaauggaaaaaaguaauuucugaaaaugaugagaaugaucauaaauuucauauagcacuuucuugagaauuucaaauugcaguuuuaauauuuuacuuuagaaacagguccaguuuucccuucuguaauuuuuuucuuuggucuuuuuggauuuuuuggguuuuuuuuuuuuuuuuuuuuuugaaaagaacacagagaucuuuucuugagugauauuugcacagacauugccuugguaauugaagcuuuuuuuuuuuuuuuuuuuuuuuuuuuuuuuuuuuuuuagaaaauccuauuaaguuuuaugccaugucuaugcucauugcaccugugccucaugucucauucauucauucguuuauuuuuuuauuauuuuuuuuuuuugagacagaguuucgcucuuguugccuaggcuggagugcaguggcacgaucucagcucacugcaaccuacaccucccagauucaagugauucuccugccucagccuccugaguagcugggauuacaggugccugccaccacgccuggcuaauuuucguauuuuuaguagagaugggguuucaccacauuggccaggcuggucuggaacuccugaccucaggugaucugcccaccucagccucccaaagugcuggaauuacaggcgugagccgccgcgccuggccuucaugucucuuuuaaauaggacuucuaaaauuuugaaaugaggucagcuucaguggcucaugccuauaaucccagugcuuuggaaggccaaggcaagaggaucacuugaagccagggguuugagaccagccugggcaacaucaugagacccugucucuacaaaguacauuuaaaaaaaaauuagccaggugugguggcacacaccuguauagucuuagccacuugggaagcugaggcaaguagaucgccugaccccaggaguucaagguugcagugagcuauguucccaccaccgcacuucagccaguuaaggggacagagcgagacccugucucaaaaaaauuuuguuuugaaaugaauuuauguauguuugguuauuucugaaagcaguucaggccuacagccauaccacccugaaugcaccugauguugucugaaagcaauucagguuuucaggauuaaaauuuuuaugcuacuagguuuguaaccuauauuuaaaaguagaacauuuaaaacauuuuaguaguauauagcacugaaaaguggcuuuuuagcguagacaguuguuuuucaagaaacuauuuuguaauccuagcuacuugggagccugaggugggaggaucgcuugagcucagaauccagucugggcaacaaaggagaauuccagccucuuuaaaaaaaaaaaaaaaaggaagaaacuauuugggaguuuugugaacaauggauaugcaaaaagacaggccauuguuaugagaggccuaauugugaguaccuucuagaauuguauauaagcaugauucucuucaauaguaaaaucucagccucuucauuuuagaaaucuaauauaggaaaaagaacacauuucuccauaguuguaaaacauagguucucagggugaaugcccaucuuugagcaaguuugucuuccuaaugguauaauacuguaagucuguuaucuaauuuuggcuuguugucacuuauuuuucauaaucaaagaaaaaugauuuaauuuuaaaaagaugcucuccuuucuguuuucuucucuuggaugauaguaucccuaucugucugaguuuauagaaucuuaauuuuuaccugcucuuaccacauacaucugauuagucauuaagucuuacugauucugcuucagaaauuuuguuuuaugcuucacucucaugcuaccaacuuauuugguagcuucagcaguugucuaagcugggguuggcaaauuuuuucuguaaaggaccaaauaguaaacauuuuaggcuuuauagcccauauaaaguuuuuuuuuaauuuuuuuuuuuuuuaaaaaagaaagaaauguaagaacccacaccuguaauugcagcacuuugggaagccgaggcaggguggaucacgaggucaggaguucaagaucagccuggccaacauggugaaaacccgucucuacuaaagauaaauuagcugggcguggugguguguggguaugugccuguaaucccagcuacucaggaggcuggggcaggagaaucgcuugaacccgggaggcagagguugcagugaaccgggaucgcgccacugcacuccagccugagcgacagagugagacucugucucaaaaaaaaaaaaaaaaaaaaaaaaguaagaaucauacuuagccuggaggccauacaaaaauaggucacaagcaggcugugggaaggauauuguaagugggccauacuuugcugaccucuggucuaggcuauuacaacaauuuccuaauuggaguauuugucaccgguauuuuaccccgguguaagauugccuccaucuuacacauuacugccagaaucaucucucugaaaugugaccauuucacuuccagguaaaaucuuuaugugcuccuuuuagcuaaguuuucuugcuuaagguauucauguauuacuucggggauuuuuuuuuuuuuugccauuucuucauaaccaucuauauuauuuauucaguauuuuuauagacuuuuuuuucuuaaaggaaaguuuauacugugaauggaaaaucaauauugauugccauaacuagaaaaccaacaaaaggcaacaguaaaaggaaauauagaacuaugaaaugccuguuucauguagcacccaaucauauauguacuacauuucaaaaagucacuggcuuauaaaaauauuuuuuagcaucucauacaagucucuucauaaucuguuauacagcucaccuuacuugcacgauugcugagccaaagcagaucgaaagucauuuugguaagaggcuagaugcugaccuuguauucugaaaaucugaugauucuacuguuguugaugugauuccaaguaagccugugugaacuucugggcuauucucagggaaguguuuaugacacauuguugaagguaucaucagggcaguugauccaagaagacucuaggagcuggcuaagccacaaagucugcccaaaaagcucagaaugacaaaugaauguuuuguacauuaucuccacuauaaugcuagaaaaaagucuuaaaagcauuugucucaauugaucauuuauauggaauaauacugguuaaucaucuuaaaucaucauaguguuggguaaugucuguagaaggaugcuuuaaacucuacuuggugcuucagcuaugcugaccaucucaccauugcccccuuugccaugcccugacauccucacaugucucucugcuuuugcauacucuuuuccaccugguuugaaugcccuuccuuuaucaugggacauuauccuuuccauuuaauacccaucuugauaaccugacucugacccccuaggcaaguuuaaaaaaaaaaaauucauugaaaugaaauucacccuuuuugaaguguacaauugccugggcacaguggcucacaccuauaaucccugcacuuugggagacugagguugggagagucacuugaguccaggaguucgagaccagccugggcaacauagugauacccugccucuacaaaaaaaauugcaaaaauuagcuggauguggugguugaugccuguagucccaacuacucaggaggcugaggugggagaaucacuugagcccgggagguugaugcugcagcaagcugagaucaagccacugcacuccagccuggacaauggagagagacccugucuggaaaaaaaaaaaaaaaucuuuuuuuuaaguauacaauuuugggccgggcguggugguucacgccuguaaucccagcacuuugggaggccgaggcaggugaaucccgaggucaggagaucaagaccauccuggcuaacacggugaaaccccgucucuacuaaaaauacaaaaaaucagcugggcgcgguggcaggcaccuguagucccagcuacuugggaggcugaggcaggagaauggcuugaaccugggaggcggagcuugcagugagcugagauagcgccacagcacucaagcccgggugacagagcgagauuccaucucaaaaaaaaaaaaaaaaaaguauacaauuuugcauauucagaguuguguacucauuaccacugucuaauuuuaaacauuuucaucacuccaaaaagaaaccucauagccaucaacagucacucuccccuuuccuccugcccccccucagccccuggcaaccacugaucuacuuucugucucuauggauuugcacaguuuagauguuucauauaaguggaaucauacaauaugugcucuuuugugacugccuucuuuuacuuuaauauuuucaagauucauccauguuguagcauguaucagaacuuuaucccuuuuuauagcugaauaauauucuauuguauucauacaauauauaagcguuuguguggacguaugcauucaguuuuuuuagauacauaucuaggaguggaauugagucauaugguaccucaguguuuaacuuuagaggaacugccaaaugauuuuccaaaguagcugcauuauuuuacauugcuaccagcagugaaugagaguuugaauuucuguacaucuucacccaacacuugauauugucugucuuucuagacaaauuuugauaaaucccuccuuuucuaaaccauagccaagucuauuacuguuuaacaaugaccaucuuggaguauaaauuuucuguucacacuuugaacuuuaacuuccgggucuuagaugucuuuaucuggauauacagagaaucuagguuuuguauguaauuauucaaugauaguauuaaaacuaaguccggacgcaguggaucacgccuguaaucccagcacuuugggaggccgaggcgggcggaucacgaggucaggagaucgagaccauccuggcuaacacagugaaaucccgucucuacuaaaaauacaaaaacuuagcuggucgugguggcgggcaccuguagucccagcuacucgggaggcugaggcaggagaauggcgugaaccugggaggcggagcuugcagugagcugagauggcgccacugcacuccagccugggcgacagagugagacuccaucucaaaaaaacaaacaaaaaaaaacacuaauuaccaguuuuuuuguuuuuguuuuuuugggacagggucucacucugucgcccaggcugaagugcagugacgcagucacagcucacuacagccucagccucccugggcucaagugauccuuccagcucagccuccugaguagcuggaacuacaggugugcaccaccaugccagacuaauuuuuguauuuuuuuguagaaacaccaugucuagcugauuuuuguauuuuuuguagagacaggguuugucauguugcccaggcugaucucaagcuccuggacucaaaugauccaccuuggcgucccaaaguguuaggauuacaggcaugagccaccuuauuaggccuaauuaccaguuuuaauuauagaccuacaugacuacgguuugaaggaaaaagacuuuauuuaauccuagugauuggaauuggaauucucauuugagccagaagauuucuugagugguuuuguuuucugugauaacuugguuuauauaaguaauccacauuacuuggguguuagugguaaagcaagucuuugccuuguacaacaaagauaauuuagugauugauacauucugaauaaucuggugguuaugacuugacacauacaaaaaauguuagugguugcaguccaucuguugcucuguaaaaagauuuuuguuauuguuuguuuguuuugagaccaagucucacucuuauugccuaggcuggaaugcaguggcaugaucucugcucacugcaaacucugccuccuggauucaagcaauucuccugccucagccuccugaguagcugggauuacaggcaugcaccaucauaccuggcuaauuuuuguuuuguuuuguuuuuucuuuuuuuuugagauaaagucucacuaugucacccagccuggagugcaauggugagaucucagcucacugcaaccuccgccccccagguucaagagcuucucuugccucagucucccgaguagcugagauuaaacagucaugugcuaccaugcccagcuaaguuuuguauuuuuaguagagaugggguuucaccauuuuggccaggcuggucuugagcuccugaccugaagugauccgccugccucggccucccaaaaugcugggauuacaggcaugagccaccgugccuggccuaauuuuuguauauuuuauagagacgggguuucgcuauguuggccaggcuggucucauagaacuccugaccucaggugauccacccaccucggcaucccaaagugcuaggauuacgggcauaagccacugugcccggccaaaaguuuuuuugaaucaccuaugguucauuuauuucaguuuaaguguauaauccucaaaggaaauaauccauugggauguauuuaugaaguuuaagucuguaaaacaauguggaggccgggcgugguggcucacgccuguaaucccaucacauuaggaggccgaggugggcagaucacuugaggucaggaguucgugaccagccugccaacauggcaaaaccccaucucuucuaaaaauacaaaaauuagccgggcaugcuuugcgcgccuguaauuccagcuacucaggaggcugaggcaggagaaucgcuugagcccgggaggcagagguugcagugagccaagauaaugccacugcacuccagccugggugacagcaugagacuccaucuuaauaaauaaauagccaagugugguggcacauggcuauagucccagcuacuugggagggugagacaggagaauugcuugaacccggcaggcagagguugcaguaaaccgaaaucgcaccacugcacuccaaccugggcaagacagagugagauucuguuuaaaaaaaaaaaaaaaaaaaggaaaaauucugaaacaaccauguaagaauaaaugcauccaaaugaacguuguucaucucagaagagucaccuuuggaggugaugcacuuaguuccaacuuugcugccuuugagcacaacauuuuagggaaauaauuuuuuggaaguguugucaaagucugaaauacauucuuguagaauguggaaaaucucauacuugaaauuuuuugauaagcaagacaaaaugucacguuuaguaauacuguuuuuuguuuaagaugagguuuuucugcuggacaugggggcucacacuuguagucccagcacuuugggaggccaaggcagguagauugcuugagcccaggagcucgagacaaaccuaggcaacaugaugaaaccccaucaccuguacaaaaaauuaguagaguguggugaugagagccuguaguuucagcugcuugugaggcugagaucggagaaucacuuuagccuaggaggucaaggcugcacuccagccugggugacagugagacccugucuuaaaaaaaguuuucuuauguaacuuacaaacuagcucuuagugguauuugaaaggaacagccccagaguuguuuucaguaacgaugguaucauuggaguaaaaguauagcgauccaaccugacuacuuugaagaaauaauacagaaaaugagguguaucaugugugacauuuauguuuaaauuuaaaaucaguuuauagucaacucauaguuaauauacgaauauuuuuuacuaacuucaagugauuccuugauccuuuaaauaauuuuaauaugcuuuuuuguuguuuuuuguuuugagauggagucuugcucuguugcccaggcuggagugcauuggggcaaucuuggcucccugcaaccuccaccuacuggguucaagugauucuccugccucagccucccgaguagcugggauuacaggugugcaccaacacacccggcuaauuuuuguauuuuuaguagagacaggguuuugcucuguuggccaggcuggucuccaaguccugaccucagguaaucugccugucuuggcucccaaagugcuuacaggcgugagccaccacacccagccuauuuuaauauguuuuaaagagacuuuagcuuuuacaaggugucucuaagcucauacuuaaugaccugcagcuuuuuuuguagaauuuaaagucaaggcaagagacucauaauacuuuauccaaguauauuuuguuaaagcaaaaaaaaugucaugugaucuuguggaaaagccauaccaugaggaaauuuuagcuccuauaaauaggugaaacuauuuuuaaacaauuguuugcuuucuuagauuauuugucauugguauaaggaauacagaugaguauuuaaugucuaaauaauauaacucauaaauggaugugguuguaugccaguuacucuuacacuacauaauaucucaaaugugauaaugguugcugaggcuuuggauggcaaauuagggcuuucccagugguuauugugguguauggcauccuugucuucccuuacuuauguuuuguuuuucuucuuucucaauggaaagccauuaagucuuaguuaauuuucuguugaggcaagcauuugacauucauucgaauucccucagccuuccagaagcauucaguauguuucaacugugacuaugagcaacaaaauaauacaaagugaaaaacugcguuuccuggugugaguauuucauuagauuuauugauccuuggccuuaugguauccaugugaaauguucagacaucuaauuuuuuacugcuaaauaauuuuuuuaggggauaaauaacaaaccuuguaaauuauuugaagcauaacugaagaugucagauauaugagaaauuauuuacuauuacuguuucagucauuuucacuucuaaucuuguuaacuacccaagaaucucuuguacaaaggauaguaaucauuaaaaugguuauauagcacccacaaagugcuuuaauauacauguuuuaaucuauuccuuaaaacaccuucuggaguauauguucuuaaccauauuuuuuaucagaggacacauuuaaucacuugcccaagguaaaaacacacaccguaggugauaaacuuuaugucaugcucugcuguuaaaccaccaauauaguuagaauuauuuugaucagacaagagcgaagcaguuuuccuguuuuuagugagugcguauguauguuuaauuucugugcuuugaucucauucauaacugugugugugugugugugugugugugugugugugugacacaggguguggcuuugucacccaggcuagagugcaguggcaugaucucagcucacugcaacauccgccuccugggcucaagccauccucccaccucagccucccaaguagcugggacuacaggcacacgccaccacacuuggcuaauuuuuguauuuuuuuguagagacaggguuugccgggcucagagcucaagcagucugcccaccucggcuucccagugugcugggauuacaggcaugagccacugcuccugggcucauuaauaacauauucucacucauaggugggaauugaacaaugagaacacauggacacaggaaggggaacaucacacucuggggacuguugugggguggggggaggggggagggauagcauugggagauauaccuaaugcuagaugacgaguuagugggugcagcacaccagcauggcacauguauacauauguaacuaaccuacacauugugcacauguacccuaaaacuuaaaguauaauaauaauaauuaaaaaauaauaaaaauaaaacauaguuuuaaaaauacaaaaaaaauaaaaaauaaaauaacuuuccagaaauuuagauucagaaucucaggucaggcuuucuagauaaggauaaguggguauguugagcaugugucucaccuggcucuuaaauauguuuaacaaaguuggggcuguugaaccaaacugacauuucuuaacaguugaucuucuuaaagaccucacuuugcaccacaguuuucuaaaugugaaacauacuaaucugcuuaacacauuauuaacaccuuaacaugacauuuguuucuacuucucuucuaacuucccuugagcaauuuucuauauugaauuguucauggguaucagaauuaaccuuucucuagaauuguuccaaagguaacuccacauugcccagaacuaguuuuuuuugcuuuguuuuuuuuuuuuuuuuuuuuuuuuggagugggagacagagucuugcucuugucacccaggcuggagugcaguggcaugaucucggcuuacugcaaccuccgccucccggguucaagcgauccuccugccucagucuccugaguagcuaggauaauaggugccugcccagcuaauuuuuauauuuuuaguagcgauaggguuucaccauuuuggccaggcuggucuugaacuccugaccucaagugauccacccaccuuggccucccaaauuauugagguuacaggugugagccauggugccuggcccagaacuaguuucuuauaugacuaguaguagccuagccaaauccucccucauucuuaacuuuucuuugaucuuucuuuucucaggacuuugaagcuguaacuuugaaauaaaugaaagaaacuuagacucuagaauaagacucgcagguuugacuuggucuguccuaaguaggucauuguuagccaacuagucacaucuuugaucuauguuaauucauucuuuuauuuauaaauucagauaaagguggucaaaaaaacaaacuucuaggggcaagugaaugucucagcugaaaucaaaaggaugaguaggguuugagagggcaagaagagggagagaggacaugcagcaucucugaaagccugguggcacgaagcauggugacuaagggacagaggauauuuuguuuguuugaacuauaaaauguuagagagcuggaaaauuuuaagaugauacucuaaagggaagcaaggcccugaucaugcaguaaaccauauuaagaguuuagauuuuauuaugagauaugagaaauuauugaaagggaaggguugguacacaguucaucuugugucuucuuauuucucuuguuuucuuacucagucuagaugcccuagacaaacauuucaguaguucuuuucuuagaucucuuggcuauuucaaggacaaggcagguaauaaaauaugcuuggucuacaguguuaguuagcauuuuggcauuuuucuuuuuguuacuuuuuaauacaugguucuauguccuauaauuuuuucuuauuuuucuaauauuugcguuuuccacauuucacacuuuaaaaaacucuucauaaauauuuuuauuggccagauauucuggucagugggucauuguuuacuuaauuuccuaaugguggauauuuauuguuguuucaguuuuucuuguuagaaagaaugcugugauuuaccuauaggcaaaaguuuaaaugccuuaacuguagacaaaaguuaaaauaucuuacuuuuuuaaaaauuucauugccaaauugcuuucccaaagaauugugccaauaugugaacauggccauuucauucuaccuuccccaucguugguuuuuuuuuuaauugcuugcuauuuuaauagugaaaaaugaugucacauuuuuauugcauuucucaauuacgugguuggccauauucccauauauuaaucauaguauuuuguaucuuguaaacauucuuuuuauguccuuugcccauuuauucauugagaauuuuaagauuuuuuucucauccguuuuaugagcuccugauuaacaaccuccuuuauagcaucuuauuugaauauuuuuaucaggcugguuguuucagcauaauggggauuuuguauagaccaaucuauugauaauuucuuugugauuguuuuuuuuucuaauuaaauagccuuccaccugaagacuuacaaauauuuuuaaauucuucugcugguuuuaugacuuccuuguucauguuuucuuucacuuugucaguguaucacaugaagugaguguuaaacugaacuuuuuuccaauuuccucaucucauuuauugagucuuuuccuuuccccuuugguuucugauuuuucuuuccacagcuaacaauguuugagaauuuacugugugcuaggcacuguucuaaacacuuuaucuguauuaucucauuuucuucucacaacaacccuguaaggaaauagaggcacagaaaccuaauuugcugaagugacacagcuaguaaguaaagcuuugucacauauucaguucuucuguguaccugugcucucauugugcuguuguuucuauauugugguuaucuuucuguuuuuaugccacuaucauucuguaauuauuauggcugauacauguuucucucucaagaaaagcuaauaucggccgggcacgguggcucacgccuguaaucccagcacuuugggaggccgaggcaagcagaucaccugaggucaggaguucaagaccagccuggccaacauggugaaaccugaucucuacuaaaaauacaaaaauuagcugggcaugguggcacauaccuguagucuuaacuacucaggaggcugaagcagaagaaucgcuugaacccaggagguggaggaugcagugagccaagaucgcaccacugcauucuagccugagugacagagcaagacucuguaugaaauaaauaaauaaauaaauaaauaaauaaauaaauaaguuaauguaacuguaguauuuacuucuuuuucuauucuugcuuguuucuaagugaacuuaagguuccaaaacauuucucauuggaauauuuuucagaauugccuuaaucuguaaacuauacuggaaauaauugcaacguaauaguaucccaccaaaguccucuguaccuuaguguuugauauguuccaggugcugacuaaauauuuguugagugaaagaaugaaugaaugaauggagagaccuuaguuugucaucugcaucaagucuuaauuuauacuucucauuaauauuuuucagauuuuccccauuugaugcugcauauuucauguuaauguuacuucuugacauuguauauuuuucccauaauuuucuaauuauuuguugccaauaucuguuauuucuguuuuuuuguuuuggaauuucccaaauauuguuaaaaaagauuggcaauagugggcauccuuguuucgauugugauuuuaauagaaauauguuauucuucaccagcaagauguugggugguaguguguaauacauucuuuuaucuaguucuuaaaauauauuuuauaaggaaaaauuuuaugaaagauuuuagguuaacucuugacugacauuuuugguauuaaaggaauuugcuguuguuugauagcaucauuauggaagauauugaauagcacauauuugugaucuuuuaaguuagcuauagaagccaucuucucauucugcugugguaagugaaugucuuucugacuuucuucugggucccuauuucacugauaucuaaaccugauuucuagcagggaagagacuaaagcaagcacauccuuucauucccuugcucucaguguguagagcugaaauguuuccauauaugggaauuucucauagcauuggguuuggacauacagaugugauaauaauccucacaacaacaacauuacugcaucuaggaaugugggugggccaagacacugugaaggguuuaugugaauuaugucauuuaaucuucagaaaaaaaccacuguaaguucugccagcccauuuuauagaugaggaaacugugacuuagagcagugaaauaacuugucuauggucauacagcugagaaguggcagaggcaaguugcuuguaaaguagagccaagccuuagagauggaugggugaagauagauauagauguauguguauauagguauguguauaucuguacacauaugcauacauauuugaugugcuugagagauagaugcuaaggacuaaugcauuuugaaauuuuucuggagccaggaauauaguaauacuuaguggcaaauaaugagccuuuuuccauuaauaauaagaauauaauuucuuuggaaggaaauacuaucuaauuauaguuucccucaguauaucugggggauugguuagcagaccccuguguauaccaaaauuugcgcauauucaaaucccaaaaucggcccuguggaacgugcuuccuuguggaaccuauuuauacaguauguggguuucacaucccacaaauacugugcuuucaaucuauguauaagugugcccaugccauucaaacccauguuguucaagggucaacuuuacuuuaaggcuagauaauucuucugucuaagaacuuagagucugaguaguugacguauauuguacuuguaaguuuaccaaguuugacucugcauuuugcagacaugucuguaggauugacauaauccauaggugcuccuaaugcaguagucuauaauuugacuuucuuauuacuuuuccccuuaaaaauucuaagacagcauugaguuuuugguauccucagaggaaaagacaguuaccucuaagauaccuacuuucagggcaggcgugguggcucaugccuguaauccuagcacuuugggaggccaaagcaggcgaaucaccugaggucaggaguuugagaccagccuggccaacaugaugaagccccgucucuacugaaaauacaaaaauuagucgagcgugguggcaggcgccuguaaucccagcuacuugggaggcugaggugagagaauugcuugaaccugggagggggagauugcagucagccgagaucacgccauugcacuccagccugggggauaagagcgagacuucgucucaaaaaaaaaaaaaaaaaaaaaaaaaaaaaaaaagaaaccuacuuucugugaaagucgguguauauguuuuuuuaaauaagacacaaguaugugguagaguagggauuaucuaagcaauuagucccuaucauggauggugaagguacuaaucaguguuugggagggaguggagauagcuuccguauauagagagguaaugcauuuuaaaaucauuuaggggacuuuuucaaauaauccuguuucuucauggugagauucccugacacagugagccaaucagguuugcuaaggcagaaaauguucgagagccacuguacuagacagcaugaaagaugacuguuuuguugaagcuuaaugguaauuuuuccauaauccugguccuuaaaaagcaaaaaaaagaacacauuagaguguuguuacuuuucucucucucaauagaaauguuccuaaaccagcaaaggaggcuaucugaauuuuuaaaaguuuuuacgaaggaacauaaaaauuccuuucucuaucuuuucccaccucuagaaaugcuugaaaugagauucugccuuacgucucacaaauuaaauaccacauuugugucucacccaucucaguuaugcugucuugcauuuuaaucaauccuguuucaggacuucuuuugcugccuuguggcuguuucuuauguuugucacuaauucauaaguuggcuaacuuuuauauuuguagagaauuucucagugauuuucuucuaguuggaguuccagugugguuugauuuggagugucaagaucucugucccaugccuagccuuaguccucagucuguuuuacuggguucaccaccugguuguaguaccaaaugcccuuuucccuuucccucucuccuuccucacuuccucaguacugcccaaguucgucagacccaaugauuuuauucuuaagcuaaucuuauuuuuaauuuagguaauucugauuucugauuuguaaaagauaaauuuucuucuccuucauguaguaggauuuuaauuuuguaaauauuuaaauucuccauuaaugguguguuaaaucugcacuaaaacugcuucuuuacauguuuuuaaauuuuuucauuauguuuuuaacacuuuucuuacaugcaaaaaacacaaccguuaaacuuuucuuauuaaaaugcaaagccuagugucuucuagcuuuuugaagagcuuuuguccauuauauaaucugucaaguagccaagaguuccucagaagcaggacaucauuuagauuuaaaacaauuauggcuugucuguaaaauaauguuguagcauaaccauucaugggauggcagcuacgauuuuacuucaguaaaauauccuuggauacuaccgccauuuuauuuaccuuaaagauuuuaccaagguacccuagaacaaaaauggugaggucauuuugauucugcuaaaguugguaugacuggaaagccaaaugacacaguuaugagcauagaccuuuuauuuuccagauguuugacaguguaaacauacauaaaauacauauuaaaguuuagaugcuuuauauuuugugcaauaaauugaagccuuaaaacauuucauuuuuuuuauaaaagaaacucauuaguuuacuuaauuaagacaguaaaauagcagcaaguaccaagacauugugcauuucuuuuauuuaagacaaguuacuucauuuacaucagaguuagaaauguuaagacuggcuuucuugaauacuuaaauauagcucgaaucacugguuagauauggacauauuuucccaacuguacaucagggaggagugcuuucauuaguuucagaaaaugcagacccucagacagccagcaugaccacaacauugagcaauaagagaaaugaagcauuuacuuuccaagcauuugccacagaagguaauggagucuuuacauuugugguugucucuucccuccauaaguuaaggguugugcuuuguugaggcauuucagagaaauuauuuggcaugccacuagugauacuuagggucauggguguuggggaugauuuuguugagcuagugaggcuuguguuugugaccauuccaucuuggagaugaauaguuagaguugcagcugcugcuucaugugaauugauagucucuguggauguaucuucuggauagggcacaaaagccuuaucagugcuaguaaagguggugucuuugcuuagaguggcaccaaacguuguuuccuuuguucgauauuguuuggguauuuuggucacuuuggguugaguuaccacacucagagaguuaaugguguccacugucugcaucccacuuacagugaauaagcuugagguaaauccagaaggugugggauacauguuauguuccuuuaaagaugauauuuggguagaacauggagucccuaucacaugggcuuuuguuuccaucauccacuucaguaaguaaguaauguuuuguuuguggucacaugaccaccuguuauuguaaaggguuaucucuugcaacugaaagaguuggucaaaagauuggucuggaaugaaugugaacuuauuguugugcagguaaagaugugugagauuugucagguuuauuaauguaccuggaagaauuugugucaaagaauuauuagacagguccacgauauguaguuuggagggcauguugguuggaacuguccaaaguuuguuacuacugagguugagaaccucgagacuucuuaguguauuuuuaaugaggacaaccuuuuccagcauguucuuagaaacauccagauauuuaagauuccacugauaagcaguaucagauuugucaagaaguuuaauguuguuguuagcagcagacauguuccacagagaccgagguaagugagcaggcaggcuuucaagccuguuguuugaaauguccaggguccucagauugguauauuggguuaacugguuaugcagaucaguaaagugguuauaagacagguuuaaauguauaauauucucuugcaguccagaugguaauguagacaaguuucugccugaacaguccacaugccugugccucucugugcauauacauuggagaggacaaaugcauaaaauaccaggugugagaaacagaaggaugaacaggcagagagacauuuucaauaucugauauuccaucaaagccuagaaacaaacagauacacccuucuuuuaauaugcaaauacaguuuaggcaucugcaugggucaguuagcauuaggcaaaauuuucaauaaaccucguuguugucgaguccuuuuauaauuguuccagugauuaaacuaacaaagcuccccuucauuuauaguccaaaugcuuaauccuucaauugggcuaugugguagagagagacucucucccuacucucuccugcauuuucuccuuuauuuucucucucccuccccccuuuucuaaccauauucuuucuuauuuaucuuucuagagccuuaauaugauaaaauagcauucuuugcaaauaaauaguugcaguuguaggcuauuacuauuuuugaugauaugcuuucuuacucagaugagaaaaaauggcugucgugucuuuuuuuuuuaaucucugcaguaauguaauucaauguguguauauaggguagauuuuauuuagauauuaaagcaguucuucgaaauuuuaucuguauguuuuuaggauaaauauaucuuuguaaaaagcacuugaaaaauccagaccaacacaguaccuauaaaccucacauuuuauaaagugauuuuuuucuguauauuucagugcccauuuuaaaggaaaacaauauguauauuuacagagugacugaauguauaaaaaauaucccucaacugacacugcagcaaauuucuggugcaugcacuugcuauugaauauauauuuaauccuaacguugacuuuuucuuaaaagaaaaaggaaaaagauuccaaagucagccuuuuacugauuuaaauaacaucuuaccguggugucgucuucaacaucagcaucucauuuucucugggaaacuuaaaggucgucuuguucuguagagucggaacuguuucuggcugugggcugugcuugccugcucagcugcauuguguugcugugagcugaagcucugcaaccaccugaucaguaccacauaggaggacugcagagcugucgcuggugcugacucaaauuuauggcaagaggugcacacgcaacaaaauggacaauuuuuuaaaaaauuuguggcaucaagcguaccuauauaucugauuugcuauaggaugggauaccuuaugcaugagaguuggcccuuacuccuuucuauguauuugucugagauuggguuccauauuuuaacauuugccucauuaagaaucugugaauuuuuaaaauaccucuacucuuuauccuuuuuacauguugaaaauaaauuugaccuuccucauggauaguuuucuaugauauuagucccacuauuuuuuaacuccugccuuuuuauauuccuuucuaaaauuguauaauuuucaugucacuuuuuuaauauuauaaaaaaucuguuuuaugacuuuuaugucuucccccaacauggugauuauuauguuuaaucagcuuuucaaauuuaucaaccacuuaaguguuccgucuucccuuuuaggauguauagaaguacugaaauacgauuauuuuuucuuuaucuuucugauacaaugaucauuugaccaaggcuacacacaagccaggauacauuuggaaauuagcaucuuauacuucagauuaucaguuccuauguaaaauaaacauguuuuauuuuauauauuuggaguuaaaguuuuuuuucuuuaugcaaccuugggugguaaguggauaugaguauuguuuuuuccaaagacauuuuuggugcuguaugaaugaccauuuauuugauuuuauguuuuaagaauagcaguaucaauuuaggugauuucagaguguugcacauuucaucuuucugggaaaguaguuuauaguuuuaaaauuacaugaaaugauauaaaaggaaaauuuuucaucaugaguuuuauaaagugagaucagauuuaugauaaauuuugcuccacucuucaguggacugcuuguguaaaucuguuaaaacacaaaucugauuuccagaauggcaaguuuaaagaaagcaaauaaaguuacgguauuuucguuaccaaguggcaccauuuaaaaacgaguaauauuuagcauguuauguguaaggaaagucucuuuaugccuuguuacuaaaucguuuguuuuucucuaaauuauauuagcauuauuuagauuauaccacaaauagaauuuguuguauuaaaauuugaaguuuauuuucuuacaagagaaacuauacucuaggagccaccuuuuguauaaaacuaauguuccucgaaaaguaucugcauuuuaagaguccgcaacauagaaguuuauuguugauugggugcuuuauugccacuuuacuuugaggguucaguugaacucucaauuggauucuuacuguggauuuaggaaaccagccaucaaucauagugcuuaaaauaauguguuaaaaauacuacauucagcaauauuguggaaauagggaaugcauugacauuuagaguucuauuuaagcucauauauacacugcugcacuucuaaagaugugacugagggucaauuuaccgaccacuuaaaucucuuaauuuuaggaaaccucauuaagucaguguagaaguagaguuaugcauuuucauuacacuuaacaguacuuuuguuugaaagaaaagacauguuacuucauuaauggauucaaaugaauuuggguuuaggcuguaucaaguuuaguuucuguuguauauaauagaaaauuccagugcaauaguaguggcaauguuucucauuucaaguuugggacauaccaaauugcuucauauuauucaaagauuauuguaaaauucucaaaaagaaaaagggagaucauuucaauauauuugaauucuaacaaucucuuacacugggugcagcacaccagcauggcacauguauacauauguaacuaaccugcacguugugcacauguacccuaaaacuuaaaguauaauaaaaauaaauaaauaaauaaaagaaauucucaugaaauaaaauaauacuguauuacuguuacucaaaaaaaauauuuuuuagaggcauaaguauguguuacaacuuauuuuaaauauuauucagacucauuacauuuucuauuaggcugucuaggucaguaaugauaguuaggcaacuuuuacauucuagauuaagcaguaaauuaauuuacguauucuuuuguguccuaggauauauuaccccaacauugugaaagguaucacaaagcaucugccaaggaauagcuaucccacgcuaaucagugguuucaguuuuccauuauuauagguaacauuugcuaugcuugagagucagauauuguuuauuuuugguaauaugguuggcuauuuagacugauuuuccugcugaauacaacugagaguacucaauaaaguacuuuaaaagcaugaaagaaauaacaacauagaaauuaccaagucaaaauccaaaugaaucaguuucuuugcccaccucccuacuccuuuuuuucuuuaugccacuggcuuguugccaaaacucagucaauuauuuccuaaaaugucucucaucuuggaguuuucucuuugacucuuugggaagauuuaauuuguucuucugucccccauauuuucuauaagugauuccucauaucauugacauaauugcucauuugcaucaucucacaauaauuucaaaauaauaccaguauugauugcuacaauuagauuauagacuaccgaauaaaguuuaaaauuuguuuguagcucugcuugcuuuauuuuacuaaaaguguauaguaaauucuguguucuaaugcaaugugaaauaauucuuuucuguguauuuuuauaucaccaacuugauauaaacuuuguuucaguuuucagcuuuucaggaucacaagucaaaauuauauauauaacaauguauauucagauaaaucuugcuucucugucuuuuccauccuauuuccuuccuucugcuauuaguaacuguuuuuauuaguuuuucguuguaucauuaacauuucuuuuugaaaaccuaaaaaaaauguaagcauauguaugguauguucuuauccccccuucuaauauaaaaggugacauauauacauacuguuagauaacuuguucuucuuuucuuacuguaucuugaguaucacuccauaucaguauauagguaucuguaugauucacuguuugauccauaguacuccauuugggaauguaccauggcuuauucaaccaguccccuauugguggacaucuggguuuuucagacuuuugcuguuacgaauaaugccacagugaauacccuuguaccuaaauaauuuuauauguuugccaguaaaucuuugaaaaagauuccuagaaguaggauugcuggguaaaaggguaaaugcauuuggaauuuuuccagacauuacuaaauuccucuccauugauuauaccauuuugcagucccaccaacaguguaucauggugucgaguucuauacagccucacuguauacuuuguuguugaacuuugggauuuauuguccaucugauaggcaaguaucuccaucuaauuuuaaaugcaucucuguaauuaugagggggaguauaugucuuuacauauguuuaaagaccauuuaaauguuuucuccuguaacugucuuuuuaauguuuugcacuauuaaaaguuguguuuugggucuuccccuuccugccccauauuaggagcauuuuaaauuuuagagguauuagcacuuugucuugauuuaaguuuuaauuuuuuuuuccaguuugccauuugucuuuuggcuuuauuauggugaggugugugugucuguguguaaugcgcacuugcaugugugugauauuuaaaaguuucauauaauuugauuucccuuuuuauugccucuggauuuugagucucagcuaggaagguuuuuucccgcuuccagauuauaaaggaauuuacucauauuuucuucuauuacuuguauaauuucaugguuuauauuuagaacucugguccuugguguuccaauauagugugaaguauggaucaaauuuuuucuuuuuuccagaugucuauccaauuguuccaaugcuuguuuccacugauuugauauuuauuucuggacuuuuucuucuguuccauugaucuguuuguuuagucauauaccgguaccacaguguuuuaguuauagguucccaaaggugcuacuuuacuuuuugaucagaauucaguaagaacaacaguuaaagaucacccucaucuaauucauuugugucccucaccacugacaccaaauagaagacuuaugugauauauguauguuucagugcaugauguaggugcucuuugguccuauauuagugaaaagaguguugaaccaauagucagggagcaaacucagcuuuuaauaccacuucuaagcacaucacuuacuuucucugguccuguuuucucaguaguuaacaaacaaaaggaguugaaccaaauggucuucaggguugugucugacucugguuaaugcuauuuugguuaagagcaccacuaguauguggugugaacuuuaaucuaccuuuuauuccccugugccuuauucuuuugcaguauucaugaaauaaacuuucucuucuggaucuuaguucuuuaaucuuuucucuaaaagauuuuucuuuguuccagcauuuucuucuguccugcauuuauuaguuuguaucucuuccugcugauuaagcaaggauugccacuguuuggcugcucagcuuccacugaccucacuggggaaaauuacaugcaguuaaaugugaauuauucuucccccagcaaagaauuucuuuaaaaaaaauaaaaggaaaaaagacaacauaaaaacccggcugcugccaguagucuguccuguuauacaaagaacagaaagagaaaaccucccuuuaaaaguacuuaaagauaucagacaacacuguggucagcuaaucagcucccguuuaaucuaagaaaauugguauuucccuauuuuucccuguauuucuuucaggaaagaaggugguaaaaaggggcaaaaauguggaacgagcccauuaaguaacugucacaaauguaaaaugagaacaguuaugaugauuuaaggcaugucaaagacuuggccaaguauaaaaacauaucuuauuuaccauaacaaaaauucguaaaauuaaaaagaauaauaggaaauucucaacuccagauugcugcuggggaaauuagcuuuaaaaguacuaaguuugggccgggcacgguggcucacggcuguaaucccagcacuuugagaggccgaggcagguggaucaugaggucaggaguucaagaccagccuggccaauauggugaaaccccaucucuacuaaaaaaaaaauaccaaaauuagccaggcgugguggugcacgccuguagucccagcuacucaguaggcugaggcaggagaaccccuuuaacgugggaggcggagguugcagugagccaagaucaugccacugcacuccagcgugggcgacagagugagacucugucucgaacaaaaguacuaacuuugaagaauacaugaaagaaaauuuuuaaugaggaagacaaaagauguaauaugacaauaaguaucaugcuuauucaggaaaaguaagaagcucaaggaaguguuucuauagauuaaaaaauuaauggucaguaaagauggcuugaaagauuuuaggaaaaacauuguauguaaaauuccuguguccaaaacccuacugguucuuauuaaauauggagcuuuguuaaugucaugaaugccagugcuaugaauaaaugcuauguucuacucugaaaaucccagaacuaugagugguucuccaagacugggcuaccauuuuauucuaagugcuuguuucccccuggaguuagaugggacuaaugaggaagaauaugugcuuguugggcaaaggagcacuucugcagacaaaggcuggcauccccaaaaguauaggcugaugaccacucuugacuuugacaaagauugggcccauuccuacucuaauaacucagacuuaccaauugucagauaauggauaaagaugaaauucuguguaagaaaggugacuuaagaguggauagcaucagaaaguauaaguuuaguaaaaaguugagaaucaucuguguuuugauagucucuuuuccugaaaaaaaaaucacccaaagucacccguauuuagaaugaagccauagucuucuuuuccuuuuuuuugcuuuauaaaacuugauuuuguuuggguguuuauaaagaagaaacuuguaaagaugccaguuuuaaaauuugugcccccccaacaugguaggaaaauauuuacauuuuaugaugcauccucauauuuuuuucaggguaaauguuccuaacccaacccuucaguugauguuuuaacauguuuguuuuacucuuugcaaugaaaccaagaagaaaauuucucuauucucaaacaugcauuuuaaucucccauucccacaaacuuggaauauuuauuuaauacuugagguauuaauuuaaaacuugaagcauauacuuagucucuuauuccucuccacccuggucuuugaaauggaaacauaaaaguuuauucaccauaauuuuauacacagcuuuucaggggaaaaaaaacuguacuggguaauaaguauauguagauuguuucagaguucuuaaauuauugaaacauaccauuuacauauguaaaauguacuauacuuuaaagauagguacuauaauuaguaaauagauuacuguuaaauaacuuuuuuuaaaaaaaaguuucaucuaugcacauaggcucugagcagauuucagauaguuccugaauaaaaaucaaaauugacuaucaguugccauuuuauauauguuaacauauaaagaaaaaagagucauuugaggauggaagaucagcuaaaaagcaaguuguaauauuuauaacaguucugcagguggagguggcagggauucauuaagaucuugaucagaguugggaggaauagagaacuccugacacuggaucucaagguuggaaucuucuugguuuuucauaaaaucuacugguggcaggggcaaguuaagugagucaagcgguggaaaugauuguauuaucucagauuuaugaucuccacagucuugauugagacaguccagagauggagggagacuaguagaaucauuuggaagaggagauacaauugucauuguggguuugucagauugguuacuuuccuguccuuccaaauccagaaggggaggugguggaggcagaucugcaucaucugaagaagaaacagcaguuccaacuguugaaccaucagcacuaucuucugauguaccauuuacuugaucuuuuauuuucucuguuuugggguuguuggagucuucaauguuuucacuugauucaaacaacuuaauuucuaagucaucugcuaaaagugugcuuuugcuugguuuccaggguguaagugaaaugauugauguacguuuuguggauauuucauuuucucugauguuauccauacaaaugucagggguuucuccaucagcaaauggagaucuaccugcccaauuuugaucauuuaaaacugguuuccuuaagcauuuccaaaguacaaugaugauuauagcuaccaacauagaagucagaaguacaccaauuaguauggcagcuauugaauuauaauuguuuuuuugugggguuuguuuguuacugguaguaucuaagauaaauccugguguacuccuaggugaauuuuugacaguugauguugguuguguggauggauuaugaacaguuauuuguuuucuagaagggaucuggacagaugaugauuguugaguaaaaguauagacaaaugacuuuggugguugugugguagaaguacgggcagaugguaguugucuggcagaggugaacacggcuugcugggaggagguguuggcuauugguguugguuguuugguguuguaggcaagugguuguccagcagaaguaugugcuucugguuuuucagaagagguauagacagcugguguugguuguccagcagugacuuuggcaggugauauugauuguccagaaaaagugucgcugaauuguguugguugacccaaaggauucccuguuguguuuugagaauuagccaauaccugugacauugaugaugugaauaagguaggcugugacugcuucucuguuguaauugucucugucuuugaaaaaaauguauuguucagguguccacaaaacaaaauuaagaugaaauauuugggauccauuucagaauauuuccucguuaucuauagcggguuuauaaugaaagagaaagacaguuaggcgucauuggugucuaguuaaaaauuugacuuuucauuaugauuccuggcauaaaguagguagacauuauuccuaauuaguaguaguugauuaguaguuauuauuccuaauuuagacuugauacacuguagguuugguguaacaacucuuggauauacucuaacccaucauacagcauuuggaccucauaagcagugaucucucuucuuuuauuaauacaaguucuguacuuggcucugcugccccucuagcuucauuauauuucaguacuucacuuagucauacuucucaaaacgcauaggcucuauaugcuggauccauguguucucuaccuuuuuucaccauuuucuacuagaaauauauugauucuccugccuugaagaacaccagugaucaucuguuaccuaaucuaauuguucuuuauuucuucucuccccuccccuccuugaccacauuagacacuacuguuccuucacuaauauucaaguagcuuuuuguaaucagucuuccuuucauguuacucucacuagcucuuuuucuucugccuccuaaauaugguuaauugauauucuguccucacccuuaccuacuuuucuuuguuccugauucuguaagauuuuaguucucagcuuuaugccacaauuccuaaaccuguaccuccagccuacaucuucuuuguccuaauucuauuugugugacuucuugguggauuuuuccauauuuuauauauauagauagauagacauagauauagauauaaauaucucccacuaucagcaaauucaacauauuuaaaauggaguucaucuuuacccucacaacugacaacugacucuucucccaacuucucuguaucuguuaaugguaccacuaaguuucuuaggcacagagucuauuaguaaucuuugaagcauccuuagugucucuguagcgugguagccuuauguuaauauugcauauuuuuaaagaauuucauucaacucagagucuuaggcuuaaaauccuagagugaucucugaaucugguggaguaaauucaauccaguuggucaaguaguccugcugcugcuuucauucaucuauugguaaaugccacauuuguguggagcucuguucuagguuuaggagauuaaaaaaaaaaaaaaaagauagucacugccuuuaaguguuucagauucuagugauagaagcaaacaguaaaggccaggcguaguggcucauuccuguaaucccagcacuuugggaagccaagaugggaggaucguuugaggccaggaguucaagaacagcauggaccacauaguaagaucccaucucuaaauaaaaagaagaaagaaaaaaagcuaaaaaauaauuacaauaauuuuuuuuuuuucaagacagucuuacucugucacccaggcuggaguguaguggcacaaucugggcucacugcaaauuccgcuucccagguucaacugauucuccucucucagccuccaaguagcugggauuacagguacacaucaccacgccuggccuauuuuuguauuuuuagcacagacgggguuucaccguguuggccaggcugcucgagaacugaccucaggugaucugccugccuuggccucccaaagugcugggauuacaggugugagccaccacgccuggcccaauuacaauaauuugauaagcuuucucauaaaaguaugcaggagauguacagagaaguuaaccuagccuggaaaggcuucagugaaguaaagcuugaacugaauuuuaaaagucuauaaaaacuaauuaaguuuccagccagggagagcaacaaugugggcacaggaaaauaaggcacauaugaaaguuuggcagauagggcuuuuucugggaugugguagaugcuaaaacuuggagaguuaaguuucaguucuacuucucccaucuaacuaccugucuaaccaugagaacuaguugcuuaaccuuuccuguucucaauugccuuuccucuaaagugaagaguucuacugagacaauuugcaacuuuugguauaauauacuuguuuugcacaucaucaaacacaauggcaacuauuugguuaucucuuaacauuagggaauagaaaaucuuaggguguuagauauugguauacaugauuagaaacuauaguucuucugacucauaagccuauauuuagagagauuugauguucuguuggaaggugcaauaaagguuuuacaaauuaccuuuucagcauaucuaaacagcauaucauugcuuacuccucuaccacuugguacacagugaugauaaauggcccuguuuuaguagaagaaaagauaugugauuuuuuucccuauacgaauaauucaagccugaauuuuaaaacaguucuccuuugaacucuccugcacacugcugaauuaaucuuaaaagugugcaugaucagguuacuacugccuugcuugaggguuuaauuucuguuaagauaaaacuuccuuuuucuuuuuuuuuuuggagacagagucguucugucacccaggcuggagugcaguggcaugaucuugucucgcugcaaccucuacauccuggguucaagcgauucuugugccucauccucccgaguagcugggacuacaguaggcauacacuaccacaccuggcuaauuuuuguauuuuuaguagagacaggguuucaccauguuguccagaccggucucgaacuccugaccucaagugaucuguccgccucagccucccaaaaugcugggauuacaggcaugagccaccacgccuggccuguuaagauaaaacuucuaaauugaguuuucuuccuucuggcuugaguuaaccaguccagauucacguaucaugacugaaacuucuuauccagccaaaugcaucccuuucccaccuugcauacuuucuaaacacacgauuuuucccugcuaaacagacacuucuaugcuguuuuuuacccuucucaaggguguucuuuuuuuuuuauuuuucuuccagaccuagccucuuccccuuucuggcugcauaucugaaucuguccucaucuuucagaccucaguuuaaauuccccuucuuaacccaaguucucugugacugacuacagcccaaacagaucagucauuuacugaauucccccuagcucucauuuauuguuuuuaugguuccuuacauaauucauguauguaucucacucacacuucuauucucuuaaguaauuguguuuacuuuucacauuuuccuauaccuacuuccuugaacaagauuauaaagaaccuugaagaaggcagaaaggagaaagaaaaauacuuaucuagagcauauuauguguuguacuaucccaguuuugcauacuuuauuucacagaaccuucaaaugacuuuauaaggaagguaaagggaucccuuauuuacagauaaagagacagugucaaaugaguuaagcaguuugccugauguuauaccacucgaagugacagauugggaguuuguacccagggccaccugauuccaaagcauacauucuuucugcuacccuuuauugccucauguuuuuauauuuugauuucuuuguaguuaaugccuuauauauuaggagcacaguaaacauuuaaccuguauugggcuucuugauuccuuuccauuuuaguuuuugcuuuuuacuaguacuucuaccagaaaauaagcagaggcagugaaaucugaguuaauaaauucugcuuuuuauccauuuugcaaaagauuuaaaagggaaaauuugaacacuuuuggcauagauauagggauuugaauaaucucuggauggucaucauccaugcaguuccuacccauuauucuuauagauuacaaaaaaaggcggggggacuucuuuagaaaauguuauucucuucagaacuucauuuuaaaaaucuguuuuaaugcuaugcaaagcaucagaaaauauaagccaugaauugucuuuagccaaaaauguuuccucuuuugugacuuugcuuaaaauaaggaaaccauacgguuccucuuuucaguuagcugaaaaaggcauuagagaaggacagggcccaaacaggaacauaauuuuaaacccagguuaguuuguaagaucaauuuugauaggcuccuauccucuacugucaguaguaagcugguggaacccuccauguaugagauuuucacuugucaguuaacgguuauggcaauauuaaaaccaaauuccauuuuuugccuauccuaacacuuucuaccacucuucaguuagcuuuuuauccuccuaggaucugccacaucagaguacuagaaacuguauuagaauucuaugauggcaauucaguguaguccagagaaggagaagaaagauuuaaaagaggaauaaauagggaauaugguaguggaaaaaacugacuuuuuucccagcgguaaugaggccagcguuacuaccaguguggaagguuauuuagcauacacauuuuaaaauauguaagugguguguaccugaaguaccaacauuguuucuguagguaaagaacaauauugggcaggggaauaaaaaggagauuuagaauaauauaaaaggcaaugcaaagaaauacaaaauaacacaaaagagaaaaaacaaaaacucuaggaagcagcgaacagaaaagaggaaggucaauugacuagagaagauacagaaaagaagaaaaguuaauaaacaggugaaaaaaaaagcagugguuauauaauuagcaagaaggcaguguagaugauugaaguaggcaaaaugaaguuggggguggggggagaugauugaaguagaugaaagaagcaacggcaaaaugcugcucuguuguggcuggccuguguuugugagugcagggagacaguaaagaggagcuugcuuucuaaaauggaggaccagaaggaaccauccuuucaaauucauuuaccuuucauuucaggcucuccugucugcugugaguauccuuaccauccucucccuuuuuuuuucccugacacuauccagaagcauaccuagcaauuauuccaaagaacccauguacccguguacguuuuauauagaguuuuccagaaaucccuuagucugcugcucaagcaaauuugucagcccucauaugccgguuuuuacucauuauuauaggcuggcacuuugagguuuaaaucugugauuuugguucuuuuucuuugcugaauauuuagaauauuuuaaaaagaaaaacauaaauuuaaacauuuuaaagacaguuacagugaagcaggaguccccguguauaagacauguucuuuuuuuuuuuuuuuuuccguuuggagacagggucucacucugucacccggguugcagugcaguggugcaaucucagcucacugcagccucugccuccugggcucaagcgauccuccucacaccucagcuucccuaaagaaguuagaaacugcaggugcacuacaccacgcccaacuaauuuuuguauuuuuuguagacaugggguuucaccaugucacccagacuugccuugaacuccuggacucaagugacccacccaccuuggccucccaaagugcuggaauuauaggcaugagccaccgagcccggccauagacauguucuuauaaauauaaugcauaaguacuuaaaggguccagcauuuaaaauugaugcuguuaaguuggauauguuaggaaguaugccauuaucuuuuaaagagaaucaagauuuggagagcauauccuagacaaaagacaaguauagauagcuguaucaauuacuuugauauaauaaaaguugugaugcaaauauaauagauuaaaauuuagcaguaguauuaucucuaacuagugaaguuuugaaaccguaaaagaaaaaaccagccauucugcaucuugaggaaaaguggaaagagaaauugaccuucaacuacaauaggaaguauuugaugaccaucuuguaucaugauagugaccauuuacugagcacccaccaaaggcuaagcaguauccuauuuuaauuagcuagguggugguuuuuucauccuacagauaaggaaacugagacaccacgauguuggguaacuuggcaguaucacagcucuaaguaguggcacuaauacaaaaaucaugcuaaucuugugccagaaccguuucuuucuaucacauuucacuguaugugcuauacugccuuucauagaaaaguuaugaaauagaaaugcuuuaugaaggaaggagaugugaguuggugggaauuacacguaaauaacacuuguagguagucuuagauaaaggguaggaaagaaauaccugaaaacccauuuuaguccugauucuacgaaaacuauuauaagaauuuggaaugguuucuauaaagugucauauuuaguaaguuuacugaaaauuuuguggugauuuuuuuuuuaaagcuuggacauugaaaggcaucagauuuauguuucucaauucaaacuuaaucagaauuaaaguuuccuucuaaguagaauuaugugggaauuagcuggaaaacacaggcacuacuaguaaacuuuagauuugggacuaacccuuuaaaaacauguaugggaccaggcgcagugguuccugccuguaaucccagcacuuugggaggccgaggugggccaaucacuugaggucaggaguugaagaccagccugaccaacauggugaaaccccguuucuacuaaaaauacaaaaaauuagccaggcgugguggugggugccuguaaucccagcuacucaggaggcugaggcagaagaaucucuugacccugggaggcggagguugcagugagccugugagccaagauggugccgcugcacaccagccugggugacagagggagacuccaucucaaaaaaaaaaaaaaaaaguaugggauucuaugacaaaaacacaccauaaggaucgaugggaaauuuuuuaauuuuaugaaauaugacagugaaaaaaauuuaauauaauuuuaugacuuuaugcauaaugaaauaaacuaaauauuagaaguagaaaaauauauagacaagccuaaucugaaaaagagauaaauaucuuuauuuucugacuuccacaguaauuacuuagaagaaauccuucuaagagaaagucaugaauauuuauuaaguguugaaaugggauaucacccacuaugaacauauuauucccugaaauuacaagucuauguaaaauacucuuugcaguuuuuauuugcccauuuuacccacagcaagcaucuuuuaugcauauuaacaauuuucuauuguuuauucuauagguuucuucuaucuuauacuauguucuaaagucucagauaaugugacauaaacacguagaugauauuaauauacgcaugcauguuugauuauugacuaacauuuuuggcuuaguaagcuuuuaaaaugagccauaauguuuucaugucaucauuauuaaauauaaaaucuauauguaaaaaauaaagcauguauaauaauaauagucaaauaccacaucugauuucuuuuucuuucuaaauuaagugaaagugaccauucuuacuaugcaaacuaaaggggauacaaaaauuuuaauuuaugcauuauauuauguacaggaaaauucuauaaaaaguacauuagaacuuuuaacaauuaauauuuuggagguuauaaauucagucauagccuguggaaucuaguucuauuucuaacccuuagcuuuaucugccauggcuauaguuucuuuuuaauucuaaaacuaagguuaacaaauaugauuguggcugggagcgguggcucacuccuguaaucccagcacuuugggaggcggagguaagcggaucacccaaggucaggaguaggagaccagccugggcaacauagugaaaccccaucucuacuaaaaauacaaaaaaauuagccaggcgugguggugggcgccuguaauccgagcuacuugagaggcugaagcaggagaauugcuugaacccaggagguggagguugcagugagcugagaucgugccacugcacuccagccugggagacagagcaagacucuaucucaaaaaaaaaaaaaaauaugugugugugugugugugugugugugugugugugugagauuaaauaaacuuaaaaggucuuauacaaaccuaggugaaaauauuuuucuaaggcaagcugaacugaguauuuuuuaauucuaugcaacaaaaccacaaaaaccuguuauagacaucuuuagacuaucagaguuuaaguuuaaaacacuaaugacaguuuuuaaaauaaauuuuauauaaagcaagaucaaaccaaauugugugaaaauuuucuuaccucagcuguuaacuucuuuugcagaaugcuaaauucuuguucuaacuggacauuuuggugauuuggcuaagaaaggaaaaugggugguucaauucagauuuaaaauguuccucuagcaaacugaaauaguuucuguagaaaaagaggaaguuuaucaauagcugguuccggaagugcaauaaaccacaaagugacuaagaaauauauuacuuuaacagaacuuauuuugaaauacauuuuggagcccuaugauuugagugcuuuuaauuauguaaauaaauauuugagauacucuaguaauaugauuauguaaauuaaauauuuaggauggagucccgaagagaaaauuacauguucuaagaagaaaagcugccaguuggguuaucacuuacagugagauuucuucucauaagaagugagugauguguucuguuuacuuguaugaccuuaggcaagacucugcacuucugagucaccguuuccuccucuaaaggaauauuuuauuggguuauugugaggauuaaauaagauagcauaauauaacauguauaaaugccucaccaacugcagguaaccaauaaauguaauguuauuuccucauaauauaaaaaguccaggguaaaaguauaauuacauuauuuugcaaaugacaggaucucauucuuuuuuauggcugaauaauacuccauuguguauauguaccauauuuucuuuauccauucaucuguuuauagacacuuagguugcuuccaaaucuuggcuguugugaauaguguuacaacaaaagugggagugcagaugucucuuuguacaguuuuccuuucuguuggguauauaccuagcagugggauugcuggaucauaugauagcucuauuuuuaguuuuuugaggaaccaccaaacuguucuccauagugguuuuacugauuuacauucccacuaacagcguacgagaguuccauuuucuccacacccuucccagcacuuguuauugccugucuuuugaguauaagccauuuuaacuggggugagaugagguaucauuguaguuuugauuugcauuucucucaucaguggugcugaguacccuuucguaugccuguuugccauuuguauauuuguaauuaaauuauuuugaccaaauauuuuacuagugacuuuugaguucaaguucucaacuauuuauuugauuacccacaaaguaguuacuucucaguggaaaauaaaauaaauuggggaucauuuuuuaaauaagaaguuaacuaaaguuaacuuguuacuaaaggguaaugagggguuggggagaugguguuaccaguuaauagguacaaaaaacaauagaaagaaugaauaagaccuauuugauagcacaacagagugacugucauuaauaccauaauuauacauuuuaaaauaacuaaaaguguaauuggauccuuuguaacacaaaggauaagugcuugaagggauggauaccccauucuccaugaugugauuauuucacguugcgugacuguaucaaaacaucucauuacccuuuaaauauauacaccuacuauguacccacaaaaauuuaaaauacaaaaaauuuuuaaguuaacuaaacaaaguguauugaaaggagugaguccaucugaauaaaaauuucuuugaguaagucaccuuuccucucuugaaaaauggagaucauaauuccuaauuuauaagcuuauuguggaauuaaauaaauguaaagugccuuggaugaugcauauuauaguagguacggaauguguuaacccaugcacugcuuuuuccuggucacugcgggaaacacagguuauuaugaccuuguucuuaacuucaggguacuuauagcuuggugcaaaaagaauaguuuuuuuuuaugggcuccuacuauaaagcauaauauaaucaaaugcuauaaagcuuuugauucacugguuuuuggaaguauuguuguuuuuacggacaggguauugcuguguugcgcaggcuggucuugaacuccugaccucaagcaauccuccugccucagccucucgaguagcuaggacuacaggcacaugcuacuaugcucgcuggcuggcuuauuuauuuauuguaaagaugaggcucuuacuuuguugugcaggcuggccucaaacuccuggccucaggugauccucccaggauuauagguguaagccacugugccuaaccugauucacuauuuuuaaaucccugaauuaagcuggugaacuguaauacccagggguagggaauguguuuuuguucaaaacuaaaugacuuuuaaauuuugaacucaaagauaucuuaccuaccauuuuaaaauaccugucauuuggaaaggaaacacuucuguuuguucaguaacuaucauuggauaguaccauucugagaguauauguuuaauagccaagauagugaguggugaauuuuaaauauucuuuuaaauauccuugugguagaagcucucuggugagaaaauguuugaccaguauguugaauaugaaaguaauuuccuauuuuuaugaugauauuaauuucuuuuaauuuucucugacacguguuuauuuaugacccuugauucaaggagugcuuuguguuacuccuggauguacuggugcacaaucucaaauuuucaauuuuugcacagaaugggaagucugcccaguuucauuucuaaucuggguuauuuuuccccucaaaagauaaccugauuucagucaccaugacuggcaugaauauucucaugcuuuccuuuuuacuuuguuaacacuuaacuuuaucuggaauaauauuguuaugauuucucguuuagagaauagauuuguuuuuuacaaauugcuaauaaauugauaauaaaaaugaugcuuuauuuuuuuccucucauuuuaauaauagcuagacguuugaauuugaugaccaagagcaguuaucaccuugagaguuacguaaaaauuaccaaugcuuagaguucaccccauuccaguugcaucagaaggaagacaugggaauuaggcauugguguuuuuuaaaaacucuucaggugauucugacaugcagccaggguaagaaucacuagcuuagaagggagaguaagauuguagucauacuugggaaaaaacauauaaaaaauauuuuuaaaaugguuacuauauugcccgaaauaaaugcccaguaagggaugagauuuuugaaauguggccugaucuuagcccuguguuaauuucaguagauauuuggaaagucucucaaaccaauuuuuguaauauauuuaauugaagauggggggguucucaacuuaaauguaagucauuauuuuacuugaagccaguuucuuuaaagguuaaauuauaaccugaaguaugcaguuuuccagauuugaacacacacacacacacacacacacacacacacacaccccuaauaaaucauuaggcuacuuggcauccuugaaguccaaaaauuaaucaaccuuugguacuuguuguuaauguuccaguaaguaguauuuauagaaaagaugaauauuauuaaucauaaacagugaaacauacuuugcguuuacacuuagccuauugguguggcuauaaaucuuauuuauuuuaguugugcucuauuucuuauugaucuuuacaauguguucucuaaaguaauaaagugaaugcaaauauacguggucacagguuuauucugaguuuuaauuuauuauacaaaaguaaagguuuuaauuuaauauuaauaguagaaaaacacuuucuuacgugugccauauggaaagauaaaggaucuauucuaaaauuagcuguguugguugauaagcugguguggauucugccacauccagcaaggaagauaccauuaaauuacacaguuuagcucucucuaucuaugcauuaggaauuugacuuccauuugauguuaaagcauauacuuggcuuuaaggacacacuaaaacuauucaaaguuuaauuacauucagacaaagaucaucuaaccacuguugcuacauagggaauauuuauuuaauuaucccuugcuaucucuauuaaucaguuuccucaauuuauccuuaaaauuuuccucaaaugcuuaguuauuuuauuauuugcuuuuuaaaauauucagugucaaaacaaaaguacacaguuuaaauaauuaagcaggcauacuucucccugucucaccugcuugauucuaaauugcaaggucuaccaugucaaauuuuagauaaucagaacaacacuuugggauuaaauaccaacugacuucauuuuuacuccauaagccuucucauugcuacuuugcauuuuucuucacuaaccuaucuguuuguuaguaaguuuuucaguuccuucuucaucuuuucuuucccuuguagcugugagcacuccaguagauugcaucacuagguuggguccugugagcuguuuuguucuuuuccaagugucugauucagcgggccauagaccgcuugccagaaaaucgccauugcuucuaggcugacgcuugccuacuuguuuugaucgucugagagaagagacuuuguuugccaaaaccacaguugauagaaauagaaagguacagauaagaaaaagcacugcaauuauaauuaagcaaauuagcauagccauguuguuguuguuuuccgcacagacauccuuuuugaaaauuucaccaugacuuuugcuuguguuuucaaugcucuguacuguugaaggacuguugcugacgacagaagguauauaaagcuccuguucagauuuagaaguuaaagcuacgaugugagauguuucaggcauguuuguagaauuaccuuuauaaucuacuucaggaguuauaggguuuguguuaauguuuucauuuugguuucugccugucuuguuuugaauaacugaaucccaggaagaaguacuguuagcccacagacggguauaguuugcuuuuguuccaggagacaaagaaaaaacuguugucaucagaaaggcaagauguagguaauguccuguguguuccauguccgugggcaugcuuggcaaucuguugggauagcaauauaauuuguuaguuugugaaagaauaauggauccuaguuuugguaauuguaguuaaaagauaguguugagauguuacaaguaaacuacaagcuuaugccuaauauucgcuacccugaauuccuucucaacuaaauuucuuuucuauucagcuauguaugaagaagcauuuuaauuucuauuaacacuuuuagaugcuagaaguuagcauuacaaauaaauauuaaucauuuuaaguggacuaucauggcuuuauauaguuuucuuccuuugaagcgugcuagacuucugcuuugagucaguuaguucugcuuuuacuuuucugauuccuucuuuaaaaaaaaaaaaaaauuaaggaucauucuuacagaaacuacccacccucuaaccugucaccaaucuuuacagaagaaauguggccuugagcuucuugcuucauguaugaaauaaaugcaaauuuuuuugguggaaagaggggaaguuugguagcaaccaaaagaaacugaacuucaaauagaaauucaagguguucuuuuuuuuucuuggguguucaucuugaagcuuagaauaaagcugguacuuagaaauacauuuguaaguguauuugugaacgcaauuuuacuguggugguugucucuuuucauuuauauuucccuggacugacugugucuuucugaaggcaaaggcauaccaguuuucucaaccuaaaaaucugaagaaaaaaaaaaaaaaacagcaaauuuccucugaguagacuuaaaaguucaacaaaaguugcuggguuuucuuuuaaagcaucauuuauaccuagcauuuuuucugauuuugacauaauuguaaaaaaaaauguguaauaaaauagaaauagagcaucaggaucuugaugauuugggaugaaguggcagguuauaagcaucucaacagauaauugaaaauguugaauuuccgcuuuggcccugagcuugcuggaaacuaguacaaaaaggagacaaguuauauuauacauuuuuuaaaucuaccaaaugauugauuuaaauagaaauggcauaucuuagaauuuaacaguuccauguacugcuaacccagcaggaaagauuuauaaucauuauuaagguaucuuauaauaauauaccaguuugucuugagcuacuuuugaaaggaguauuuuauuguuagcauuuauuugaaugaacuaaaagcaaaacuauauuguucuccugagauuuacuaaaugaaauugccugguuaagaacccuacguaugcuauagaaauucuucucaaauguacuuaggaguccuuuuauuuaaaaaaaaaaaaaaaaggcagauucuuaccuagcuaguauagguagggccugaaagucuuuguuuccaaaccaacuccuaagcaacauggaugccacugcuagucaggcuuuugaacaucaagguuuuauaagaaaugguuguuauaugucauuggcugacauuuguauacuauuaaaauacagaaauugaaaauaagaaaugugauacguugaguuaugcaaacaaaaguagcauguaauaaacaaugcuaacuggagacuauauuucauauuaauaguagggaggaaaaacuauuaaauauuccaggauuaagauuacuuuuuagauuaugaccuuuaguagacaauuaaaggcccaagucacuggcuuuuguauaauaguguucagcuuuaauuuuuaaguuuagugacauaaaucuuuggauauuucaugauucuuccacaaaaagaaauacuugaaauuggauuagcaaguaauuuccaucuuuuuauacuagacuggacuucuguauuagaugcuagaaugauuuaaaguagauuauucuuuucacauuaguucauuaacaguguaguauacaucauaguauugguacacauuuuaacagugcuuaccacggaacagauaauaggccugcuguugauugucuucagccagauguacugcagugcccaaauaaacaaacuguaugacaaaaugagacuuucucuugcccuuacaaaugccugagaauugaggacuguuuuuacuccaguuuaugccuuggaggccagguuguguuaucagaaguuuucuuauaucugaucauuuucaguagaauuuauuuucaguagaauuuguaauguccaagcauuaguaaugagaaauuuauuuuuuaacuuuugaaaaauaacaaaacauuuccaguuuacuugaggaaaccaaacuuagauccuucguaauccuaauuuaaaacuccauggcgauggcaaauuuuuucauuucuaacuuaaaauuuauguaacaggacagaaaaaaaaaguauacauuuucagucacaauucuaguuuguuagugagauucuuacacacuuugauagcauuuccucgaacacuaaucugucagacguuagaagugaaaaggcauaagaaaagccguauauauaugaccuaccuuacaaaaugcuuggucaaaaucugauuauaacgugauuuugauaaaccacuucuuuucuugucuucuuuuuaaagcagaauagacuuggagaauaugagccuuaaaguaaaucugcaguaaaaaaggauaugugcagcuaguuuuccacuuuuaaaaccaaaccacagaugacacauuuccuuuccacugcaacuaaagcacaugucacaggagggaaaaaaaaaaaaacaacgaaaaagcuccaacuucucuaguuggccacuggcaugacaggaggcuuuguagaaccaauccccgccuccagagcagggaggguuuuccacuuaaugccuuuugacaguaugcucauucuauaggccugcuacaugcuuuagugucauucaaaagagguuuugaaaugguaucuuccauuucaaaucuucucuaaaagacuuauuugaaaucuacagacugauuugaaaaugugaguuuggaguccaugggauacugaucagauaauguaacaauuguggaacugcagcaauuauuugagaaaauaucuaguaaacuuagauuauaugggacagaaaaugcuuucgugugguguaguguguguauacacacacacacacacacacacacacacacacacaacugucaaacauccugucaucaccucaaguuuaacaugacugaaacagacuuuaagaacuagguaugggcugaacacgguggcucacaccuguaaucccagcacguugggaggguugacgcaggcagaucacuugaggccaggaguucaagaccagccuggccaacauagagaaaaccugucucuacuaaaaauauaaaaauuaaccaggcaggguagcaugcaccuguagucccaccuacuugggaggcugagacaggagaauagcuugaacccgggacguggaggcugcagagaucaugagaucuuggcugcaugagcuaagaucaugccacugcacuccagccaggaagacagaguaagacucugucucaaaaaaaaaaaaaaaaaaaaaaaaaaaaaaaaaaagaacuggauauggcagcacauaucuguaaucccagcuacuagguagguugagguaggaggaucacugguggagcccaggaguucaaauccagccuggguaacauagcaagacuccaucucuuaaaaauuaauuaaauuaaugaaauaaaaagaacuuuauuuuuucuuuaaaggaggcugccugugacagucuucuuguuucuguucaugauagcaacauucuaauaucagaggcuuaguauacaacacaucauuuuaauuuaaguccucucaguccugaucagacuuugaaucauguugguccuuccuucauauuguuggaucaguuucuuuuucccuguuuuuacugucaacaguacuauuuuagauccuuaucaggucauaccuagacucuacagugccuuuucgguagcccugaauccuucuuauaucuuguauacaucacugucuuuggucauaccacccuuucuuuaagggaaaauaaaaccgguugaacaguucccuaauacauacaacaaugauucagaaauguuuguguacauaaacaucagaugagaagauuguuuaaaaauuauaaaagcaggacaugguggcucacaccuguaaucucagcacuuugggaggcugaggcgggaggauuacuugagccacagaaauucgagaccagccugggcagcauggcaaaauccugucucuacaaaaaauacaaaaaaacaaaaacaaaaaacuagccgggcaugguggcgcuuaucuguagucccagcuacucaggaggcugaggugggaggaucaccugagccuggggaggucaaggcuacagugagcugugaccgugccacugcaguccagccugaguuaagggaaaaaaaaaaaagauaaaaauuuccaggccccacuacauagauccauauuuaguagguccagguugggaccaggaaacugcauuuuuaucaagcaccacaguugauucugacgccaguaguccacagaacauaugcugagaaauggugagccccuaguagaaaaccuaagcccuuugguugggcaguuauggucucuccacaauuugacuauucuguauuuucccagcuuuaucucucaaaacuucucuaccugaauccuccauucuggcuagacuagcugucucuucaacacaucuaguuaccuguuucuuuuccuuuuugccuuucuccauaaggccugcccaguccucuugcugagucugcauuccuccuuaccugauucagccacuguaucuucuauguagcuuucacugacugcccaguuuguguuaaucucucucucucucuccuuugucuuaauaacaguauuuucucugcauuuccuuugauaagugauuacuuucuaccucauaucuucuaucuugaaauauuuguguuguuuuaaaaucauuugacuugucauauuuuuaucuuauuuucucccaacaagauuaaaaauucugaggugaaguuuuuuauugauacaugauaauuuguacauauuaauggaguaugugugauuuuuuugguuuuuuuuguuuuuguuuuuguuggaaucucgcucuaucgcccaggcuggagugcaguggcacaaucucagcucacugcaaacuccccucccagguucaagcaauucuccugccucagccucccaaguagcuggggcuacaggcacgugccaccacgcccagcuaauuuuuguauuuuuaguagagacaggguuucacccuguuggccaggcuagucuugaccuccugaccucaggugaucugcccgucuuggccucccaaagugcugggauugcaggcgugagccaccaugcccugccuguaugugugauauuuugauacaugcauauaauguguaaugauuaaaucagggugauuaggauauccauugccucaaagaaaagaaauuguuucgucuagcuguuuugaaauauacaauguuauuauuaacuagucaccuuacuaugaauaguagaacuuguuccuucuaucuaauucuaacaauacauauauuauuuauuuuauuauuauuuuuuuaagacagucucacuguugcccaggcugaagugcagugguacaaucucagcucgcugcagccucugccucccagguccaagugauucucgugccucagccucccaaguagcugggauuacagacauguaccaccaugccuggcugauuuuuguauuuuuaguagagacagcguuuugccauguuggccaggcuggucucgaacuccuggccuuauguaacccaccugccucagccucccagagugcugggaauacaggcgugagccacugugcccagcccugauuauauuuuuauauccauuaaccaaccucugagguaaagauuuauuuuaacuuacuuaguaguauuaucaccagaaucaucacauauggaaaacuuugggccuaaguuaacauagauuguuuugauuugaaacuuugguaccauuacuucagggcuuuuucaugguccucacuguggcugcucccauuuauuaguauucuuuugguuuuaagcaacauaugaccuaauauggcuuaaucaaaaaaugguauuuauuggcuuauguaacugagcaguccugggauaaauuugaccccaggagaggcuuuaucucauacacaaaugauauggccaggguuccaguuugucuauuucucagcuccuucucuucagucuuuugggaggcucuucuuuuauaucccaaaauaugagcuagcaacuccuagggcuacguauucccuuguuuauaaacaccaggaaagaaauaucucaaaucccaacaauuuaagcuaaacuaccugaacugggccucuuuggcccugguuguccugguuugaauaauguguucauugcugaaucagucugugaucaaggugggauaaauggauuggcuaaaaccaucucacuccagagcuccagaugggucauuccuaccagacuauucgccuaaggaguuuggugggcccugcaggcaaccaacuaauucccacuguuuucuuccuuucuugacucaugggcaaauuuuuuauuguugucguggcucaaaauuuuugaauuggagauuugucucuucucuuagccuuauuucucaguguccaaaaaacaacugauuuaaaaaaugaauccagacuuugaagaauuguuuuauauuauucucucuagaaaaugaaucauaaaauaaaauugauuaguggcaucuguauauuuauuuuaaacacugcuaauaaucuuugucuuuuuugucauuuuccuuagguucaaaacuggucaaaucaauggugauuugcugauauaccaugucuuacugacuuuaaagccauauuaugcaaagccauaugaaauuguaguggaccuuacccauaccgggccuagcaaucgcuuuaaaacagacuuucucucuaagugguuuguuguuuuuccuggcuuugcuuacgacaacgucuccgcagucuauaucuauaacuguaacuccugggucagggaguacaccaaguaucaugagcggcugcugacuggccucaaagguagcaaaaggcuuguuuucauagacuguccugggaaacuggcugagcacauagagcaugaacaacagaaacuaccugcugccaccuuggcuuuagaagaggaccugaagguauuccacaaugcucucaagcuagcucacaaagacaccaaaguuucuauuaaaguaaguuccagucuguguuuuguaaacgauucauugcuuuucuugacuaacuagacuauauccuggccucccuagguguccuaccccuauagugguguauaaaaugucacguaaggcugucgcgguggcucacgccuguaauccaagcacuuugggaugucaaggugggcagaucacgugaggucaggaguucaagaccagccuggccaacacggugaaaccccgucucuacuaaaaauacaaacauuagccggguaugguggugggcaccuguaaucucagcuacuuggaggcugaggcaggagaaucgcuugaacccgggagguggagguugcagugagccgagauugcgccacugcacuccagccugggcaacagagggacgcucugucucaaaaaauaaaagguuauguaaaucuagauguaggaagaccaacauuugugucaucauggagguccuguggaggauaugagacguauacauuuuauucuagcuuaggcuggaaguagaagaguguuuuggagagggcaauuuguuaugucauucaaauuguaggaauguguggagaguagaaauuaccuaaugagaguucugauuauuacaugcuuuuuucagagugaggaacaugaaccuucaggauaaaaucaguacuuuucuauaagauuguuuguuuuguuuuguuuuguuuuuugauauggagucucacucuguugccuaggcuggagugcaguggcgugaucucagagugcaguggcgugaucucagagugcaguggcaugaucuuggcucacugcaaccucugccucccagguucaagcgauucugcugccucagccuccccaguagcugggauuauaggcgcccaccgccacggcaggcuaguuuuuguagguuuaguagagacaagguuguuggccaggcugaucacgaacuccugaccucaagugaucugcccaccucggccucccaaagugcugggauuacagggaugagccacugcacccggccuucuauaagauucuugaccuuuuuaaaaaggaaaauuaaaaaauuuuuaaauguuuuuuguuucuuuugagaacauuuaucauaauaauuacugaaccauuugaauauacaauggugggaacucuuccuuaaauggcauaguguuuuguuugguugguugguuucuggagccuuuuagaauuuuauguaaaagaguuuaauucuucuccacuucaccccgucaccaccacuuuccagguugguucuacugcuguccaaguaacuucagcagagcgaacaaaaguccuagggcaaucagucuuucuaaaugacauuuauuaugcuucggaaauugaagaaaucugccuaguagaugagaaccaguucaccuuaaccauugcaaaccagggcacgccgcucaccuucaugcaccaggagugugaagccauuguccagucuaucauucauauccggacccgcugggaacugucacagcccgacucuaucccccaacacaccaagauucggccaaaagaugucccugggacacugcucaauaucgcauuacuuaauuuaggcaguucugacccgaguuuacgguagguuuuuuaaaauucucuucaguuugauuugggguuuguugcuuuuaaaaugagaccauuuaaugaauuuuaaaacagccucuaccuuaauauuguaaauuggaagguaugcaguguugguuaaccacugugaccucaucaaguugugggguauucacaugaacuguggaauuccaaacagggugauucacacuaaaccaauauauguccuuucuccaucauguaaaacaacacgacauagcagauuuuuuuuuccaaaguauccuaaauuaaguuuuucuuccucuaaguccucuaauuuuuuuccauuuucagaaguauaucacuauuuaguuuaaaagucaagucagauuauugcuuuacaaaagaaggccuaauguucaauaacuugguaacauuauugcauacuuuccaccuacaucacucuuaacaaaauucucaaaauaaaucuuaagacaaauaagucaucugagcagaguguaauugguuccauuuaggcuuaauaacuugaauaugcauguggaaagagcauggcuguggagugaguagaugugguuugaacagauaugccacuuucuagcuauguacuuugagcaagauacugaaguuuucagauaucuaguuuccuuauuugugaaauaaagguaauugccuuucuuauauacccacaaaagcuuaaaaaauaguauguguaguaguauaguauagcaaacuagcaaauaguuuauacuuaguaaguaguauuuucuuaucuuuucccucccugccagcaucuccuugcacccuuucucccuuuucuccccucuccuuaccaaguuaggauaauucuuugucucaaguacccugagacuuugaagauuuuucagauguaaauucuuaacuucugaaaauuuucccugaggauaacauagcccagguuuuauagugggccuuuuaggauuccaaauucuccuuuacuuaaagggaaaaagaagaaaaucaagauauguuuacuuggaugggcuucagaaauuguacauaagauuuuguguaugcuuugcuuccuuuaucucauaggugucugugacaccuguccuggguugaggaaguccaauucuuuauaaguguugaaauacacaggauaaaaguuuugucaaaauuguauaacuuagaauuccugggaauuaguaaaagauacaagcugagcacuggcacuguagucccagcuacucgggaggcugaggcgggaggacagcuugagcucaggaguucaaggcugcagugugcuauaaucaugucugugaauagccaaugcacaccagccuggggaacauagugagacucugacuaaaaguuuuuuaaaaaagaaaaaagauauguaaacagaaauaauaacacuaauuuucacauuuuaggaaaauggagcuauaagccugccuuuaauuucuaauucaaagaucuucauugaaaaauacaaccuuuuaacaauuauuagccuggguaaaccuguauucuucucuagugaccuaaagcaaucucugacagcuucugcuuuuugcugaagcaugucaucccagagaaaaagccuuuaggcagacuuaaauuccaguggcuuuuuuucccuauaugguuguugcaucaauauaguagcaugauaaacauucagagguaaggaaaaccugacaguuacugaacaaacuauuuccuuuacuggacaggggagaaaauuaaaauuuuuaaauugagucugagucuuuuaggcugucuccuaaauugcuuaaauauauuuucagacauuuguaagugauguuuggucucaaugaaaccuggauauuauaguuuuuuuccauauuggugguuauauaugauguaaugaggucauagagggaaaaaugggaggacuuaauuauaaguuaauuuuguuuuuaaccuucaguuuguaggguaacuuuuaggacacccagaaagaaguucagcagauccugauuaaagauuuucacauucuaauuugaugaagggaagggccaucugauaucugucccuaugauccccauuauaacuggaucuagugggaaagagaaccagaauuugaguuuuggcuuugcuaaaaauguauggugugccuuauucugacuuaauuucuauugauccacauuaggaccauaaguccucucauauuuuaugucucagugagauguauuuuaggaaagccuauaccccgccccucugucauaggagccucacagugcucuuaugguuauaucaagugugucccuuuuuauaaaaucccuaaaugauuaagggguauuuugguuuuacuguagaauuauaacaucuuauuucuaacugaucauaaaauuuaaaaauaguugaucauacuuuguaacagaaucacaaauuguauguuaugaaaaaauuuuggaacuauaaggaaaaauacguuuuaaaacaacuucauuuguguuuucuccuaggucagcugccuauaaucuucugugugccuuaacuuguaccuuuaauuuaaaaaucgagggccaguuacuagagacaucagguuuauguaucccugccaacaacacccucuuuauugucucuauuaguaagacacuggcagccaaugagccacaccucacguuagaauuuuuggaagaguguauuucuggauuuagcaaaucuaguaaguaaugauaauuuucuuuaauacuaacaauuauucuaagagaauucaaagaaaacccuuucauuucagaauuuuccagugaagacuuucacuuacauuuuuacuuuuuuuccucuucugauuuuauaucugugguauccuguaacugaaggaacucugaaggaacuuuuugguaggccacauugagaaauccaccaaaauucugauaauaaaagcaaagcggcaagaguuugguacuuuacacaccucuggaccacuuacaaaguauuuucuucacuguugcaguuuaauuagcuucagcauuucucuucauagcagaaaaguccacauaaguauccauguugccuccuuaauuuuagagaacuagucauuuucucuuuucuuuagguugacuuugaacaaugaauuuauuguaaauguacaguucacggagagcacaguggcacauaauacagggcccagagucaguucugacuuuguuuuaacuaagucuuauaaauuuaauauccacucuuuauauuuguccaucuuuauauccuauaguuuuauaaauguugaucuucucccagcauauuuccugaccuuuucuucccuuuccuuucccuguaauauauaaaacuuuuuuuucugcauucaaacacauuucuugacuuuuauauauuagauaauuaaaagcuucagcaauucacuaagacucuuugucagguaagagauguaggacuauaacccuaacaaaaaaauguguaggacugacaaaacaagaaaaguauaaacuuuauucauaaauauuaauaugagagaagauuugagugaauguaaaggcauauuguguuccugcaugaacaguucuucccagauuauuacaaauuuaauguaauuucaucaaaauaaccaugggauuugaggauugagaauggagauagaacuuaaaugauucuaaauucuacauaaaagugcaauaauagcuaagaaaauauugaaaggaaagagacuugagacuuaauaguacagaugucugaacacuuuauagcaguacaauaauuaaaacauacaugugcaagaaucagccaucagaucaguuuaagagaaacagauugauaaagaagcaucacaaacugaugagggagagauuaaaucauuuaauaaaugaggcugggaaaugacuuaaauuaggucuucgucuucaccguacaccauaagauaccaaguauguucugccuguauuuaagaguugaguagggcugugugugguggcucucgccuguaaucccagcacuuugggagguugaggcaagaggauuguggcaggaggauugcuugagccccagaggucagggcuauagugagcuaucaucguaccacugcacuccagccuggaugauagagugagacccuucucuauuaaaaaaaaaaaaaaaaaaaaaaaaaaaaaaaaaaaguuguauauaaaagcuuggaaccauuuuaaaaagaagaggaacaagugaauauuuaauugcuuucuagaugaguaaggacauaugaaguaaaaaagugauaggaugaaacaaaggaaauagcgaacagauuugacuacauaaaacuucaaaacauagcuacucaaaaauaaacacaagugaagauaauuaaaaacuaggaaauacacuuggagcaaauaugagaaaugauuaauauccuuaaucggccagacgcgguggcucacgccuguaaucccagcacuuugggaggcugagguggguggaucacaagguaaggaguucgagaccagccuggccaauauggugaaauccccucucuacuaaaaauacaaaaauuagccgggcucggugguacaugccuguagucccagcuacucaggaggcugaggcaggagaauugcuugaacccaggaggcagagguugcagugagccgagaucacuccacugcacuccagccugggcaacagagggagacucugucucaaaauaaauaaaugaaugaauaaaugaaugaaugaaugaauaaaauccuuaaucaugaagggugcugaccgauuaauaaaaaguggauuaacaguaacauacagaucaugguuuuuuuuuuuuuuuuauuauacucuaaguuuuaggguacaugugcacauugugcagguuaguuacauauguauacaugugccaugcuggugcgcugcacccacuacugugucaucuagcauuagguauaucucccaaugcuaucccuccccccucccccgaccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggauaugaacucaucauuuuuuauguuuuuuaaaaaagaauauuuguacaaaaaaagaaaaaagccaggcaccauggcacaugccuguaaucccaccugcucaggaggaucgcuaagcccaggaguuugagaccagccuggacaacauagugaggcccccaucucaaaaagaauauuuauauuuuaagaaauucacuaauaaaagccaauugaaagaauagugagauaaucaguuaucagcuuggcaaagauuuuuuuuuuaagauccauuccugguggucuguggaauugugaguagaggcaauuuuucuagaaaggcauuuggaaguggauaacaagaccuuaagacuauucauaccuuuuggccucauaauucugcuuuuuagcauuuauccuaaagaauuaauguuaaaauguuuauuauagcauuauuuuuauguagauuuuuaaauugagguauaucuugucaucaguaaagugcaagaucuuaagucaacagcuugaugaacuucuacaugcaaauacaucaugaaaguaucuccagaucuagacauagaacauuucuagcauccagagggauauucucaguacccucccuucaccaagaguaaacacuauuaugaccucuauugcacagauuuauuuugccuacuuuagaacuucauaugacauuauuuauaauagcaaaaaaaugaacaggccaaaagucaaagaauaaggaacugauuaaauuauugguucuccaucugauggaauaauaugaagccauugaaaaauggcuuuguuacagaauuucaguuuggaagaugaaaagguucuagagauggaugguggugauggcugcacaaugauuugaauguacucagugccacugaacugugcccuucaaaauggguaaagccacggaacuguacauuuaaaaauaguuaaaaugguaaauuuuguguuguguauauuuuaccacaauuuuaaaaacucuuugagacuuuagguaaaguguauagauaaauuuuuguacaauuuuugucuuauaaaugugaagcuuuuucaaguaaguuuaaaagaaguuugcagaauuuguaauguugaauaaauaaucucaguauaggccaggggugguggcucacgccuguaaucccagcacuuugggaggccgaggcgggcagaucacgaggucaggagauugagaccauccuggcuaacacagugaaaccccgucucuacucaaaauaugaaaaaaaauuugccgggcgugguggugggcgccuguagucccagcuacucgggaggcugaggcaggagaauggugugaaccugugaacccgggaggcggaacuugcagugagccgagaucgcuccucugcacuccagccugggcgacagaggagacuccaucucaaaaaaaaaaaaaaugaauaaucucaguauaaucacugaaaaaaauauucagagccuacugcauguauagcauaauccccguuuuugcgggggagugggaguggguuauaccuguguacacacacauaaauguacauuaacucuacauaaauuugaaagccugaggagagaugagaugauacaccaauguuaauacaguuuucauuuuguggugaugcuuuccuuuuaccaaacuuucuaugauuaccacauuuccuuuuauaaugagaauaaaacaacuuuuuaacaagaaaggacuaaaauggaggaaaauaagacaaaacuuuucaaaaauuggcuuacuggcuuuuaaaauuacuuucuucaaggacuguucuuucuucgccucuacaaaaauauauuugccaagugucuuuucuccaggccugauucuagguaauagucuuuaccuuuuaccauuuuuuccccgaauucuuuauguuaaauaauuguugaugugauuuucauugaccaucacaugcuaauaguguauuuuuuuccagguauugaauugaaacaccuuuguuuggaauacaugacuccauggcugucaaaucuaguucguuuuugcaagcauaaugaugaugccaaacgacaaagaguuacugcuauucuugacaagcugauaacaaugaccaucaaugaaaaacagauguacccaucuauucaagcaaaaauauggggaagccuugggcagguauugaguuugcucaaauauuuaucuaguaucuccuuugugcacauauuuaucuggugccacauugggcaaagcacugcgcuagacacuagggauagaguuguaaaaaacacaguuuccuccuucagaaagcauguagacacucacccagcucuucaucugguucaaaauuguaaaugucuagugcaugucucagagccagagaaaagcuaguuauuugcacagucuccuucaaggcauaauuauauauauauauauauauauaauuaugccuugaaggagacugugcaaauaacuagauuuuauauauauauuauauagaacuguagaaaucuggugacauuucuagugcuuuauucuaguucucuacauuccaaaggugucaguagauguuucuucuuauugaugcuauuugggacaucugcuuucauuuauaguucuacauaagaaugccaauauuaaaauaggauauaauguaaauuuuauuuuuaucugacaagaauuaggcauaucauuucuucaaaguaaucauuuaaggaaauaaugcccucacucaaacacugcugcuccuccuccaaauaauuagaaauaaccuuggagccaguguugcagcccuagaaaacauccugguacuuaaugucauuuccuauauuuuauuuuuuuuugagacugagucucgcucugucacccaggcuggagugcagugguacagucucggcucauugcaaccucugccucccaggcucaagugacccuuccaccucagccucccaaguagcugggccuacaggugcacaccaacacaccuggcuaauuuuuguauuuuuuuuuuuuuuuuuuuuuagagauaggguuuugccauguugcccaggcuggucuugaacuccuggccucaagcaauccgcccgccucagccuccccaagugcugggauuacaagcgugagccacugcacccagcucuguauuuucaaauuacuauuuuauauugaugcuacauuacugucuuagaaaagcauagagauacuuugcaagugacugaagauaguauugauagagauuuaaaauuuuugaauaccaaucucuuaaucucugaaggagucaaaugaauauacucauccuuuacuggauauuuuauaauaaauuguauuuacugacaggccuguaaauaaaaucuaguauuuuugaggccucagguaaaauagaauuuucauauugauuaggcuguuccaaugaauauuuuuuaauuaaaaauuaaauugguagagugauuaaaaacauguuauuuuccuucuucaacuagauuacagaucugcuugauguuguacuagacaguuucaucaaaaccagugcaacagguggcuugggaucaauaaaagcugaggugauggcagauacugcuguagcuuuggcuucuggaaaugugaaauugguuucaagcaagguaaucacuuuucuuuugccuucuguacuauagcauaucuguuuuaucaucaggagguuuuuuguuuuguaauuacuuuuaaauuaaacugaacuuuuuugugcuaaaacuuugagucccauguuuuuuuuuuuaaaaaaaaaaauccugcuucuuuacagguuauuggaaggaugugcaaaauaauugacaagacaugcuuaucuccaacuccuacuuuagaacaacaucuuaugugggaugauauugcuauuuuagcacgcuacaugcugaugcuguccuucaacaauucccuugauguggcagcucaucuucccuaccucuuccacguuguuacuuucuuaguagccacagguccgcucucccuuagagcuuccacacauggacuggucauuaauaucauucacucucuguguacuuguucacagcuucauuuuagugguaaguucuaggaaaggaauuuguguuuaccaguuccuuucuccauuuuacuucaccugaucaauauagauuaucuuauuuauguuugugcucuaacaccaaguugcuaauuuaagccuccaguaaugacaugaaauauuaccaaaaagaaaauaaauuacuuccauuccauaucaagcuauaguaaagauuuucuaugcauacuugucauguagaguuaucccauaagcggaauacucagugccaguugaccauguucaguuaccagcacuaauuuguagauaaaugaagcaaggagcauuaauacaauguaucuagagguuugauuuagggaacaugauuauguaauuuuuauaugguauucaaauuuucuaaauucaaaaugaaacauggaacuuuagaaauuaaaaaguaauauuuucugucuuuacuuguuccuuuauucucuuacagaagagaccaagcaaguuuugagacucagucugacagaguucucauuacccaaauuuuacuugcuguuuggcauuagcaaagucaagucagcugcugucauugccuuccguuccaguuaccgggacaggucauucucuccuggcuccuaugagagagagacuuuugcuuugacauccuuggaaacagucacagaagcuuuguuggagaucauggagguauagaagccaaaaugauaagaaacuaaguuaaaaucuuuuuuuaaaaauauguuaauacuauauagaagaaauauugguuuauugugcuauuuuguacuuaaugcuuaaauaaaaacacuugcauggacuguguuauugguaacaggucacuuaaugacaucauaauaaacauuauuuaaacaguucuaaaaacauuuauguacaauauguauucagaguauccccuuuuuuaggcaugcaugagagauauuccaacgugcaaguggcuggaccaguggacagaacuagcucaaagguauguccuaaauuaaauauaaguuguaaaaauaugcauauuguugaaaauacagcuauuacuguaugaucaauguuauaauuuauuauuuaguauauauaaacacaaagguuuuuauaaguucuguggaucuuuuaauugcagauuugcauuccaauauaauccaucccugcaaccaagagcucuuguugucuuuggguguauuagcaaacgagugucucaugggcagauaaagcagauaauccguauucuuagcaagguaccuguuccgcccucacuucucccaaauauuuaugguucucaaguuguaaagcauaucuuucauuuuucuaaaagacguuuaaauuugaggucaaugaaauaucuuauauguuacuuauuaagccuuuaaaauguauuuugauuauuuauuguaauucuuugaagaagucuucucuaaagaagcugucuuuauauguaaacucugauuacuucauuaaggaagaugucuuuaaaauaaaauauguugccucuuuugcuaagcagguacacuuaguauuuuaccaguuuucaaagcauuuaauuauaugguaagacuauagccuugcauaaaauuauuuaauuuguaauuacuauaauaaugucugacucuuauaauguagaaaugucaaaaaauaagaaaacaaauguacauuaagcuagcuaccaagaucaccauagcaugagaaaucauucuagcauuuauuaaauaaguaaauguuccugaauucauuccgagauucaguuuaggaguuaauguuuuauuucaaugaaaguaaaauaaaaaauucuguuuuccuaaaaggcacuugagaguugcuuaaaaggaccugacacuuacaacagucaaguucugauagaagcuacaguaauagcacuaaccaaauuacagccacuucuuaauaagguaauuacuguauagaaaaugagugcauucauuuuggguaucaguguugaauguuacuuucuuucaaagaguuuagaaaauaagaugaauugagaauaaguuauaaagaaaaaacuauaguuaaaguagaaccucuuaaaguuuaguuguuugaaguagucauauuagaagaagaguaaguauggauaguauguucucaagcgcuuguaaguuuuuggucucaucagugcuaaaggaaagauagguauauauucuuaauuauuuuaucuuauaacuauuaauuaucugcuauugccaaguacuguuuuaggcgcuagagauagaguacuaacaaagcccauaaaacucacugccuucauggagcuuacuuucugggguggguguggagguuggggagugaauggauaaugaaguaaacaaaauacguaguauguuagugauuauuacuauggagaaauuaaagcugggagaaguauacuugaucgucauaagaguuugggugccaaaugaagauuauauuuaaaaggaguaaaaugaaguggccacuguuuuaggauggucugaccuuaucccauuuuuauauuuaagauaucuggaaaucauguuuuuguauuaauaaaaugaaaaagauucgauaauggcaugguauuaccauccaguucuaaagugguuuaauucugugauuugaguacaaagguaugccagacuugggagaaauaacagagaaauaauaccuguuauauuccugguuugucuacaagcauucuaauuuuguauuauacaaaaugguucucugguccccaucuucuaagugaaaaugagcucagaagggcuaaauaacuugcccaaagucacauaccuaauaaaagaaccaugauucuaaugugauacuauuugacucuaaaguccauguauuuucccuaauaucacagugcuaaguaaagauugccaguaauaaauacuuuuaauucagagcagcaagagauuaccauacugguuaagagugacaagaaguugaaaagacaguuuaaaauaaaguuaaagggaaacauaggaguuaauguagguagagagaaagggagagagcugcacaagaaugccaggacaauggagggaagguggguagaacauucuaguuguaauggagaagcuuuucaaaggaaucgagagagggaaaguugugaggacuggauagaccucaucucacauucagcauuguucaaaagaguuuggaaauguacaguuuuuaagcagacaagucauacgaugaaagcaggacuuagcuccuggugguagugugcacaguggauuggaguagggagaaacugaaguaaaaagaauccaccuuuauaauaaagaagguuggcaugugguaaugucauuagcaauaagaaagaaaugacaaaagauacaaaagagacuacucuagaagaaucaacaaaccuuggugacuggauuuagaaaucaaagaacagggagaagucaaaggaggugcuaaguaacguucucaguccagcuaacagugucuuuaguuauacauauggaaaagugaagagcuuacucauaucuuuaucuuccccaaaagagaaaacauggguaauuuaggaagauaagcugcuuuauuuuuaacugcaguguguuuugaaagagacuaugucaugauucaucuuacuagccucaaacauaucuucuuugccaggacucgccucugcacaaagcccucuuuuggguagcuguggcugugcugcagcuugaugaggucaacuuguauucagcagguaccgcacuucuugaacaaaaccugcauacuuuagauagucuccguauauucaaugacaagguaagcaaacuuugccuugagguuccuagauuacucaaauuuaguacucuuccaucuuuucuuguugcuauucuuuuaaaaucacaagaaguccauaacuuaaguaggaauuuguauaauguaacuuauugugaguauauuuccuuaccagcucauaaagaacuauguaaacuugaaugcauauuuuuuacauaaaaauagcaaaaaaaaaaaaacaaaaaaaaaacaguacuggccuaauacuaguagaauuacagaauaaggauaaauaauacaugaucauccuuacagaaugagcauaaacaauacaugguaauaauauuaauagcuaccaugccaggccguaugcuaaacacuauacauuuauuuuuaauuuucauaaccuuaagguaaagguuagcauucucugccccccauuucacacgugaagaaauaaucuaaaaguaaucuuaguuuuacuuaauaaugccacuuaaugaaaaauacguauaauucauaguagauaaggaaguuggagagucuaaaggaaacuuuuggguacuuaauuuuacuaguuuuuuuauucugucuaaucuuacuuuaaaauauaccauuaguggccaggagugguggcucauaccuguagucccagcacuuugggaggccaagacagguggaucaguugagcucaggaguuagagaacagccugggcaacuugcaaaaccccaucucuacaaaaaaggcaaaaauuagcuaggcaugguggcaugcaccuacaaucccagcuacucgggaggugagguaggaggauugcuugagccugggaggcagagguugcagugagcugagaucacgccacugcacuccagcuugggcaacagagcaagacccugucuccaaaaaaaaguguguauacauauauuacauacacacauauauauguaauguauguguauauauauauauaaaguguguguguguguguguguguguguacacacauaaaauauguaaaauccaacuccaauuaagguuaauaaauguuaggaggggugcuaauggggugugugugugugugugcacgugugcauguguguguguauauauauaugaacaugggcaaauuacuucuuaguuccuuucuaauuuguaaaauggagaucuaauugggguuggauuuuaguucauagagaauagaggagagaauaaaauaguaugaaauuacgucccuuuugucuuuggauaaaaaugggaagggucuaggagaaaagaggggaauguuuuuaaaagaauguguauauacagugagauuugcuugaagugaaauuaacugaacuguggguacaaagaacaggauuaugguuuuaaguguaaaaagauacuuggucuaaacauuauuaguucagucuaccagauguagugugaaccuggaacagauaugggucugaaaaauauagaagcaaaauuuuagagguaagaggucuuauggaguuuauuaaucagaccuccauuuugcaaauuagaaaggaacuaagaaguuaaguaacuugcccaugcuuguacaucuguuuugggacuagaaccccucuguccuaauucucauugccguuuuucuaaaacuguuuugggacagugguggucagcgauaucuaguuguuggcuauuuauauguuaagaauauuugcaaauuggccgggugcaauggcgcauguuuguaauuccagcacucugggaggccgaguugggaggaucacuugagguuaggaguucgagaccagccuggccaacauggugacacccugucucuacuaaaaauacaaaaauuagccaggguggcacauguuuguaacuccagcgaccugggaggcugaggugggaagaucucuugaacccaggagguugcagugagccaagguggugccacugcacuccagccugggcgacagaguaagacuccaucucaaaaaaagaauauuugcaaauggagcauugcaaauggggcaucugccucgguauuuucaucuucaaaacagcccaguagcgggagcuaauauugauucuagugcccuuuggaugcuaggcaucagaguuaauaagcauguuaaaagucaccgggauguaaauugacagucauuuauuuuguauuguaaauaaaagugauuucaucuuccaccaucuucuuauuuauaugcuugacugucuugcaccaguuaauuuguaguagcuaaaauguucugugguuuucugcagucaacugaaaauaauuucucucaaauugaaaggauuacuuaucuugucauacuauugaacacaaaauuaagugagccuuuaaagaaagcuacugugugaaccucaucaaccaucucaugauuaucuuuaauagaguccagaggaaguauuuauggcaauccggaauccucuggaguggcacugcaagcaaauggaucauuuuguuggacucaauuucaacucuaacuuuaacuuugcauugguuggacaccuuuuaaaagguaaaaaagccuuauuuagaauauuuuuaugaaguacuauuaagaaaccagaaguaauuugaauaagugauuacuugaaauaaauugaaguaaguuagcccuuaugucuuacuuuaaaugcaaacuaggccaggcgugguggcucacgucuguaauaccaacauuuugggaggcugaggcaggaggaucacuugaggcuaggaguuugaggccagccugggcaacauagugagacuucaucucuacagaaaauuuaaaaauuagccaggcaugguggcacgugcuuguagucccagcuacuuaggaggcauagauggaaggauugcuugagccugggaagucgaggcuacagugagccgugaucacaccacugcacucagcccuagguaacagagugagacuuugucucaaaaaauaaauaaauaaaugcaaacuauaucugucuuaaugaguuguguuuuauucaauauguguuuuaagagagcuucauuuccaauucaaauaucaaauuugccugaaaaacaaaagaguuuauucuggcuggguaugguggcucacaccuguagucccagcacucugggaggccaaagcagaaggaucucuugagcuuaggaguucgagaccagccugggcaauauggugaaacccccuuucuacaaaaaauaaaaacauuagccaggugcgguggcacaugccuauagugccagcuacuugggaugcugaggaaggagaaucacuugagcccaggaggucaaggcugcagugggccaugaucgugccacugcacuccagccugggugacagagugagacccugccuuuaaaaaaaaaaaaaaaaaaguguugauucuuacaaaaaccuacauacugagucugauaauagcuauauuaauaguaacaauaccuaaguaucuuacugauuuucaaaaugaaacagacugcaaaucacuaaguguuauuugaauaauuuauauuagaaaauguuaagagauuugaucacagauuuucuucaacuuguuuauaguuuauuguugauuaauacuauuauuuuauaccauuguacaucaccuuucuggcacccuauucucaccccuuucuauauugcuuauagccagugaucuccagcuauuccucagagcccgcucauucacuuccuaaccugguuuuacuccccguugcugacuucacagcuuguuaacuuugguucauuaacauggggcagucauggccagagacugcaguuaauaagaacagcauguaguggugggucagaagcaaagcaggauaaaguaagaccugggauaaggagcuggcaugaaccccaguggucucagaaguggauuuggccacaauagagauucaagcuauagcuugagucaacaauuuuguauuaauuuaaaucauaggcuugagggaccauggagauucucccaguuuuuaugagagagagagagauaugcauacacccacuauugugaauguaugcauuugauuucacuuucuuaugaaauuucuacaaaaaauauugacaguguuaaucucuaaggucaauggggauuucucaaaaaauacuaccuuacuaaaggauaccaagauaaguaauuguaacugggcuaauaaagugcuuaauuauucuuuauaucuaaaagaauaccaggcugggugcagcggcucaugccuguaaucccaacacuuugggaggcugaggcagguggauugcuugaggccaagaguucaagaccagccuggccaacauggugaaaccccugcuugaaggcaggaguucaagaccagccuggccaacacggugaaaccccaucucuacuaaaaauacaaaaauuaggcaggugagguggugcaaaccuguaguuucagccacucaggaggcugaggcacaagaaucgcuugaaccugggaggcagagguugcagugagccaagauccuaccacugcacuccagccuuugugacagagugacacucugucuuaaaagacaagaaaagaaaagaagaccagauacuuuccauguucaaaucaccuauuuuuaaaugggggaaggauuaaugauuaaaagcuggccaaagaucaaauuuauccucuaaucaacccuauuuauugggcucuuagagcauauacuuccuaugucaucagcuuuucuuuuaauuaaaaauguuuuuguauuccgccugcgacucggucccggcgcugggcugaggggagggguugucuuaaaagucucuccuucccccuguaggggcggccggcgagucccagugagagcggagggugccagagguagggggccgagaaacaaaguucccggggcucccuccggggccgcggucggggcugcgcguuugaccgccccccuccucgcgaaggcaauggcuuccaaacuccugcgcgcggucauccucgggccgcccggcucgggcaagggcaccgugugccagaggaucgcccagaacuuuggucuccagcaucucuccagcggccacuucuugcgggagaacaucaaggccagcaccgaaguuggugagauggcaaagcaguauauagagaaaagucuuuugguuccagaccaugugaucacacgccuaaugauguccgaguuggagaauaggcguggccagcacuggcuccuugaugguuuuccuaggacauuaggacaagccgaagcccuggacaaaaucugugaaguggaucuagugaucaguuugaauauuccauuugaaacacuuaaagaucgucucagccgccguuggauucacccuccuagcggaaggguauauaaccuggacuucaauccaccucauguacaugguauugaugacgucacuggugaaccauuaguccagcaggaggaugauaaacccgaagcaguugcugccaggcuaagacaguacaaagacguggcaaagccagucauugaauuauacaagagccgaggagugcuccaccaauuuuccggaacggagacgaacaaaaucuggcccuacguuuacacacuuuucucaaacaagaucacaccuauucaguccaaagaagcauauugacccugcccaauggaagaaccaggaagauguggucauucauucaguaguguguguaguauuggugcuguguccaaauuagaagcuagcugagguagcuugcagcaucuuuucuaguugaaauggugaacugauaggaaaacaaaugaguagaaagaguucaugaagaggcccuccucugccuuucaaaaggguggucaccuacacauguuuaaggugucucugcacaugucucaagcccaucacaagaaagcaaguacaguguggauuucaaaugguguguaacuucagcuccagcugguuuuugacagcuguugcugugguaauauuuuuuacaugugauggugauagucucugguucuccccauccccacaaaggcuguugaaccacagcaccaggaagccugagaaugaauccugagggcucuagcccaggcuuugucccaggcuuucuggugugugcccuccugguaacagugaaauugaagcuacuuacucauagugguuguuucucuagucuugagugacuguguccacaguucauuuuuuuccgguaggaauaacuccuuuucuacauccacacuccauagagucucuccuuuucagacauccugggaugaaagaauuuggcuuuuuuuuuuuuuuuuuuuuuuacaucuguuuucacucuuaggcuuuuaaacaauaguuauugcucuuaucccucucagauucuaauaacugagagcgauggggcuauauugaaucucuguaugcacugauaacugagcuaugaagaggaucuuauuaaacugcuggucugacucuauggauugacacuguuccuuucuuuuauugugaaaaaaaaaaccccugaaagucuugggaacccccuaaagucuuuugggaauccucaaaaagcaugggaaguuaaguauuuagcuacauaaauguuguaagaucauaucuuauguauagaaguaauaagaccauuuggaauuacuggacuaauugaauaguuaagguuucuauucgggacaauaaaauguauuuugaaagugcugcuaacuauugaugcugacaguguuucacuccuaugagugacccaaacauauuauaaauaugugguaaagggaauggagccugugggguugagcagaauguuguacuagcugugccuggacugaguauaacagcuuuaugauuaugagaaaacaaauucuuuauuuuuuuuucuguuccaaagauucauccuaugggguggccauaaagucuagaauuagauacuaauauuuugucauucauuauaacauaucgauaaaccauuuguuaaaagauuugccugguuuccagacuugguggccaccuugaauaauucuugcugucuucugggaaggaugaugaaauuuauuccugcugccuuaaaaauauguaucccuucuucacccaucaugacuguccccagugaguguccuuuacuauucuugggagugacuccugucuaacuuuucauacuggcgagaagaaaagaagccuauuuuaacacuuuagugguguugaaacacauuacuuacuuucugaagaugucccagugaauccucugucaauucacugccauauguaaucuauaugauaaggaaugcaucuuccuucuaaguacugcccaaacucuugccagcuccucucccauugucccuucaugugaauauuucuuggcuaccuuaguggaaauauagaucagucuucuccccauccauccucucaaacauaaugagauuguuuacuuuuuagauuuaugcagugaaaaugcccagucaggucugaaucgucagugcauuauauugacucugagcacuuuagaauuuagaguugcaauugaaugccagcuguggagauggggugcauaucagauauauaaauaaagcucagguuugcuagggaaccagguauagagaaaaauaagucugauaugaggaaggaaaauugcacaauuuagaguaguuaugccauagagaaaauuuccacaaacuaggaaauguagagaguuauucuauagaauacucaaaagaggaaaguaugugauuuuuggaaacaggaaaaucuucaaacuucuuucuucacuucccuuuguguuuagcugacccuccaaugugaucauugccuuuggaguuugggagagguacgggaaguggccugaucccugcuuccauacuucacuccuccauccauccuucccucccucuuccccuccagcuaaauggacaauucuagccaacauugagucacucaauaagucucaacaguggguguguuugcugagauuguccagcaguugagcaguuuggucucaccucccucgcuaguugagaccaaaaagagacaaauaacuuuuucauggucuuugaaacauaaugcuuauuucguggucaauggcuuuaaaaaaaucuguuucuuguuuucuucaacaaacucacuaguuuucccuuaacugauauuguaaaaauuaaaguaaucuugaaaauguuuugacaaaaguaaaauuaaagggacaucuuuucuuaaaaaaaaaaauguuuuuguaaaagaacccuauuuucaaaugaaaucuuaaggagaauuauaauacauagauuuuuuuuuuuaaucucugugcugcuuuagggaauagaagaucugaaagacuaucauguuuuuuaauuuuccucuuccuggaguacuguagaguucuagggaauauuauauucuacacauuuuugguacuuaaucuuauacauaauuaauuauucucauucacauaugcauguuuuaccuucccaaauggcuauucuuggaaaguaggaguuauauuuccuuuccuugcagaguuguuagucagggaagaagaccucagcagaugcuuguucaaaaaauuaauucuuacuuguuuguuuguuuguuuguuuguuuuuuguaggguacaggcauccuucaccugcuauuguugcaagaacagucagaauuuuacauacacuacuaacucugguuaacaaacacagaaauugugacaaauuugaagugaauacacagagcguggccuacuuagcagguaaaaacacaaaauaaacaaaauuaaucuugcuacaucuauauauaaggaucacccaaaaaguacaaauaccuauagguuuuuuggcgguugcguggcagagcagaaaguucacagucuaguccuuuaguggugguuacaauuuugagaguuuugccagaacauuuuucuguaggaaaaaauuuaauucccauuaaaaucugaaauguguucccuuggucaucuuugguucaagacacuacaguggcucucuguuaucugucauaaaaucugaaugcuucagucuagcacccuggguccuuaaauagcccucucaguucuguuaucuuucucuaaauuucaugagccucauuuuuuauuaccacuccaaauggaugagcuauuuuaagcuaaucuacuugccaucuccuacaagcaacugccucuucaauauucauuccuuaugucauuuuaucuggaguaucugcccuauccccaccauuccauuaaagcuuccuauuugcucuuaucugauuuuuguuucucuacucagcaacacuuagcacuuauguacaauacaauucuugaacauaguuguuugauagaaagugcugauucucaguuucacagacuuguauuuguucaacuuuuuuguuugaaccguaucaucuugagcaaaucauuuaacaucucaguauuuuuucucauucagcuuaauaauaccugcccugccuacuuuguguuuguuaaagaucaaauguauauuaaagaacuuggaaaauaaaagaugcuuauuaaaucucucuguauauuucacauuuauguagucuuccaaaauaugugcacauuuaacagguacuaugcucuuuaggagacuguaagaaguucauccuguuuuaagucacacuugugauuuguuaaauuuuuuaaccugccaccguuuuccuuuuagcuuuacuuacagugucugaagaaguucgaagucgcugcagccuaaaacauagaaagucacuucuucuuacugauauuucaauggaaaauguuccuauggauacauaucccauucaucauggugacccuuccuauagguaaguggauuuacucuccuauaauuacauaaucauaaucaaguuucaauuuuccaacuaauggaggcaagcagcagaguaaucuagaagguaacaugggagaaaucuagagauggccuaggaagaguaagugaaacucauuuuauaaaugugugguauuuuauguggguuaguaggaaaguuauucuuccagucugauugugcuaauguuaacauuaguuugccucugaagcacagaccaaaugaacaaugaaaagagaugcucuugaaaauauuagguugcaggggaagggccuggggaaaaaaacuaacgcgaaauauaaacaacacauuacgugcuuggauagagaacgaaucuauacagauuuguaaaaauacaggcaugcuaacacauuuguuguauuuacucauaucacacaaguuauuuaaaaguuuucuauaauguagacauagaugguaaaaauuauaucugcuauacauggguuuggguaguauauuuuucaguauaauuuagagaaauuucaugaaaauggcaucauugggggauuuuucuguauuuucaauuaaauaaaaauaucuuuaagguuuagggacaguguugaacacagaaaaguuaucuucuguucgcaaaacucguaucauuccauuuaucaacauccugcuuuuugauaaaaagacuucaacaauuuccuuaagauucuaacaauguacgcaaaaauuuuucaaacaugguauucaauagucuuacuuucgucagucccauuauuauauuacuuugagauaugcccuuuuuguuauagaaaggguaaaauaguuugccuguguuccccugucaaaguauaaauuaauaucugauuuucuugguuuuuaaacaauugccuauuuagacuuaauuuuuucugauuuaaaaaaaaucagugcaauaaguucaaggucuuuuaucaacauaacuacaguuaauguauuuuauacuugaaaauagcuacgaguagauuuuaaguauucucaccacaaaagauaaauauaugagguaacacauauguuaauuugcuugauuuagccauucuacaauguaaacauuuuauuuauuuuuauuuuucuuuauuaauuuuuuuugagacagagucuugcucugucgcccaggcuggagugcaguaacacaaucucggcucacuacaaccuccgccuccuggguucaagcgauucuccugccucauccucccgaguagcugggauuacaggcgcgugccaccaugcccagcuaauuuuuguauuuuuguagagaugggguuucaccauguugggcaagcuggucuugaacuccugaccucaggugauccgccugccucggccucccaaaguguugggauuacaggcgugagccacagcgcccagccaauguaaacauauuuuaaaacaucauguuguacaccaagcuugcucaacccauggccugcaggccgcacgcagcccaggauggcuuugaaugcagcccaacacaaauuuguaaacuuucuuaaaacauuaagugauuuuuugggguuuuuuuuuuuuuuuaagcucaucaacuguaguuaguguuaguguauuuuauauguggcccaguauauucuucuaauuccaguguggcccaggaaagcuaagagauuggacaccccuguugcuauaccuuuuuauuugucagcuuuuaaaaauugcaguacagaucuuuuuguucagcauuuggugaguaccuacuaugugcaagauacuauggcaagaaaguugauaauuccuagggauacaccaagaguuuguauccuaaagcccuuuaaagugcaauuuuaaaauuaauugauugcuguuguuaggaaauaggacagccacuuggaaggagcaaacgaugguuguauuugucaccauauuaauugauuuuucucuauuguuuucaucuuucaggacacuaaaggagacucagccaugguccucucccaaagguucugaaggauaccuugcagccaccuauccaacugucggccagaccaguccccgagccaggaaauccaugagccuggacauggggcaaccuucucaggccaacacuaagaaguugcuugguuaguuuaucuaaauuauguagauuuuuuuuauuauuuaaaaaaauagauauuuuuacucuuggaaaauuauuugaaauuucaggauuaucaaaauuuuccaugucaguguagcaaaguuuuugaugccauuuaaaagagaguuugauagaucaguuaagcauuauaaguugagauagagaaaugagaaugggaccuugaaacaguuuuuucugaaucuuauacuaaauauugugacucuccuuauuuuguuuugccuuugcuggccagcagggaaugggacucugagacauauuagauaaauaccuauaagaaaggaagagucuugcugcacucaggggauuuaaugauauacuguaauacuucccaaaauuaucaucugagagaauauaugaauaugguaugaagcuguaauaguacuauuugccgugcuuucuuugaaaagacaaaaagacaugcuucucaauuaccgaaagaaaauaggauucuuuuuuuucuuuuuucuuuucuugauaugaagucuuguucuguucacccaggcuggagugcaguggcgcaaucucagcucacugcaaccucugccucccgggcucaagcaauucuccugccucauccucccuaguagcuggguuuacaggcacacgucaccacaucuggcuaacuuuuguauuuuuaguagagacagaguuucaccauguuggccaggcuagucuugaacuccugaccucaggugauacacccuccucggccucccaaagugcugagauuacaggcaugagccaccaugcccggccggaagauaggauucuugaaauuaagauugcucaguuacaucaacauuuauagaauuuuugucucugagaaguacaccugaaaugcugcgagacucauuuccauuuuaguaacugaaaguaaaugaaugaaaaaacccacuaggccaggugcaguggcucacgcccauaaucccagcacuuugagggacucaggugggaggauugcucgaguccaggaguucaagaccagccugggcaacaugacaaaacccaucucuacaaaaaauacaaaacuuagcugggcauggugacgagcaccucuagucccagcuacuugggaagaucacuugagcccaggagguggggguagcaguaagccaagauugcaccacugcacuccagccugggugacagagugggaccccgacuccaaacaaacaaacaaacaaaaacacugaucuuacaucgcuccucagaggaaaugcagagauguucuugcauuccauuggguaaaauuguaauuguuacuggaauacauuaggaucuguauuucaguagccagcacugaaugguucaacagauuucaguuauccaugcaaacauauuuaaguaucuuuagguauuggaaaaauguuuguguucauaaggaaauuagugaacaaacaacaaauuguaacauaaauaacgugccaguaaaccgugaaagaaauagaaaccaugaaugugucaaucacaguuacuagccacauagguguguuacuguuguuugaguucccuucuguuaguaccuugccauaaauaaucauuuaggaguuuccugguuacuuuguguuuuguaauucuggauuuucaugccaaugaaguuguaaaugaaaaacuaaccucagaaaaaaauauauugaauucauucaacccauguacuaagugaaaaagauaagguaacugcccuggaagacuuuguaauuuguguccaagacuuauaaucagccaaucacaacagcaacuccaggugccauuaaaaugauaugucuugauggagaaagcuggagaucuggggaaauuagaagaaaaaaaacugcagagaggagauaacauuugggcugugucauaaagauuuaauauaugcuugcaaaauagcaggauaaguaggggcauauguuuaagagcaguggggaauagcaagaauaaagaaaaggcaggaaagcaacugaugauacaucauggcaucauggggaaugggguaggaaaugagaugagaagaaggacuagaacucgauuggaaacgacuguaugccaugguaagauauuuacccuuaucacacauucagcugagguauuuaaguaggagaagaacaugaccaaauuuuaauuuuugccaaguuuuucuagcagcaauguggagagacaggaagagauuuuuagcaagggaaccauuuaauaaaauugauauagcaguccaagcaaaaaaaauggugugggccccgcacuaaugcaggagcaaugggagaauggagaagaaccagcagguuuggagcugggcauaaugguacacaccucuagucccaggaacucaggaggccaaggcaggaggauuguuugaggcugaccugggcagcauagucagacccugucucaaaaaaaacaaaaaucagguuuggaauagguuucugaaguacaauggacaugacuuagugaccaauuguugcagguggggaaggggagaagacugugaaggaugucagaagcuuuuaguuuuaaaaacugucuagauagugauaccauucauagagaucaggacuaauacguucacaguacaugauaaauuuagguugauuacauuugauauauuuucaagacaucuaugaguauauaucuaagagauaaaccacaagauguaccuggaauucgggaagaaaguaaacaaguaaacauuuagaauugauuagcucacagauaguugaagcuauggaagcagaaugagaucuuccaggaagaaugcagagaauaaaauaaaaaggacaagugagaaaggaaggaaaacuaaauguagaaaguagugucccaaucucauguacuuuggaaagcacugacugguuuuagaaaaccugaguuuuccaucuggucauugucuagaucccuagccaugcuaccucagacuaauuacuuaacugcucauggcuucaucaguguacaugugcaugaaacgaagaagccggacuagaucccuuuggacuguuaaauuauuuggccuugguauuuaugacuauuaugaauaguuauucauauucuugagguaauagacuuuguauuucucaaguguuaaauugucagauuuuauuauauuggcuuuaauucuggcuuuaauaaaauaauacuguuggccgggcaugguggcucaugccuguaaucccagcacucuggggagaccaaggcagguggauugcuugagcccaggaguucgagaccagccugggcaacauggagaaacccugucucuacuaaaaauagaaaaaucagcugggugugguagugugugccuguagucccagcuacuggggaggcugaugugggaggaucaccugagcccaggauguggagguugcagugagcugaaaucauaucacugcacuccagccugggccacagagcgagacccuaucaaaagaaaaaaauaguguuaauacaugauuacaugauuagagaaacuaaaagccaaaugggagauaaugcuacuugcuauuuuugaagcaucucccaguguaucugguuuuuaguauuuucaggcaugcauaucuuuuuuucaaagcuuaaaaaauuaaaaucaaacucugcuuucuuccuaagcuuggaaauuacucauguauuaaugaguaguucuuggcaccagcagcguuucuuaaacugaaaagacuggucagacauaguugaccuuugcuacugaauaaugccuaccauugcauuuauuaucaguuaucauauuuguugauuuaccuccaguguaguuugguuuaccuccaguguacagaauacaaucucaguuuaauuugcaccaguaaggugcaaccuauccugaaacagaaagcuaugggaacaaaacccuuugagaagauggaaaauaaaggaaagaaacugcuccagggauguauuagagcuuucuuugaguccucagugaaagcuuaaacacuuuauguccaaacauuuucuuuuuaguguauucccauuuauagacacuguaguuaaugaacuugcauauucuuaacuuuuguuuauaggaacaaggaaaaguuuugaucacuugauaucagacacaaaggcuccuaaaaggcaagaaauggaaucagggaucacaacaccccccaaaaugaggagaguagcagaaacugauuaugaaaugggugagaaacaaaguauugaucuagaucauugaaaauaaggugggagaguacaugaaagucauguuuauuuuccagccauuucuuagaaucuuuagagugaaauauagaaacguuugccauuucucaaaagauaaacucuaccauucaagacaguuaucuugaagcuuguguaaaaauuaaucauauauauuauauacagcauuguaaauagguagccaaaacuuuuguguaggcgaauaguaauucucuaugauguuuauguuaguauuuuaaguaucuacuaaagaaagcuguugaauuuuagaaguaacauugaaauaguuaggugaagugauuauccagguguuugaucacguuaauucccuaucuugcugcagaaacucagaggauuuccucaucacaacagcacccacauuuacguaaaguuucagugucugaaucaaauguucucuuggaugaagaaguacuuacugauccgaagauccaggcgcugcuucuuacuguucuaguaaggauuuccccuuuuugagucccccacccucaaauuuuuauuccagucuacuuuuaggaggcccuuaaauauuaaaaacaugaauaggauacagucuucuacuucucacccaaacagauaacaauucagccacaaaguaaaaauguuguguguuuacuuuuuugcaucuuggcaggcuacacugguaaaauauaccacagaugaguuugaucaacgaauucuuuaugaauacuuagcagaggccaguguuguguuucccaaagucuuuccuguuguguaaguaucuccuuuugauuuuaauucaccuucgugccugucuuuaaguuaaaugcuuacccaguaaugugcacugguugcaaagagggcaaaaugagauauugugauagugauuuuagcuuugagacaguagguuuaaugaggguuaagauuaguuuugaccuacuagaucuauuagaaaguuuauaaggaaagacuuuuaaaaaaucugguugauuuauuuaagugguuuauuuugaugaucauugcucauuuuccucacuuagaagcaaacuauuagacugcuauaucuaaaucagcauaucuguuuugguuuacuuuuuaguagagcuuuuguauuuauccacagcugagugaaaacaaaauugaccuucuguuuaggaggugaauuguuuacucucucuuaaggacuaaaaaauauuaaccucaaaguguucaaauuuaaauaguucaaauaaauucuuuuccugaucuaggccuucuauaucaugucauuauuuucuuuuuuuaaucucauguuagaauuuuagagaguuagaacucaguuauuuuuauuaauggaguguagccggguuagaaauaauuuuuuuccuaaguuucaguuggaucauguauuucacucccucuaaacuauuuugcuuucccuauuugaucugacucagcauuuuaaaagcacugauuaacauuaaauuuaauuuuuuucuuuuuguuuugcacagauccuaaauuuaguuuuaacuuccuaagcgcaugucaguauacaacagauggaaauaguacuaaaacaugcuaaguagcagacagagccaaccuugucuuaagcaaacauuuaccguauaugguuacacaugguuauaugacacuaccaguuguuuguuuucacaauuucuucccuggugacuaaaaacaaaagacaaacaaaaacagacacacacacauguucauuguagaaaauuuggaaaaugaagaaaugccccagaaaguaaaaagcacucaucucccuuuaauuuuggcacauuauucuggggaauguauauuauguuuuccacuacauauuuucauuuaauuuuccucuaaaauguuccucuguugacuuuuuuuuucuuuuaggcauaauuuguuggacucuaagaucaacacccuguuaucauugugccaagauccaaauuuguuaaauccaauccauggaauugugcagagugugguguaccaugaagaauccccaccacaauaccaaacaucuuaccugcaaaguaaauaaauguaucuggagaaggaugguugaugaacuugcuaacaugcgcgcuguuguagaaugcacugacuacagaauucuuuauaagggauagacuuguucauacuuuuauuuccauauuccauuuuuuuacucucucaacuguauguccaauguaacugguugacaacuuuuuaugcugaguauauuuuaaguagguuuuaguugcuuugacacucauucuaaaaacauguuuucaacauguacauaggguuuauauaucaucagcuauaugacuuauuuaauuucuguuacaauuaaaagauaccuugcuuguuauaagaguaaaauuugauuuguugcagguuuugguuuuaauggcuuguggcgguuugcaggaccguuuucaaagguaagaaaauauauuuuucucuaacuuuuggcaaaaugaagguuucuguucaaauuaguaugccugcuuuaagaacacacaaugugcugaaaaccagaaaaauaauucacaauaaacacauauguuacuuuuauaaaaaguuucucaucacaagguuuuuuuccaggaggcagcaugguguugggguguguguauucacuuuuacaaacaaagucaacuuaugaucaauuuuucagaagaguaugauaaaccucugugauacuuuucugccacagucccuuguguauuugauaaucuuaaugcacacaguuagauaucuuaugacuagcaaggagcauuaccaugguuaaaaucuauuucaugaaaacauuuuuauuuccagccuauuagauuagauuaauuucucucuggauuuguccucauuugcucuuauucaguuuuuuuguuuguuuguuuguuuugugagacggagucucacucugucuccaggcuggagugcaguggcgcaaucuuggcucacugcaaccucugccucccagguucaagcgauucuccugccucagucucccgaguagcugagacuacaggcaugcagcaccacgcccagcuaauuuuuguauuuuuaguagaaacaggguuucaccauguuggccaggauggucuugaucucuugaccucgugaucugcccaccucggccucccaaagugcugggauuacaggcaugagccaccgcaccuggccucaguuuguuuuuugauuggcauuaguuuauguagugcuacauaagauguauaugaucauuuucucuguaugugggcucucuccaaauugaucaaaguuccuugaagacaggguuucuguuucuuccuuaaacaguuccuggugcaguguuuuagauacagggggugcuaaaucaauaugaauuguauaaaccuuguuccaguuuuuaagaauuggguauuuuauuuauuuccuuucacuauuacuugaauaucugucaacaugcaaagguugucacuuaaaaaaugggccugaaguuacagaaauaaguauaucauacagaaguuuuugcauuuggauugccaguaacccucugagcccuuuacagugucuagugaguggaaucuaaauggcagcuggaaugaugaugcucugcucauuuucucuguuuuggaaaauuggcuagacaucauuccuggugauuguauugucucaguauuacauucagucugucuugugcauggcuuucagaaaaugcagguucaucuggaagcuuuaagcugaauagaacucccuguuguaaguccuaugguagucuauaaauauuacuccacuccccuuuuuuaaugauaaguaauacaaaggaagaaaaauaguaaauuaaguccaaacaaaauuaauauuuuuggcuucagauggggauuuacuuaaaaaaaaggaacuaaaauaauuuccuauuuuccauuacagcaaacacaaauuccagacuaugcugagcuuauuguuaaguuucuugaugccuugauugacacguaccugccuggaauugaugaagaaaccagugaagaaucccuccugacucccacaucuccuuacccuccugcacugcagagccagcuuaguaucacugccaaccuuaaccuuucuaauuccaugaccucacuugcaacuucccagcauuccccaggucaguaaaugugaucuuuauaugacuuugagcaacaauauaagacaccaacauuaggaauucccuugugaucaguuuauagcaaauuuugcuccuuuuucuuaugagauucaccuuacauuucuucuuuaccuuguaacugacuugacuuuuguuauucuaugaagcuuucuacuuucaaacaaguuguacauaagacaguaaaauguuaaaauguccacaugauauuccaagguugacaaguuuguagaguuugggcaggaagaggaacuuaaaacacauuauucuguaagugaacagaacuauaauuuauuuacuagauauacuaacauugcccuaagggccucuuucucugucucugauacagcauacuauaucaaaaaaaaaaaaaaaaaaaaaaaaaaagaagaagaagaagaaacacaaaaucuauuagguaccucacuuuccugcugccagcaauaacucaaccauccauagaccauccugaaaaucuggaaguaaauaaauaaucaaacaaaaaauucaucucaagaaaauaacaucuuaaagcccauaagcauauauauaccaauucguaaugcaacuuagauuugaauacacugagaaauacuaauagcuaauagcuccagugggacugagauaaacaaggugggagaaauggcaaaccuacagaacucuggacuuauucagugucauagugaaugguuucauacaacucugguugacccuggaggugcuauucauuauagaacuuaaacuauuguguguguuauuaugacagugaguaaugaaggaaagcuuuuguuaugguuguguuuucuauuuagaaagauauucuucuaaaaugguuaaaaauaaaagaaacuuuaguuguuuaacguuccauuaucugaaaaguucacuuaugaaacacaucauuguauaaggaaaaguuacuauauauaguucuuuuaaguguuagcauaaauuuaaaaaaaauccaaugacauaacuauucugugauauucaagaucaauaaauagaauucccaguuuaugaucucaguuuugcaugaacauuucaacuuauguaauuuugaagguucugaagaauuuggcaauacccaauucauauuauaaacuauuauguaauuaacuauauucuauuaaauucugcuuaacaacaaagcuuuggucagcagaggaaacaaauuuuauuuccacauuugucagucgccuuacaaguaauccuuuuuucccccagaaguaagagaagucuaacuuuuuuucccauguaacaagguuuguuugcccucugccacuaacucucuaguacaguguuucuccacgugugaucccagaccagcagcaucauuugggagcuuguuagaaaugcagaugcuguaguuucaccucagaucugcacaaaaaacucccaaguagagcccagccagcagucaguguguuaauaaauaccccaggcgauucuuacacacacuagaauuggagaagcacugcccuggggucugcuucuggucuugcccauuaucagcauuucagcugugaaggccagggcaaaacuuaaaauuuacuuuuuuuacagauacugcagccacugaauuccuuccugcuuccccgcugauaaaccuuuuagcauuuuggagcuagggaaccauacagguaauuuaguuuuaggcucacaauauuguguacauuggggagacugaguuuuagaagagcuggguuaacugcuuuauacaguucuuaucuagaaccaaggccaggcccuuuuguacuacauucauugccuuccauggcuguugucuguuugauuaucuaucuacuuucccuucuccuucuuuauuuccuuguuuuuguuuguuuauugcuaauucauuacuucugucugccuugccuuaagcccaccaguucuuuuuuuucuguuggacuauuuucuggguuacugaacagaaguugaaaaguuuuuaaaagucugcuucaucuuaaccaagcuuuugccuuuugggcuacuaaacugguguuaaacaugucaaaaaugguuaguuuuuuuauugacuuuuuuuacccagucuaauuguagggaaauuucugccuaucuuugcccacuaauggagacaauaaaauaaucuggaugagaauaaagaaccauuacagguuucucugcuauuugauuaguugcauauguccaguguugauuggcuauuugccaaaucauuugcuuuggugaaacagucuuacucuacaaccuuuuacuuaaaauuguuuauuaaaaucagaauagguuuuauggcuuugguuccaguuucaaacuaauggugucaccuccauuagcucuccaaaguuggugccuuuauucaggcuggaaaucucugacuauacacagaagagaugaggagguuuaaaaguaauagaguuaagugguauugugguguucaacucuuccugucacucaauugugugucauugguuugacaguuuauuuuacuacauguuuucagagaaaggguuuaucuuuucaaaaguaaccuuacucucccacaaaacccauuuguaucucuaaauuacaggcucauguucacaaaaggaucccaauuuauaugcccaaucacugaguuuuugucauuugcucuuacagaauaacucuuaaugguaagaguugaucuuuuguuuauaauuagguauauugcuucauaucuuuagcuccauguaaucuuauauccuuaucucucucuuuuuuuuuuuuuuuuuuugagacagagucucgcucugucgccgaggcuggagucaguggugcgaucucgacucacugcaaccucugccucccagguucaugccauucuucugccucagccucccgaguagcugggacuacaggcgcccaccaccacaccuggcuaauuuuuuguauuuuuaguagagaugggguuuuaugguguuagccaggaugaucucgaucuccugaccucgugauccacccacuucagccucccaaagugcugggauuacaggcgugagccacugcgcccagcauuuuuuuuuuuuuucccccuuuggagacagugucucgcucaguagcccaggcuggagugcaguggcgcagucuuggcucacugcaaccucugccuccuugguucaagcuauuccccugccucagccucccuaguagcuggaauuacaagugcacaccaccacgccuggcuaauuauuguauuuuuaguagaaacccgguuuccccauguugaccaggcuggucucgaacuccugaccuuaggugauccacccaucucagccucccaaagugcugggauuacaggcuugagccacggcgcucagccaucucauuucuuuauggcguugaguuugcuuauaucaaaaaaccaaaagaaaguuguccagauuccuaacucagucuggcguuucaacuuugcuguuuagcuguauagaaaccaaaacauuuccuuaucuccauucccagcagccaagucucaagcaguaguauugaaagaaguucucugucauuccccgauauggagcauaaguuugauuuaccaucaaauuacccaacaucaaccuauacuuagucaacugagauuuaaacagauaaagguuccauugcccuauuucaaaaagcaaauguugcugaucugcacgcauucaauccuuugcuauaaauguuucaugucaaugcaaaacucuucauucuagaucuuugauguuuagcaggaucagcuacugagcuguauuuucuuuuguccaacauuuucuacuagcaaaucaacaaaauaagagauucaugaaccucuccuccucccccuccugccccagcauuaggucuuacuuaaauuaaacauuugggcaguauuucguuaguuaccagcuuugaggagaagugguagucacuuacauaaagcaauugucucugaaaaugcauucuucuugacaaauuagcauagccuaauucuccauccuaagggggacuguuuuacaagucuacauauaaaaguaccuaaaugguugucuucugaaucccucccuaguagaaauugaauuuggcaucaguggagccagugacuguaccugggauucagugcauauagaauugcauugacugugacccuuuaggcaaauggauguaagacuuuggcucuuaggauuuucccaaacaccaauaagagcaucuugaagagaauccauuuacuuuaugauauauaaggauauuucagguuugauauuaugauccuuauuagguccagucuagcugagcuggacaugaauugaagaaccagaauuagaacuagaaaaugaaacccaggcugagugcgguggcucacgccuguaauccuaacacuuuugggaggccgaggcagguggauugcuugagaccagccugggcaacaugacgaaaucccaucucuacaaaaauagaaaaauuagccaggcguaguggcaugcauuuguagucccagcuacuugggaggcuggggugggagaaucaccugagccggagaggucaaggcuguggugagcugugaucaugccacugcacuccagucagggauugagaaccuaucucaaaaaaaaaaaaaaaaaaagaaggaaagaaagaaaaugaauuaauaggauccauuuccaaagcauuaaaauuuaauauauacuuuaucagggucuucugauauucuucagaggagaauuguuguaaguuaauucaauaaacauuugaauaccuguuuuguagguguauguuaaguauguauuagaauccuugaucaccagagacuugacgguuuuugccuugaaaguuauuuccuuccgauccauguuguuuaacaaauucuaagugugcacuauuuuuuuuauuuuaaauacaagauuaauacuauagugcacuguagaaaauaccaaaauuccagauauuuauccuacauauauguauuguuuacuauaugcaaggggcucuuagaccccaggggagcagaggggcugccagggcaugauaccugccuucaauauauuucagaucagaacgggcaguagaauguacauagauaacuauuuugaccucuauugugauaccugucauguuguaccuuguacuauauaguauucugauaguucaaagggacauuuguguggaaggaucauguaauaauuauggcaaaaguuuuauaacacauuuuucaccucaaaaauguuuuuaaacaaaacaaguaaauucgugaucuauuuaauuuuuuuuuuuuuuuuuuugagauggagucuugcucugucacccaggcuggagugcaguggcacgaucucagcucacugcaaccuccgccucccagguucaagcaauucuccugcuucacccugcugaguagcuggcacuacaggcacccacuaccaugccuggcuaauuuuuguauuuuuaguggagacaggguuucaccauauuggccaugcuggucucgaacuccugaccuugugauccucccaccuccaccucccaaagugcugggaauuacaggcaugagccaccgcaccuggccuaaaauuuuuuuuuacuaggaaaaaggcuuuaacuuuuuuuuguuugaucagcucauuuuacuguuaguauuggugcgugaauuuuuuagaacaaagacauacuuaguucaucguuacuuuagacucccuucuuccauuuuuauuucuggccuugguccaagccuaccagucauucucucacuuugcuucuguaauguagaccuucuuccugagaagcuggcuagaucagguagugaucauaacauuccuaaaccaauagugcugauagcucuguguacggagggauauuucaucuaaaccauugcucuaaacuuagacuuggcucugagucaguaauacuucuguuuacuagguuugaaauaucucccucuuagcugggcacaguggcacaugcuuguggucccagcuacuagggaggcugaggugggaggauugcuugagcccaagaguucaagucuggccugggcaacaucaugagacccucgucuuuuaaaagaaggaaaagaaauaucucccuuuuagaagaaaccuagaagucucuauuuugaggccacuuaagaucucugaaaugauuuuaauguuuuagagaauuguuuaugguauuaccugaccuuuuuuucuugauuuguuuucuuuuucuuuguuauuauccuauguuuaagggagaaaaauaauuuuaaauugagcgauuucuugguauaauucuugcuaauuuuuaaaucuaauuuuuagcuuaauucuuaauuuaaacuaaaauucuuaauuuuaauauaagugguaaaaaaauacaucuacaaaguuguaaguucucucauuuauuuaccaacuguaauauuuaggaaauuaauggucagaauucaauaauuaaaaccagauuccuucugaaaaccaaggaacauuauaauuaucuaguaucuaauuguauuucacccuuuuuuaaaucuuaugaacaucacuuacuugcuuuuuuuucuuccauucuuuguaaagcuucucugccuugcucuaaaucagcaguuuucaugcagcuguucccucaucaagguacucuuuauuuucaucaucuuugcacgaaaauacugcuuaccccacacucauccugggcacauagcaugagacuuuacucaccggucccuguaagcucagucugccuuaggcacuuuaggaacuuguaaagccaccacuuuauaaggucuugguacuuaacaggaauugcacggccaguguguggccugucuuguuuaaggagcugcuaauacccacccagaacaaugaagaugcaaucccauaccuggacuaacaaaggcagguuaauaagaaacucaagagagaguuaauagagaaagagcagaauacgugguuugaugaaguuuuuuuagcuuagaaaauaacuuguuuuccccaaauagaaagccaaccccaguguuuccucagaaauuaaagcuggcugucuauucaaucaccugugguuaaaaaaaggaauauggccaggugcgauggcucacgccuauaaucacagcacuuugggaggccaaggugggcggaucacuugaguccaggaguugaaaaccagccuggguaacguggcaaaacccucuuucuacaaaaaauacaaaaagcuauucacaggacugagguggggagguugaggcuuuggugagcugagaucgcaccaccgcacuccagccugagugacagagcaauacucugucucacaaaaaaauuaaaaaaaaaaaauauauggucauuaguuagcuauaaggacuaagaugaaaaaauuugacacauuuaugucuaauuuauaaaagaugccuuuucuuuuauucaccuguaauuaauauacaaaaagauuacaccuaaacagaaaaagaagugcuagcaguuggugaacgucauuuuuaaaaauucuuuuuucuuuuugagacggagucucucucuguugcccaggcuggaguacaguggugugaucucagcuuacugcaaccuccgccuccccaguucaagcgauucuccugccucagccuccugaguagcuggaauuacaggcauguuccaccaagccuggcuaauuuuuuuuguauuuucaguagagacgagguuucaccauuuuggccaggcuggucucgaacuccugaccucaaagaucugccugccuuggccucccaaaauguuaggauuacaggcaugagccacaauaccaagccaaaaauucuuauaguuacaauuuuuuauauuuagcucaaaauaaaaauauuucuaaguauauauuuaauacgccuccaugaauguauuuacuguagcuuaaaaauaggcuguagcuaccuaagaagauuuauucuauuuugugcuuauuuauauuagcuucacucauuuuacaaauucuagcauaaaauuaaaguccuaguauuuguucuaaaacuccuuuguaucaccuggucuuuuacuucagauauuaggagcaucuuaauuuguggaguaauuauuuuaucugugugcaaaaauucuucacauagauuauuuugucuaacaacccuuugaaauagacaagucugcuguuauccuuaauugccagauuaagaauuacaacuaaauaagaauauugauccaaacaagucucaaaccuaggucuucugacauguuuaaguucuccuguauguaauaagaguuuucuaauaaguuugccauauuguauaugaaauaaacuaaaugcagaguaagguaaccuacuagugcuccugcacagguggcaggagauuucaguuuuuauuagucugucauuuuuguaguauaacuucucacaaauuaccuaacccauuuuuccuuagcuuuucaagaguuaaaagcgauucuguuguuuuauuauuucaugauacuauuauaacugauuauuucaguuugggaaaccaaaaguguuuuuuaaaaaugagugacuaaaaaauugucaggcuggagcuacaucacuaguuguaaaaauacacaaaccuugauaccugccuucaaggaacucauguucuagcagggaagauagacaucuaacuuaaauaacaauaauguaaucuaauccuuuuccccagcuacucaaauucacugaauuuuggccaauaacaccuucuaguuaggauuuugucuuuaucuggaaccaccacaauuuauugaaacauaguacugcugauauacugcuguacagaauguccagcuguuucugcucugcauguuuguaauuggcugcauguuugaccacagcauaucuguggggucauuuaagcuggcaaaucaggaccacagaaguuuuagcuuuauuuccuuugugugguagccucuggguuucugucagucacuuuguaguuuugucuguuuguuguccaccaaaggccagaaaggagagccaaugcuuuaggggcaaaagagauaccagaauacaaaacuuuaaagggguuuugaugaaaagaagugcagcaccaaggccuucucacuaacuuaaaauauggcauauagcaauacaggauguguucugucugcauuggaguggucuaucagauaaucugagaguuuuuccuaugggauauugaggugaaauccuucaccaguuccuagagagauuucuagauuuaauuuuagaggauaaaaagaaagaaugcugccaaaauucuuagaagugagaauuaugcugagaaacuuaaaugccagaacuagauacuaugaucauucuguuucauacuaccuuggcuuuuucaagauauauuuugguguaaacguaaugcauuuuaauuguuuuuuuuuaaugacuuuccaagauuuuuguuaguuucuccuuugauccuuacaguaaaacaucuuugcugugaaguugaacuuaggaaucacagucacaccacauuuaccuaugugugauuuauacaguugggucacuaaguaggaagaaaacauacauuccaaaaacaagaauuuagaugaaaaaugaauuugagaaaagaaguagaauaucaacuuuugacauaguguugaagcuuuugguuaugagggauggggcugacaagucacucguacuuuuacauuuuuaauuaaugugcucauuaggaaaaaaauuggaaaauucagaaaaauaaaaggaaaaaguuacccacaauccuaucauucuaagauagauaaccacuguuuauuaacauuuuggugcauuuccuuccaguuucuuuuuuuuauauacuugaggucauaguaugugaacaacuuuauagcuuguuuuguacccucaacauuuaacaggagauaaauaaggccuuuaaaauuauuugagguuugacgguuauuugcuucacaaaacagaaaguggaauguucuuagcacuuuuuugaagauaccuucacccuagugacuucaucuacauuacuacaauuuauguaauuguaauucucaggaauaacacugugcccaaacagaagcauugccacccaugucaugacuguuuuccccucagaguaggccauggucuaguaguagcaagacacacaagaacgagccccaggguagcagauugcuggcagagagucacagggccuuccuaguggucauccaugcuucaugccccuccugcaugcgggccagcuccaaguuguuucaaaccuuugucuuuuuaagguccuaguuuugccugaaucuuauuuucuauuaaagaaacaacucagaauuacuggacuugaaacuuguaggccaaaugcaaauuugaggaaauggaaggucaaauacgcugacaaauucauaauuuuaaguggaggaugccaaagggaaaaaaaaaaguucuaucuuuucaacuaaaaauauuauaccacucucuggagaucagggauugcaugcuuuggggcucugaauuacagguaucuagcuaucacauuuuaaaauggaaguguucaguucauucaguauuaauugaaaauaauuuuucaauguauugaaaaaauaacuagauuuuacaggaaaacaaaaaugaauaauaaugaucuuuacccuucucagugccuuuacucaguagaggaagauggauguacaaguuguagaaucauaggcaaguuaauuuaaaagcaaggaaggagaaaguaguucuggcaagagacagaauaaugcaucaugaaggaaaaggauaugagaaaaaaaaauauggguugaauuuuaucuuguagagauacgcaagacaauuaaaagagccuacacaaacauacaucccaaagaagcucaaggcacauuccagagaucaugagcagcuuucuuucaguuuuguuauuucuuuuguaaauagcucuggagaggaugcaaauaaauauacagaagagaauuuaaauagaccagaauucuguuacccagagaaaaguuccaugaauguuucuagucaucuuucuaugcauaugauuagauuagauuagauuagaacaugacuagccuuaaaaaauuuaauaaggguuuuaaaaaagauuugaauagaacagauuuucaguggugguucagcuaugcucaccuccuggagaaaugucgcugauguuuuuccuugcacucauaugccugaugcagugcacauguucauaaacagucacugacaaaugcccauguuccuuugacagcaguucagauuuucaagacagcaaaucucuguugagcacguguaaaccaggccacgugcuuacagaugccugauacucuugagucgaauucagagcugaauccaaaugaaagaugaguggcuccuagagggaggucaucccaaguucauuuccuguucaugagccaacaaauaacuaacuggguagaucuauguacauuuucuguaacauaaugaauacuucuugacuugaaauauuacuuuuuguccaaaaauggaaauuuuucuauucuaagauuuaaaauuucaauauauaaagaagaauaaaguacaaauuagcugaaaucuugccauacagagguaaaauauauuuuuuaguccuuuggcuucugacagagauaaaauauuuuggcagauguuuacccagcccuacgcccucuccccacaguguguggguguuuuuuuccuacuccaaaaauuguggucaucuuuuuguaucaguaaauaucaaucaguaauguacauuuugauacaaauuacuaaaacguucugcagcuguuugcuuucccgccaaaauuuaugccagcaguaaguauaaucagucuaauuuuggggguaaauuuuauugauguuuaacagaaaaguucacaaauugcaaguuuucagcuuagugaacuuuuaaaauguaaacacacuugaaaauccaucaucuacaucaagaaacagaacauuaccagcaucccaagaagccauccucaugcccccuuaagucacuacuuccgcaagggugaccacaguccuguuacccaauuuguaaucuuuccuaaugugauagauaaaaauaaaaaucuuauuuuaguuucugguuacuuuucugaaguuacugcuuagauuauuuauaauauuaauugggguggggugcaguggcucaugcuuguaaucccagaacuuugagaggccaagauggaaggauugcuugagaccaggaguucaagaccagccuuggcaacauagugagacucuaucucuagacagaauuuuaaaauuagcugggcaugguggcaugcaccuguaguccuagcuguuugggaggcugaggcgagaggauagcuugagccuggaaguucaagguuauagugagcuaugaucacaccacugcacugcagccugugcaacagggcaagacccugucucuaaauaaauaaucaaucauuguuaggcccagguuuuggagguuuaaucuccuccucaagagaaauaaauggcaucuguuuaagguugcagaaugugaaaugacuuggcauagcugaaaagaagcaaagauucuacaguaugaccuuugugauauauuauuuucucaguaaauaguuucuuugggauaggcacugugauuaaaaaaauaaaagcaucuugaguuuucuuugaagugacaaauuugcuggaaagaucaguacuuucugcugcuggagaguauauucuguuuauaaacaugaaugaggaugugaauaaggcuagaagaugaccucugcuggaaguuucugguaugauuuggaggaaggagcacuagucuucccugguggcugcuagccuuucauuuaguucaagccugccagccucuagcuuuuccuugcaacuugucuuuucauuuuucuugugcuauuuucugcuaugauagcaaacuuugcauaacaaaaugugaaguuuuccaugugacauuaacuuaguaaacauuuuagcaauugacuauuaaaaugaaaugugcauaaacaauuugccagguuguaucuuaucacaaauauagucaugugcugcauaacaacauugcagucaacaacagaacacauauagacaguggucccgaaagauuauaauacuguauuuuuacuguaccuuuucuguguuagauauacaaauaguuagcauuguguuacaacuacauaaaguacacaauaugguaaccugcuguacagguuuguugccugggagaaacaggcuauaccauauagccuugguguguaguaggcuaugcuaucuaaguucauguaaguacacuccacaauauuugcacagacaaaaucgccuaaugauuguuuccuagaauguguccccguuguuaagcgacacaugacugcaaugaaauucaguccuggaaggaaaagaagaaguaacuggcuguucucuuuuucuccaggaaucgacaaggagaacguugaacucuccccuaccacuggccacuguaacaguggacgaacucgccacggauccgcaagccaagugcagaagcaaagaagcgcuggcaguuucaaacguaauagcauuaagaagaucgugugaagcuugcuugcuuucuuuuuuaaaaucaacuuaacaugggcucuucacuagugaccccuucccuguccuugcccuuuccccccauguuguaaugcugcacuuccuguuuuauaaugaacccauccgguuugccauguugccagaugaucaacucuucgaagccuugccuaaauuuaaugcugccuuuucuuuaacuuuuuuucuucuacuuuuggcguguaucugguauauguaaguguucagaacaacugcaaagaaagugggaggucaggaaacuuuuaacugagaaaucucaauuguaagagaggaugaauucuugaauacugcuacuacuggccagugaugaaagccauuugcacagagcucugccuucugugguuuucccuucuucauccuacagaguaaaguguuaguccuauuuauacauuuuucaagauacaaguuuaugagagaaauaguauuauaaccccaguauguuuaaucuuuuagcuguggacuuuuuuuuuaaccguacaaaacugaaagaaccauagaggucaagccucagugacuugacaccauaaagccacagacaagguacuugggggggagggcagggaaauuucauauuuuauaguggauucuuaagaaauacuaacacuugaguauuagcaauaauuacaggaaaauaagugcgaccacauauaucuuaacauuacugaauuaaaacuauggcuucuaaguccuuauccaaacucagucauccaaacuaguuuauuuuuuucuccaguugauuaucuuuuaauuuuuaauuuugcuaaaggugguuuuuuuguguuuuguuuuuuguaaaccaaaacuauacuaaguauaguaauuauauauauauauauauuuuuuccccucccccucuucuuuccuaacuaauucugagcaggguaaucagugaacaaaguguugaaaauuguucccagaagguaauuuucauagauguuugcauuagcuccauagcaaaauggaaugguacgugacauuuaggguagcugauauuuuuauuuuguuaaauaauuuccaagaauagaguaugguguauauuauaaauuucuuugauaagauguauuuugaaugucuuuuaaucuuccuccuccucuccaaaaaaaucagaaaccucuuuaagaaaacauguagguuauauaugcuagaauugcauuuaaucacugugaaaagacuggucagccugcauuaguaugacaguaggggggcuguuagaauugcugcuauacuggugguauggauuaucauggcauuggaauuuucauaguaaugcagauccaauuucuuugugguaccugcaguuuacaaaauaauuugacuucagugagcauauugguaucuggauguuccaauuuagaacuaaaccauauuuauuacaaaaagauauuaaucccucuacucccagguucccuuuauauguuaagauauaauggcuuugaggggggaaaaaauaaaccuaggggagaggggaguuuccuguagugcuguuucauuagaggauuucaguaaauuaaauuccacagcuaauucaauaaauaaugguacauuuaaguguucugauuuuaauaauauauuucacauuuauccacacaguaacaauguaauauguuaauguaaauaaaauugguuuugauacucagaaauaacaagaauuuaauuuuuuaaauuuguuuacaguccugggaaaaguaagaauuauuugccaaaauaagaggaaagaaaaccuuaguauuauuaaugaguuuaccauagaauuguuggaaauacugaagacaggugcaauuuacuaaacuuuuguuuuuaaacuauuguagaggcugcauuagaagaaaauguuuauaaugacagagcaacuaugacuauauaaaaaagcugaaauuagaacuguguuuagaaauagaucaguaacccagugccaaggaugccaagcugccaccauggucuuggcucucccacaacccaguguuucugggguaaguuucacaguuucuaggcccuggaauagcaggcaguguaagccuuugauaacuuuaguucgauguuuuucuuguuuuuguuuguugguuuggugcauaugauaguggguguuaugcuauuuugcucuucccaucaaaauaaagaaacuuccagagguuuacuguuaaaaauacugauauuuccauaaacggguuuaccaaggguguaguauuucauaccgccugaaaugaucagcauuggcacaaaucaaaauucagccgccuuugaaaugcaaaaauaccuuugacuaguaaguacauccuaggaguuugaaaacuuaacuaagguuuaaaauuuaccuuguuuaaagaacuucugacuuuugaggaaaaucuagcuuuccaaguaacuaaaauguacaugagauaaaccucucaccacuaugugucccuugagaaaugcaacacuuuuuuagucuucauacuuguaaucuauaaaagaaauucugaaguuuagaccaaguugcccauuucugcguaauugacauaaguucuguuaaaaauauuauaaguaauucguuucgguuuguagauguuuccccugacuuguuaaagaggaaaccaggaacucagucauguuuuuguccuggauaaucuaccuguuaugccaguacucccauccgaggggcaugcccuuaguugcccagauggagaugcaguucaguagauuuggggcaaaguggcuacagcucugucuuccauucacucaacaccuguucaugacugagccaggugcccaggacacauccuaaacagucagcuucuauccuguguccuaguuggggagacagagugccagccagcaacccucccagguuuguagguuuuagggguuuucaguuuuguuuggguuuuuuguuuuuuguuuuuguuucuacauccuuccccgacucccaggcauaaugaggcaugucuuacucaauguuaugcaauggauuuaggcaaaaauucauucuuagugucagccacacaauuuuuuuuaaugcaguauauucaccuguaaauaguuuguguaaaauuugacaaaaaaaguauauuuacuauacuguaaauauaugugaugauauauuguauuauuuugcuuuuuuguaaagcaguuaguugcugcacauggauaacaacaaaaauuugauuauucucguguuaguauuguuaacuucuuuuugcgacugcguuacaucauuuaaagaaaaugcuguguauuguaaacuuaaauuguauaugauaacuuacuguccuuuccauccgggccuaaacuuuggcaguuccuuugucuacaaccuuguuaauacuguaaacaguuguacgccagcaggaaaaauacugcccaacagacaaaaucgaucauuguaggggaaaaucauagaaauccauuucagaucuuuauuguuccucaccccauuuuccuccuuguguauguacuucccccaccccccuuuuuuuaaguaaaauguaaauucaaucugcucuaaga

SEQ ID NO: 192277 - RNA, 38540 nt, Homo sapiens
gggucuccgaaccugaaaccgggagcuuccugcucguguucgcuguugagaagcuacccgcgggguuguagaccucggaccucauggcagagauaauucaggaacgcauagaagaucggcucccggaauuggaacagcuggagcgcauuggacuguucagucaugcggagauuaagugagagaggguuggggagagggaagagcugaggcggccugaggggagguugggaguguguggcaggggcuagauguggggacgcucgaccuguguuuacuuuuccuaacgugguggaagcccauuucucguuuucggugauguccagaauuaauuuuucauucguugcaagguaauccguccgucuacuuacccaucagacguuuugacagcccuucauggagccgggucuuagggcuguaaaggugauaaacccaggauuccugcucauuaggagcuaauugggcagaguguggugggggagacagacaaauuaaauauuuugauaacaguguacuguaaguugauuguaguaccuuguacugcuguagggaugggaacagagugcugugagagcccagggggaguggauaaauuccuaacuagacuugaagguggggaccauugaaaucaguuucauaugcuacuccagagccuaacuacagcgccuggcacaugguagacauucaguagcguguuaaaauuauguuuaauaguuuuuaaugguuucugugacuguugcuuuguuuugcaacgucugaauguaguaaugugacucagagcuucaaaguaagcauucguuaaugaaacacaaaacaaagcaguguggacgcuuagaaagugcucaguuaagguuaauguuaccauuacuaaagacaccugucuugcacaucuugcauuaaauucuccuaauauauauuugucauauguucauuccuuagcuaaggacucugaaucuucucccguaaguccuucguaguaauaagucuuuuaaggcagacgcaauuuagauuuuuaaaaaaauuuacauguugagaacucagaaauaagaggaauuucggaaagaaauuuauuauuaaaauuuaagugaccugaacuuggaguaaaagaagucuuuauuaauaccagccaggcgcuguggcucacgccuguaaucccagcacuuugggaggccgagguggguggaucacgaggucaggaguucgagaccagccuggccaauauggugaaaccccgucucuacuaaaaauacaaaaauuagcugagcgugguggugagcgccuguagucccagcuacucgggagucugaggcaggagaaucgcuugaacucgggaggccgagguuguagugagccaagaucaugccacugcacuccagccugggcgacagagcgagaaaaaaacaaacaaaaaaaacaccauacauaaaugguauaaaguucuuaauuguauuugcuuugcuggugggaaugucauugguuuugggaguugauuaagaugauuuuccugaaaguuuaaaaaugaacccuuaagaacacaaaaguaauuguguaagagaauacuuuuuuuuuuugagauggagucuugcucugucgccaggccagagggcaguggcgcgaucucggcuuacugcaaccuccgccuuccagguucaagcaauuuuccugccucagucucccgaguagcugggacuacaggcacgcaccaccacgcccagcuaauuuuuguauuuuuaguagagaugcaguuuuaccauguugaccaggguggucucagucucuugaccucuugaucuacccgccucagccucccaaagugcugggauuccaggcaugagccacuguguccggccgauaauacuuucuuaugaaagauaacucuaggaauuucguauuuugaaaaacauguuuuaaauauauucaaaauaaacuuaaacguuuaauuuuugcaguuuucaagugaaguuuaaauggcuuucuccucagggcuaucauuaagaaggcuuccgaucuagaguacaaaauccagagaagaacccuuuucaaggaagacuuuaucaauuauguucaaguaaguguguaauuaauaauuucuuucuuuuuuucuuuuuuguuuuuuggugagauggcaucucacucugucacccagguuggagugcaguggugugaauggugugaucucugcucacugcaaccucugcccuccaggcucaagcgauucuccuaccucagccuccuggguagcugggaccauagaugcaugccaccaugccuggcuaauuuuuugguagagacuggguuuugccacauugcccaggcugaucucaagggauccacccaccuuggccucucaaagugcugggcuuacaggugugaaccacagugcccggccaauaauuaauaauuucauuacuuuuuuuugaggcaggggcucgccuuucacccaggcugaagugcaguggugccaucauggcucaguguagcuuccaccuccugagcugaagccauccucccaccucagccucuggaguagcugggacuacaggugugugccaguauggcuggcuagcuuuuguguuuuuuguagagacaggguuucggcauguugcccacgcccaaaaugcugggauuacaaguguuugugagccaccgggcccagccuuacuuuuuuuauuuuuguuuuugagacaagagucuugcucugucacccaggcuggagugcaguggcgcgaucuuggcucacugcaaccacugccuuccggguucuagugauucucaagucucauccuccucaguaacugggauuacaggcguauggcaccgcacccagcuacuuuuaguagagacuggguuuugccauguuggcuaggcuggucucgaacuccuggccucaagcaauccaccagcaucggccucccaaagcgagugcuaugauuacaggcaugaggcaucaugcucgguccuagccuuacuuuuuaaucccuucacaaauugauugauugguugauuaauugaaauagagucucucugugucacccaggcuggagugcaguugcacagucucugcucacgcucaccgcaaccuccgccuccuggguucaagugauucuccugccucagccucccauuccuucacaaauuuaaaaucaguucuagaaugaugagcuuaacaucaaauuuuuuuuuuuuuugagauggaguuucacucuuauugcccaggcuggagugcaguggugcgaucucggcucacugcaaccuccgcuuccuggguucaagcaguuaucugccucagccuccugaguagcugggauuacaggugcccacaaccacgccaggcuaauuuuuguagagacagcguuucaccaucuugaccaggcuggucuugaacuccugaccuggugauccacccgccucggccucccaaagugcuggaauuacaggcaugagccaccacgcccggccaacaucaguuuuuuaaaaaaauuaaaagaauuccagaaacguucauuagauagauauuucugaacaggaguagcauugggaguagcauuacuccacuaagacuguaguccuggccaaacugaacuuacuuuuccccuccucuuucucucuugucguuuucuuucuuuuuuuuuucuacuggguuuguagaucagagauugucagagacauaguguguaucaggacuucagcaagagauuugccucuuggugagcaagauagaggagagugaaugugaugaguguagagaauugaaaaguuacugcuuguuuaucuauugucuguccacuuggaaagagguguacugcaagauuuuuucaucuuguaaaugcauggaagguuugaauaaagaaaaauuaugucagaccaauuuuccagugggggagaauagcuaauauguuggaugacggaaucaggauucagaaagaaccaauaacaagaucacauguuuauaagacuagaaguuuugguugggcaugguggcucaugcuguaauaccagcacuuugggaggcugaggcaggcagaucaccuguggucaggaguucgagaccagccuggccaacauggugaaacccccaucucuacuaaaaauacaaaaauuagccgggugugguguugggugccuguaauccuagcuacucaggggcugaggcaggagaauugcuugaacccaggagguggagguugcagugagccaagauugugccauugcacucccagccugggagacaagagcgaaacuccaucucaaaaaaaaaaaaaaaaaaaaagacuagaaguuuugagcuuagauuuaaaaagacaaaagacagccgaacaaacaauauaugaaccuuggcuaagcuauuguuuuuggaagagguccuaugaguagauugcucacucaaaaugagccaagaccauauuaugucaaaaauagauuuuuuuuuuuccaaauaauacacucacucuugcccaggcuggagugcaauggugcgagcacucauugcagccucgaacuucuaggcucagaugauccuccugccucagccucccaaguagguaggacuacaggcuugugccagauggcuggcuaauuuucuuauuuuuuguagagauagggucuccuuauguugcccaggcuggucuugaacuccugggcucaagugauccuccugccuugccguaccagaguuuugggaauuacagacuugagccagugugcccagccaaaagauuucuuaaagcuaaauuagacugugaaagcacaaaccaugagagaaaagacugauuuauuugauuguguucaaaauacaaauuucuggaggggcguggcggcucacgugugagacaggcagaucgcuugagcccaggaguucaagaccagccuaggcaacauggcaaaccccaucucuacaaaaaauacaaaaauuagcugggcaugguggugcacaccuguagucccagcuacucuggagguugaggugggaggaucaguugaaccugggagguggaagcuguagugagccaugauggcgccauugcacuucagucugggugauagagacccugucucaaaaaaaaaaaaaauuuuuuucugugcaaaaaagacacuacaaauaaugugaaaauacaagccacaaaaugugagaaaauauuuacaacacauaauuagaacuacauauacacauauauaaagaacuguaaaucgagaagaaaaugaaaacuaaaaagaaaaaugggcaaaucaugugaacgugaaagucacaaaggggaaacaucacuuguaguuaaacuuaugaaaagacaucagccuuaucaguaauuaguuaaauaaagauuaaaacaagguguaggggccgagcgcgguagcucaugccuguaauccuagcacuuugggaggcugaggcggguggauuacuugagguugggaguuggagaucagccuggucaacaugguggaaccccaucucuacuaaaaauacaaaaauuagccaggcacgguagcacguaccuguaaucccagcuacuggggaggcugaggcaggaaaacugcuugaauccgggaggcggagguugcagugagccuagguugcgccacugcacuucagccugggcgacagagcgagacuccaucucaaaaaaacaaacaauaaaaaaaaaccagguguaggacugcuuuauauucauuauaagagcaaacuuuuuuuuuuuuuucuuuuuugagauggagucucgcuccgucacccaggcuggagugcagugacaugaucucggcugacuguaaccucuaccuccugaucagccucccaaguagcugggauuacaggcacacaccaccagccucggugaauagggauauagcuaaagggauaauguugaguagaaauauggauugaugggccgggcacgguggcucaugccuauaaucccagcacuuugggaggccaagguggguggaucacucgaggucgggaguucaagaccagccuagccaacauggugaaaccccaucucuacuaaaaauacaaaaauuagccgggcaugguggcaggcgccuguaauccaagcuacucgggaggcugaggcaggagaaucucuuaaagccaggaggcagagguugcagugagccgagauuaugccacugcacucuagccugggcgacagagggagaccccgucucaaaaaaacaaaacaaaacaccuauggauugauggauguagcaugauaccauuuauguaaaauuuaaaggcauucaagacaucauuauaauaaaguccaaagucauguuugggaaugauaacaaagucaagguaauugcugccucuggagagggagaagaguagaaucagagauagguacauagguagcuucauuuuuauacgaacuguuuuauuucuaaaaaagauuugaagcaaauguagugcaauguagguuugguguagcugcauuguagcugcaugggguguuuuauaugcuugaaauauuucauggaauaauuuuuaagugaagcauguaauuauaagcuuguuaauucuguuuaaguuuuauagcuaagugaauuuuaagugaguucuagacauuuauuguaaauuaugugauagcacauuauuuuuuauuuuauauucucgauuuuuguuuuaugacuuuaacuaaauuuccaguauuuaaaagguuuuagauuuucuagcuucucauuuuuuuguauguuuuucuuucauaguaugaaauuaaucuuuuggagcugauccagagaagaagaacaguaaguagaagauuuucuagaaguuggagaaaaauacagaacuaagcaguauggcuguauaguuaggacuuguguuugggagacaguguugauaaaacuguggugauaugccuauaauggauauuuguaauuauuuguuugcuucaucaguaccauuaaguggucaaguaggaaugcuguuuuggacaaauaugauuaaguugaggcucuguuuuuuuaugucccccuuuagcgcauuggauauucauuuaagaaggaugagauugagaauucuauuguacaccggguacaagguguuuuccagcgugccucagcaaaauggaaagugagugaucaaggcauccuuaacuuuaugagaugugaagauaaguauuauacauauuguauuagggauucaaaugcaguuuucuauuuuuaucuuggguaucuuuauacuuacucuaaugaugguaucauuacucaaaacauuuuuugagccacuuaacaaaccaguaagaaaauugaucuuauuaccuuauaguuauucuaugaggacagugcugaaaacaguguauuugauacauuacuaaggauuggaaauuugggagauauuuguauauauuuguaaguacacugaagacuuagagcuagaaaauaaaugguuauguaggggcaauaccucagaaacuugauuuuuuuuuuuuucuuuuuuuuuuuuuuuugagauaaggucucacuguguugcccagacuagaguacaguagggugaucucgguucacuguaaccucugccucccaggcucaaaugauucucccaccucagccuccccaguagcugggaucacaggcgcaugccaccgugccuggcuaauuuuuguauuuuugguagacauaggguuucgucauguuuuuuaggcuggucucgaacuccugggcucaagugaucugcccaccucagccucccaaagugcugggauuacgggaguguuugggauuggguauauuauaugagaaguauuuuggauucuugguaaugacaaauuuuauauugcuaccccagauugagauucuuuaagaacugcauuaaaccaacuggauagauaacaaaguuuuuuuggagcauugugagugggaguugggggaaagguugaauuaucauaguuaagagaucggaggccuuugugaggaagagccagauaggaugagaggugacuggauuuucugaaaucugcuucuuuuuuuuuuuuuuuuuuuuuggugggggauggaguuuugcucuguugcccaggcuagagugcaguggugugaucuuggcucacugcaaccucugccucccagauugaagcaauuuuccugccucagccuccccaguaccugggacuucaggcacgcaccaccgcgccuggcuaauuuuuguauuuuuaguagacaggguuucaccaucuuggccaggcuggucucaaacuccugaccucaggugauccaccugccucagccuccaaaagugcugggauuacaggccugagccauugugccuggcuuuuuuuuuuuuuuuuuuuugagguggagucuugcucugucacccagguuagagugcaguggcacacaaucucggcagcucacugcaaccuucgccuccuagguucaagugauucuucugccucagccucccuaguagcugggauuacaggcacauaccaccacaccuggcuaauuuuuuuuguuuguuuuuuugaguuggagcuucccuauguugcccaggcuggagugcaguggcccgaucucggccucccggcuucaagcgauucuccugucucaacuuccugaguagcugggauuacaggggucugccaccaaguccggcuaauuuuuuuguauuuuuaguagagacgggguuucaccauauuugacaggcugguuuugaacuccugaccucaagugaucaauccgccuuggccucccaauaaucuuuguaauuuuagguuaggugggguuucaccauguuggccaggcugguuucaaucuccugaccucaagugauccgcccgcuucggcuucacaaaguggugggauuacaggugugagccaccgcauccaaccugaaauuugcuuguuuuuagcaaaauuaauuaaugcaaagguguauuauauguaaaggucaaauuugggcagcuuacuacauugcuuuucuugcaggacgauguucaacuuuggcucuccuauguggcuuuuuguaagaagugggugaguaaagccaugcaugucuugcuuccucugaccgucuuuuuguuaaucugcccuuuaagcuucaugccagauguuuuuuccugaaguguaggguuaacaugaaaaaagaacccaagaaggcggaacaucaauauaacauuggauaucugaaugacuaugguuuccaauucaauugaaaagaauauaauuuuuacguguguuuguucaauacaguugacuuuuuaaaaagauauuuaaaguguuuagugguuuaauugagguagaaaauuuugagggucuguguucguuuauauaucccuagcaauagcaugucaugcuccauuggauuuuacaguugguaaaguuaggguacauauuacuuagagaguaagaucaaugauuuaucugugcaggaaguagaaauauuuuccuuuuuuacaggcuacuaaaacucgacuuagcaagguauucucugccauguuggcgauucauuccaacaaaccagguauggugaaaucuuugucaauuuuucuauguuuuauuuagacucaagccauuuuggauuuuauuucgauugaugaaucuaagagaaauuauuuugaggacuugagcuuaggcaguuggccucagcaguuuuucuuacugaauagcugccucauaguucaccccugccuacuauauacuaguuacuguccuagguguuguaucugcaggcaagaaggacuguauuucuuuuuuuuuugagacggagucucgcucugucgcccaggcuggagggcaguggugugaucuuggcucacugcaaccuccgccucccagguugaagcaauucuccugccuuagccuccugaguaggugggauuacaggugcccgccaccacgcccagcuaauuuuuguauuuuuaguagagacuggguuuuaccacguuggucaggcuggucucucgaaccccugaccucgugauccacccgccuuggccuuccaaagugcugggauuacaggcgugagccaccacucccggccagacuguauuucuuuuuagaugauggcaaaauaaacuuuugaauccuuugugggacauuuuauuuggaggcagucaaaucugaggaauuuuagaagcuuaaaggggaaaauaucaauauaaauuuuagaagagugcugguacagaguagacucauguuuuguaagagaaauauuucucuugugaauaauguauaaauggucuaguugauaguggaggggccucagcaccuauucucaggguauuaggcuuaaucagauaucuuauaccacacaagacucaaauagacuacauuuggcaccaguuuacucagaaauauagcaggauagccuuagguauguuccuucugcagaaugcucuuagcagaauggagguagccucugguuccuaaggugacuguucagguaugaggagaugagaucauaucaguagguaggggauccagucugguuuagaagccccauggaugggcauggcuucuacagauccuagaaaggucaugcucaauuuuaggagucacauguucaaggaagcccaaagcaauugcuugccaccauugcugacccuucuauuccaggugugguuaccaaucaggcgucauuuuuaacaaaagcaaucuugauaagauaggugaccuuuauuaaaugucuagggaaauagcuagaauguuaacucaggguuaauuucccauguagaaggacaaaggguuuuagagaaaauuaugaauuauaauuuauuuuauuuuuuauuuuuuugagacagagucuugccucuguugcccaggcuggagugcaguggugugauaucagcucacugcaaccucugucuccuggguucaagugauucucaugccucagccuucuaaguagcugggauuacagaugugcaccaccacgccuggcuaauuuuuguauuuuuaguagagaugggguuucgccauguuggccagacuggucucagaacucccagccucaaacgaucugugcaccucagccucccaaagugcugggauuacaggaguaagccacuguggcuugcccuauaauuucucuaaauauugagaaaagagcaaaaaauaauuuuauuugugguaagauaagcaguuuuuucuggacuuuuuuuuuugacauggagucuugcucugucgcccaggcugggguguagucgugugaucucagcucacugcaaccucugccucccagguuaaagugauccuucugccucagucuccguaauagcugagacuauaggagggugccaccacgccuggcuaauuuuuuguauuuuuuaguagaaacgaggauucaccauguuggccaggcuggucucaaacuccugacaucaagugaucugccugccucggccucccaaagugcuggaacuacaggugugagccacugugccuggccuuuuucuggcauuuuacuaccuuuaaaauuuguaugugggccaggcacgguggcuuaugccuauaaucccagcacuuugggaagccgaggcaggcagaucauuugagaucaggaguuugagaccagccugagcaacauggugaaaacccaucucuacaaaguuacaaaauuuaggugggcgugaugguguaugcauguggucccagcuacuugaggggcuaaggugggauucugguaggugaagacugcagugagcuguuguuugugccacugcagccugagcaacagagcaagacccugucucaaaaaaagaaaaaaauuguaugugacuuacaauaauguccuuagaucugaugaaaacaguaacagacacuuagguacucauccucuaaauugaacauuuguuaucauuuacucauuugcuucagaauacuguuucuaauuuuagauaacguagccaagcuuugcaguuagaaacugucuguccgaacugcuuccccuuuuguuaaagguuuuuuuaaaaaauuguuugagugggccgggcgcaguggcucaugccuguaauccuagcacuuugggaggccgaggcgggcggaucacgaggucaggagauugagaccauccuggcuaacauggugaaaccccgucucuacuaaaaauacaaaaaaaauuagccgggcaugguggcgggugccuguaguaccagcuacucgggagacugaagcaggagaauggcaugaaccugggaggcggagcuuguagugagccgagauugcgucacugcacuccagccugggcgacagagugagacugucucaaaaaaaaaaaaaaaaaaaaauugugcgaguauuaaaauuggaucauuugguucuuuucuugucugacuugauuaauuuauugaaaugaaaucugaugguuuuucacuuacagcuuuguggauuauggcagccaaaugggaaauggaagaucgauugucuucagaaagcgcaaggcaacuauuucuucgcgcacugcgcuuucauccagagugcccaaaacuuuauaaagaagugaguguguaugcacauaggaugagacagugauguuucaguuugguccucuggagacauauuuuuuuuuccuggauucaagcaauucuuacgccucagccucccgaguagcugggauuacaggugcccgccaccauaccuggcuauuuuuuuuguauuuuuaguagaggcgggguuuugccauguuggccaggcugguuucacuuuuuuuuuuugagacagucuugcucuguugcccaggcuggagugcaguggcacggucucggcucacugcaagcucugccuccuggguucacaccauucuccugccucagccuuccgaguagcugggacuacaggugccugccaccaugccuggcuaaauuuuuguauuuuuuauuagggaugggguuuuaccauguuagccaggaugaucucgauuuccugaccuggucauccgcccgccuccaccucccaaagugcugggauuacaggcgugagccacugcgcccggcccauguauucuuuauuaaauaaaaaaggcuucaauuuauggaggcuaggaauaaguguggagguguggguaaggacaaacaucuuuuuuauuuuuugagauggagucucguucuguuucccaggcuggaguguaguggcccggucuuggcucauugcaaccuuuaccuccuggguucaagcaauucuccugccucagccuccugaguaggugggaucccacguccggcuaauuuuuguauuuuuaguagagauggaguuucgcccuguugggcaggcuggucucaaacucccgaacucaggugaucugccugccucagccucugaaaguggugggauuacaggugugaaccaccaugcccggccagggaaaaacaucuuuuuguagguguugacacugcagcuucuaaguuaguugagagguuggaacccccgccuccuuccugugguuggaaggaauagggaacuagacucuaacauuuuuuuagcugggagccagauuuagccucuuuauacuuuuguuuuuauuuuuuuuucuuguucccuugguucuccaaagaagcccucuucuggcuucuuugccuugucuuccucuuuucuccauguucuuucugucuccuuuucuugagauagauaccugguaguacuuccuuucucucuucggggacuuacucccuuauggauggugccuuagaacauuugagggccaagcuuuagauaaaaucccaaauaagagaaagaauguauuggaagcugcacuguuuucugagucauuugucaggauaaaagagaaacugcuauuuaauucuuuuuuuuuuuuuuuuuuuuuuugagauggagucucacucuuguugcucaggcaggagugcaaugguguguucuuggcucacugcaaccuccacgcccgggguucaaacgauucuccugccucagcccccgaaguagcugggauuauaggugugcaccaccaugccccgcuaacuuuuguauuuuuaguagagaugggguuuuaccauguugggcaggcuggucucgaacuccugaccucaagugauccgcccgccuggccucccaaagugcugggauuacaggcaugagccaccgugcccagccugcuauuuaauucuuaaaugaaaguuaagccugggugugguggcucaugccuuuaaucccagcacuuugggaggcugaggcaggaggaucacuugaggucaguuguuucaggccaggcagcaacguagcaagauccugucucuacaaaaaauaaaaauaaaaaaauuaucugagugugauggaaugcaccucuaauccuagcuacucaggaagcugaggcaaggggaucacuugagugcaggaauucauggccgaaaugagcugucaucaccagugcacuccagcuugggugacagagcaagacccugucucaaaaaaauuuuaaaaagcaucuccaaagauuuucaguuuauuucucuucuguaguacuuuaggauggagcugaugcaugcugaaaaacugaggaaggagaaggaagaauuugaaaaagccaguauggaugugguaagguucuaauuauuuuauucucacuugcuaacgauguauaacauuuugagccugcuuaggaguaagagaaaauauuuggaauauauuuuucuuuuuuuuucuuuuuuuuugagacggagucucggucugucacacaggcuggagugcaguggcaccaucuuggcucacugcaaccucugccuccggguucaagcuuuaauguuuaauguuguuacauuuugaaacuuccagaugaguuaguguuacuuauaaauggacuuaguuaggaaaaugaagcuuuaugcuauaaaaauagauauuuggacuaauuaaugugguucucaaaauuguuacuuacagaauagccaaauacuauucuuuaacgcuguaugaucucauaaagugauauauuaauggauucaaggagcuugagaaagguugugaaaugugugguuuccuggccuucuuucuuucccuuuuuauauaauuuuuuauaugacagaauaauuaaaagauuuagaauguuagagcugagaagaaacuuugcuauugucuguuauugugguuuccagcuuagaacuuuuuucucagacggaguguugcuccuugucgcccaggcuggagugcacuggcacgaucuuggcucacugcaaccuccgccucccggguucaagugauucuccugccacagccuccgaaguagcugggauuacaggugcccgccaccacucccggcuaauuuuuguauuucuaguagagaugggguuuugccauguuggccaggcuggucaugaacuccugaucucaagugauccgccugccucggcuucccaaagugcuaggauuauaggcaugagucaccacgccaggccaggacuuuuuuauucaaauaaaauguuacagagaagcgcaaacaagacauguaaaaucugaccuguuuugguccaaauggagagugaggccuuaagccaugugaucuugccaccacucuuggagccucagagaacacaguuggaaggucagugaucuuguucaagcugcacacuuuacaagugagggaacuggcccggagagagagacaugauuuaccaguggucauauggcacagguagucuaggauuguuaauuuucguccuagugcuuuuccuccuuguacuaccuguuaaguuacguuugauauaacacucuuuaggagaauccugauuauucugaagaaauccuuaagggcgaguuggcauggaucaucuacaaaaauucuguaagcauaauuaaagguagguaucuuuugaacauuauuuuugguaggaaagugaaacauucuuuucuuaaugaagaucuuuagcuaguuuugaaauuuuccauuagaauguguauaaaacucuguaggaauaguguccuguuucuuucagaaaauacuuauuuuuccuaggcuauaauugaacauuucaguaacuuauuuauuuuuugagauggagucuugaucuguugcccaggcuggagugcauuggcgugaucucggcucaccacaaccucugcuuccuggguucaagugauucuccugccucagccucccaaguagcugggacuauaggugugugccacccugcccagcuaauuuuuguauuuuuaguagagacguaguuucacuauguuggcuaggcuggucucguacuccugaccuugugaccugcccgccuuggccucccaaaguguugggauuacaggcgugagccaccaugccuggcauaagucucuuuuuaaaauuuauauucuacucccauuuuuuucccuuaaauuuuaauagguuugggccggguaugguggcucaugccuguaaucccagcacuuugggaggccaaggcagguggaucaccugaggucaggaguuugcgaccagccuggcccacauggugaaaccccauuucuacuaaaaauacaaaaauuagcugggugugguggugggcgccuguaaucccagcuacuugggaggccgaggcaggagaauugcuugaacccgggagguggagguugcagugagcugagagcgccugggcaacagagcgagacuucaucucaaaaaaauaaaaaugucaauagguuuuuggggaacagguuuaguggugaugucugagauuuuggugcacccaucaacgagcaguguauacuguacccagcguguacucauuuauccuuccauguuuuuuuuuugagacagggucuuacucugucacccacgcaggagugcagugguacaauuauggcucacuguagccucgacuucaugggcucaggugauucucccauuucagccuccugaguagcugggcauggaccucuaugccuggcuaguuuuuguacuuguaguagagaugagguuucaccauguuguccgggcuagucuugaacuccugagcucaagugauccuccugccuuggccucccaaagugauggcauaacuggugugagccauugcaccaauccucaguaaguucucauggaguaauuaaaucguggggaguugaaaauuaguucuuuuuuuaugaauacuccaaagauuaacaauagcuuugcuugaguagggggacacuggggugaggggacuaugggaugacuuuucuucuauuuuauucuauuucucauuucaaaaaacaagaagauuaacuccaguacaugaaaagaaugcuacuuuuaaaguaaagugauucuuauuggcaauaaacuuccccuccccugcuuuuuaaauuuaggugcagaauuucacgugucacugcuuucgauugcacagcuauuugacuuugccaaagaucuacaaaaagagauuuaugaugaguaaguaaaguuaguagaaaggugaauauaucuauuucugaucuugagauuaaggguuugagguuggauauuuaguagaagagaaagaagauaccacacuaaaucccuggaauaaaagcuaauauuggccgggugcaguggcucacaccuguaaucccagcacuuugggagacugagguggguggaucaccagaggucaggaguuugagaccagcuugaccaacauggugaaaccccgucucuacuaaaaauacaaaauuaguugggcgugguagugcaugccuguaaucccagcuacuugggaggcugagccaggagacucgcuugaaccugggaggcggagguugcagugagccaagaucccacaauugcacuccagccugggugacaagcaaaacuccaucucaaaaaaaaaaaaaaauuaauaucauauuacguuaaaaaaaaauuuccuggcccaguguaguagcucacacuuugggaucccaguacuuugggaggccaaggcagguggaucccuugagcucagggguuugagaccacccuaggcaacacggugaaacccugucucuacaaaaaauaagcuaggugugguggugcaugccugugguccuaccuacucuggaggcugaggugggaagaucaccugagucugggagguugaggcuggagugaacugugauccugccacuccacuccugucugggucacagagugagaccgugucucagaaaaaaaguaucuuccugauugaguucuuugauucacuuacugggggaaauaguuuauucaauaaaaaaaaaaaaucuagccaggcacgguggcuuaagccuguaaucccggcacuuugggaggccgagaugcauggaucaccugaggucgagaguuugagaccagccugaccaacauggagaaaccacguuucuacuaaaaauacaaaauuagucgggcgugguggcgcauaccuguaaucccagcuacucgggaggcugaggcaggagaaucacuugaagccgggagguggagguugcagugagccaagauugugccauugcacuccagccugggaaacaagagcaaaauuccaucucaaaaaaaaaaaaaaaaucuaaagcuuauauaaaauucuaaauucuauuuuccuggcauuuauccauaaaaugagaguuauacucauauguuuauaguugagugcugguaauuuuauucuuuuuauuucuuuauuauauuuuuauuuauuuauguuuuuaauuauagagaugaggucucacuauguugcccagguugaucuugaauuccugagcucaagugauccuccugccuuagccucccaaagugcaaggauuacaggugugagccauuacaccuggcugguaauuuuauucuuuaaugucugauuauaugguuuaacaauuauuuguaagcuucggcaacauggcgagaccuguuuuuacaaaaaauaacaauaaaauuaguuggguauggugacaugugccuguagucccagcuacuugcggggcugaggugggaggaucccuugagccugugagguugaggcugccgugagcuguuauugcaucacugcaccccagccugggugacagagugagacccugucucaaaaaaagaaaaaaaaaauauuuuuagccuaccuuguggguacuuccguuuuuugguaacaccucuuccuuugacaggaggggaaauggaacuugaaucaaucuguuguuuggauaucuucaggguuuugagagaggaguagguugugcuuuuucucuauuauuuagaaaaugaagaacccugggcugggugugguggcuuacgccuguaaucucagcacuucgggaggccgaggugggcggaucacuugaggucaagagauugagaucauccuggccaacauggugaaaccccgucucuacuaaaaauagaaaaaucagcuuggugugauggcaugcaccuguaaucccagcuacucaggaggcugaggcaggagaaucgcuugaaccuggaagguggagguugcagugagcugagaucgucccacugcacuccauccuggugacagagaagacucugucuccaaaaaaaaaaaacagaugcaguggcucaugccuguaaucccagcacuugggaaggccgaggcgggcggaucaccugaggucaggaguuugagaccagucuggccaacauggugaaaccccgccucuacuaaaaauacaaaaauuagcuggguguggugucacaugccuguaaucccagguacuccggaggcugaggcaggagaaucgcuugaacccaggaggcggagguuauagugaguugagaucgugccacugcacuucagcuugggcaacaagagagaaacucugucuuaaaacacacacacaaacacacacacacacacaaacgaaaaugaagagcucagcuauaauaaaguucuuuaggcugggcacaggggcuguaaucccaacacuuugggauggacuauugcuugagcacccaggaguuggagaccauccugggcaacauggcaaaacucuguacaauaaaacuaccaaaauuagcuggguaugguggcaugcacuuguaguaccagcuacaugggaggcugaggugggaggaucaccugagccugggagguggaggcugcagugagccaugauggcaccacugcacuccagccugggugacagacccuaucucaaaaacaaaaaaaaguucuucaggucucuuggagucuuguguugucacagauaacugcugauuugacuuugagagcuaacuugaaaguuaacauuugugaaugauaccugaaauauucugaaacucaauaaaugugggacagcucuggccaggugcaguggcucacacuguaaucccacccagcacuuugggagcccaaggcaggaggaucacuugaggucaagaguuugagaccagucuggccaacauggugaaaacucaucucucccaaagaaauacaaaaauuagcugggcguggugguaugcgucuguaauuccagcuacuuggaaggcugaggcaggagaauugcuugaauccaggagauggggguugcagcgaacugagauugugccacugcacuccagccuugguggcaaugagauucuggcucaaaaaaaaaaaaaaaaaaagugaaaaagugggacaauucugauccauugacaaaauuucuacaguuagugaacauauucuggagagccuguugggaaauauauuuuuuuuuuuuuugagacagagucucgcucugucgcccaugcuggagugaugcgaucucgacucacugcaacuucugccuccuggguucaagcaauucuccugucucagccucucuaguagcugggacuacagucacaugccaucaugccuggcuuauuuuuguauuuuuaguagagaugggguuucaccauauuggucaggcuggucucgaacucccgaccucaggugauccacccaccucagacucccaaagugcuggucucccaguggcgugagccaccgggcccggccugggaaauaguuuuuaugguacugcaguuguuacagggauguccuguguagauuuuuuaagcacagguaacuguuucucugauauucugagucaguuucuuguugugggauugauaacaguaaauuguauuuuucagccuucaggcucuacacacagaugauccucucacuugggauuauguggcaaggcgagaauuagagauugagucacagacagaagagcagccuacaacgaaacaagccaaagcaguggaggucggccggaaggaggagaggugcugugcuguguaugaagaggcagugaagacucugccaacaggugaacuucaccaaaccauggugugauauagaaggaauaguaucccugauugugaaacuuaagcuccuguucccauugccaaaaucaauauuggggaugucucuguaacauaguuuacgaugagccuggccuuuuuuuuuuuuuuuuauugggaggcagagucuuguucugucacccuggcuggaguucaguggcucgauuucggcucacugcaaccuccaccucccggguucaagcaauucuccugccucagccucccaaauagcugggacuacgggugcccgccaccaugcccagcuaauuuuuuuguauuuuaguagagacgggguuucacuguguugcccagacuggucucgaacuccugagcucaggcgaucuacuugccuuggucucccaaagugcuaggguuacaggauuacaggcgugagccaccgugccuggguuuuuuuuguuuuuuguuuuuuuuugagacagagucucacucuguugcccaggcuggagugcaauggugugaucucggcucacugcagccuccaccucccagguucaagcgauuguccugccucauccucccgaguagcugggauuacaggcgugugccacgaugccuggcuaauuuuuguauuuuuaguacagacggaguuucaccauguuggccaggcuggucuugaacuccugaccucaggugguuugcucacuuuggccuccuaaagugcugggauuacacgcaugagccaccgcauuuggccgugccuggcuuucuaacuuggucuuggcuuucuaacuuuuaugaccuuccuccauaguagugguauuuauguucaucuauuuugggggaagcuuaggaaauaauuucuaagauucuucaauuauuauuucuuaauuaucuauguuuuuuuuugagacaggauccugcugugucacccaggcuggagugcaguggcgcaauuucagcucacuccaaccucugccuccuggguugaagcaauccucccgccucaacccccugaguagcugggucuacaggcgcaugccuccacgccaggccaauuuuaauguauuuuuuguagagauggaguuuugccauguugcccaggcuggucuugaacugcuagaaucaagugaucugcaugccucggccucccaacuugcuaggauuaccgacauccuuaauuaucuuuuugagacagagucucacgcuguugcccaggcuggaguacagugacacgaucucggguuacuacaaccucuuccucccagguuuaagcaauucuccugccucagccucccgaguagcugggauuacaggugcaugccaccaugccccauggauuuuuguauuuuuaguagagaugagguuucaccacguuggccaggcuggucuugaacuccugacuucaggugaucagccugccucagccucccaaagugaugggauuacagaugugaaccacugccucgcccuuaauuaucuuuggaaagugauuuaauuuuuauuuuguaauaauguagaauaaaggcagaggggauauauaaccuggauaaggcuuucaauuuuuauauuuaagcuguuacucaguuguuuucccccaauauuugagguguuugauuggcuguagucagcauaacacuucuuaaaaucaggcugauuuaaacucuucuucagaggagaguuuuccccuugaaguaaagguguaggaugacuguuuuuuuccuuaucuuuuaauaacuuugaugugaugaauguugaacuaagugaucugaucaacacaaucuuucugacuuuuccagaggccauguggaaguguuacaucaccuuuugcuuggaaagauuuacuaagaagucaaauaguggguuccuuagagggaaggugagguuguuacaugguuacagugguugacuagauagugacugccuucugaaagaacagaagcacagaucuuuuggugucuggcacaguuucugagaacuuuuauguuuagccacucucucucuccuugugggugacgugacauucuaaaggucugagucugguuugccgccagguuaggaggggcucucguguaacugggcucuguucggugcagcugcccauugcaucuauucauaagugaaaccaccaugcaggagcaagucagcuucuuugaauuuuaagaaaugcgcaaaacugcuuuuguucaugucagaggccagaggccccugcugggaucuuuguaaugaacugagggauuuuucuguuuucagagguuggaaagaaccaugacuguauucaggaaggcacaugaacugaagcuucugucagaaugccaauacaagcaguugguaagaacauagagaaaauauucugugccaguuacaaauaccuuauuccaguuguuuugugccagagucauguuuuaaauauauauagucuuaagaugaaggccacuugggaguucgguaugugaaguguguuuauauguguuucccaguauuuggccuaugcaaaaaaugaaaucuguacuagcaaagggaggaguauuauacagugaaaagcacuuagaacaagagucaugauuuggguuuauuuuguuuguccacccauuccuuuuuuuuuuuuuuuuuugagacggaguuucacucuguugcccaggcuggagcacaguggcgcgaucucagcucacugcauccucugccucuuggguucaagugauucuugugccuuagccucccaaguagcugggaucacaggugcaugccaccacgcccagcuaauuuuuguauuuuugguagagacgggauuucaccaucuuggcugggcuggucucuaacuucugaccucaagugaucccccugccucggccucccaaagugcugggacuaaggcaugagccaucaugccuggccaaauuuuuguauuuuuaguagggacagaguuucacuauguuggccaggcuggucuugagcuccugaccucaagcgaucugacugccucagccucccaaagugcugagauuacaggcaugauccacugcuccuggccgugccuggcuuucuaacuuggucuuucaggcgugagccacugugcccagccuagaugauucaucuucugucggaagaaacauaucaaaccguuuugucucuuagacuggaggcucuaugggugguagggaaugcaucugauuuguucacuauugaaucuagcacauauagugugcaauaaaaaugcuugcugaauguacugauuauauacugucauuuaauuuuucacaaauuuguacaauuggauuguuuuuagguuuuuucucuuuuucaaauaauguagguauaagcauuuugaacagguaaaauuuccuuucauucauguauuuuuuggaccauauuuguuaauguagaagucccaaauugaagcguugagcacuuucaugacucuugcuacaaacugucaaauugaauuucagaaaaauuugcuuuaguuuauguuauguccaacucuguuugaauauaccuguuuccuugacacuccacaaauacugauuuuguggauugauuuuuguuuauugauuuuuaaaauuuuuuuggagacagagucuugcucugucacccagccuggaguguaguggcaugaucuuggcccacugcaacuuccuccucccagguuuaagugauucucccaacucauccucccgaguagcugggauuacaggcgugcaccaacacaccuagcuaauuuuuguauuuuuaguagaaacaagguuucaccauguuggcuaagcuggucuugagcucuugaccucaggugaucugccugccuuggccucccaaagugcugggauuacaggcgugagccacugagcgcagccuauuuguuaauuuucauccucuguuuggugagcauguguucuggcauagugaacuguuuuguuuuuauuuauuuauuauuuuuuugagacggaguuucgcucuuguugcccaggcuggagugcaauggcaugaucuuggcucaccucaaccuccgccuccuggguucaagcaauucuccugacucagccucccgaguagccggaauuacaagcaugcaccaccacgccuggcuaauuuuguauuuuuaguagugacaggguuucuccauguuggucaggcuggucuugaacucccgaccuuaggugaucugccugccucagccucccaaagugcugggauuacaggcgugagccaccaugccuggcugugaacuguuuuauuaaaaacuuauaugcugggcaugguggcucacgccuguaaucccagcacuuugggaggccgagguggguggaucaucugaggucaggaguuuaagaccagccuggccaacauggugaaaccccauuucuacuaaaauacaaaaaauuaaccaggcguggcgaugggcgccugucgucccagcuacucgggaggcugagggaggagaauugcuugaacccaggaguuggagguugcagugagccgagaucauugcgccacuguacuccaggcuggguuacagagcaaaacucugucuccaaaaaaaagaaaaagaaaaacaaaaaaaccuaacuuacagucuaaauucuuuagguucucugguuuuuacgucuucccuguuuuuggauaacccucauggguaggagcagugaaaauaggagaaauucuaaauuguucacuucgugccuguuuaacagccauggaaaauuuguuuugauaccuauaaguuaucacauagcucauuucuuuucuuuuuuuuuuuuuuuuuugagauagaguugcucugucgccgagguuggagugcaguggugugaucucagcucacugcaaucuccaccuccuggauucaagcgauucuucugccucagccuuccgaguagcugggauuacagaugcauaccaccacacccagcuaauuuuuguguuuuuaguagagacgggguuucaccauguuggccgggauggucuugaucuccugagcucgugaugugcccgccugggccucccaaagugcugggguuacaggugugagccaccacaccuggccucuuuuuuauuuuaaauuguaguggaaagguuggugaaauucuugccucaaaugaggcauagguuuacauuuacauagauuguuuggguuucaguaauuaauuuuccagucauccuucaucuugucuagaguguuucguugcuguguuauaacuuccugagggaagcucuggaaguggcaguagcuggaacugaauuguuuagagacucugggacaauguggcagcugaagcugcaggugcugaucgagucaaagagcccugacauagccaugcuuuuugaagaagccuuugugcaccugaaaccccaggucagugagcuggaucuuuuguauucauuauauuugggaaaccuuuuaagacuagccaaggcucauuuggaauguacuugucuauugagagccaacucuagaguggcauuugcuauucaguggugaugguucauagguuaagaguagaagaauuugcuucuauuuaauauccuuuauuugaaaguuaaccaaauuaaauaaaacuuccuauucuauuuagauaucuuauaaaguuagaaauaccaguagaauauuaaugucacuugcugaauauaagcccaaccuuuuuuuuuuuuuuuuuuaagauggagucucgcucuguuguccaggcuggagugcaguggcgugaucucagcucacugcaaucucugccucccggguucaggcaauucuccugccucagccucccgaguagcugggacuacaggcgcaugccaucacaccugacuaauauuuucuauuuuaguagagacaggauaucuccauguuggccaggcuggucuggaacuccuagccucaagugaucugcccgccuuggccucccaaagugcugagauuacaggcgugagccacgguguauggccagauucacuuugcagugaauuuuuuauauuaguagguaaaacguauuccagaagauaaaguaggaaaaaaacuacugcucauuuggugguuuuuccuuuuuuuugagaugaagucuuguucuguugcccaggcuggagugcaguggugcaaacuuggcucacugcaaccuccaccucccagguucaagcgauucuccugucucagccucccaaguagcugggauaagaagugcccaccaccaugcccagcuaauuuuuguauuuuuaguagagacaggguuuugccauguuggccaggcuggucuugaacuccuggccucaagugauccgccugccuccgucuuuaaagugcugggauugcaaaugugcgccaccaugccucgcuuuugcugcucauuuguacguaccucugggacaugaaugaagaucagauaguucagccuagauuaauuaguucuuguguugugggucuuagacagcagagacaugaccuggguagcugugggucuaacugugugggcuguuaauuacuuacuuaacuaaaagaugauugaugauaacuacaugaaauauuucccaauagaaaggaacuaaaauucacagaagaguguugcucugagugacuuggucagaaggcuggcuguguucuggagugccauuccugcugggcaaugagaauucugucacaaugaggacuguuugggaaugaaucccuauuuuacauguugauuaucuuaggaggaaccugccuuuuuaacuaguuuucagagcauaggacuaaacugucauuuuauagcauaaaaaaauugauacauaauauuuuacauauuuauaggguacaugcgauguuuuguuauaugcuguucucuaacuaacauuuuuuaaacugggaguagguuugucugccauuguggauuuccugggcagaguggagugaaggugccaaaagccaagaagacacugaggcagucuuuaagguauaggcuccguguuccaagucuugugguguggggaauggcagaagguucccugguuggucagcucuaguguugcaggugcgccuaaagcacuauggaguggccucaggugguucugggaaaaucuguuuugguaucuauaaguuuucucacauagcuucuuucuuuuuucuuuuaaauuguagaaagcucucuuagcugucauaggugccgacucaguaacccugaagaauaaguaccuggauugggcuuaucgaagugguggcuacaaaaaggccagagcuguguuuaaaagguacucacagacguucauaguuguuacuagucccucuaccccaugcucagccgcucauacccagauuauuugaaucacagauagcaucugagggaguaaucugauacacuuuuucuuuuuuuuuaagauggagucuugcucuguugcccaggcuggagugcaguggcacaaucucugcucacugcaaucuccgccuccugcguucaagugauucuccugccucggcuucccgaguagcuaggauuacaggcaccugccaccacgccuggcuaauuuuuaaauuuuagauuuuaaagacaagguuucaccauguuggccaggcuggucucaaacuccuaaccucaggugaucugcccaccucagccucccaaagugcagggauuacaggcaugaggcaccacaccugacccaauacacuguuucauuuuccuuuuuuuuuguuuuuuuuuuguuuuuuugagacagugauucucccgccuuagccuccugaauagcugggauuacagaugugugacaccacgcccggcuaauuuuguaauuuaguagagacgguuucaucauguuggccaggcuggucucgaacugcugaucucaagugauuugcuugucuuggccucucaaagugcugggauuacaggcaugagccagugcauuuggccuccagugaacuuuuucaaaaaguaauguuuccuuuucuuuuuugagacagguucucgcucugucaccuagguuagaguguaguggcacaaucaugguucaccgaagccuugaccuucugggcucaagcaguccgcccaccucagccucccaaaugucugggucuacaggcauguaccaccauguccagcuaacuuaaaacauuuuuuuuuuuugguagagacugagucucacaacauuguucagccuggucucaaacuccugggcucaagcaguccuccugccucagccucccaaagugcuaggauuauaaguguaagccaccaugccuggccuucuuuuucuuuuuuuugaacaauaaaagcaguucauuguggugggggaaaacauaaccaugauaauuuauuacaucaucgaaggaaaaauuacuguuaacacauaauuuuaaaauuuguuuuuauguaguugagauuauaguauaacuguaauuuuauuuaugauuuaaaaaaaauuucuuuuuuuuuuugagauggagucucacuguguugcccaggcuggagugcagugguacagucucggcucacugcaacuucugccucccggguucaagcgauucuccugccucagccuccugaguagcugggauuacaggcaugugccacgacgcccggcuaauuuuuuauauuuuuaguagauaaggguuuuugccauguuggcuaggcuggucucgaacuccugaccucuggugaccugcccgccucggccucccuaaguguugggauuacaggugugagccacugugcccggccuaaauauuuuuuuuuucuuugagacagagucuugcucuguugcccaggcugaguguaauggcgccaucuuggcucacugcaaacucugccuuccugguucaagugauucuugugcguuagcuucccaaguagcugggacuacaggugugugccaccacacccagguaauuuuuuauuuuuaguagagaugggguuucacuguguugcccaggcuggucuugaacuccugggcccaagcaaucugcccagcucagccucccaaaaugcugggauuacaggcaugagcuaccaugccuggcgaugccccgcuaauucuuaaauuuuuuugcagagucagggucucgccuuguugcuuaaacugaucuugaccuuauggcuuccagugaucuuccugccuuggccucccaaagggcugggauuguagguaugaggcacugugcccagccaaaaauucuuuauaaacaucauuuauuaaacauagcuauaugagcugggcacggugguucaaggccucuaaucucaggauuuugggagacugagacaagaggauugcuugaucccaagcauuugagacgagcgugggcaacacaacgagacuucauuucuaugaaaaguuaaaaggccgggugcgguggcucaugccuguaauccuagcacuuuaggaggccgaggcgggcggaucacaaggucaggaguucgagaccauccuggcuaacacgaugaaaccccgucucuacuaaaaaaaauacaaaaaauuagccgggcgugguggcaggcgccuguauucccagcuacuugggaggcuaaggcaggagcauggcgugaaccugggaggcggagcuuucagugagcugagaucgcgccacugcauuccagccugggcgacagagcaagacuccaucucaaaaaaaaaaaaaaaaaaaacuuaaaaaguugggugucauggcaugugccugugauuuuagcuacuugggaagcugaagucagaggaucacuugaguccaggugguugaggcuguagugagccguguuugugcuaguacacuccagccuuggugacagagugagacccugucucaaaacaaaaacauccaggugcgguggcucaugccuguaaucccagcacuuugggaggucgaggcagacggaucacgaggucaggagaucgagaccauccuggcuaauauggugaaacccugucucuacuaaaaauacaaaaaaaauuagucagaugugguggcgggcgccuguagucccagcuaccugggaggcugaggcaggagaauggcaugaacccgggaggcggagcuugcagugagcugagauugcgccacugcacuccagccugggcgacagaucaagacuccgucucaaaaaaaaaaaccaaaaaaaaaaaccaaaacaacaacaacaacaaaaacaaaaaacccaaaacaaaacaaacauaauagcuguauugaaggcagccagcauacaugugaaaaaauguucaagaugacuaacuuuuagagaaaugcaaaucaaaaccacaaugagauaccaucucacuagucagaauggcuauuaaaaagucauaaaauuauagauauuggcaaggcugcaggguaaaccuuauauacuguuggugggaauguaaauuaguucagccacuguggaaaucagcuggagauuucuggaagaacuuaaaacagaucugccauuuaucucagcaaucccauuacuagauauauacccaaaggaaaacaaauaauucuaccaaaaagacauguacucguauguucaucacagcacuauucacaauaguaaggacauggaaucaaccuaggugcuuaucaacaguugauuggaaaaaaaacaaugugguaaauauacucuauggaauacuaugcagccauaaagaacaacaaaaucauguucuuggcaguagcguggauacagcuggaggucauuguccucagcaaguuaucacaggaacagaaaaccaaauaccacauguucucacuugcaauuauagcuaaacauuggguacacguggauauaaagacagaaauaguagacacuacaggauagggggaaggaggguaggaggaauggaggaaagggcugaaaagcuaccuaucgauuacugugcuccuuacccagguaacagggucagucuaucccaaaccucagugucacgcaauauacacacauaacaaaccugcacauguacuccccugaaucuaaaauaaaaguugaaauuaaaacaauacauggcugaugggccaggcacuguggcucacaccuguaaucccagugcuuuaggaggcugaggugggagaauugcuugaguccaggaguuugaggcugcagugagcuaugauugugccaccacacuccagccugggcaacagagggagagccugucucaaaaaauaaaaaaaaaaauaaagaggccaggcgugguggcucaugccauuccuguaaucccagaacucugggaagccaaggcugaggugggaggauugcuugggcccaggaguugaagaccagccugagcaacauagcgagacccuuucucuacuaaaaaugaaaagcaauuagccagaugcaguuugcaccuauggucucagcuauucuggaggcugagguggaaguauugcuugagcccaggaauucuaggcugcagugagucaugaucucagcacuguacuccagccugggugacagagggagacuuugucuaaaaggaaaaaauaaaagagaaagcuguaugauauaccacucuguggaugcaguauaacuuuauguuuuuguuuuuugagauggagucucacucugucacccagguuggagugcaguggcuugaucuuggcucccugcagccuccgccucccagguucaagugauucuccugccugagccucccaaguagaugggauuauaggugcccaccaccacacccagccaauuuuuauauuuuuaguagaggcaggguuucaccacguuggucaggcuggucuugaacugaccucaggugauccaccugccuuggccucccaaagugcugggauuacaggugugagccaccaugcccggccguggaugcaguauaacuuuuuuggccacaguaauacuguuuugaugaauauuucugcacaaauauuuguccauauuagaaaucauuuccuuagaauauauuccuagaaauggaauuacugauuucccaaaagacuuugacauguaguugagggaacuugaaaacucuacaauugauaaagaagaguacaguaagaaaauuaaaccaggcaugguggugcaugccuguaauccuagcacuuuggaaggcugaggcgggaggauugcuugagcccgggaguuugagacuagccugagaaaccuagugagaccucuucucuacaaaaaauuucaaaaauaagcugugugugguuauguaugccuguagucacaguuacucuacaggcuaaggcaggaggauugcuugagccugggaauucagggcugcagugagcuaugauugcaauacugcacuccagccugggugacaaagugagacccugucucaaaaaaaaaaaaaaaaaaaaaaccaaaaaacuaagaacuggguaugaagagaaagucauuaguggucauagaaucgugagaaugacuggccaucaggucaaguccuugcauugauuugaagucaagucuuuauuaaaccauguguuguggaggcacuggucucgguauuuacaguuaugagauguaagaggcuuuuugucauuguugaagauaacguuuucuccuuccuuuuuaguuuacaggagagccgaccauuuucaguugacuuuuucaggaaaaugauucaguuugaaaaggagcaaguaaguguucuguuucagcauuucuugucugggaaaauggauuagugguuacuaaucuaucagacuguuuuuuguuuuuuuguuuuuuuugaggcagagucucgcucuguugccaggcuggagugcaguggcgugaucuuggcucacugcaaccuccaucucccagguucaagugauucuccugccucagccccccggaguagcugggacuauaggcacacgccaccaugcccagccaauuuuuguauuuuuaguagagaugggguuuuaccauguuggccaggauggucucuaucuguugaccucgugaugugcccaccucagacucccaaaguguugggauuacaggcgugagccaccgugccuggcccgggaguguuuuguuauguaaaaagcucucauuauaauacaguauaaauuucugaucccuuggucuaaucccuuuuccauagagcugguuuaagaacgguaaucaagcaaagagaaaguauauguuuggggaauagaaaacuuacauguuacuuuuuuuuuuuuuuuugagauagagucuuacucuguugcccaggcuggagugcaguggugugaucucggcucacugcaaacucugcauccuggguucaagugcuucuccugccacacccucccgaguagcugggauuacaggcacgggcugccacgcccugcuaauuucuguauuuucaauagagacgggguuuugccauguuggccagccuggucucaaacuccugacuucaggugauccgccccccucagccucccaaagugcugggauuacaggugugagccagcacgccuggcaggccaaguaucuguucuuauucuacaguauagaacaguuuuauaguauaggagauagucuagccuaauauguaauagccaggcuuuggauuuauaacaugauaguuaggugccuugagcaagucacuuaauucuaagcuucccauccucaucuguaaaggaggucauuauaccuguuucagggguaugagaguuguaaggccaaaugggauacuggauagaaaggacguugcauaaugccgugcacauaugagccauuaaacaggugugauucuguuuuucaugcaugucuaaaauaugagguuaaauugacuuuuuuuuuuuuuuuuuuuuuuuuuugagacaagagucuugcugucuguugcccaggcuggagugcaguggcgcgaucuugguuuacugcaaccucugccuuccagguucaagcgauucuccugccucagccucccgaguagcugggauuacaggccccugccaccgcaccuggcuaauuuuuuuuuuuuuuuuuuagacggagucucucucugucgcccaggcuggacucuuggcucacugcaaccucugcuucccagguucaagcaauucucuugccucagccuccugaguagcuaggauuacaggcaugcaccaccaugccuggcuaauuuuuguauuuuuaguagggacaggguuucaccauguugaccaggcuggucuugaacuccugaccuugugauccaccugccuugccucagccucccaaagugcugggauuacaggugugagccaccgcgccuggcccuaauuuuuguauuuuuuguagagacugguuucaccacguuggccaggcuggucucaacuccugaccuugugaucugccugccuuggccucccaaaguacugggauuacaggcaugagccacugcacccggcaagaauacuuuuuuuuuuuuuuuuuuuugagacagagucucgcucugucgcccaggcuggaguguaguggcgcgaucucggcucacugcaagcuccaccuccuagguucacgccguucuccugccucagccuccugaguagcugggacuacaggcacccgccaccacgccuggcuaauuuuuuguauuuucaguagagacgggguuucacuguuguagccaggauggucucgaucuccugaccgugugagccaccgugcccggcaagaauacauuuuuaaaaauagguggagaaugagcaguuuuugguuguaaaguuaguuacagcuauucugcuagguacauaauucaucagcauuuuaaucuaauacuuauaguugugcuaagagauauuaaagcuuguuuuauaggugaggaaauguuuaaggucaaaggguucaaaaacuugcugaaggucauauaacuaguauuuauuuuaagguggauauaacaaauaaguaccagagcccagauauucaaaaggaagaaauccuuacucaaagcgaauagaaccuucgcuguuucuuuauuuaauucccacucauuccucaagacuuucaaauacuguuuucugugaagcugcccaugucccccacuuuuuucuaauagcacuuuucuccaugcuacuacagcaaagugcuuuuauguuucacauauguacuucacucuguugaguggcuuugauuuuuuuccuagaaaaguugagagccaaguuguguucauguuaaacucuucccuucaaauaccugacagacaguagcugcuuaacaauaugguuggaaugaauuuguuauguuauaaaucaggcuuuugagacaagauugucuaucuuugucaggaauccugcaauauggcgaacauaagagaauauuaugagagagcuuugagagaguuuggauccgcagauucugguaaguaaacccuuaauuugugaccaauuaguaugguuagaacaguguuucuuggcugaguacaguggcucaugccuguaaucccagcacuuugggaggccaaggcaggcggaucaccugaggucaggaguucgagaccagccuggccaauauggugaaaccccgucucuacuaaaauaaaaauuagcuggacaugguggugcgcaccuguaaucccugccugggaggcugaggcaggagaaucgcuugagccugggagacggagguugcagugagcugagauuauaccauugcacuccagccugggcaacaacagugaaacuccgucucaaaaacaaacaaacaaacaaacaaaacuguuucuuaguuuuuugauuugcaucauaacccucuuuuaaaauaaaacuuguuuccuuccucugccuccucacuugcuuuguguauacuaucauuucaggaucauaaguucagggguccaugggucgucuguuaagaacccuagauuucucaggagccugagaccagccugggcaacauauuuagauccccaucucuacaaacaauaaaaaaaaaaaaguaacuggguaugguggugcaugcuuguggucccagcuacacagcaggcugaggugcgaggauuguuugggccccaggauguugaggcugcaaugacugugaugccaccauuguacuccagccugggcaauacaaugagauccugucucaaaaacaaaaaccaaaaacacccccucuggauuagagaaagauuugcaugguuuuguuuucuuaaaaaaaauguauuuagaguuacaugaaagggguaaacgugagaugcuaauuggcgucuguuguugacuaucuccacauugcccucauuuguaggacuuguacaacauacuucuggguauagguaugucauguaaaaucuguggacuuugugaacucauaaacauugauuuguuuauuuuuauuuuguuuugagacagagucucacucugucacccaggcuggagugcaguggcgcaaucuugccucacugcaaucucugccucccagauucaagcgauucucgugccucagccucccaaguagcugggaguacaggcacgcgugccaccaugcucggcuaauuuuuguauuuucagucgagauggaguuucgccaugcuggcuaggcuggucuugaacucuugaccucaggugauccgcccgccuuggccucccaaagugccgggauuacaggugugaaccacugugccuagccaaaaaguuuaguauuuuugaguucauugaauaaaauagacuuuuaugauugaugugaagguuuucuacugggaaaaaaaacaaaaaacaaaaaaacaaaacugaugaggcacaguggcucacgccuguaaucccagcacuuuggaaggccaagguagaaggauugcuugagcccaggaguucaagacuagccugggcaauauagugaaacccuguuucuacaaaaaauaaaaaaauuagccuaauaugguggugugccuguguucccagcugcccuggaggcugaggcaggagggucacuugaacucaggagguugagacuguaguaagccauguucccgcuacuacacucuagccggggcaacacagugagacccugucucaaaaaagaaaaaaacacacaaaaacaaaccaaaaccugccacuauacuuuaaagaagcuaagagagguauuguuaaacaaagcguccuagggaaguaacaaugagaaguuaaguuucuuagaaaucuugaguugaauugauauuuaauaagguuaccuaauaacacucugucaguuaucuaauuguauguuuuuuuuuuaaaagaucuuuggauggauuauaugaaagaagaauugaaccacccccuugguagaccugagaacuguggacagaucuacuggcgagcgaugaaaauguugcagggagagucagcagaggcauuuguagcuaaacaugcuaugcaucagacuggccauuuaugaagaugaagaauacagucagcuuugugaaauaguauugcaagcaagccccgugggcaaauuuguauugaguccaucuguaauuugcucagugauggcagacaagauggcugucugguuuugagacacacuuuaauuuuauguuaacuuguuaaaucuuuuuaaaaauuaaaaaauuuuuaugauugaga

SEQ ID NO: 192278 - RNA, 42077 nt, Homo sapiens
ggcggcggggcugggcggugcuuccgccugcgcgaggccgcgccgggccgcuuggaggcgcccggugcagucgggaacccgcgcuagguuucgccggccgcgcggccagaugaggggggcgauggagcuggagccugagcugcuguugcaggaggcccgcgagaacguggaggcagcgcagagcuaccggcgggagcugggucaccggcuugaggggcugcgugaggcgcggaggcaggucggagggccacacccacaggggcgcugugggcccggggguggcgcggaugccgggcgaaggcugggagggcuuugaggggugggacuguccgaaaacucuggaguagggaagaggcauucauuugaaaggagaccuaauggagucugggaacggggaaggugggaguuggggaggucguaaggggaaguuuuggggguggagggagggugugaggagcguucacuaaacuguggggcagcgaugggaguagcgguggccuccgaaguuugggagagugagggaccagagcagaauccgagggggucaugcggguagugaugagucgggggaggaggagacugguaaaaaaccugcgguggguaggcggggaggcauugauuuuagagagccugaggaagaggugggacagugaccugggagagcugaaaguggagacaaaauggauauuggaaggggaggacuaaggggcgagagugagggagagguagggauugagaagcaguagcauuugacaauaaaugcgguuaaugccugaauaauaugucauacgaucuugaaugcuuuuuaaaaaaucauuuagaguaauccuguucuagaagguuuaaaauuuaaggugaaggugaagcuauguuggaagagcagaaggaaaaugauuuccuuuuccuugagagagggaauacaaagguauagagaaauggaaaaauagauuuuaagagaggagugcugaaaggaaaagcuaaauauaauuucaaguggugcaguuaucuguuucacagggcaagaguuaucaaagauacaggaaagccauaugguuucucuauacccucgaauauauauagaaaaagauauaacccgcugccaauuggcgauaggacggauaaucuucagaguacuauuaacgcaacugcuuaauaagugcuuuuugagugagugggauuccaucugaauuucucugggucauacuugauauuaaucuaguuggucgucuuagcacuuccuugcugcauauaaccugaaaaugguagaaaagugcugugcuaacagugucuuuggauauucucaucauuaacgacucaacauguuuuggguuuuauauauauauauaaaacauauacaaacauauauaaguauguauauauauaaucuguuuuuuuugagacggagucuggcugugucgcucaggguggagugcaguggcacuaucucggcucacugcaacaaccuccgccucccggguucaagcgauucuccugccucagccuccugaguagcugggauuacaagucugcgccaccacacccggcuaauuuuuguauuuuuaguagagaggagguuucaccagguuggccaggaugaucuugaacuccugaccucgugauccaccugccucagccucccaaagugcugggauacagacgugagccaccgcgcccggccggguuuuauauauuuaaaaauauuuguaaagccaguguaggccagacaucauuugcauuuuaguggcgaaaccggaagcagaaucuagauaugauuaugcugauuuggugaauacuuuucaaggccuuucaaugcacucaucucuauuucucuuugaaaauaucugcauuauuccuucugcuauuuugaaauagggacucuagauguaagacauuguaugaaaagaaagauauuaaaauaccaucuaacauuucagucaguuaagauguauucuauaugaccaugauuauuguuuuuguauuagcaauuaagaaucagaguugacacuaaaugagugaguuuagcaccugggaguaauuaauuucucuugauauuggaugcauuaaaaaaaaucgugauuacacccuagaugguucaguauucaauuuucaaaccuguauuuuuucaauuuuauauccaacaauuuaaauacaggacaugcuuuucugugguuuaguuuauuaugagcuuuguuuuguuuuguuuuugaggcccauugucuugggcuucagacagaaaacacuaaaugaacaucgaucacaauuagguuccugaugacauugccuucugacuagacugaguaauaauguaguucucuuuugugagugugagucucuuuugggaauguguuuugugccaguggcaguuacaacagcaucucucgaagcuaacucuaguggauugugcauguuuggguuuguggcauaaguccucugucaacuugcauuuuaaggaaggucuaugguacaaaaauauuaucaaaguaagcagcugcuuuuguuuggugguuuggauauuuuuaggguuccagucauuuucagaauaacuguaaaauauauggcacuuuagucaaggauuuugcaugggagaagcaugagaagagcagagaggaagggaugccaccugucgucuguauuuuuuacuugcugauuuuauaucuuuuuggcagaugauuucuuuucuuuuuuuuuuuuuuuuuuuggcgggggugcggacaggguuuuguuacguuucccaggcuggucuccaacuccugggcucaaaagauccucccaccucugccuuccggugauggaauuacaggugugagccacugugcugccuggcaugugacuuuuuuuauugagauauaauucacacaccguaaaagucaugccuuaaaguuuacaauucagugguuuuuaguauauucauagaguuguccaaccaucaccagugucuaauucaaguauauauucaucacccccaaaagaacuccuuagcugucacucccauacccccuggcaaccacaaaacuacuuugucucuauggauuugccuauucuggucauuucauauaaaugaacucauacaguauguagccccuugugacugacuucuuugacuuagaauaauguuucaagguucauugaugugguagcauguaacaguacuucaaaccuuuuuauggcugaauaauuguuauguggauauaccacauuuuauuuauccauucaucaauuaauggacauuuggauuauuuccacuuuugacuauuaugaauaaugcuucuguaaagaauuuguagacaacuuuuuguguggacauguuuucaguuguuuuagaauauagcuaggaauugguggaucacaugguaacuuuuuguuuaaccuuuucagaaacucuuggcauacuuuuuuuccuuuuuucuuuuuuuuuuuuuuugagaaaggaccucacucugucacccaggcuggagugcaguggcacaaucucagcucacugcaagcucugccucucaggcucaagugauccucccaucucagugugccgaguagcugggacuacaggcacgugccaucaccccuggcuaauuuuuuguauuuuugguagagaugggguuuugccauguuguccagccuccugggcucagaugaacacccacuuuggccucccaaaguguuaggauuacaggcuugagccaccgcacccagccucuuuuuuuuuuuugagccagagucuugcucugucacccaagcuggagugcaguggcaugaucagaacucacugcagccucgacuuccuaggcucaagccauccuccugucucagauccccaaguagcuggggcuauagguacacaccaccacaccugccuaauuuuguuuaauuuuuuuuaguagagaugaugucuuccuguguuucccagacaguuucuuccuuuuuuuuuuuuuuuuuuuuugagagagucucgcucuuuugcccaggcuggagugaaguggcacaaucuuggcucauugcaaccuucagcucacugcaaccuuaggcucacugcaaccuccgccucuuggguucaagagauucuccugccucagccucccgaauagccaggauuacaggcgucugccaccaugcccaucuacuuuuuguauuuuuacuagagacaggguuucaccauguuggccaggcuggccucgaaguccucaccucaggugauccugcccaccucagccucccaaaaugcugggauuaccaccgugccugggugagccaccgugcccagcugccaggccgauuucuaacuccugagcucaagcaauccucuugccucggccucccaaaguacugguauuacaggugugagccacugcaucuggccuaccuuuugucuuugcuuuaguuucuuauccuuuaaacucuagcaugaaauuugucucguauugagaaaucauguuguaugaacauuuagaaggaagaagaauaaaaauguuuuuaaguuauucugucaaaacugccaacauguagcaguuucuccucuugugguuaaguuugggcucuacccucuguuuucagagaaaaggaaguucuguguaggaaugcaaggauugucuguuaacucuuaauguuugaauaaguuaaaggcuagaaagcuguucauugucuucaggaaaucagauaauguuuacagccaacuuggccuagcugauguugaaaucauuaagaauaguucucuauagcucacuggaauccuugguacuaagauguaaauaccaaagaaauuaacucccacuguccuuaaauauucauuuguucauucacucaauaaauauuuauugggugccuacuguagggcugagaaacuucuagguccuagauucuguguucaaggaaauagaucacugcccucauggauuuaugcuuuccucuuuccuuugguggcugauacuuagguuacuaccccuaaaaacaaaacaaguaagaaaaauauaaguucuauuuguguauucauuuuuauauuucacuucuauuauaucuuucaucacuuguccuauuucuacagcauuggccuuucuguuuguuauaaguagagauccagccuggccaauauggugaaaccccgucucuacuaaaaaaauacaaauuagccaggugugguagcgugcaccuguagucccagcuacucaggaggcugagccaggagaauugcuugagccgggcaggcggagguugcagugagccaagaucacaccacugcacuccagccugggcgacagagcgagacuccaucucaaaaacaaaaacguaaguagagauaacugaucaaaaugucacguagugaugucagcuggccacucaggccucacagaguggcaccaccuugaugacaaugccaaagucagggccuggucuuuaaucuuuguaaguccaaaaacuucaucuugguacauuaucaaaggggaauuaguugagguacuggaggugucuacagugagaaaugccaguauuuuagucuguguguuguaguucacucuauaaaaugacuauguuggcuuucauguaccuuuugguauucugauucaguauuucucaggacacugacaaaagcaagucucugcuccuucaagagcaaaugguaagauccugguaccuaauuaagauacuaguugguggcugggcucaguggcucacgccuguaaucccagcacuuugggaggccgaggcggguggaucacaugagaucaggaguuugagaccagccuucaacauggcaaaacucugucucuacuaaaaauguaaaaaaaauuagccaggugugguggaaugcaccuguaauuccagcuacucuggaggcugaggcaggagaauugcuuauaccugggagauggagguugcagugagccaagauggcaccacugcacuccagccucagcaacagaagaagacugucucaaaaaaaaaaaaacacucaaaaguuauuucaaaaaaccaagacaggaagucucaguagcuuagcaaagaaaagaaagcuguuggccaggcgugguggcucacaccuguaaucccagcauuuugggaggcugaggcgggcggaucaccugaggucaggaguuugagacaagccugacccauacgaugaaaaccuaucuuuacuaaaaauacaaaaauuagccgggugugguggugggcgccuguaaucuuagcuacucgggaggcugaggcaagagaauugcuugaacccaggagacggagguugcggugagccgagaucaugccacugcacuccagccugggcaacaggagugaaacugucucaaaaaaaaaaaaaaaaggaaaagaaaagaaagccauuauugcuccuuuuaucucccacuuccccuucuguuacccauuuugaaaacacuacaaaaaucuguguauaauuuguuacaguaguaguauuuaaagugucccuauuauaguauucuaagaaaagguuaaauccagauacagggaaaaccaagaacagaugaaauaauuuuuuuuuuuuaaugaaguuucgcucuugucgcccaggcuggagugcaauggcucaaucuuggcucacugcaaccuccaccucccagguucaagcaauucucuugccucagccuccugaguacuugggauuacaggugcccgccaccacgcccagcuaauuuuuguauuuuuaguagagacgggguuucaccauggugaaggcuggucucaaacuccugaccucaggugauccgcgcaucucggccucccaaagugcugggauuacaggcaugagccaccacacucagcccagaugaaauaguuuuaaaauaaccuacuacuuacagacaacugcaguuaacuuuuuuuuuuuuuuuuuuuuuuugggauggagucucacucugucgccaugcuggagugcaguggcgccaucucggcucauugcaaccucugccuccuggguucaagccauucuccugccucagccuccugaguagcugggacuacaggcgccugccaccacacccagcuaauuuuuguauuuuuaguagagaugggguuucaccacguuggccaggauggucuccaucuguugaccucaugauccaccuuccucggccucccaaagugcugggauuacaggcuugagccacccugccuggccugcaguuaacauuuugauguaucuuucuauacauauuauucugcaaaguugagagacuacuguauaugcaacuuuguaucaauuuuuaauuuuuauuaacauuauaagcauuuuguuagcauuauaagaauuuugguaacaucauaagcauuuacaagaauauuuuucccaugcaaagcuuuuuuuuuugaagacggucucacuuugucacccagacuggagugcaguggcaccaccuugguucacugcaaccuccaccucccggguucaagcaauucuccugccucagccuccugaguagcugggauuauaggcgcaugccaccacacccggcucauuuuuuguauuuuuaguagaaggagguuucaccauauugcccaugcuggucuugaacuccugagcucaggcuguccacccaccucggccucaaaaagugcuaggauuacaagcgugagccacugugccugucccacagccucauuuuuaauacagagguggagucuauuguagauauuuaaaggaacauuuguuggugguagguugcaauguauugauucugguaccccaaaauacuggaagcaaaacuaauugcaaauaagggggguaaaaauaaaagccacacauauacagucaaaacaacagggauauauucucagaaaugugucauugggcgauuuugucauuguacaaaccuagaugguaucaucugcuacacaccuaggcuauaugguauauucuauugcuccuaggguacaagucuguacagcauguuacuauacugaauacuguagauaguuguaacauaacuguaagugugcaucuaacauagaaaaggugcaguaggcaugcuggcucacacuuguagucccagcacuuugagaggccaagacgggaagaucucgagcccagaaguuugagaccagucugggcaauauagggagacccccaucuccacaaagaaauuaaaaauuagccaggugugguggugcaugccuguggucccagcuacucgggaggcaaaggugagaggauuuauugagcccaggaggcugagggugcaguaagccaugaucacaccacuguacuccagccucgacaacagaacuagacccugucuaaaaaaaaaaaaaaaaaaaagaaagaaagaagauacaguaaagacauaaaaauauaguaauauaauguuaugggacuaccauuauguaugugauugucauuguccaaaacaucauuaugugaugcuugacuguauuuguuugcaaaagaccacauauuuacauugguuuuugagucagucuuuucaccaauaaaucuuuuuacaaguugucuuuuuuuuuuuuuuuugagauggagucuugcucugucacccacgcuagagugcaguggugcgaucucggcucacugcaaccucugcuuuccggguucgagugauucucccaccucagccucccgaguagcugggacuacaggugcaugccaccaugcccggcuaguuuuucuauuuuuaguacagacggaguuucaccauauuugccaggcuggucucgaacuccugaccucgugaucugcccgccuuggccucccagaguguugggauuacaggugugagccaccaugcccggccuacaaauugucuuuuuuuuuuuuuuaacuuuuuauuuccugaacaacaccaauguacagaaaucaucuuuaaauaugguacucugaaagcugcugguugaguuuaaaacuccccagaaauauagaaggaggucaaggagaauuaaaacaagccauucuggccgggcucaguggcucacaccuguaaucccaggauuuagggaggccaaggcgggcggaucaccugaggucaggaguucgagaccagccuggccaacauggugaaaccccgucucuacuaaaaauacaaaaaaguuaggugggugugguggugcgccuguaaugccagcugcucaggaggcugaggcaagagaauuacuugaaccuggggguuagagguugcagugagccgagauugcgccacugcacuucagccugggcaacagagugggacugcaucucaaaaaaaaaaaaaaaaaaaagaagaaacuagccauuuucuggucgggcagggugguuuacuccuguaauaccagcacuuugggauggcaaguuggguggauuaccugaggucaggguuucaagaccagccuggccaacauggugaaaccccaucucuacuaaaaauacaaaaaguuggccaggcgcaauggcucacaccuguaaucccagcacuuugggaggccaaggcggguggaucaccugaggucaggaguucgagaccagccuggccaacaugcugaaaccccaucucuacuaaaaauucaaaaauuagccaggcuugguggugggugcuuguaaucccagcuacccgggaggcugaggcaggagaauugcuugaaccugggaggcagagguugcacagagccaagauugcgccacugcauuccagcuugggcaauagugcaagacuucaucucaaaaaaaaaaaaaaaaaaagaaagaaagaaaaaagaaagaaaaaaaugugugugaauguuauagagguauguuuuuguguguagauuuuuuuguuuuuuaaagacggaguuucgcacuuguugcccaggcuggagugcaauggcgcaauauuggcucacggcaacuuccgccucccggggguucaagugauucuccuccuucagccuuccgaguagcuggcauuacaagcaugugccaccacacccggcuaauuuuguauuuuuaguagagaugggguuucaccauguuggucaggcuggucucaaacucccgaccucaggugauccaccugccucgagcucccaaagugcugggauuacaggcaugagccaccaugcccggcaauuuuguuuuaguguagauuguaauguauauaauuuugauagagaacuauuuuuuuuuuuuuugagguggagucuugcucugucacccaggcuggagugcaguggcacgaucucagcucagcguaaccucugccucccggguucaagcgauucuccugccucagccuccugaguagcugggauuacaggcucccaccaccacgcucggcuaauuuuuuuguauuuuuaguagagacaggguuucgccauacuggccaggcuggucucccaacuccugaccuuaggugauccgccugccucggccucacaaagugcuggaauuacaggcaugagacacugcuccuggccgauaacuauucuuauugcuauaaaucugguaaagaauaugacuaauuugucaucuaaaaagccaaacaaauauaagacagccuuuuauuguuauuacuauuauuauuauuuuuucgagacggagucuugcucugucacccaggcuggagugcagugucucagucucggcucacugcaaccucugccuccuggauucaagcaauucuucugucucauccucccgaguaucugggauuacaggcaugcgccaccaaggccagcuaauuuuaguauuuuuaauagagacgagguuucacuguguuggccaggcugguuuugaacuccuggccucaagugaucugcccgccuuagccucccaaagugcugggauuacaagugagagccaccacacccaacccagccuuuuuuuauuauugagggcuaucagugagucacuaauauuugcagcuauuuuaguuguucguauuagcugugaaagcuugagaaacuaaauuuuccuaaucuucaguuuccuucuguguaaaaugaggauaaggguaguaucugcuuuaccuggccauugugggaauuaaaaugagaaacuuauuuaaaaugcuuagcacuggguguggggaggggggagggauagcauuaggagauagauauaccuaauguuaaaugacgaguuaauaggggcagcauaccaacauggcagauguauacauauguaacaaaccugcacguugugcacauguacccuaaaacuuauaguuauuaaaaaaaaaacgcuuagcacagugccuaggacauaggagauucuuaauuaaugucagccauaauaauacuaaauauuauuguuauucaaggugacauccccugcuccuccaacugacaacuuauucuuuaaaugucuccuacucucuuucccaucauaaugcucuuuuaugcucugauggcaguuuguggcugccccagauauguaagaacauaauucauuucauuauaguuacuuuugcuugccaucccccuuaccagaaugagaguuuuugaggugaagaccaugcuuuauucaucuuuauaacccuaauuucugacacauacuaggccucaauaaauguugaaugaaugccuuuaugaauguuguggguguaauuuggcagacauucuuuuuucgauugucuuggucuugaugaugugcacucuauuaguauagauaaucaagaauuaagcguguauuuuuuuauaugauuuguuuacugcuacguaauaaaacugugccaaagcuuaaugacuuaaaaagcaaccauuuuauuugcuuacaauucuggaaguugacuggggcucagauagguaguucuccugguuuugcuuggcaacacucuugugguugcaguuguggcuggaaugucugacagagaacauucauuuauauuuggagacuuaguauuagcuagucucaguuggaacacuggcauaccugggcuuuggugccagucucucucccugucuuccucccuuccugccuuuucaccuuccugucucuuuccccuuguccucuccagaaagauagacauacuucuuucaugguggccuccaaaaagcagauguugacaggucuucugaaggaugaggccuggaacuggcacaggaucaguuucacucuauugcugugcacgugugacugcauugcuagucacaggcccagcccagauucuaggggagaggaccacacaaggccacgaguaguuggaaaugugaauuccugguucauugggggccacuacuguaacagauuaccaaaucauauaauauacguuuucuguuugaaaguucucaauuaagcacuuuuuuuucuaaaaaagucuuaaguguaagagaaacaaggagaaacauagcagugcuuacaaguccauucuugagucagacugaauucaaaaucucugccacuucacuaacuuugugauauggccaguuucaucucucugacucccauguuacucaucuacacagguucucuucacaggguuaugguagaguuuaaaugagaccauagguacagauuuaccuggcauacagguacucaguagauaauagcugcugcuguauuguugcuguuuccauuauuacuaaugacugaugucuuggugucaguacaaagacaaauagcuaauguaauauacauuucacagaaacugagaaaaaauauguugauuagcguuuucaauuucaguugacuauuuuuuaucuuugucuuuauuuuuauuuuuauuuuuauuuuuuuuuuagacggagucucgcucugucgcccaggcuggagugcacuggcgcaaucucagcuugcugcaagcuccgccucccccgcucacgccauucuccugccucagccucccgaguagcugggacuacaagugcccgccaccaagcccaacuaauuuuuuguauuuuuaguagagacgggguuucaccauguuagccaggauggucucgaucuccugaccucaugacccgcccgccucggccucccaaagugcaaggguuacaggcgugagccaccgcaccuggccuuuuuuuuuuuuuuuuuuuuuuuuugagacagagucucgugcuguccccugggcuggagugcaguggcacggccucggcucacugcaaccuccaccucccagguucaagcaauuuuccugccucagccuccugaguagcugggauuacaggugcccgccaccaugaccagcuaauuuuuuuguauuuuuaguagagacgggguuucaccauguuggccaggcuggucuugaacuccugacuccgugauucaacugccucagccucccaaagugcugggauuacaggcaugagccgcuguacccggcugucuuuuauuuuugauaaauauguuuuucuguuuuuuuuugugguguuuuuuguuuguuuguuuguucgagacagaguauugcucucucaccugggcuggaguacaguggcgugaucucggcucacugcaaccuccaccuccugagcucaaaugauucuccugccucagccuccgaguagcugggauuacgggcaggcaccaccaaacccagcuaauuuuuguguuuuuagcagcgacaggguuucaccauguugcccaggcuggucucaaacuccugagcucaggcaauccaccugccucagccucccaaaauccuaggauuacaggcguaagccacuguaccuggccaguuuuuaaucaguauguucuuguuagcaaauaguuuuguguuuuauauaugugguuuucuuuuuuguuuguuugguuauuuuugaggcagggucucacuuugucacccaggcuggagggcaguggugcaaaaaccacccacugaagccucaaccucucaggcucaaguguuccugucacuuuagccucccaagcagcugggacuacaagccaugccaccacacacagcugauuuuuuguauuuuuuacuagagacagaguuuugccauguugcccaggcuggucuugaacuccuggacacaagugauccguccuucaaaagugccgggauuauaggcaugagccaccgcaccuggccucuacauaugucuuuuuaguaacuaaacucuggaggaaaauauaucagucacuguuguuuuggaggguugugaaggaaauacucccuaagcuuuuggguggcuuaguauugaaauacaaacuugaugaauuuuuggcauuuugugagcucuuaaucauguuaaaauuuuaaaacaguugcuuugggguuauauucagcuguaguggaaacuuuguaaguuuuguuuuuuauuauuuauuuauuauuuuuuuuugagguggagucuugcucuauugcccaggcuggagugcgauggcacuaucuuagcucacugcaaccuccgcuucccggguucaagugauucuccugccucagcccaguagcugggacuacaggcgugcaccacuacgcuuggguaauuuuugcauuuuuaguagagacgggguuucaccauguuggccaggcuggucucgaacuccugaccaccugaucuugugauccaccugccugggccucccaaagugcugggauuacaggcaugagccaaugugcucaggccaaaacuuuguaaguuuuaauggucuguuacauuaaagguuuuaguggcagauuauuucaaaauauuauugaucaacauaaacaauguauauuacaguuuccuguuugaaaucuugucugucauuuguauucuuaaaucuauuuuguuacaaaucaccacaguuguuuuugccuugaaugacuagguagcauuugaagcugauugguuguccaccacacaauucuuuacacagggacaggaaauacuacguguuauaccaagaagugucuuuagccaauacauaauuuacagauuuaucugggagcucuuuuaaaauaguguucuauggccgagcgcgguggcucacacuuguaaucucagcacuuugagaggccgaggcaggaggauugcuugaguccaggaguucgagaccagccugggccacaugaugaaaauccgucucgacaaaaaauacaaaauauagcuggguguagugacacaugccuguggucccagcuaccugggaggcuaaggugggagaaucaccugagcccaggaguucgaggccgcagugaguugugauuguaccacugcucuccagccuggacgaccaagugagaaccugucucaaaaaaaaaguguccuguaaguacaaaacagcaugguguaaugaaagagcauagucuuuggaguuagacuguuucuggcacugcgaagccuuggguaaguugucuucuuucucuucuuugguccucacuuucugaaagugcauugugaagauuuauugaguuaacagugaacgcauggaaccauugguaccacaucaaauaugaagaaauucacucagcaguggagcugcauuuuuaaauuaguuucauaaagucaagcaaaugaacuugauuaguuacaugauuggauuaaaggugacuaggcuuuaaaucaugaaauauuucaaggaaaagaaaaugaucccauggugguaucaaguuucaaauggcagugguugggauucuaugagcaaaagggaccaaauuuacaaugagaguacaggaggugaauuuggaaauugagucucauuuuuuuagcccucugucuguuuuguguucacuuacuuccuuuuuucugagguucugaaacaaaaacaaaacguaggcucugcaacagcugaaggagcuuuugaauucuuucugaagaggaaauugacuuuaccuaaccaaugcacuuccuguguaugcuauauccgcuaaagagcaagacaggaccucagaggcacagugcucaacugcagaauuuccucuuggccauucgaaauguauuacagcguucugacacaaggucuucacuuauucugguaucuguaauauguauacaaagcaacugaggguccuguuaaaaauacagauuuggccgggugcgguggcucaugccuguaaucccagcaccuugggaggcugaggcgggcagaucacaaggucaggaguucgcgaccagccuggccaaaauggugaaaccccgucucuacuaaaaauacaaaaaaauuagcugggcuugguggcgcaugccuguaaucccagcuacuaggggggcugaggcaggagaacugcuugaaccugggaggcggagguugcagugagccgaguuggcgccacugcacuccagccugggcgacagagcaagacucaaaaaaaaaauauauauauauacagguuuggcugggcgcguuggcucacgccuguaauuccagcacuuugggaggcugaggcagaaggaucaccugaggucaggaguucgagaccagccugaccaauaugaugaaaccccaucucuacuaaaaauacaaaaauuagccaggcaugguggcaugcgccuguaaucccagcuacucaggaggcugagacaggagaaucacuugaacccgggagguggagguugcagugagccaagauugcuccauugcacugcagccuggguaacaagagcaaaacuccaucuccaaaaaaaaaaaaaaaaaaaaaaaaaauauagguucuaggggaggaggaggaaagaaaaaaaauucauguucugauuuagcaguucuggguggggccugagauucugaauuucuaacaguaucccagggguuguguuaaaaucauaagguauucucucuuugguucuuuuagaaaguucuuugaaacacacaugauuaacugcguuuucacucaacagcauuuguuuaccagaugcuauguagaugagggcccaguuugcaaagaucucauaguugaauggugagcugaaucaagugcaauuuggguuuauggccuuucuuucuuuuuaaaauuuuuacuuggauuuauuucacagaaauucuuugguaaauacagaaauuaguuaacaauuaauuuaggauuucucuuugugauuuaaagaauuauuuuacuaacugcauaaauauuauuauaacugcguuaaugucaaauggagagaaaagggcuggaugagguggcucacgccuuaucccagcacuuugggaggcuaagguggguggaucaccggagaucaggaguucaagaccagcuuggcgaaacuuugucucuacuaaaaauacaaaaauuagccaggcgugguggcaugcgccuguaaucucagcuacucaggagacuaaggcaggagaaucucuugaacccagaaggcagagguugcagugagccgagauugcgccacugcacuccagucugggccacaagagugaaacucugugucaaaaaaaaaaaaaaaaaaaaaaaaaaaaaaaaggaaagaaaauuguuucuauggucugcccacccaguaaaugauacugcucuuuuucuguuuuaguccuugggcaugggcauuuuuuguuuuuacauggucgugaacauugcugggaaacaauauuguauucugcuuuuuaaauuuagagagaauuuagagaauaaauagaaaguuuuuaaaucucuauauuaacuguugaaauauuguccuuuauucauauuuugauauguucuuucuugguggauuuuucuuauacuuuaaacuuucuugauaagagaaaguuaacaaaaggguuauggugguaaacaauaugucauaugaaacuaagauaauaauaucuagaaagcaaaguauguuuuugcuuuaacuuaucggaguggcuuauaguuagaauuuucccauuaagcgagagaaaaugaauuauauguuaccugaauuguuuuuugagaagagggccuugcucugucgcccaggucagguugcaguggugauccucccaccuuggccucccaaagugcugggauuacaggcaugagccaccaugccuggccuguuaucugaagucuuuaaaauaaaaaucuggaccaggugcaguggaucacuccuguaaucucagcauuuugggaggccaaggugggaggauugcuugaagcugguucaagaccagcuugggcaacauagcaagaucucgucucuacaaaaagugaaaaauaaaauuagccaagugugguggcccgcaccuauaagcucagcuacucaggagacugaggcaggaggaucaccugagcccaggaguucaaggcugcagugagcuaggaugugcaacagagugagacccugucucugaaauaaaagaagaaaaaucuggugucuguauaaacaaccuauuuaucuucauaauauauuugacaugaagauuuuccugucauauccccuagaauauggguucuuaaucugagaucaguagauuuagggcaauguuucucaaauugugggcuacagaaucacaggugugcuuggaaaaaaugagaacuccauccauacacuccuuuagccccuccugucauuuucugguucaguaggucugggauggaacucugcagucugaauuauaacaaguagccuacaugauucuucugcaaacgaaguuucauaauuacugcuccaggcaagccaugguuuggcucugagggaauuuguaaacuucugcaauugaauaauuuuuuaggguauagauuauguauuuuuuggggaagaggcuuuuucuucucuuucaauaacuuugaaaggaagaggcuuuauaaaccucucauuuagauugacaaagagcacuauaauucaaaaaggauuaagucauugucccagcucugccuccuacaggccucuuugguuuuuaaauaauuuuugguuuucuuuuagcauaaugagggcauuuuauccaugaguuuuuuuguuuguuuguuuguuuguauuguggcuuuucauuuuuauuuagagacagggucucacucugucacccaagcuagagugcaguggugcagucacagcuuacugcagucucgacccccugggcucaggugauccucccaccucagccuccuaaguagcugggacuacaggcaugugccaccaugcccggcuaauuuuuguauuauuuguaaagacaggauuucuccauguuauccaagcugguuucaaacucuugggcucaagugauccuccugccucagccucucaaagugcaaggaucauaggugugagccacugcaccugaccauggcuugcuuuuuuuuuuuuuuuuuugagacggagucucacucuguugcccaggcuggagugcaauggcgcgaucucaguucacuggaaccuucgccucccggguucaaccgauucuccugccucagcauccuaaguagcugggauuacaggcaugcaccaccaaacucagcuaauuuuuuuguguuuuuaguagagauggaguuucaccauguuggucaggcugaucuugaacuccugaccucaugauccacccaccucggccucccaagugcugggauuauaggcaugagccuccaugcccagcugaccauagcuuuuuaaucuaccacuucuuugcugcuuuucaguaaaaugaauuuuaauccccucauaauuaaacaauuuucaguauugaaacguacacuuuucaagaacaacuuuguauagauaauaauuuauaacuuuuuuuagcgaguauaacaaugugccauuuauuuuacccacuguaguaccuagauuauuuuaauuuauccucacagcaacuccaugaaguaacuauuauuuauuucucuuuuuugaaauggcgucucacucuguugcccagcuggagugcaguggcgcaaucuuggaucccugcaaccuccaucucccagguucaagcaauucuccugccucagccucgcaaguagcugggauuacaggcccgcacuaccacguccagcuaauuuuuguauuuuuaguagauacaggguuucacuacguuggccaggcuggucuugaacuccugacuucaaaugaucugcccuccucggccucccaaagugcugggauuacaggcaugaggcacugcgcccggcugaaauaacuauuauuaugcucauuugacaaauaagaaaauugaggcauagaauacuuaauuaacuuaaccaaauugacauaguuugugaaugaugaaaccaagauuuggcuuauucuaucugacuugaagggcaguucuguguacuucugucuguuugugcaaaugaaucacauuugguuuaucaaugaauggaagauguauauauacaauggaaugccauucaaccuuaaaagagaaggaaauucugucauuugugacagcauggaugaaccugaaggacacuaugcuaagugaaauaagccagauacagaaauaaacauacugcacgaucucauauguagaaucuaaaaaggucgaagucauagaagcagaaaguagaauggugcuugccagggauggaguuggggauggggagauguuggucaaaggguacagaguuucaguuauuuaauauguguaaauucuagagagcucaaguacaggauagggacaauaguuaauaauaguguaauguauacuuggaauguguuaggagagaucauaaguguucucaccacacacagagguaaccaugugaagagauggacauguuaauuagcuuaacuauaguuaacaguucacuauguauauguguaucaaaauaucacaccuuaaauauaauuucaguuaaucuuuuuuuuacuaaauugaagaagaugguuauacagugcuuuuagauucaugugaauuauaccuuuggauuagccuuuuuuaaagauucugauuuugaguauuuuguuauuucuuuuuagaucaaagaaagugcaucacagacaagggauguucucaaacagcauuuuaaugauuuaaagggaacccuuggaaagcuccuggaugagcgauuggugacccuuuugcaagagguggacaccauugaacaggagaccauuaaaccacuagaugacugccagaagcucauagaacacggagucaacacugcagaggacuuaguccgagaaggugggggaccagggagccuguuguauuagugcauucguccauuuucacacugcugauaaagacauaccugaaacugggcaauuuacaaaagaaagagguuuaaugaacuuacaguuccauguggcuggggaggccucacaaucauggcaggugaaaggcacaucucacauggcggcagacaagagaagagaaugagagccaagcgaaagggguuuccccuuaaaauaccauuagaucucaugagaguuauucacuaccaagaacagugugggagaaacugcccccaugauucaauuaucucccaccgggucccuccugcaacacaugggaauuaugggaguacaauucgagaugagauuuggguggggacacagagccaaauuauaucacagguuaaaugugguucguucagauugacauuuugcugauuucucaggauagcagcaggcuucuugccagcugugggguucuuagaauguucuuaccuagagacaguuuguaauauaggaugacagauauaccguuagguaucgcauggcaagugcaguugaaguguuaguuauaauuaguuauaaaacaagaaagaauaaaugauauggggcacauugagauguuuugauacaggcaugcgguguguaauaaucacauuguggaaaaugggguauccauucucucaagcauuuaucuucuguguuacagucaaucaaauuauauauauauauauauuuuuuuuuugacacagggguuuugcucuguugcccaggcuggagugcaguggugcugucagagcucacugcagucuugaccucccuggcucaggugauccucccaccucagccucccaaauagcugggauuacaggcgcgucccaccaugccuguaauuuuuuaguauuuuuaguagagacaggguuucaccauguugcccaggcuggucucgaauuccuggucucaagcaaucuucucaucuuggccucccaaagugcugggauuacaggcaaaagccaccacaauuacagucuccauuguuuuauuuagaaaguuuaaaaaaaugugauugguguuuacuccuaucuuugccaauuauuuccauugagucaugcccugcugccuuccuuucuucauuauaccaccuuccuucaacagagaucuuugucaggcacauaacauaaacaagggggccaggugugguggcucacgccuguaaucccagcacuuugggaggcugaagcaaguggaucacuugaggucaggaguuuaagaccagccugggcaacagccugucgcuacaaaaaaaaaaaaacuuagcugggcaugguggcaugcaccuggagucccaacuacuuaagaggccgaggcgggaggaucccuugaggccaggagauugacacugcagugagccgugauugcaccacugcacuccagccugggugacagaguaagacccugucucaaaaaauauaaaauaagacuaagaauaaaggccgggcacgguggcucacgccuguaaucccagcacuuugggagguggaggugggcggaucaucaggucaggagaucaagaccauccuggccaacauggugaaaccccgucccuacuaaaaauacaaaaauagccgggcguggcagcgcaugccuguaguccuagcuacucgggaggcugaggcaggagaauugcuugaacccgggaggcggagguugcaguuagccgagauugcaccacugcacuccagccugggugacagagugagacucccucucaaaaaaaagaaaagaauaaaauaggugagaguucuuuccuuugggauucagagcccagugagagagagauacaugcuaagagaucaagaccuuauuggagcauagaggaggaaguucuuaacuuugucuggaauagugugggauagcuuucuguaggaagaguuccacagaggcuugaagcaauucauccagcagacauaggaaaaagaggagguaacagcaugauuccaagcagaaguaacauuaucauaaguggagugaauggcauauucaaggauuaguugaagcauuuuaagcagcagagugacaggaucagaugugcauuuaaaaaaaaaaugacccugccuauuuggagacuauguuagagauuguaagacuagagggaaaagagacugauuaaaaaguuauuagaggccgaggccaggcuaacaccuauaaccccagcacuuugggaugucaagaugggaggaucacuugaggucaggaguuugagacuaaccuggccaacaugguaaaaccccaucucuacuaaaaauacaaaauuuagccagacgugguggugggcaccuguaauuccaguuacucgggaggcugaggcaggagaaucacuugaaccugggagacaaagguugcagucagccaagaucacaacacuacacuccagccugggcaacagagugagacuccgucucaaaauaaaaaaaaauuauuagaaacugggcacggugguucaugcuuguaaucccagcacuuugggaggcugaggcggguggaucacuugagcccaggaguucaagaccagccugggcaagauaaugagaccccaucucaaaaaaaaaguuauuagaaaguaauccagguaggaaugguaaaggcgguggcugguaaagaugaggcagggcugauuuuaagagauuuugagccaggcacaauggcucacaccuguaaucccagcacuuugggagccuagacaggagaggaggaucauuugagguaaggaguucgagaccagucugggcaauguagugagauugucucuaauuuuuuuaaaaaaaaauagcuaggcgugcugagcacaguggcucacaccuguaaucccagcacuuugggaggccgaggcaggcauaucacaaggucaagagaucaagaccauccuggcuaacacagugaaaccccaucucuacuuaaaauacaaaaaguuagccaggcaugguggcaggcgccuguagucccagcuacucgggaggcugaggcacgauaauggcgugaacccaggaggcggagcuugcagugagccuagaucgugcuauggcacuccagccugggcgacagagcgagacuccgucucaaaaaaaaaaaaaaaaaaauuagccaggcaugguggcacacacaaguugucccaacuacucaggaggcugaggugggagagcuugagcuaugauugcagcacugcacuccagccugggcaacagagcaagacccugucucuuaaaaauaaaaacaaaaaaacaagacagaguuuuuuuuuuuuuuaagaaguagaauuauugaugauuuuacugagcagugacuguuaucuguagaugauuaccuacauaugugauggaggggaaaggaaaggauuugugauaacaaaaaucagccuacuuuuggauucugaauaaauaguggugcuguuuuugacaaaggaauugaaggagaaggcgggugcuuaguacguaguuaggcauuuggcuugggcauggugaguuugaggugcuuaagauggaaauacggguaugauucuuaggagagagaucauaccaggagaugucaguauggcaguuaauggcauauauaucaaaucugaaucuauuggaauaaguacaaucaucaagggacaccguguaaugugagaagagcagaugaaagagauuagaacgcuaagggucaccaacauuuaaaagucauuugaggaaaaaggagcuagggaaggagacugaauuccaucucuucugcagaaugagugcugggaguggugugggaaaaaggcguggaugauucacauggcugucacuccaccuggaaguuaaucuucuuuuggucccacuuagaauauaguauggguguuaucuugacauugcugguuacauuuuugucuugucuucaaugagaaguguuuauuugccacugaccauaacaguacuuuugagaaaauucuagcaguaccaugaaaugucuuuccuugguggcuuugcauuuggaaacaaacccagaagcagugcaccacgggccaggaguguacacucaucacccugaggacugaucauuuguuuuuauuuuagaagauaaauccuggccgggcgcgguggcucgugccuguaaucacaacacuuugggaggccgaggggggcggaucaucugaggucaggaguucaagaccagccuggccaacauggugaaaccccgucucuacuaaaaauacaaaaauuagcugggcaugguggugggcaccuguaauccuagcuacucgggaggcugaggcaagagguugcagugagcugagauugcaccauugcacuccagucugggcgacaagagcaagacuccaucucaaaaaaaaaaaaagauaaauccuggcugggcauaguggcacauuccuguaguccuagcuacuugggaggcugaggcgggaggauccccugagccccagaguuugagguugcagugagcugugauuauacaucacacuccagccugggugacagagugagacucugucucaaaaagaaaaaaucccuuugaggcagugugaguguuacagcauuugauacuugaauauuuuuguauguccaaaauuuaauuuaauuaauuaacuuauuuauuuuugagauggcguguugcacuguugccugggcuggagugcaguggcacgaucucagcuugcugcagccuacgccucgcagguucaagcgauuuuccugccucagccucccgaguagcugggauuauaggcgcccgccaccacgcccagcaaauuuuuuguauuuuuaauagagacagaguuucaccauguuggccaggcuggucuagcacuccugaccucgugauuugcccaccucggccucccaaagugcugggauuacaggcgugagccacugugccuggccuauguuuuuuaauuaaaaaaaauuauuauacaucucagcagcagaaggaaacuuuaggaauauuuuuaaugucaaacucuuuccuauucuccugagggauagaaacuuacuuauggaauuuugaggauuuuauuuauuuauuuacuuauuuuugagacagagucucacacuguugcccaggcuggagugcaguggcacgaucuuggcucacugcaaccuccaccucucggguucaagcgauucuagugccucagccucccuaguagcuagaacuacaggagcgugccacuaugcccagcuacuuuuuguauuuuuaguagagacgggguuucaucauguuggccaagcuagucuugaacucccaaccccaggugacccaccagccucagccugccaaagugcugagauuauaggcaugagccacaguacccggccaugucucuguuuuucuuuuggugaaggagaaggucauauggucucaaaaaacuugaguaacuacagggcacauuuagauggaaaagaguucuggcaguguucuucagggcuguggaaggacauagaaguuggucauuuucauaucauaugccucuauguaacuuuuuuuuuuggcgggggggacggagucucgcucuuuugcccaggcuggagugcaguggcgugaucucggcucacugcaaccuccaugucccggauucaagugauucuccugccucagccucccuaguagcugggaauacaggcaccugccaccacacccaacuaauuuuuguauuuuuaguagagacaggguuucaccauguuggccaggauggucuugaucuccugaccucgugauccaccugccuccgccucccaaagugcugggauuacaggcgugagcuaccgcacccagccugacauuuucuuuuuauuguucuguugaauaauuuguaaucugauauaugauacucuuuuaggaaaacauagaugcaucauuuggcuuuucaagccuuaugcccagccugggcaacauagugagaccucaucucuaccaaaaaaaaaaaaaaaaaaauagcugggcaugguggcgugcacguguggucacagcuacuugggaggcugagaugggaggauugcuugaaccuggaaguucaaggcugcagugaguuaugauccuaccacugugcuccagcaugagugacagaacaagacccagucucaaaaaaaaaaaaaaaaacacccuauccccuguugcaccucucagggcaauauuuuguacuggcuccuauugaaguucauaaugauucuguaggagagauggaaagaagucccugggcuuucugcuuugccuaaaauugguugauuuccuuguauagaguagauagauuuuucaucucuggcaaaauguugccacuguauaucccuuuuccucuuggauuugaucuuagagucacgucuaaaauaguuucuacuuuaacuuuuugggaauuugacuguggcaucacuuaagaacuuauuugcaagaacgcuagagacccacccagacaugaguuguguugauuacuuuauaugugaccauuuucauuguucuaguucucuuauucuugauuguaggugaaaucgccaugcuugguggugugggagaagagaaugagaaacuguggagcuuuaccaaaaaggccucgcacauucaguuggacagguaaaagaguuugugccuuuuugacuuacuuuuaagcauuuaaacuaugucugcuuuuuuccucccucuguucaagauucucauuaagggagauagagaauauauauuucaagguuuucagaccaugcguggugguuuacaccuguaaucccagcacguugggaggccaaggcggguggauugcuugaggccaggaguuugagaccagccuggccaacauguugaaacccugucucuacuaaaaauauaaaaauuagacgggcauggaccuguaauccagcuacuuggggaggcugagacaggagaauugcuugaacccaggaggcagauguugcagugagccaaguuuguaccacuacacuccagccugggcaacagcaagacuccaucucaaaauaaguauaaaauaaaauaaaaaauuauccgggcaugguggcgugcgccuguaagucccagcuacucgagaggcugaggcaagagagucgcuugaaucggggagguggagguugcagugagcugagaucgcaccacagcacuccagccuaggggacagagugagacucugucugaaaaaaaaaaaaaaaagcguuucacugcccauuaccacuguuacuaaugaaauaguugugauuauaauccuugguauaguauuacuacacauuuuuucaauccaauauauaaaagaauuguuaaauuuuagaaauuaucaauguauuguugaaauggagucauauuccaguaaaccagaucuuuuggcuuaaacuggacaguuaugauccuaccaauuuucugucuuacuuauauuuauuugaaaagagaaucuuuguguaacaucuugcaaauccccuacugccaugagaauuaauuacugggggcuucaggaucuuucaagcaugugacugcucuaaaauauuucuuguauuuuuuaacucucaguuagaggucucauaacacaugagcuuuguuuccucagcuuaccagaaguaccuuuacugguugaugugccuuguuuaucugcucaguuggaugacucaauucuuaacauagugaaagaccacauuuuuaagcauggaacaguagcaucucgcccaccaguacagauagaagaacuaauagagaaaccuggaggcaucauuguacgaugguguaagguauguaauucagaauucuagaaaugacuuccacauuauggguuugcgauuuggaggccuuucagauuuuuucguugacuacuuuuaaauacauucuuuucuucucaaacaaaaaucucuuuuacuuuacaguuaaaaugaagucacauggaacacugagguagcucuuccaguuuuauuuuuauuuuauuuauuuauuuuuugagacagaguuuugcucuuucaccgaggcuggagugaaguggcgugaucucggcuuacugcaaccuccaugcccucccccgccugccgcuucccccggguucaagccauucuccugcuucggccuccugaguagcugggauuauaggcaccugccaucacaccugccuaauuuuuguauuuuuuguagagacgagguuucaccauguuggccaggcuguucuugaacuccugaccucaggugacccacucgccucggccacccaaagugcugggauuauaggugugagccgccgugccuggccuuuuuuuuuuaaaugaagccuugcugugucgcccaggcuggagugcagcgaugcaaccuccgaccucaggugaucugcccaccuuggccucccaaagugcugggauuacaggugugagccacuccgccuggcugacauuuucuuuuuuuuuuuuuuugagacagaguuucguuguuguuguucaggcuggaauacaauggcacgaucuuggcucaccacaaccuccgucucccggguucaagcaauccuccugccucagccucccaaguagcugggauuaaggcaugcgccaccacaccuggcuaaguuuguauuuuuaguauuuuuguauuuuuaguagagacagaguuucuccauguuggucagguuggucucaaacucccgaccucaggugaucugcccaccucggccucccaaagugcugggauuacaggugugagccacugugcccagcugagauuuuauuaaaaggaaauuuuuuuuucuuuuuuuauaaacaugcuguuguuauuuucuaacaggacugucauuccauuuuuauuauuuuuccuaucaguggaccuaguuauuuccaguuuuuugcuauaaguauuuuuacuuguguuucuuuauggacauaugugaaguuuguaaaauauuaauauuuaccuagguguaaaauuaugaggucuucuuagaguauuggauccauacgcugauagguaauaacaaacuuuccacaagaugauucuaucaauuuagccuuccaaggaguauaugaguuucuguuauuccauaucuugaccaauaauuggcauugugagacuuuauauuuuugccuaaauguaccuuguugugguuuuauuuauuuguuuguuuuugagacagggucucacucugucacccaggcuggaguacaguggcacaaucaugucuccagucucaaucuccugggcucaagugauccucccgccucagcccccaaguaauugggacuucaggcaugugcuuccacagccagcuaaguuuuguaauuuuuuguagagaugggguuuugcuguguugccuaggcuggccucaaauuccugggcucaagugcuccacccgcuucggccucucaaaguguuaggauuauaggcaugagccaucaugucuggccuuguugugguuuuagaucguauuugccauauuacaaauuagguacaaauuagguugaauauucauaauauacauuuuuggcuauuuauguuucuucuccuguagaacgcuuauuuaugucuuuuacccauuuuucuauuggguggcuaauuaacauacagaauauaugcaggaccccuaaaaauuaauggggguucuguauacuguauguuaauuaucucuugguuauuaugaaugauguaugguugugggagacuuacugaaucuugaauguuuuaucuuuggcauugauuaaaaaacaugccauuucuucaaaggaggcagacuuuuuuauaucagacugggaaauacagaacacaugguucaauaaagaaaagaagggagcccaggcgcagugucucacgccuauaguccuagcacuuugagaggcugagacgagaagauugcuugagcucaggaguuaaagaucugagauauggugaagcccagucucuacaaaaaauacaaaaaauuagccggacaugguggugugcaccugaaaucccagcuacuugugggguggaaggaagaggauggcuugaacccgggguguggaggcugcaauaagccgagaucacgccacugcacuacagccugggugacaaagugagacccuuucucaaaaaaaaaagaagggagauaaugaugugauggcauauuuucuauggccuucccaagaauaccccauauucagcaugugggccugucugcuugguccaaaauggcuccguucaaaauuuuuaagcagugaugcugagagaagucauuuucuguuuuuuaccuaacauaaagcuuuucucccuagguggaugaugacuuuacagcccaagauuacaggcuccaguuucguaaauguacuucaaaucauuuugaggauguauauguagguucugaaacugaauucauaguauugcacauagaccccaacguugauuaccaguucagagucugcgcccgaggagauggccgacaggaguggaguccuuggagugucccccagauaggucauuccacauuggugccucaugguaugcugcuaaccuuuucucuccugaagccuaacuauauauuagaauaccuguauucugugcuaagggcagcacacugacaaccagcuauucuaagcauagauccugaauugauaagaacaacaugcaccaugucuuuuacucagauuaccucaugugauuuuuguuuucaucaguucuucagaguccaaaaaaaaugcuggacaagauuuuuagccucauugaaaaccaaagauugaaaauauuauguagggcacugauauuccuuuuuauucuuuuuuuuauauuugaauguuauuuaguuaguuuuuuugagacaaggucucacucugucgcccaggcuggugugugguggugcaaucaugcagccugaccucuagauccuucugccucagucucccaaguagcugggaccaccugcaugcacaccacaccuggcuaauuuuuuauuuuuuucuagagacugggucuugcuauguugcccaggcuggucucaaauuccugggcucaagcaauccucuugccucggccucccaaagugcugggauuacaggcgugagccaccgcgccuggccuauuaauuagauuuuuaucagguuggaauaaguucaagcaauuaugcuuguacaaugauuuuauuagauaagagauaacacuugugugauuuauuaugucaaaauuaugcaggaauauacuaaaaucuuuuguaauuugugggacugaucaugauacccuguuaauggaaucuuuuauuuuauugaacuugaccauggccccuaagaguagucucccauuuccauguuuuauuuaacgugucuguauugaagauaucccucaagagauucuaacaguuuucaauaucuuugcuuugaaaaagaguggacagcugguuuugagggguacagucugagcagucgaagaaauauagcacuucggaacgauucugaaucaucggguguucucuacuccagagcuccgacuuauuucugugggcagacauuaacauucaggcaaguagauauuaaaacaucucaccugccucaggaagcagagugaagugcauagagcauacauaagcuuugaauucaaaacauccugaguuuauuccgucauuuauaggcaguguuacugugggaaggcuucuuuauuuccuguagcuguaguuuucucaucuguauucacaggguuauuacguagauuaacugggaaauguauauaaaaugcuuguuauuuaauauguuuauaucucuuuuccucuugguaaguagagguaaguagaguaucucucaaaagucaaucuuaggcugggcauagugguucacaccuguaaccccagcacuuugguaggccgaggcagguggaucaccugaggucgggaguucgagaccaaccugagcaacauggagaaaccccaucucuacuaaaaauacaaaaucagccgggcaugguggcacauaugccugcaaucccagcuacuugggaggcugaggcaggagaauugcuugaacccaagaggcagagguugcagugagcugagaucaugccauugcacuccagccugggcaacaagagcgaaacugugucucaaacacacacacaaaauuaaaaaguaaaucuuaaaaauuuagaggccuggccaggcacgguggcucacacuuguaaucccagcacuuugggaggcugaggcgggcggaucacgaggucaggagauugagaacauccuggcuaacauggugaaaccccaucucuacuauaaauaaaaaaauuagccggacaugguggugggugucuguggucccagcuacucgggaggcugaggcaggagaauggcgugaacccgggaggcggagcuugcagugagccgagaucacgccacugcacuccagccugggcgacacagcaagacuccguuucaaaaaaaaaaaaaauuuuagaggccaagagacuggacgcaguggcucacacuuguaaucccagcacuuugggaggccgaggcgguuggaucacuuguggucaggaguucgagaccagccuggucaaccugguaaaaccccaucuuuacuaaaaauacaaauauuaggacaggcgcaauggcucccgccuguaaucccagcacuucgggaggcugagguggguggaucacaagguuaggagaucaagacaccacccuggccaacauggugaaaccccaucuuuacuaaaaauacaaaaauuagcuggaugugguagugcacaccuguaaucccagcaacuagggagagugaggcaggagaaucacuugaacccgggaggcaaauguugcagugagccauugcacuucagccuggcaacagggcaagacccgucucaaaaagaaaaaaaaaauuagcagggugugguggcacacaccuauaaucccagccacucaggaggcugaggcaugagaauugcuugagccugggaggcagagguuacagugagcugagaucgcgccacuguacuccagccugggugacugagcgagacuccgucucaaaaaaaagaaaaaaagcauaggccgggcacuguggcucaugcauauuaucccagcacuuugggaggccgaggugggcagaucacgaggucaggagaucgagaccauccuggccaacauagugaaaccucgucucuacuaaaaauacuaaaaauuagcuggguguggugaggugcgccuguagucccagcuacucgggaggcugaagcaggagaaucacuggaagccuggaggcggagguugcagugagcagagaucgugccacugcacuccagccugggagacagugcaagauuccgucuggaaaaaaaaaaaaaaaaaaaaaaaaaaagcaaaaaaauuuacuggccaagaauuuguuuuguccuuugugaaucauuaacagcaagucuuuguaagagacaacacuguaaacauauuauguauaugcuacucucuaaaguaaaacugaaagcaagccuccccuaccacuaauuaauguuguuucucuacccauuucuuucuguaauggaaaaguuucuuuuuucuuguuuucauguuaucugagauguauucuuuauagucauguuucugaauagcucuucguagaaacuaaagaccaguuuugacuuagagaaguaaaguuugccugauuuucaccauacucaccuuaguguaacaagcucuccucuaaguuuuaagucuugagaugggauuuuauugugaaugcuugacccaaguuccuuuuguucucaggcccuuauuauuuaaggcauggagaauaucugaauauuuuaucuaagccaguguugcuguauuccucuccagcuaaguaauuugaauugucagcgguugucagauuauacuaguuuguuuugucuaauuuuugacaccucaccccuuaaugaagaaugacucaguaaacagaaaaauaccaacaaagagagagagaggaaaaaaaaaaacaacuaauaccuaaaaucuauuuaacuauuccccagguaaucaugaguuuucuguacuuacauaccccuucucugcuuaugucccuuguuuacagaagcacuucgguuagugacucuccugagaacaagguauuucugugcaaugacagagcuuccuaacuugauaaauucaggccagauaucucagacugcaauaaugaugauaauaauaauaauugcaguuaauauuuaaacaguauuuacuaugugccauguacugucuuaaguauuuuacuuguauuaacucauuugauuuucaugguaacccagugagauagauggguuauuuauuuuagggaugaggaaacugaggcauagagaaguuauuuacccagugucacacagcuaguaaaugccaaaacuaggguuuaaauccaggcaguucgacuccagacuggucuguauugcuucuuuuucaugggagaguuaacaugauucuaguuaguguugaagucuacaguuucucuauuacuguguccuuagcucuuuaacuuuuaccucuuaugaccuuucaccacuugaucugaugcucuccugcuuuuuaaauucuuccuccuuggacacaugguaaugucugauagauugcauaguuagguuuauuucuuagaccauucaguaaauauuuauuaagacauuggaaauuauacaaauugauuuaaauucaccucugcugaccgugaugugaaagacacauuaggucucaauaaacuguugagucucucuugcaucuccuaaagaugcaucaccaggccccacuuggcagggugauuaacugaaauucaguuaaacucaauauaaugguagccagccuuuugcauuuuugucauuuuuuucuuuguggaaugaaauguuuucuccccuuguuuaaaggaauuucaggcaucagcagugaagccagagaugugaaugcaagggggacuccaugcauaagggcauaagggaggagcaagugcgccuacuugaaucaagagaaacaauauuuaguuuuuugaggguacuuaagggccuaguaguuagaagggagacuauacucuugaaggcacuacguuagccgggcacgguggcucacgccuguaaucccagcacuuugggaggcugaggugggcagaucacgaggucaggaguucgagaccagccuggccaauauggugaaaccccaucucuacuauaaauacaaaaauuagccgggcgugguggugugugccuguaaucccagcuacucaggaggcugaggcaggagaaucgcuugaacccaggaggcggagguugcagugagccgagaucacgccacuguacucuagccggggcaacagagugagaugcugucucaaaaaaaaaaaaaaaaaaaaaaaaaagaaggcacuacuuuguuauuuaucccagucagucccugcugaagcuucuggaaggcuuggagcugcugaagccagagaaaccugugauacuggcuggauuuuaacagucucuagacccacucucauuagaugcccaggucugcuagcaacccccuccuuccaggucucccucacuuccuaugugaacauuccugcucuuuccuugcuucuaagauuuucugauuuuuuuuaagguuuccuucuuucuuuucuuuucuuuucuuuuuuuuuuuuugagacaaagucucauucuguugcccaggcuggaaugcaauggcacaaucggcucacugcaaccuccaccucucagguucaagcgacccucucaccucagccuccugaguagcugggacuacaggcgccugcuaccacgcccggcuaauuuauuguauuuuuaguagagacgggguuucaccguguuagccaggauggucucaaucuccugacuuugugauccgcccaccucggccucccaaagugcugggauuacaggcgugagccacugcacccggccuauuuucuuucucauuccccuccccagcucucccccucuuuuuguuuaagacaaggucucgcucugucgcccagguugaagugcaguggcaugaucucagcucacugcaaucgccaucucacagguucaagugacccucucaccucagccuccugaguagcuaggauuacaggagccacuaccacacccagcuaauuuuuguauuuuuuguagauacgggguuucaccauguugccuaggguggucuuggaacuccugaccucaggugauccacccuccuuggccucccaaagugcugggauuacaggugugagccacuaugcccggccccuccuccccauacuucuuuagacugcucagauaugaaauaacuucagaaaccuacccaaauauuaugauccugcauguuugcuauuucacaaucaaugacauuuugaggccacauugacuauaaauaaucacaucugucuuuggaaaagccacauuuuguuucacacuaauuuuuuuuuuuguccuugcaaaguuggcuuucuggauggagagaaugaugugucuggcaauagggaucuguacauuuccuauuucaagagcacacaaaguacugacaucugaaaugaaaacacaaaaggaaaagcuuaaacuugccacauaggaaguucuucaugcuugaauagugucuucauaaccauaaugggauuuuuuaggauuauaauaguucuuuuuaaaugcuuuauuuacuuaacaaauaguaaucaaaucauugcaaauucuuauauggaagauuuaggcgcuggcagcaauaguuacauaaauuauaaugucaacuaugacaaaccuucuaugugucuagagcuagaauauaaaauagaagugugccaucauggcuacaaaugguuaagaauauagauucuaggccgggcacgguggcucacuccguaaucccagcacuuugggaggccaaggaggguggaucaccugaggucaggaguuccaagaccagccugagcaacauggugaaaccgugucucuacuacaaauacaaaauuaggccaggugugguggcucacgccucuaaucccagcacuuugggaagccgaggcaggcggaucaccugaggucaggaguucgagaccagccugaccaacauggugaaaccccgucucuacuaaaaauacaaaacuagccgggcaugguggugcaucccuguaaucccagcuacucaggaggcugaggcaggagaaucgcuugaaccagggaggcagagguugcagugagcugagaucgcgccauugcacuccagccugggcaacaaggaugaaacuccauuucaaaaaaauagauagauagauugauugauucuagagucagaaugccuguguuugaguccugguuccaccagucaucagccagguagucgggaucagguuauuuagcuauuuuuaaucuuuuuuucuuuucgugccucauuuuccucacuuauaaaauggguauguuaaaaauagcaccuaccggcuggacgcaguggcucacgccuguaaucccagcacuuugggaggccgagguggguggaucacaaggucaggaguucaagaccagcuuggccaagauggugaaaccccaucucuauuaaaaauagaaaacuuagccggguaugguggcgggcaccuguaauccuagcuacuugggacgcugaagcagagaacugcuugaacccgggaggcggagguugcagugagccaaggucgcaccaccgcacuucagccugggugacagagcgagacuccgucucaacaaaaaagaaaaagcaccuaccucauagauuguuguaagaaugauagauagauauaaaauaauuagaacagugccuggaguauagcaagaacucaaucaugguugcuguacuauuuagaaaaaaacaauuguggugagauugcucuuuuuaagcuaguggcuguuaaguaucauucauguuauauuuuuaaaaguaugaaaugaccuuucuacuucauuuacagaguugaaacugugggacagccagacagaagagauagcauaggagugugugcagaaaaacaggauggauaugacucucugcagcgggaucaagcugugugcauuaguacaaaugguaagagauaaauaacugucauucucuuggaaauauauuaauuauuuuaguaauaugugaaucuguuccaguuccauacauuuauaguaggagaugagaaaauuuagguauuuuucuuuuucuuuuuuuuuuuuuuuauuaugaagucucacuccaucacucaggcuggaguacaguggcaugaucguagcccgcugcagccugaaauucuugggcccaagccauccucccacuucagccuccugaguagccgggacuacaggugcaugccacugugacuggcuaauuuuuuuuauuuuuacuuuuuuguaaagauaaguuguugcccaggugagucuugacuccugguuuccagcaauccucccaccuugguggccucccaaagugcugggauuacaggcgugagccaccguggcuggcugaaaguuuuggucuuaaugacauaauuuaugugacuaccauguaccaggcauuguucuaaauucuacaaauaauaaaucauucagucuacaucccuagugcucuuuaaaaaucgcuagccagaggccgggcgcgguggaucacgccucuaaucccagcacuuugggaggccaaggcgggcaaaucacgaggucaggaguucaagaccagcccggccaacauagugaaacccugucucuacuaaaaauacagaaaauuagccaggugugguggcgggugccuguaauccuagcuacuugggaggcugagguaggaaaaucgcuugaacccgggaggcggagguugcagugagccgagaucaugccagguaacagugugagacuccgucucaaaaaaaaaaaaaaaaaaaaaaauucacuagcaagacauguuaauaauauuuugugguguuggcugggcacgguggcucacgccuguaauccuagcacuuugggaggccaagguggguggaucacaaggucaagagaucgagaccauccuggccaacauggugaaacccugucuccacuacaaauacaaaaauuagcugggcguggugguacauaccuguaauccgagaggcucaggcaggagaacugcuuaaaccugggagguggagguugcagugaguccagaucaugccacugcacuccagccugggcaacaagagugaaacucugucuccaaaaaaaaaaaaaaaauuguguuggugagucaagaauucgguagaacaagauucuuucuuguuuauuccauaagaaauagucuugcuauuucacaggagguaauuuuguaacacugucaaguuucuuuugaugacacugauaugggaaacucauagucucugcuggaagaguacaacccuggacagaacucuaaaaucuauguccaguuggcauuccagauuuuuuaaaaucugaauuaggaaaugagcuguguuaccaguaaucuagaaacuauuucagaucucuuaguuauugcucacauguaaaugacucuuuaccuuaacauuuuaggugcaguuuuugucaauggaaaagaaaugacaaaucaguuacccgcaguuacuucuggguccacugucacguuugacauugaagccgugacucuaggaaccaccaguaauaaugaagguggacacuucaagcuucgaguaacuauaaguucaaauaauagagaagugguuuuugacugguuacuugaucagucuugugguucucuuuacuuuggaugcucauuuuucuauccuggauggaaaguguuaguguuuuagauguuugggugcuuggcuuugguuuucagggucuaacguagcuguccucagcccagcguaguuguaauugcuuuaaaaaaaaaguugaauucaucucuaacuuaggccauuggaaaguguuuacuggauucauuuuguaauauuuuagcaaaaagagacuucaauguuguggacaaaaucauacaauucagucaauuuuauuuuuagcauacuguuaaauaucacaucacaauaaaaaucaaauuggcauuaaaaguauagaagauauaggaaguucuauacccuuccacuguacuucucaaaguugguuauuagaccaggaaaacuuaauguaauauuauuuuuaaaaucaucuuaaaggauccaaguccauguaacucuuuagaacaagaggaauaggucagauagaagaagcuguguaauguauuaauacauccguucaugugcuguccacaugaauguguugacugugcucuccauguucagguauuuguaagcaguguugacuuuuauccccucuucaguaaucuuuaaguccccaaaacauuauaacuuuuucuuuuuuuguugagacggagucucacucuugucacucaggcuggagugcaguggugugaucucaguucacugcaaccucugccucccacguucaagcgauccuccugccucaggcuccugaguagcugggauuacaggcgucggccaccacaccuggcuaauuuuuguauuuuuaguagagacaggguuucaccauguuggccaggcuggucuugaacuccugaccucagguguuccacccaccucagccuuccaaagugcuaggauuacaggugugagccacugcaguggaccaauuuuuguauuuuuuuaaaugcuugaccaagugucuaaaauaggcaaguaguaccuuuuguucuuucauugcaauuugauacaguauaggcuacaguauuuuuacaggguaaaacuaguuauggcaguaguaugcacagcaguguuagccauuucauauguauguaauaugcacguguguauccaaucugccugugacaugcauuuuacucuuugcagagaaugagcugcaguccaguuuaaugucaguuuaauaaguggucucuuuuuagcagagcaaaaaaauauagcguaaauacuuauuuuuuuuaaaaacuuacuuaaauuuguguguaaaauauuuauuugaaggacuuuaauauguaaaaauaauugucuucuaugccacccuacagauuuuauuuuaaugugaauuauuuuuuucauuucauuuuuaccaguauaguaaaaaaguagaaaagcaaguaugauauuuuuguaagauaauuuauuuggggauucauguucccuguuagacaaucaugaccuuuucuacuugucuuuuuauauauaaguaguagauuuccacuuguuuagggauuaagaagauguucuagaauguagauaccuuguccagccauaggaaucaaaauaaaaaacuaaaaaaguuca

SEQ ID NO: 192279 - RNA, 63273 nt, Homo sapiens
ccuccgaagcucugugguccgaucugcgguccgcuugcuuucccugcccggucccgagcgcucagccugaagcgccgcuuucgagggcacccugcauacacuggccgcgccucagggaucucauugcccgcgcuuucucauugccucuuuccguguucgauucggcugaucugggcccagccuccgcucccgcucucugucggugggcgcgggggaauccgaaacggcucagcagaaucccagcagcuugcugcuacuggagcgggccgccuccauggccuccaggcaggccgggcuggaccgcgugagguccuaggagacgggauuccgggaagcggggaguaugguggggguccuggccauggcggcugcagcugcuccgccucccgugaaggacugcgagauugaggugagguugagucgaggaucuguugaguuccuuccucuaucuuuugggggauuggaaggugggucuuggcggaaggugauccugacuuuguaaggggaaaggugggacauugugaggacccacagcugugacacauugugugcaacaguugccagagugugucguuuagagucgugucaaguccugauaaacauuuggauucugagauauuugcggggucacaguaaauuggggacuuaagauaacacggccaguucccagaucccgaaauguugguggaacgugauguuuuggacuuccgacaugucacagaggaucccagggucaaguucuggguucgugauacggaaucacugaacuuuagcgcugaagaagaucuuuaaguuaaacuaguucauacauccaccugugcuuggaaugccacuuuagaaugucacuacagaaaucaagcaagguacuuaaagaaaacaguuucucauggcuuaguaucugcgguuaggaaucgcaguguaacauguucuuuuggguuuaucagguuucagugacaggcacuaagcggucauuauaaagagauucuaaugccaugaaguagugggcuagcaucuuaagguagacuuguuauauuuuacaccuuuucaucucagacuagcauucuaacugaagcauguaucuuggcguccuugaagagaguuaagauguauguauguucauuuaacugcgaccaguuguuuuuuucagaaucuggugacuugucuacuuaguuuuuguuuuuguuuuuuuuugucuacuuaguuguuaugcugauauuccuuugcuaaaucaaggcaguuaguuacucagcuugucuucugguacuugauguacacaguucuugauuucuauguggucuguuuuaucaaucuuuccguuacaguuucugguuuuggugcccuaaugcuaagaaacccuauuucauaauaaugauacuuaccauuuaauauguuagggguaagaaccuuaaacacauuauuuugcuuaauagcaacccuaugaucuauugucuguauucuacaaaugaaagaagguaaaaaguagcuaaaaguaaguuaaauuuuuugaaaaauuaaauggaaaaguuaaaaguaauuugcuuaacguuuuacaccaguaaaugucagagccagcauuuaacuuagauuugccugacuccagagccuauguauguugccuuugauacaauugcagcuuuauaaauaauaacugaauggcguuuuucuaauacauguaugguuucuuuuuguuuuuugagacaaggucuugcucugucacccaggcuggagugcaguggcacaaucuuggcucacugcaaccuccgccucccagguucaagugauucuccugccucagccuccggaguagcugggauuacaggcgugcaccacuaugcucagcuaauuuuuuguauuuuuaguagagacaggguuucaccacguuggccaggcuggucucgaauuccugaccucaagugauccacccgccuuggccuccugaaguacugggauuacaggcgugagccaccgcaccuggccugguuuaacuuuaaagccuauuuucuuucuaauauaucacguuuuucaccuaaaggaggcuuccuuuuuuuaauccuauuauguaaacuauuagauccauguuuaaaauuuauauuuuguauuauauugcuugaaauaagugccuuuuucucuuuuaaauugccagccaugcaaaaagcgaaagaaagaugaugacacaucuaccugcaaaacaauuacaaaauauuuaucaccacuagggaagacuagagacaggguuuuugcuccaccaaaaccuaguaauauucuggauuauuuuagaaagacuucacccacaaaugagaagacacaauuagggaaagagugcaagauaaagucaccugaaucaguaccuguugacagcaacaaagacuguacgacaccuuuggaaauguucucaaauguagaguuuaagaagaaaagaaagaggguuaauuuaucucaucaacuaaauaauauuaaaacugaaaaugaagcuccaauugaaauuaguagcgacgauagcaaagaagacuauaguuuaaauaaugauuuuguggaaaguaguacuucuguuuuacguuacaagaaacaaguagagguacuugcagaaaacauucaagauacaaaaagucaaccaaauacuaugaccucccugcaaaauucuaaaaaaguaaauccuaaacaagggaccacaaaaaaugacuucaaaaaguugagaaaaaggaaaugcagagauguaguagaucuaucugaaagcuuacccuuggcagaggaacuaaauuugcuuaaaaaagaugguaaagauacuaaacagauggagaauacuacaagccaugcaaacucuagagauaacguaacugaagcagcccaguuaaaugauaguauaauaacugucucauaugaggaauuuuuaaaaagucacaaggaaaauaaaguggaagagauaccagacucuacaaugucaauuuguguuccuucugaaacugucgacgaaauagucaaaagugguuauauaagugaaucagaaaacuccgaaauuucccagcagguacgcuuuaagacaguuacuguucuugcacagguucacccuauuccgcccaaaaagacagggaaaauaccccgaauuuucuugaaacaaaagcaauuugaaauggaaaauaguuuaucugauccugagaaugaacagacaguucagaaaagaaaaucuaauguuguuauacaggaggaagaauuagaauuggcuguuuuggaagcuggaaguucugaagcugugaaaccaaaaugcacucuagaagaaagacagcaauuuaugaaagcauuuaggcagccagcaucagaugcacuuaaaaauggaguuaaaaagucuucugauaagcagaaagaccuuaaugaaaaaugucuauaugaaguaggaagagaugauaauucuaaaaaaaucauggaaaauucugguauccaaaugguuucaaaaaauggcaauuuacaguuacacacugauaaaggaaguuuucugaaggagaaaaauaaaaagcuaaagaagaagaauaagaaaacauuagauacuggggcuauuccaggcaaaaacagagagggaaacacucaaaagaaagaaacaaccuuuuucuuaaaagagaaacaauaucaaaauagaaugaguuuaagacaaaggaaaacagaguuuuucaaaagcagcacuuuauuuaacaaugaaagucuuguuuaugaagauauagcaaaugaugaccuucuaaagguuuccucucuguguaacaauaauaaauugucaagaaaaaccagcauaccaguuaaagauauuaagcuuacacagucuaaagcugaaucugaagccagcuugcuaaauguuuccacgcccaagucaacuagaagaucuggaagaauuagcagcacaccuacuacagaaaccauuagagguauugauucugacgauguacaagauaauagucaacuaaaggcuuccacucaaaaagcagccaacuuaucggaaaagcacagcuuauauacagcagaauuaauaacaguacccuuugauucagagagcccuauuagguaagguuuguuuuuguucuaacguucuaguauucugcauguauuauuagcuggggacaaaaaugcuucaaguauuggaggguauuuuuuuuucuagaacacagcuguuuaaaagaaaaagaacaggauuucuuuuuuuuuuuucuuugagauggagucuugcugugucgcccaggcuggagugcaguggggcaaucucggcucacugcaaccuccaccucccagguucaagcaauucuccugccuuagccucccaaguagcugggacuacaggcacccgccaccacgcccagcuaauuuuuguauuuuuaguagacaugggguuucaccguguuggucaggcuggucuugaaccccugaccucaagcaauccacccacccggccucccaaagugcugggauuauagucgugagccacugcgcccggccuggaagaaaaagaacagagcuucaaaaaugcuucuuuguuugccacauguaauuaaauuuuuuuuuuaauuuuaauuuuuaauuuaauuuaauuuuauuuuauuuugagauggagucucacucacuguuguccagucuggagugcaguagcacaaucucagcucacgacaaccuccaccuucuggguucaagugauucucgugccucagccuccugaguagcugggauuacaggugcgugccaccauacccggcugaucuuuguauuuuuaguagagacgggguuuuaccauguuggccaggccagucucgaacuccugaccucaagugaucugccugccucggccucccaaaguacuggguuuacaggugugagccaccacacccggcaaguuugauuacuuuugaaucagugguuugaaacugaugggaauuauuuuuuuccuccuguuucagaacauuccagaaauuggagcccuaguugguucuuugcugucuaucuaucugucuaugcaucucuaucuaucucucuggaaacaaguucucacuguguugcccaggcuggucuugaacuccuggggucaagcaauccuuccauauuaggguccugaguagcugggauuacaugcagaugccacugcaccagcucuauuuuaucuauauuuaauugagauucuuguguauguuauaaucaugaaaauguuucugaauaccuuauuuuuauuucagaaugaaauucaccagaauuaguacucccaaaaaaucuaagaaaaaaucuaacaaaagaucugagaaaucugaagcaacugauggagguuuuacuucucagauuagaaagguaauuaaaauauuagagaguccuauaagugccauucuguuuccuuaaaaaacaaacaaaaaacccccacauuacuaugggaaguaaugagccaaaauaaaauucauguauuucauaaauugguuaacuacaacccuaugauauuuuucacuauuauccuguuccucuaguuaauuaagauaucuuauugugaggugaaagcaauugauaaaggcagaguauaauuuacuuauaaaaagcuuucuuagugaguuuacaucgugaucauuuuuccuaacacugccgaucuuaguuugggcuccuguagcaaauuaccauagacugaguggcuuaaacaacagaaacauauuucucacaguuauggggauugagaaaugcacgaucaaagcaucagcuaugcagugucuggugaagcugucuucuuguuuucucacaugguagagaacagcuagagagaggggucuccacccucaugaccuaaucaccuccuaaaggcccuaccuccuaauaccauuacauaguggguuaggauuccaacauaugaauuuucaggggauguauucagucuguaacacugccuauaggucaugauugaauuuuucauuuauuucuauagauuauagagacugaaaagcagaguuucucaaccuugcuauuauugacauuuuggcuggauaauucuuuacuguggagggcuguccugugcauuguaggauguuuagcaacacucuggccucuauccauaagaugccaguagcacccaacuaacuccuguauaaugacaaccaaaaauguguccagacauugcuaaauaucccucggaggggaaaauaaucacuuccacuugaaaaacuacagcucuaaagggagaaguaagauacauaagaaugguuuaguuguuucggcaaaauaagcuccuuguccccaccauggcagaauuggaguagguacagguauguguauuucgaaaaagccaccaaggugacucugaauuaauccuugagugaaaaccacugcuacauugguaucuccuuugguuuuauuuaacagcugucauuuuuuggcaucuuaccacauucuaggcagugugcuuaguacucacaucauuaaucucauaaaguaaauauuauuuaacccuuuuuuauagaugaagaaacuugcuguuaguucauagggugaggaaacguguuuuuauuugugauucugggaagugucuuuccuagaguuauacaacuacaagcaguuagaaagacggucuuuagucuuuuggaaaacaugcgagaugccagcugauuguacuacagcuaaagguugaaagucucuuuggugaacuuugucccacauauuuuauucuucuugauuucauucuagaggacagcuucaacuuuaauuuuuuuagagauaauuauaccuugguuugccucauguacuacuuaaaauugggauuuaauaguaaauuuuccagcaagagaagucucaaaauuaaauguauccaaauugggaccuuuauccaaacuuacuuagaucaguuauuuuaucucauacucugucaauggacuucuuaccacagggcccuuguuguucacugaagacuuauccagccuuguguacuagcucuaggagaaaaucuuaguaauuuucugggugagauuuuucuuuuuuauuucuuuuuucuuuucguuuguuauuuuuguagagacagggucuugcuauuuugcccaggcuggucucgaacugcuagccucaagcaauccuccagccuuggacucccacagugcugugcugguugguauucaggcaugagccacugugccuggccagauuuuuaauguuucuaugagaauaaggaguaaacugguuccccuaagagccccauauucauaacagcuuauuguuuauccuuucagauaauaguuuaauaguuagauuuuuuucucuccagauauuuuuucucugcuuaaauagauauaucuuuuuuuuuuuucuuuuugagacggagucuugcuguguugcccaggcuggagugcaguggcacggucucggcucacugcacucugcuucacgccauucuccugccuuagccuccugaguagcugggacuacaggcacccgccuccaugcccagcuaauuuuuguauuuuuaguagagaugggguuucaccguguuagccaggauggucuccaucuccugaccuugugaucugcccaccucggccucccaaagugcugggauuacaggcgugagacacugcacccggccaucuucuuuuuuuuuuuuuuuugagauggaguuucccucuuguugcccaggcuggagugcaauggcgcgauuuuggcucacugcaaccucggcuuccuggguucaagcggauucuccugccucagccgccccaagucguugggauuacagacgcccgccaccaagcccagcuaauuuuuguuauuuuuaguagagacggggguuucgccauguugacccagggaugucuggaacuccugacuucaggugauccacccaccucggccucccaaagugcuggaauuagaggcaugagccacuguguccagacucuuucuucuuuaucauauauaagaagcuugaggcugggugugguggcucacgccuguaaucccagcacuuugggaggcuaaggcaggcagaucaccugaggucaggaguuugagaccagccuggccaacauggcgaaccccaucucuacuaaaaauacgaaaauuagcugggugugguggugugcaccuguagucccagcuacuugggaggcugaggcaggagaaucacuugaacucgggaggcagagguugcacugagccgagaucaugccacugcacucuagccuuggcagcagagcuagacucuguuaaaaaaaaaaaaaaaaaaaaaaaacaaccuugaggccaagguccauguauuauaauacuguuuucuuuauaguauccagccuagagccauucauauaguaggcuggguaacuguuuggauuuggaaaguacuuugccugaauuuggugacuaaaauuaaaaaauagauugccaagucuauacuacagacauccucuuggguguuuugcucacauguaaauauauuuaccuggaugauuucaaguaagaaauaaaggcaaacuaaugauaacuagacacauuucaauuuaaggccccugguaagauuugaauaaccauuucuuuguugauuauuuaaugugauuugugauuguauuuuuuucuauuauuaaauauaaaauauuuucuugugauguaaauuaauguuucaauuuuuuguuuaggcaagcaauacuucaaaaaacauaucaaaagcaaaacaauugauugaaaaagcaaaagcuuuacacaucaguaggucaaaggugacugaagaaauagcgauacccuuaaggcgcuccucuagacaucagacacuuccugaaaggaagaaauugucagaaacagaaguaaguauuauaaauaucuguugguauaaauucucuccuauuuugcuguuuggagugggagaaggaaaccauuauaaaguuauaagguagguuugugugauagcuugaagugguagagagaauaucauuuucaguuuugcuuuaaaagccuucugcuuuuuuuugucugcagaauacaguuugaauccuucuuaagucacucaagaucuuucauaagcugaacuaccucuuccuuuuuuuuuuuugagacagaguuucgcucuuguugcccaggcgagagugcaauggcuggaucucggcucacugcaacuucugccuccuggguucgagcgauucuccugccucggccucccaaguagcugagauuacgaguguguaccaccaugcccggccaguuuuguauuuuugguagagacaggguuucacagugauuggccaggcugguuuugaacuccugaccucaggugauccaccugccuuggccuacuagggugccagcccucuugccuuucuucaaaacgacucuuugcucuagucacacagaauuguucauuucucccuaaauggugcaguuuucacgguauuuguuuuauuguuaucagcuugaaauauacguuccaaguacucucuucuaugugaggaauuccuacuuaaacuuugagauccugcuaacugccaguaccucuuucuaauaaaauaguuugagauauaauucauauacaugcauuucaccauuuaaaguguacaauucagugacuuuuguauauuggaagaguugugcauccauuaccguagucaauuuuggaacauuuucauuuccccaaaaauagacucuuuucuucuugguugucaccccccaauccccucauuccaccagccauagcuaacuacuaaccugcuucugucucuguagauuugcuuguucuggacauuucauaucaaugguaucauauagcaugugguuuuuugugucuggcuucuauuacuuaggauguguuuucaagauuuauguuacagccucaguauuucuuuucuuucuguugccaaauaucccauucaucaccugauggacauuuggguuguuuucacuuuuuggcuauucugaacauuuuacccccuccucuucaaagcugugcuuguauucaagacucuucugguugaauauauaaaaagaaaaauaaaaacaaauuaaaaaaauaaaauaaugggaugggcacaguggcucacaccuguaaucccagcacuuugagaggcugaggcgggaggaucacgaggucaggaguuugagaccagucugaccaacauggugaaaccccgucuuuacuaaaaauacaaacauuagccgggcaugguggcgcgagcccguaaucucagcuacucaggaggcugaggcagaagaaucacuugaacccgggaggcggagguugcagugagcugagaccacaccauugccuuccagccuggguaacagagugagacuccaucucaaaaauaaauaaauaaauaaauaaauaaauaauaaauaaaauaaaauagugaaaauaaugaauacugugcuugcugaugccuucaagacaaauauuuucuuuccugauauguacuuuuguauauuuuuuuguguugauggugcacucaccaugcuguauuauaacuaguuaaacuaucugcucaugggcuagcucucccucucuccccuacauucagauguaacauuugaugccaauucuugaauuuugucuguguauucccaauuucuucuauauugcuucacauaugguaagugcucgguaaaucuaugcugaugacaggaaaaucacagacuucauuacauuucuaggauguacaguuccaacagggcuauaaccagacuuuuuauagcuuggucauauugacuguuuuauuuggaguacagucuguuaguugcuuuuuaaaaauuuucugcauaugaauaccaggucauauguuaguugcuuuauuuuuuagacagaguuuugcucuuguugcccaggcuagaguuaauggcgcgaucucagcucacugaaaccuccacuuccuggguucaagcgauucuccugccucagccucucgaguagcugggauuacaggcaugcaccaucacaccuggcuaauuuuguauuuuuaguagagacgggguuucuccauguuucucaggcuggucuugaacuccugaccucagguaauccccccugccuuggccuccccaagugcugagauuacaggcgugaaccaccguccggcauuaguugcuuuuucaaaaaagaaagccuuuuugggccugguggcucacgccuguaaucccagcacuuugggaggccaaggugggaggauugccugagcccaggaguucgagaccagccuggucaacauagggagaaccuggcucugcaaagaacacaaaaauuagccaggugugguggugugcgccuguaguccuggcuucuugggcagcugaggugggaggauggcuugaggucgggaguuugaggcugcagugagccaugaucauguuacugcacuccaccuuggguggcagagugagacccugucacaauuuaaaaaaacacaugaggccaggugcgguggcucacuccuguaauccccgcacuuugagaggcugaggcaggcggaucaccugucaggaguucgagaccagccuggccaacauggcgaaaccccaugucuacuaaaaauacaaaaauuagcugggcgugguggcgcgcaccuccaaucccagcuacuugggaggcugaggcaggagaaucacuugaacacgggaggcggagguugcagugagccaagaguacaccacugcacuccagccugggcgacagagagagacuccauuucaaaaaaaaaaaaagaauaaaaauaaaaaagaaagcccauggucauaauaaacguacccugauaucauauaaacuuguuugauguaagcauggacuccugcuauucuauuguguguuuucuguuucaaugagauaauaucugaugggagguguauggagcugcuaauuauguuuucugugguuucuaucacugugauucuuuugaaauuucaaugauauuaauuauaugauuuaauuaaaauuuauucucuuauuuugucuuaggauucuguuauaauaauagauucaaguccuacugcuuuaaagcauccagagaaaaaucagaagaaacuucaguguuugaaugaugugcuaggaaaaaaacuuaacacauccacuaaaaauguaccugguaaucagaguuaauaauauuuaugauguauauuagaauguuuugggguuuuuguuuuguuuuguuuuuguguucugggguauuuauuuauuuauuuauuuauuuuugagacggagucucgcuuugucacucaggcuggagugcagcgccggcgggaucucggcucacugcagccuccaccuccuaaguucaagugauucuccugccucagccuccugaguagcugggacuacaggcacccaccaccaugcccggcuaauuuuuuguauuuuuaguagagacgggguuucaccauguuagccaggcuggucucgaacuccugaccuugugaucugccugucuuggcuucccaaagugcugggauuacaggcaugagccacugcacccggccuguguuuugggguauuauucugaacgugcuuaugauugaaauuuaguaucuuauguaaaauuuuaacuguauuauauuucuauuuuaguaaguaaaguuaugguauagugaagaguuuuucuuuuuuuuuuuuugugacagagucuugcucuacuaaaauacaaaaaauuagcuggguguggugguagguacccguaguuccagcuacucgggaggcugaggcaugagaaucacuugagcccuggagguggagguugcagugagccaagaucguggcacugcacuccagcuugggcuacagagugagacuccaucucaaaaaaaaaaaaaaaaaaaaaaaaagaaaguagcugaagguggagaugguaaacauugauacuaacccaaguauuuauuuuucuaaggaaaaaugaaagucgcuccuuuauuucuugucagaaaagcacaaaaagcagcugauccugucccuaguuuugaugaaagcaggucaguccaauacaaauuuuuaaaugccaaaauauuuuauagaauguauuuguauugauguguuuacuuugaugagaaagcaugugaauuaucauuugaagcucuaguaaguccaguuucaaaguugacaauauugacagugcugcaacugcuauuugaauaucuugguuuuuugcaagugcuuuggccaucgcuagacaaaacagaaaaauaagcaaaccaaaaauacaaaaaagcugauaaugaauuuuauucaguaaauauuuaaauaccuacuaguauguaccagguacuguuuuugguaucagagauauuauggggauaagacaggacacauucccuguccuccuguggcuuaaguggagauggaagauggucuaugauuaaacauucauugggucaacaaaugaaaaauugcaguugugcuaaggagagguauaauucauauugaggaggguuggucugauuaaagaagacuucaaugaggaaaugaugucugaacugaaaucugagggaugagcaggaguucaucaggaggaggaacuguguuucagccagagagaacugucuauguaaagucucuguagcuggaaggaacuugcuaaauaccaaaaacugauagaaugcuagugugacuagagcacagagaacaagggugagaggugggugccagccaauguaggaccuaggaggccauguuaagggauuuuaucauuauauuaagagcaaauaagaagcagccaaaggguuuuaaacauaaauauagaccuaaacagauuuggauuuuagaaguuuaauuggccugcuggauaaagaauggaauggaagagggguuagaguagauguaggaguccagguauugugagaugauggagguaaggacuagguuguugggaaugacauaugaaaagauuuuaggagaugaauuaaaaaucccucgaugauuaaugagauuugugggagugagagugugggagaggaagguauaggaugacauguaaguucuaguuuaugcgccuggguggcaugauggaaggucaggucuaggagcaacauggguuuagauuaucuuuuuuucuguucaaguuuuacugagguguaauuauauauuguuaagcacacauaucuuaaguaugcaguuuugacaagugcaucuuaucaagaaauaacaaucuucuuuuuagcucagaaagguuuugugugcucuuuccuauuauccccaccaccaccaucaccacaagauuaccaaaauauucgauuucuauuuccaucaauuaguuugauuucuauuaccauagauuaauugugucuauucuagaacaucacauaaacuucauauauauauuauuuugugucuggcugcuuuugcauaguauacacgcccacaaacaaaugcacacauacauauuuuuaaaucaacuucauucaguuauauuguccauauaauaauaugugcccauuuuaaguaaagaguuugagguuuuuuuuuuuuucuuuuuuuuuuuuagacggagucucacucugucacuaggcuggagugcaguggcgugaucucggcucacugcaaccucugccucccggguucaagcgauucuccugucuuagccuccugaguagcugggacuacaggcacgcaccaccaugcccagcuaauuuuuguauuuuuaguagagaugggguuucaccauguuggccaggauugucucgaucucuugaccuugugauccgccugccuuggccucccaaagugcugggauuauaggcgugagccaccguguccagccaacaguuugaauuuuucucucuuuuuuuuuuuuuuuugagacggaguuucgcucuuguugcccaggcuggagugcgauggugugauaucagcucaccgcaaccuccaccucccagguucaagugauucuucugccucagcuucccgaguagcugggauuacaggcaugugccaccacgccuggcuaauuuuguauuuuaguagagaugggguuuuuccauguuggucgggcuggucucuaacuccugaccucaggugaucuggcccccucagccucccauagugcugggauuacagguaugagccaccgugccuggcccacaguuugaguuuugacaaauguacauaccuguaauuaccaccacaauaaaaauauagaacauuuucaucacucucaaaaaaaagucuucuugugccucauugcaguuaauuucugcccaaucccaugcaaucucuuaucugcuuucuguugguauagacuaguuugccuuuucuagacucucauauaaaugaaauccugcaguagguauacuuuugucucuaguuucuuuggcaagguagcauaucaguugucuguucuuuuucguaguuaaguaguacucauaugaauaugccgcuauauauauauagagagagagagagagagagagagauggagucuugcacugucgcccaggcuggagugcaguggcgcgauguccgcucacuguaaccuccgcuuccuggguucaagcgauucuccugccucagacucccgaguagcugggauuacaggcauccgccaccacgccuggcuaauuuuuuguauuuuuaguagaaacgggguuucacuauguuggccaggcuggucuugaacuccugaccucgugauccgccugccucggccucccaaagugcugagauuacaggcaugagccacugugccuggccuacugcaauauuuuuuauuuauucuuuauuaaugggcauuuggguuauuuucaguauuuggcuauuauuaaauagacugcuaugaacauuuuuuuuuuuuuuuuuuuugagacagagucucacucugucgcccaggcuggagugcaguggcacagucuaggcucacuguaaccuccgccccccggguuuaugccauucuccugccucagccucccgaguagcugggacugcaggcgccugucaccacgccuggcuaauuuuuuuguauuuuuaguagagaugggguuucaccauguuagccaggauggucucgaucuccugaccucaugauccacccaccucggccucccaaagugcugggauuacaagcgcgagccaccgcgcuccgccugacugcuaugaacauucuuauacacauguauggacaaguguucucauuuuucuuggguaaauaaauaccuagaaguggaauugcucugucauuagggagguacauguuuaacauuauaagaaccuggcaaacuguugucccaaguuguuguucgguuuuacacucccaccagcaauguauaagcguucugguagcugccuaucuuugauaacacuuggcauuaucaggcuuuuuuuuuuuugagacggagucucacucugucauccccagacuggaguauaguggcgcaauuacagcuuacuguagccgugaccuccaagggucaggugaucgucccucccaccucagccucccaaguagcugggacuacaggcaugugccaccaugccccacuaauuuuuuguauuuuuuuuucuuugguagagacaggguuuugccauguugcccaggcuggucucaaacucuuggacucaggugaucuacccaccuuggccucccaaaguguugggauuacaggcgugagccacaaggcaaggucaauucuaucaauucaaaguguguauuuuggugagcuuugucaguuguacacccagugaaaccaccauaaucaagauaccaaguuauuuccauugccugccucagacuugucaugcucuuuuguagucuguucucuaaguggccccaacccaggcaaacgcuagucucuuuucuuuauacuaauuuauauuuucuagaauuuuauauuaaugaaaucauauaguauaugcucuuuugugucuggcuucuuguagguggcaugaugauuuugagauuuauucauguugucaaauauaucauuaguuuucuuuuucuuuucuuuuuuuguuuugagacagagucucgcucugucgcccagacuggaguacaguggcaugaucuuggcucacugcagucuccgccuuccggguucaagugauucuugugcaucagccuccugaguagcugggacgacaggccuacgccaccaugcucggcuaauuuuuguauuuuuuguagaggcaggguuucaccauguuggccagacugauuucgaauuccugaccuccagugaucugccugccucggccucccaaagugcuaggauuacaggugugagccaccgugccuggcuauauuuuugcucaguaguauucauuguauggauauaccacuuuuugucucuccauacaccuauuaauggacaucuggauuguuuccuuuugucuuuucccuccacuauaagagauggagucuugcuguguuucucagccuggccuugaacuccugggcucaagcaaucuuccuuccucagucuccugagcagcugggacucaaacgugcaccgcugcacccagcuguuugcaauuugaagcuauugggaauaaagcugcuaugaacauucauguauaagucuuuguguggauauacaucuucauuucucuuuuuaauuuuauauauuugaauggcuauguagucauaucucauaguuuuaauuuucauuuuucucaugucuacugauggugaacaucuugugauuauuggccuuuuguaugucuuccuuagggaaaucuuuugccccuuuucuuacugacuugucuuucuucuuguugaguugugaggauucuuuauauauucugacuacauguccucugucagauacauguuuugcaaauauauuaccuugccuuuuuauuuguugugucuuuugaaguacagaaguuugaugacguccaguuuauggguuugacaaaccuaacauuuaaaagacacaaagaaccuagaauagacaagauaaucuugaaaaagaagaaaaauuugaaggccucuacacuaccugauuucaagacauugaacaaaccuacaguaauagaaguguguuguauugguauaagaacagaaaaauaccagccugggcaccacugugggacuccaucucuuuaaaaaaguaaacaacuagccaggcauggugguguaugccuauaggcccagcuacuugggagucugagacaggaggaucacaugagccugggaggucauggcugcagugagcuguaaucaugccacugcacuccagcuuggguaacagagcaagaugcggucgcuaaaaaaaaauuuuuuuuuugcucuucuucaaaauuugaaaauauauaauaaauuuuuguuuauuauggugaccauauaguacuguagaacacuagaaguuauuccuccuaucuagcuauacuuuuauaucuguuaaccaaccucuggcuaugucucccucuccccuccccucucccaccucuauuaaccacuauucuacucucuacuucuaugagacuucuuuuuuuuuuuuuuuuaaaggcagcaacuugcucuguugcccaggcuggagugcaguggugugcucacagcucacugcagccucaaccuccuggguucaagugauccugccaucucagccccucaaauagcuggaaccacagaugugcaccaccauguccagcuaauuguuuuuuugguagagacaaguuguugcuguguuacccaggcuaagguuaacuuuuuuagucuccacauaagagugagaacaugggguauuuaucuuucuguguucagcuuauuucacuuaacguaauauccuccaagcucuaagacaucucuuacuagagguccuggauaguucaauuaggaaagaagaauauauaaaaggacauaaagguuuggaaggggagaaguaaaacuauccuuauuugcaaaucauauauuaaaaaaucauuauuuuaaagaaauuauuauuuauauuuauauauuuuuauauauauauauauauauauauauauauauauauauuuuuuuuuuuuuuuuuuuuuuuuuuuuuuuuugagauagagucuugcucugucagccaggcuggagugcaguggcacgaucucgacucacugcaaccucugccucccaggcucaagcaauucuccugccucagcaucccgaguagcugggauuacaggggugugccaccacaccccgcuaauuuuuuuuuguauuuuuaguagagaugggguuucaccauguuggccaggcuggucuugaacuccugaccucagguaauccaccugccucggccucccaaagugcugggauuauaggcgugagccaccgugccggucucuaaaaauauauauuuaaaaauucugagcugggugcgguggcucacaucuauaaucccagcacuuugggaggccaaggcguguggaucacgaggucagcagaucaagaccauccuggcuaacauggugaaaccccaucucuacuaaaaauacaaaaaauuagccaggcgugguggcgggcgccuguagucccagcuacuugggaggcugaggcaggagaauggcgugaaccugggagguggagcuuacagugagccgagaucccgccacugcacuccagccugggcaacagagcaagacucugucucaaaaaaaaaaaaaaaaaauccuaaggguaggccaggcauaguggcucacaccuguaaucccaacacucugggaggccgaguugggcagauugcuugagagcaggaggucaagggucaagacaggaggacugcuuuggagugcaauggcacuaucuuggcucacugcauccuccgccucccggguucaagugauuaucgugccuuagccucccaaguagcugggauuacagguaugcaccaccacaccuggcuaauuuuuguacucuuaguagagacgggguuuugccguguuggccaggcugucucaaacuccuggucucaaguuaucugcucgccucagccuucuaaagugcugggauuacaggcaugagcuaucuugccuggccucuuuugcuuuuuuaaaaauagagacuagaucuuacuauuuugcccaggcuggucuugaacuccuggcugggguuacaaaugugagccacccaccuggccaaaugccaaaaucuuguuucucaucaaaccugcaauuaugggccuuaauauugacgaauuccaauggaauuaaccacaugaugaugguuuccaaauggcaauucucuauugcagucauucuuucuuuguuaguuggcugcuauaagagcuuuuuugucuccucaguuuaucuauuuauucacuuauuucuucauuuuuauuauauucaguggauuguaauccauucauauuaguuauuuugaugcucaaauuguuuuuaauuuggccagugugagcucuucagcuugguuucuaugucccuuugacauguccucauaauuuauggagcauuucuuaauuucuggaacaggaagauauucuaggcuucuauuuuacuugccuugucucagcucugcaguuagccauuucucuguggaccccugguuccuuuucguggaggaugguauuuagagacgaaggucuagcauuaaauucauugcuccugauguggcagugcuucuaggccuuuucaguagauaaaguuaggauacuguguuugucuguuuugcauucccauaaacgaauaccuaagacucgguaauuuauagagaaaaagagguuuauuuggcucacagcucuguagauuguacaagcaugguuguacagcaucggcuuggcuguuagugaggccucaguaaucuucaacucauggcagaaggugaagggagagcaggccugucacauggcgagagaaguggcaagagagaggaggagguaccagccucuuuuaaacaaccaucucucgggugaacuaauagauggagaaguuacucauuacugugaggacagcaccaauccguucaugagggaucugcccccaugaccccaaacaccuaggccugccuccaacauuggagguuauauuucuuucuuuuuuuuuuuuuuugagacagaaucucccucucuugaccaggcuggagugcaauggcaugaucucgacucacugcaacuuccgccuccuagguuaaagcaauucucccugccucagccucccgaguagcugggauuacaggcgccugccaccacagccagcuaauuuuuguauuuuuaguagagaugggguuucgccauguuggccuggcuggucuugaacuccugaccucaggugaucuguccaucucagccucccaaagugcugggauuacaggcaugagccacugcgccuggccuguauuucaauaugaaauuuggaggggacacacauccaaaccauaccagcuauauauguauguauauguguacacacaaacauuuaaaacuauuuauauguguguaauauauguauaugcauguaauauauauguaauauaugauacauuauauauaauauguauauuuuuuauuaguaccuuguaccccucuccuuaacaccuaccuucugcuauagagacauacuaauuuaacuacaacuuuacccaucuuccuccuucccgccaauuaacaguuaaaaaaaauacacuucuucuuuucuaaaaaagaaaagagauaucucauuuaguaucuaucuggcuucauagcuuauuuucccuucauuucacucaaagaggaaaagaaaacagaaauacagaaaaaguuuuuguagucucuuuugaauuaccagcccaaauaucuaauugcacagaauauugugagucuuguucuuucuacaggcaggcuaggaaggacauauaagcugugacacaccaucuuccacuacuccaaccucccauucuccccacccuuuugccucugucccacuccugccacuguagucagccucccuaugauuugcaaucugaagauaaacugggcaaaacugagacaauaauaaggacccuacucuuccuccuguuacauugggaacaauauuacaucagaaguucuuguauuaacuuuuugaaauaugacagugauuuuuuuuuuuucugauuguuuagcaagaaaacaaaagacaagagggaaaaaacucaccuaccacccaaagauagccccuguuaacauuuugguggauguccuuuaagucacuuuuuucuauacauauuuauuuuuauuuaauuucuuaacauggguagacuuucauuuuugugaugagcaaaaaagaauuugaucagcuaauauuuuagguaauuuuauuaccuaaauguauuaaauaaauuuuaaaaauuaauauuugucaauaucuuauauaaaaucuaaaacaaaauuuuuauauaauuauauauaaauuauauaauuauauuuuauagauaaagcuaauauuuaagcauuuuauauuaauuaccuaauauauauuuuauauuuagguaaauuuauuaccuaaaauacuaauuuauugaauuuauuuaauacauuuuauuaaauuaauuuaaauuuuuuuuuuuuuuuuuuuugagauggagucucccucuuucacccaggcuggagugaaguggcaugaucucggcucccuguaaccucugcccccuggguuuaagccauucuccugccucagcauccugaguaggugggauuacaggcacccgccaccaugcccggcuaauuuuuguauuuuuaguagagauggcguuucgucauguuggccaggcuggucucaaacuccugaccucaggugauccacccuccucggccucccaaagugcugggauuacaggcgugagccaccaugcccugccaauuuauuuaauuuuuaaaaauuaaauuuaaagguguuucuucucuuuucugguuuuuguuuuguuuuguuuuguuuuguuuuuuguuauuuuuugagacagucucacucuguugcccagacuggaaggcuagauagaguacaguggcgcgauccugacucacugcaaccucugcuuuccaggcucaagugauucucgugccucagccacccaaguagcuuggauuacaggcauuugccaccacaccuggcuaauuuuuguauuuuuaguagagaugggguuucaccacguugaccaggcuggucuggaaauccuugccuuaagugauccgcccaccucugccucucaaaguacuuauauuacaggcaugagccaccaugcccagcccuaaaaauguuuauuuuccagauaguuuauuccuuuaaauguuuauaaccuuagcuuuucuuuuucaaaucauuuucuuaaaagucaagauacaucugaaaaaucucaggauugugauguucaauguaaagcaaagcgugacuuccuaaugagugguuugccagauuuguugaaacggcaaauugcaaagaaagcugcugcgcuggauguguacaaugcagugaguaccaguuuccagagagucguacaugugcaacaaaaggaugaugguaaguuuguuuuuuauuauugaauauuuacucuucagcuguuagcaggaacauuaaacuauguaaguuucuuaaagaugaggcugaaguuuaauuaucauucuuauggugacuuuagugggaauuuuaaggacaauuucucucacuauccaugggguuugauuccaggacccccuuguggauacuagcacucauggaugcucaaguuucuuguauaaaaugguguaggcuggguguggugucucaugccuguaaucccagaacuuugagaggacaaugcaggagaagagcuugagcccaggaguucgagaccagccugggcaacacagcaagauccugucucuaaacuagcuaacuaacuuaauuaauuaauuaauuaaaauuugcugggcaugacgguguaugccuguagucccagcuacucgggaggcugaggugggaggaucacuugagccuaggaggucaaggcugcagugagccaugaucaugccacugcauuccagccuaggugacagagcgagacccugucucaaaaaaagaaaaaaaaaaaaaaguuuagccuuucuucuguacgugggaauuucccagcuagucuuuucaguaauuuauucuacuuuuucuuauuucccaucucugccacuggccauucaguugaugaaggcuuucuuguuauuuuuacuaguacagcuuuauauagcauuuuccaauaguauguucaacuguagaaauuaguuaugcuuuucuugacucauuuugauaaacucauuuucacaggagugcugccauaaaacuuagcauaucuauuuguagaugagcagagaggcaagcacagagggaaccucucucucuuacaaccuucagaauuauugaacgcuuacuauugucuggaauucugcugagcaauucauauacauaucuaguuuaauccugauaacaacucuaagagguugaguauuauaauuaucacccucacuuugaauguaaggaugaagaaacuaagauuuaggaucucgccagugcucacaagguuaguaaguggcagagguuggguuugaauccaggucuaacuugaaaguuuagacuuuagaccagguugcuaacugccucuuaaaagguuuuuguuuguuuguuuguuuguuuugacagagucuugcuuuguugcccaggcuggagugcagugaugagaucucagcucacugcaaccucugucuccuggguucaagcaauucucuugccucagccuccugaguagcugggauugcuggucucgaacuccugaccucaagugauccaccugccuuggccucccaaagugcuggaauuacaggcgugagccaccacgccuggcccuccuaaaaguuuuaaccugaguaucaagguugauuugaaaagaaaggaaaguuuguuaauauuuguuuguuuuaaacaacuggaagggaagucuaggugauuuuuauuaauucuauuuguuggaggguaggauuuuguucccuuuauagucaugugguuuuugguauguuuguguuaauuauguaguugucaacuuuucauguuuacguauuugacauucaguaaauggauaguguauaaauaagguuuauuaagauauuugucuauuuuucuuuaggguguuguuuguggcauuugaaaccacccucuuguccucucuuaacuaaauuuaaagaacugaacacuaaaguaauagaucucucaaaaugugguauugcucuuggugaauuuucaacauugaauucaaaguugaaaagcgguaacucugcugcugugguaaguauuaaauaguucauccauuguagaguguuucccuuacaucuugcagaggaaaaacauuuuuggauaucuacucuuauagccucgaguguuguccuagaguuuaauuuuuuuuuuuuuugagacagagucucccucuguugcccaggcuggagugcaguggugcaaucuuggcucacugcaaccucugcuucccgaguucaagcaauucugccucagccucccgaguagcugggacuacaggcacacaccaccaugcccggcuaauuuuuguauuuuuaguagagacggaauuucuccauguuggucaggcuggucuugaacucccuacuucaggugauucccccgccucggccucacaaagugcugggguuacaggcguaagccacuguacccagccuaauauuuaaaaauaaauccuaauuguaguacacauuucuuuuaaauacccauagagcuuuaaaaacauuuuaagaauuaaugauugccaguucucaaagaauguuagauuacauagcacauuuagauacuuuauaaguaggucauauaaucuaauagauauaauuaguucaaagggagaaaaauaaauuaauucuucauaagcuuuauauuuagugacuaaagcuauuuuuuuuuuuuuuuugaguuggagucucacccuguugcccaggcuggaguacaguggcacgaucucggcucacugcaaccucugccucccggguucaagcgauccuccugccucagcucccccuaguagcuggaauuacaggcacacgccaccaugcccagcaaauuuuuguauuuuuaguagacacgggguuuugccauguuggcuaggcuggucucaaacuccuaacuucagaugauccaccugucucuuggccucccaaagugcugggaauauaggcgugagccaccacgcccggccuaaagcuaaucuuacguugauacugauuuaugauggacagaaagugguugguaguauuguaauuaacaugaauagaugauguuggucuguuauugugcauuuuauucuuuauugcaguucaugaggacaaggaaggaauuuacugaagaaguaagaaaucuuuugcuugaggaaauuagguggucaaauccugaauuuucauugaaaaaauauuuucccuuacuccuaaaaaaacaaauugagcaccaaguacuuucuuccgagugucauaguaaacaagguuagugauaauuauuaucauuuauguuaacauaccaguuuuggguuuuuauauuauuuauuauuuuauuuuuauuucugagacggaguuuugcucuugucgcccuggcuggagugcaguggcacaaaccuggcucacugcaaccucugcuuccuggguucaagugauucuccugccucagccuccugaguagcugggauuacaggcacccaccaugacgcccugcuaauuuuuguauuuuuaguagagaugggguuucaccauguuggccaggcucgucuugaacucuugaucucaggugauccaucuaccucagccccccaaaaugcugggauuacaggcaugagccacugcgcuuggccuauuuuuucuuuuuuuuuagaguguugcucugucacccaggcuggaaugcaguggugcaacuuugccucacugcaaccuucgccucccgggcucaagugauuccugugucucagccuccugaguagcugggaccacaggcuugcgccacugcaccuagcuuauuuuauuuuuuaauuuuuacuuauucucuugagacuggguuaugagacuggcuaguuuuuguauuuuugguagagaccaggucuugccauguugcccaggcuggucuugaacuccugggcucaagugauccuuucgccuuagcuucccaaagugcugggauuacaggcaugagucaccacgcccagccuaacgugucaguuuugaaaaacacuaagacuuaaccaaugacacuuggaaguguucaccacagacaacauugcuuacacuuggcagggagaauuguucagcugaaguaaaaguaucuuguacaaugcaaugugcaacauuaauccccgccaguuuccaaaaaugccaacucaaagauagcuuuaauuauguuaaaauauuauguacuuaaggaaugccuuagauaauuuuagcuuauauagcuuguauaaaagacagucuaaguauuaaaaucuccagcuugcuuucaguauguuauauuugauucuugccuuuuuauuuuauuuuauuuuauuuauuuuuugagacagagucuugcucugacacccaggcugaagugcaguggcgcgaucucagcucagugcaaccucugccucccagauuugagugauucuggugucucagccugccuaguagcugagauugcaggcaccugccaccaugccuuucuaauuuuuguauuuuuuaguagagaugggguuucaccauguuggucaggcuggucucgaccuccugaccucaagugauucacucgccucagccucccaaauugcugggauuauaggcaugagccaccauaccuggccuauuuauuuauuuuuuaagagacacggucucacuuuguugcccaggcuagaauacaguuuguuuguuuguuuauuuauuuuuauuuuuugagacggcgucuugcucugccgcccaggcaguggugugaucucggcucacugcagccucagccuucuagguuccaccgauucuccugcuucugccuccuagguagcugagauuacaggcacacgccaccaugccuggcuaauuuuuguauuuuuaguagagaugggguuucaacauguuggccaggcuggucuugaacuccugaccucaggugauccacccaccuuggccucccaaagugcugggauuacaggugugagccaccgcgccuggccuauuuauuuauuuuuuaagagacagggucucacuuugucgcccaggcuagaguacagugguguuuucauggcucccugcagccucgaucucccggguucaugugauccucccaccucagccucccaaguagcugggacuacaggugcaugccaccaccccuggcugauuuuuguaucuuuaguagagauggaguuuccccauguuaccgaggcuggucuuaaacgcguagacucaagcaauccgcucaccucaaccucccaaaguucugggauuagaggccugagccacugcaccuggauugccuuugcauuuuaaaguuacaagacuauuggauacuuggaagugauauuaauauuacugguuuuuguugauuaguaagcacaugcacuucuuuaauucccaaagcagaacuggaggcugaugucagccauaaagaaaccaaaaggaaacucguagaagcagaaaauucuaagucaaaaagaaagaaaccaaaugaguauucaaaaaaucuggagaagaccaauaggaagucagaagaacuuagcaaaagaaacaacucuucugggauaaagcuagauucuuccaaagguauauuuucuaaaacaucccaaaagaaauagauugcuuugaggacaugcaaaguggaaaccaaagcaguagaagauuuugauaugcuuuuuaaaaaauuuuaauucaauuguauuuuaauuuuagauuuucuuuuucuuuuuugagacacaguuucucucuugucacccaggcuggagugcaauggcacgaucuucgcucacugcaacgucccuccaccuccuggguucaggugauucuccugcuucagccucccggguagcugggauuacaggcacccaccugcacgcccagauaauuuuuuuuuuuuuuugagauggagucuugcacggucgcccgggcuggagcccaccaucaugcccagcuaacuuuuuguauuuuuaguagagacggaauuggccaggcuggucucgaacuccugaccgcauuauucacccaccucggccucccaaagugcugggauuacaggugugagccaccgugccuggccacgcccagguaauuuuuauauuuuuaguagagacagaguuuuaccauguuggccaggcuggucucaaacuccugaccucaggugauccaccccccaccccccuccccgcccuuggccucccaaagugcagauuuugauauucuaauagaugaugacagucugcaccagaaauauuaacaucuuccauuccugguaaauucgaguuuuuccuucuaguccuagaacucuuuuuguuuuuuaacuuuucauucuuucuccuucucucucuuuuuuuuuucuuuugcucauugcaacuuucaaacaauaaauauguguuugaaauaaauagaaccucacggauuaugggcuuacaaaugaccauauuaacagauagguguucagucuuugauuuuucugugcuuccauaaauacaugugcuuuuauuuuuuuauuuuuuauuuuuugagacagcaucucucuccgucgcuugccugaucucagcucacugcaaccucugccucccggguucaagugauucuccugccucagccuccucaguagcugggacuacaggcgcacgccaccacgcccagcuaaauuuuguauuuucaguagagacaggguuucacugugugguccgggcaggucuugaacuccugaccucaaaugaucugcccacuuuggccucccaaagugcugggauuacaggcaugagccacugcacccggccaauauaugugcuuuaaaaaaaaucugguauugugcucgcuuuggcagcacauauacuaaaauuggaaugauacagagaaaauuagcauggccccuugugcaaagaugacaauuuuuuuuuuuuuuuugguauuuuuaguagagaugggguuucgccauguuggccaggcuggccucaaacugaccucaagugaagggaugacaauuuuaaaauuaaaaaguaaaaaaaaaaguaacacaguguccgggcauaguggcucauaacuguaaucccagcacuuugggaggccgagguggguggaucaccugcagucaggaguuugagaccagccugccaacauggcaaaacccugucucuacuaaaaauacaaaaauuaaccaggugugguggugcgugccuguaaucccagcuacuugggaggccgaggcaggagaaucgcuugaaccugggaggcggaggcugcagugagccaagaucucgccacugcacuccagcccaggagacagagcaagacuccgucuagggggcaaaaaaaaagguaacaaaguugaaaaaaaaauauggucuuaucccauacauacuauuuuacaccauguuuuacauaucucugacauguucucauucaguuuauuuauuuacuuuuuuugagacaguuuugcucuuuuugcuuaggcugcagugccauggcaugaucuuggcucauuguugcaaccucugccucccggauucaagcgauucuccugccucagccucccgaguaacugggauuauaggcaugugccaccacgcccggcuaauucuguauuuuuaguagagacuggguuucuccauguuggucaggcugguuuugaacucccaaccucagguuauccacccgccuuggccucccaaagugcugggauuacaggcaugagccaccgugcccagccccauucaguauauauagcuuuuccaaaguaugcuauugauuuauucauuuauauagcuuuauacaggaugaauaucccuaauccaaaaaucugaaauuugaaaugcuccaaaauccaaaacauuuugagugcugacauggugcccuaaguggaaaauuccauaccuggggccaggcaccauggcucaucccuauaaucccagcacuuugagaggccgaggugggagcauugcuugagccuaggaguuugaggccaggcugagcaacacagggagaccacaccuuuaccaaaaaaaaaagaaaaaaaaauuggcuaggcaugguggcacaugccuguagucucagcuccacaggaggcugaugugagaggaucacuugagguuaaggcugcagugagccaugauugcaccacuacuccaggcuggguaacagagcaagacccugucucaagaaaaaaagaaaauuccacaucuaaccucuggucauagucaaaaugcccaggcuggacugugguagcaugaucuggacucacugcagccuccaccuccugaguucaagcgauucuucugccucagccuccugaguagcugggauuacaggagcccaccaccaugcucggcuacuuuauguauuuuuuuuuuuuuugagacagagucucacucuguugcccaugcuggagugcaguggcgcgaucucggcucacugcaagcuccgccuccuggguucguaccauccuccugccucagcuuccugaguagcugggacuacagguacaugcugccacgccuggcuaauuuuuuguauuuuuaguagagaugggguuucaccguguuagccaggauggucuugaucuccugaccuugugauccacccuccucagccuccgaaaaugcugggauuacaggcgugagccaccgcguccggcuuuuuuuuuuuuuuuuuugagacaaagucucgcucugucacccagguuggaguguaguggcacaaucucggcucacugcaaccuccaccucccagguucaagcuauucuccugccucagccucuuuaguagcugggacuacaggcgugugccaccacgccuggcuaauuuuuauauuuuuaguagugacgggguuucaccguguuggccaggcuggucucgaacuccugaccucaagugauccucccaccucggccucccaaagugcugggauuacagaugugaaccaccgagcccggccuacuuuuuguauuuuuaguagagaugggguuucaccauguuggccaggcuggucucgaacuccugaucucaagugaucugcccgccucggccucccaaagugcugggauuacaggcaugagccacugcacccaucccgauuauugguuuuaugccacaaauuauuucucaucauucauguuucuucagugguuauuaaaaauuuaaauauugcuguuugugguggcucacaucuguagucccaccuacucaggaggcugaggugggagcuugagucuggaaguucaggaaugcagggagcuguguuugugcuugugaauagccacugcaguccagccugggcagcauagcaagaccucaucucuuaaaaaaagaaaaaaacuauuuauuuuuaauuuucaacucaaggggcacauaugcagguuuguuacauggauacauuccaugaugcugagauuuggacuucaauugaaccugucacccaaauagugaacauacugcccaauagauaguuuuucaacccuuguccucacuucuucccuccucccuuuuguaguccccagugucuuuuuuguuguuguuaagagacagggucacacuauguugcccaggccaaucccgaucucuuggguucaagugaucuaccugccuuggccuuccaaagugcugggauuauaagugugagccaccacauguggccuccagugucuuuuguucccaucuuuauguccauguguacccaguguuuagguucagcuuauaaaggagaacaugcauuauuugguuuucuguuucugcauuuauucacuuaggauaauagccuccagcugcaaccauguugcugcaaaggauaugauuuuuuucuuuuuuauggcugcauacuaucccaugguguauauauguccuacaaauucuuuauccaauccaccauuuuugggcacuuagguugauuccauuuuugcuuuuuuuuuuuuugagauggacugucacucuguugcucaggcuggagugcaguggcacaauccuggcucacugcaaccuccgucucccagguucagucucuuugcuguucuaaauauaaacaugugaguacaugugucuuuuugguagaacaguuuauuuuccuuuggguauauacccaguaaugugauugcugggccagaugguaauccuaaaaaaaaaaaaaccaauguuuaagugugcacuuuaauuuuuuuuuuuuuuuuugagacggagucucgcucugucgcccaggcuagagugcaguggcgcgaucuccgcucauugcaagcuccgccucccggguucacaccauucuccugccucagccucccgaguagcugggacuacaggcccccgccaccacgcccggcuaauuuuuuguacuuuuaguagagacgggguuucaccguguuagccaggaugguaucgaucuccugaccucgugauccgcccaccucagccucccaaagugcugggauuacaggcgugaaccaccgcgccuggcuaacacuuuaauauuuuaauaagauuauggugguuauuuuuuuuuagggggaaggguuuggugugaagaauuuuaaauguaauguuguuuuaaaaguaccucuggcauuuuguaaauauaaauauuucugcaaauaccuacugugacauuguaacaauaauguaaaugacuaauaauucauauauguuuaugucaaggaaugaauaccuuaauuuuuuuuuuuuuugcuuuagauucuggaacugaagacaugcuuuggacagaaaaguaucaaccucagacugccagugaacuuauaggaaaugaguuagcuauaaaaaaguuacauagguugguaaaauguguaaggaauugagaaauaguuuacaaacuuaguuuuacuguuuuuguuucgaaauuguaguuacaaaguaauauaucucaugauaaaaucuucaaaaaacugguagaaguuuaagugaaaaguagcccucuuuucuuacauuucuacuucucagagauaaucauugaaaauuuuuuguaaaagcuuccagaaaaauauuuuuaugcauauguuaguuccuuccuuucuaacaaaugggaucacauuacuacuaauucagguccccaguccuucaucuucaauucucacauccaaaaaauucugaauaaugaaaguuuauugacuuuauuacaugaaauuuguuacaccuuuacacuuaguagaauuuacaaauuuuuuuuuuuuuuuuuuuuuuuuuuuuucaagacagagucucacucuguugccuaggcuggaguguaauggcacgaucuuggcucacuacagucgcugccucccagguucaacagauucuccugccucagccuccugaguagcugggacuacaggggugcaccgccaugccaggcuaauuuuuguauuuuugguagagacaguuucgccauguuggccaggcuggucucaaacuccugaccucaggugguccacccgccuuggccuccuaaagugcugggauuacaggugugagccacugcacuuggccagaauucauauauuuuuuaauaaaaauauuaagugauggcccagugcaguggcucacaccuguaaucccagcacuuugggaagcugaggcgggcagaucacuugaggcugggaguucgagaccagccuggccaacauggugaaaccccaucucuacuaaaaauacaaaaauuagcuggguguggugaugcacgccuguaauccuggcuacuggagaggcugaggcaugagaaucgccugaacccgggaggugaggauugcagcgagccgaggucgugccagugcacuccagccugggcaacagaguaagacucugucccaaaacaaagcaaaaaaacaaaccaaaccaacuuaaaugauuauggguguacugccuagaccccauuagggguauuauguaauaugcaguauauguaccaaauaaccuuuuaaguaucugaaaaauuaauucuaaaacaaucugguccaaaggauuucauauaaggauuuacggacccauaauuacaguuaauagcgugaacuugguacuacuguucuaaguacuuguauuguuccuucuuucuuuuuuuuuuuuuuacuuguacuguucuuaauucauuuuauccuuagaaugguacugugagcaguggguacaguggcucaagccuguaaucccagugcuuucguaagcugaggcagaaggacugcuuguggccaggaguuugagagcagccugggugaaauagggagaccccaucucuacaaaaaauaaaaaaaauagcugggaaugauggcgcccacuuggauucugagccacucaggagccugaggugggagggucacaugaguccaaggauucgaggcugcagugagcuaugaucgcaccccuacacuccagugacaaagcaagacugucucaaaaaaagaaaaauacuaugagcauaaauacuguuguccucaucucauagaugaagaaaccaaggccuagagaggcugaguuauuuguccaaagucacacagcuagaaagugauggaacugggauuuaaacucaggcauucuagcucuagacuagaacuuaaucuuucuguuguacauuguauauuaggcaucuuucauggaauuacacaacauaccgcaguucuuuuuuuuuauuuugaaacagggucuugcucuguugcccaggcuggagugcagugguugaaucuuggcucacugcaaccuucgccucucaggcucaagccauccucccaccugagccucccaagucgcugggacuacaggugugcaccaacaugccuggcuaauguuuuuuguagagacagguuucgcuguguugcccaggcugguugcaaauuccugggcugaagcaauucaccugccuccgccuuccaaagugcugggauuacaggccugagccacugugccugcccugccaccucaguucuuuuuaauugcuguauaccaguuucuaagugaguguacuauaauguauuuuucccaaugguguauuuuuauguuuuuccuguuagaggcuaauaugaacaaugcuacagugaauauucuuacacauauagucuuguauauuuuggcagaaacuacuucauuuaaaaauguucauguccauguaaaacuauuuuacucuuuaguugauucacaagcacuguggaguguuuagaaacuaacaauaugccauauaaagcuguacuaguaaaaauaacaagaaagccuucaucaguugaauggccaguggcagagaaacuaacaauaugccauaacuucccccgauaaucauuuuaacauaaagucuaaggcauagcuauauucugugaauuauuuuuauuauguuuucuuguggcaguugguugaaagacuggaaaagaagagcugaauuggaagaaaggcagaaucugaagggaaaaagagaugagaaacaugaagguauuuugugugucuuuuuuuuuuuuuuuaccauuucacugaacauuuuuagaguuacauuaacuaaaacuuucuauaaaauuucuuuuuuuuuuaauuuuuuuuuuuuuuuggagacagagucuugcucuguuucccauaguggagugcaguggcgcaaucucggcucacugcuaccuccgccucccgggucaagugauucucaugccucagccuccugaguagcugggauuacaggcgccugccgccacgcccgacuaauuuuuguauuuuuaguagagaugggguuucaccaucuuggccaggcuggucuugaacuccugaccucgugauccacccaccuuggccucccaaagugcugggauuaagcaguggcaugagccacugcaccuggccuauaaaauuucuuaauugguauuuuauauuugauuuucuacuuuuuuuuuuuuuuuuucacucugucacccaggcuggagugcaauggugugaucucggcuaacugcaaccuccaccuccuggguucaagugauucucccaucucagccuaccgaguaccugggacuacaggcaugugucaccacaccuggcuaauuuuuguauuuuuaguagagaugggguuuggccaggcuggucucgaacuccugaccuugugaucugcccgccucagcuucccaaagugcugggauuacaggcaugugccacugcguccggccuguauaaaguaauuuuucagcaucuauugcaagaaguuugugggauuugaucacuggguuucauaagguagaauugcuuccucagcaauugucauuuuauaugcauuugaauaauuuuucagauuucucggguggcauagacuuuaaaggcaguucagaugaugaagaagagagucgucuuugcaauacuguccuuauaacagggccaacaggagugggaaaaacugcugcaguguaugcuugugcccaggagcuuggauuuaagguuaguaacagcuaugaugagagaauguuaauguaauaauuacccuuggauuaaaaggaaacauaaaccauucucccuucguuuuuucuuauauucuucuuuuagauauuugaagugaaugccucuucccagcgcagugguagacaaauucuaucucaguugaaggaagcuacucagucccaucaaguagacaaacaagguguaaacucacaaaaacccuguuuuuuuaauagcuacuacauaggcaagucaccaaguaaguaaacuauuuuccuuaagccauaauguuuugaaaaaaauaaaaucuaagaaaguaauguuaauuaucagcauuuugccauuuauuuuuuaucuucuacacguacacguuuccugcccaccccugccagauuauuuuaaaacaaaucugaagaccaucauaucauuucacccauaccuucuucaauauuuaucucuaucugauaaggacuuuuaaaaaagcauaacuauaauaucguaaucagacccaacagaguuaacaaccagccuaagcagcauagcgagaccuugucucuacaaauaauaaaaaaaaaaaguagcuagguguggugguguaugccuguagucccagcuacucuggaaguugaugugggagguucacuugagccuagaagguugaggcugcagugagcugugauugggccacugcacuccagccugggugacagagugagaucccaucuccaaaaaaaaagaucuauuaacuauauuucuucauauaaucucauacacagucuaaugucaauuuucuguuguuucaaaugauuuguucaaaucuggauccaaacaagguucauaucuuacauuugauucaguucucuuaacuuucuuuuaaucucgcuaacaauucacucaccuuucuuuucaugucauuaauuuguugaagaaucugagucauuugucaugaaauucuucacauucuggauuugucugcugauuauauccucauggugucaguuaguauaguccucuucccuauauuucuuguaaacuggcaguuagaucuaugggccuuauuagauucagguucuguucugggucuggcauacauauacagguggccuguguacuuccuaugacaucauagcagauuaucccuuguagauuacaaaaugauaauuuuauaauucucuuuuuugcauuuauuagaauuuuaaaaggaagcacuauuccucaucaacucuuuggaugcuuuggaauacaguuuauaggcaccagaaaugcuucauucauuccuuuauuuauuaguacuuagagugaugguguccuagcaaccuugacaguugaccagugaguuuuuguguaguuuaauuuuuuaaguauuauuaugaacucauggauuuuuauauauauaauauguuucaccucuuuguguuuauuauuucuuuguugcuuuggagauuuucucacugguuuuaaguaauuugauuaugaugugccuugguguacuucucuucauguuucuugugcuugggauuuguugaguuucuugcauauaugaguuuauaguugggaagaucaaaguugauaaaauuucaaccaguauuucuuaaaauauuuuuucuguccuccccuuuuccuuuggcaacuccaguuauuauuauagguauuuuagaccacuugaaauugucuccuggcacacugaugcuuuguucaauuuuucagucuuuuuccucuuuuuguuucaguuugguuaguuguuauuacuauucaaguuuacacaucuuuucuguaguaucuaguaugcugucacugcuauaaguauaguuuucauuucuagaaguuugauuuggguccuuuuuauaucuucuguguuucuacuuaccaugugcccagucuuuccuguagguuuuugaacauauggaauacaguuauaacaacuguuuuaauggucuugguuauuaauucuaucaucuguguaauuuuuguuuuuuugaaacggagucucgcacuugucgcccaggcuggagugcaguggcacaaucuuggcucgcugcaaccuccaccucccagguucaagcaauucuccugccucagccucccgaguagcugggauuauaggcaaccgccaccacgcccagcuaauguuuuuguauuuuuaauagagacaggguuugaccauauuggccaggcuggucucaaacuccugaccucaggugauccaccccccauggccucccaaagugcugagauuacaggcaucagccaccacgccuggcccaucugugucauuucugaguuguuuuuucaauugauugauuauucccucuuucauuauggauuguauuuuucugauucuuuggaugccugauaauucugauugcaugucagacuuuguagaguuugccuucuugggugcuggauauuuauguauuccugacuguucuuuuuuuucuaaauuuaucaauccugcacuuuuuguaccuauaacuguucguuaacuuucuucugugaugugguuaaguuaguugggaaaaguuuaucuucaggucuuguguauguguuuguuuuugagacagucucaaucuguugccaaggcuggaguggaguggcacgauuaugguucccugccaccucgaagugggcuugggcaaucccccaaccuuagccuuuugaguagcuaggacuacagaccaccgcacucagcuaauuaaaagaaauuuuuuuuuguagagggggucuugcuguguugucaggcuagucucaaacuccuggccuccagcagucuuccugccuuggccucccguagugcuaggauuacaagugugagccgucaccacgcccagcuuuuucaggucuuuuaaacuguaguaggcaaaaaaguagcagcauuuagucuagggcuaauuuugccccacuccuuaggcaaaaccuuucugagugcuucaauauuccauuaguuauguuugccagucuaccugaugggaagacgaaucauucacagcucucugugagccucagagauuguuuccucugaucuuucacugaugaguacucaauuuuagacuugagagggacucugcaaauuuccagagcuuugcccagcuguuucuucuguauucuuccccacaucucugucugcuuggccuccucagguuucuuuuucuuuuuuuuuuucuuuuuucuuuuuuuuuuucuuuuuuugagacggagucucacacuguugccugggcuagagugcaguggugcgaucuuggugcacugcaagcucugccucccagguucaagugaucuuccugccucagccucuuaaguagcugggauuacaggcgcucgccaucacgcacagcuaauuuuuuuguauuuuuaguagagacaggguuucacuauguuggccaggcuggucucaaauuccugaccuugugaucugcccgccucggucucccagagugcugggauuacaggcaugagcuacugcacccagccaaccuccucagguuucuagugcagucucaacucagaaaacauggauugacuuuccccucacuauggaaauuuucucagggcaauaggcugggcaauccuaguguucaccuuauuuguuuuuauaucucagagauuacuguccauuguugcaucaugacaaaagucuugaaaaguguuauuucauauauuauguccaguuuucuuguucuuauuuaugaugggaggauaaauccagugccaguucuauaccuugacuagaagcagaaucccaucuuauuuucuuuuggugcucauauuuuuccaucuuugacuagcaaggaacuauuuuaauugguuuguguccuuuugacauuaccccagcaauaguugauauuuuacuugcuuucuggcaugucaggaugucccagaccuacaguuagcuguuucugcaagaagguaguucuuuuggugugaaauuucuuuuucuuuuuuuuuuuuuuuugagacggagucuugcucugucacgaggcuggagugcaguggugugaucuuggcucacugcaaccuccgucucccagguucaagugauucucaugccucagccuccugaguagcugagacuacaggugugcgccaccaugccuggcuaauauuuguguuuuuaguagagacacgguuucaccauguuggcuaggcuggucucgaacuccuaaccucaggugauccaucugccuuggauucuugaagugcugggauuacaggcgugagccacugugccuggccaauuuuuuuagaaagaauauauugauauaguuuagccagcuacucacagaguaucuuaaaauaaaaauugccuuuuuuuuuuuuuuuuugaaaagacggggucuuccucuguugccaagguuggauugcagugaugcaaucauagcucauugcaaacuugaacuccugggcucagaugauccuccugcuuuagccucccagagugcugggauugcagguaugugccacugcacuuggcuaagcauguauuuuuaaaaccagucuuugggccggguacagugggucaugccuguaaucccagcacuaugggaggcugaggcagguggaucacaaggucaggaguucaagaccagccuggccaacauggugaaaugccaucucuacuaaaaauagaaaaauuagccaggugugguggugcacaccuguaaucccagcuacuugggagacugaggcaggagaauugcuugaacuugggagguggagguuacagugagcugagauugugccacugcacuccagccugggcgacagugugagacuccgucucagaaaaaauaaauaaauaaaaccagucuuuggacugguauucauacaugaucaagcaguccuuggucuauaucaaaauaagaaaaauaaggacaaaggccaggcacgguggcucaugccuguaaucccagcacuuugggaggcugaggugggcggaucacgaggucaggagauugagaccauccuggccaauauguugaaaucccgucucuacuaaaaauacaaaaauuagcugggcaugguggcgugugcuuguaaucccagcuacucgggaggcugaggcaggagaauuacuugaacccggaaggcagagguugcagugagcugagauugugucacugcacuccagccuggugacagagugagacuccaucucaaaagaaacaaaaaaaaaaaaaaaaagaggaaaaaaugguguuuuuuauaaauugauaucuguucaacuauuuauuuauuuauuuauuuauuuauuuauuuauuuauuugagauggagucuuggucugucgcccaggcagcagugcaguggagcgaucucagcucacugcaaccuccaccucccagguucaagugauucuccugccucagccucccgaguagcugggauuacaggcaccugccaccauccccagcuaauuuuuguauuuuuaguagagacacgguuucaccauguuggccaggcuggucucaaacuucugaccuugugaucugccugccuuggccccccaaagugcugagauuacaggcgugagccacugugcccugccaaauauuuuuauauuuuaagauauugcaucucuuaccugugguguugaaauguucuauauuuuugaaaugauggucaugucugugacagcuuuuuuaaccucgagauuuucaguaagcuuauugaacaccucuaauauacaagggcuaugauaagaucuauggagauagaggguagaaaaaaagaauaggacacagauauggaacugugaucaugagaugguaugugaggaagauccuguucugaggccauacaguaauuaggauuuguaaggacuaaauccagguaccuagaggggaagagaggauguauuauguggaaaaaugccauggggcuuuuggagaauagaggugaacuauuuauuuuuuaacuucguaucuaucuuccaaagcaucucuaaaaauacauuuuauuggcuugcaauauuaauuuacugcaggucuaaauuaaaguugaacaacaaaguucuguaaugugcucaguguauacuguuauuuucccuccacccucuucuuucuuuaagcagguguagaaaaaaaugaacagagguacugugaacaguauuuguuguaagaauguguauuucuggcuggguacaggggcccacgcuuguaauccuagcacuuuaggaggcugaggcaggcggaucgcuugagcucaggaguuugagaccagccuggacaacauggcaaaacccaucucuacuaaaaauacaaacgauuagccaggcgugguggugugcuccuguagucccagcuacuuggggggcugggcaggaggaucacuugagccugggagguggaaacugcagugagcugagaucauaccacuucacuccagccugggugacaaagugagacccugacucaaaaaaaaaaaaaaauguguguuucuuuggaguagagugucuuuucuaaaugacuggcuuggccgugugcgguggcucaugccuguaauccgagcacuuugggaggccgaggcggguagaucacgaggucaggagaucgagaccauccuggcuaacacggugaaaccccgucucuacuaaauauacaaaaaauuagcugggcgugguggcgagugccuguagucccagcuacucgggaggcugaggcaggagaauggcgugaacccaggagguggagcuuguagugagccgagaucaugccacugcacuccagccugggcgacggagcgagacccugucucaaaaaaauaaaauaaaauaaaauaaaauaaauaaaugacuggcuuaaccuucuguacugguagaauaaauaaauauaguaauauuuggauguacauaguauuuuuaagaaugaaagaaaauuucugugucuuugauuuuuaacuguuaagaguagaaauacagaauguggcuaacugucuugcuaccuguaugauuuuuagaauauuuaucuuuaagugcaauuuguuuuugggcagaaaaaauaagcuccccuaagaaaguuguuacaucaccaagaaaaguuccuccaccaucaccaaaaaguaguggaccaaagcgagcacuuccucccaaaaccuuggcaaauuauuuuaaaguaucucccaaaccuaaaaauaaugaagaaauaggaaugcuucuggaaaauaauaaagguaagacauuaaauugacaaauuuuauauuuuuuaauaauaaugacccuuauaccuaaaaaugugagcacauuuuacgaguuccuguugcuauuuauuaaaucucagcuacacugaagguucuacauguagaaguguuaauauuuuguuuccuuuuuuuuuuuuuuuuuuuuuuuuuuuugagacagagucuugcucuauugccaggccaagcuggagugcaguggcacaauuuuggcucacugcaaccucuuccuccuggguucaagcaauucuucugccucagccucccgaguagcugggauuacuggugcacaccaccacucccagcuaauuuuuguauuuuuaguagagacgggguuuugccauauuguucagacugguuuugaacuccugaccucaagugauccacccaccuuagcaucccaaagugcugggauuacagauaugagccaccacgcccagcuuguuucaguuuuuguuuguuugagacagucucacucuuucauccaggcuggaaugcaguggcgcaaucuuggcucacugcaaccuccgccuccuggguucaagugaugcuccugccucagccucccguguagcugagauuacaggugugugccaccacacccagcuaauuuuuguauuuuuaguagaguugggauuucgccauguuggucucgaaacccugaccucaggugauccacuugccucggccucccaaagugcugggauuacaggcaugagccaccgcgcccguccuguuucaguuuugauaauggauuucaguuugagcuuauucuguggacauauccaaugucuuagcaaaaguugauuuuaccuaaaauauuaauauuguauuuaugcaggaauaaaaaauucuuuugaacagaaacaaauuacucagacuaaaucuacaaaugcaacuaauucaaaugucaaagacguuggagcugaagaacccagcagaaaaaaugcaacaucucuuauucuuuuugaggagguaggcuuauagaaguauacauuugugagagcucaugauaaagacuuacuuuaaagaauacuguauguuuucuuauaaagaauuguaaaauagcuaaggaggucaggaauacguguaucuauuugaaauuaaagcaaauuaaacuguccacucuagaauaauuuuucaggaagaugauuaauguaauucacggcugcuaauuauuguuaaaugauuguauaaauuauucugauccauaucugucuaguuauagguggcugcguuuguuuuuaacauuugauaguugauaauuuuaaaauucauuauaguguaugacauaaacuuucaacaugagcugaauucacacuucauaaauucauaaauuuugucucuaacagacauagaauauuuacuauguauacauaacugauauuaguaaguguauuaauauauuaauauucuaauaaacuguagguugauguaauuuuugaugaagaugcuggguuuuugaaugcaaucaaaacauucauggcaacaacuaaacgaccuguaauccuuacuacaagugguagguaacaaugauuuuacuucaguuaaacaguuacucaaaucuguaguucaucugcagacuggaguaauuauaauuaacucacaaauagcaauuacuuuuuuaaaauugauacuacuuuggguuacuauguuggguauuagauauuuaggaauuggagaacaaucucuagaaugcaaauaagaaaucuaguaaugguauuuugguagggaaaauacuagauucuucuccugguguccuuaucauaccuauaaucagaucacuaaaucugauuuaguggucaggauuuuuuauggaacccaaccuuucugcuguuccuuaauccugaacuuagccacucuuuugccccugauaacacuuucuuaugaauuauuguauauuuagcuaucaucagccuaauagaauugauccaucuucuaaagaauuaucacagaauguuucauuuuaaaaacucauucaauuucuuuuucaaaaaauuggaaauacuauaauaauuuucuaauauuuuuccaauuauaaauauucaugaggcuagucucuacuuacaaauuaaugcccauuugguagugauuguacucuuaaaauauugagaaaaaucuuauuaaucagaaguuaggugguguuuuuuuuuuuuuuuuuuuuuuuuuuuuuuggagacagagucucacucuguugcccaggcuggagugcaaugguaccaucuuggcucacugcaaccucugccuccugaguucaagugauucuccugucucagccuccugaguagcugggacuacaggcacacaccaccacgcccagcuaauuuuuguauuuuuaguagagacaggguuucaccauauuggucaggcuggucucgaacuccugaccucaugugauccaccugccucggccucccaaagugcugggaucauaggcaugaggcacugugcccagcugguaguuuuauuagaagaucauaguuggccaggugugguggcucaugccuuuaauuccagcacuuugggaggcuaaggugggcacuugaaccugggaguuuugagaucagccugggcacuauagugagacccccaucucuacaaaaaaacuuaaaaauuaucugggcauggcagcuugagcuuauaauccuagcugcuugggaagcugaggcagaggaucacuugagcccaggaguuugaggcugcagugagcuaugacugcaccacagcacuaggcagugguggggaggcgggugcugaauauuuucauagaaaaguauaacuugaaaaaguuauuuauuggucuuaguguuuaagaauuuuuuuuuuuuguguguguguguguguguagacccaacauuuaguuuaauguuugauggcugcuuugaagaaaucaaguucaguacuccuucccugguaaguuuuaaauuuugauagccacaaauuacauaucaccaucauguaaaaguaguuuauuauuaaauacagcuauaauuuuuuuuuuuuuuugagacggagucuugcucugucgcccaggcuggagugcaguggcgcgaucuuggcucacugcaagcuccgcuucccggguucacgccauucuccugccucagccuccgaaguagcugggacuacaggcgccugccaccacgcccggcuaauuuuuuguauuuuuaguagagacggaguuucaccauuuuagccaggauggucuugauuuccugaccuugugaucugcccgccucggccucccaaagugcugggauuacaggcgugagccacugcgcccgguccaauacagcuauaauuuagccaggugugguaucacgccuguacucccagcuacuugggaggcugaggcaggaagaucacuugagcccaggagguggagguuacagugagcugaaauugugccacuguacucuagccuggucaaucaaucaaucaauaaggccaggcacaguugcucaugccuguaaucccagcacuuugggaggcugaggagggcagauugcuugagcucuggaguucgagacuagcuugggcaacauggcaaaacccugucucuacacaaaaauacaaaaaauuagccaggugugguggcacaugccuguaguccuaccuacucaggaggcugaggugggacaauugcuugagcccaggaggucgaggccauggcugcagugagcugugauuguaccacugcauuccagccugggugacagagcaagauucugucucaaaaaaaauaaauaccuggccgggcguaguggcucacgccuguaaucccagcacuuugggaggccagguagggugggucaccugaggucgggaguuugagaccagccugaccaacaugguaaaaccccaucucuauuaaaaauacaaaauuagcugggcgugguggcgcaugccuguaaucccagcuacuugggaggcuguggcaggagaaucgcuugaauuugggagauggagguuguggugagccuagaucgugcuauugcacuccagccugggcaacaagagugaaacuacaucucaaaaaaaaaaaaaaagaaaaaagagcuauaauuuaaaugugguuucuaaggaauauguuaaaauuuuuaaguuuuaggaaacuucugauuauuucucuuuuuuuugcuuuaaaaauguguuuucuuaaauuuaaaauaauuuuuacuaggcuucaauguucacuagguuuuuugccuaguaaaagugcuuuucugagguaaaauuuaaauggaguuaaaaugcccuuacaugaauaacuuaaugaauauauuuuguacauauaacauauguaaaaaucagugucaucauuaugcagaucagaauauagagcauuuccauuaccuccuaaaguucucauggacccuuucuaguaagaauccccuuuuccaccagaaauagccaccuuuuuuuuuucuuacgaugaugaacaaggcacuuuuuuaaccuuuaaaaagauaguguuuuuguguauaugucuuuuuuucuuauuuuuuccuuuuucuuuuuuuucauucuucuaaaaaaaaaaaguuuuuaaaauuaacauugaguugcugggcaugguggcucauacuuguaaucccagcacuuugggaggcugagguuagaggauugcuugaggccaacaguuccaggcugcagugagauaauuguggucaggucaauuuuacuguauggguuauuuuauuuuuuuaggugaggucucacucuguuacccaagcuggaguguaguggcacaauuguccuguugcccaggcuggaguacgguggcacgaucuugguucacuacaaccuccaacuccuggguucaagcaauucucccaccucagccucccuaguaauugggauuggagacgcacaccaccacgccuggcuuauuuuuuuuguauuuuuaguagagacgggauuucgccauguuggccaggcuggcuuugaacucuugaccucaaguaauccacccaccuuggccucuuaaagagcugggauuacaggcgugagccaccgcgcccgacccuguucuuacuuuuaaauuguguuucuuagcuggaggcaguggcucacaccuguaaucccagcacuuugggaggcagaggcaggcggaucacuugaguccaggaguuugagaccagccugggaaauguggugaaacccugucucuacaaaaaauuaaaaaaauuagcuggaugugguagcgcacaccuguagucccagcuacuugggagauugaggugggaggaucacuugaguaugggaggcagagguugcagugagccaagaucauaccacugcacuccagcuuggugacagagcaagacccugucccccccccaaaaaaauaauuguuucuuuuaaauaacacauaauugaauauuuuuaaaaauuugucuaggccgggcgcaguggcucacgccuguaaucccagcacuuugggaggcugaggugggcggaucaccugaggucaggaguuugagaugagccucaacauugagaaaccccgugucuacuaaaaauacaaaauuagcugggcgugguggugcaugccuguaaucccagcuacucgggaggcugaggcaggagaauugcucgaaccugggaggcagagguuguggugagccaagaucgcgccauugcacuccagccugggcaacaagagcgaaacuccaucugaaaaaaaaaaaaauugucuaaacaggcugggggcuguggcuuaugccuauaauccuagcacuuuuggaggccaagguggguggaucccuugagcccagaaguucaagaccagccugggcaacauuggcgaaauccugucucuacaaaaagcacaaaaauuagcuggauguaaaaagaaaaaaaauuaacugggugcaguggcaugugccuguagucccagcuacuugggaggcuaaggcaagaggauugcuugagccugggaggcagagguugcaggaagccaagauugugccacagcacuccagcuugggcaacagagugagacucuggaagaaaaagaaaaaaaaaacaauuugucuagacaauucuucauucuuccuuuucugcagucuuuuggauuaaccaaguauauuauuucauuucaccuucacuguuggcuuucagcuauaugcuaauauggucuccacuacccaaaugaagcuauugagcuuuuaaaauguggcuagucuacaguuaauaaaagaucacauuuuguaugauaauaauuguaugaaauguccagaauaggcacauuuauagagacagaaaguggauucauagcugccuaaggcuagaggagcuagguagaaauagggagugacugcugauuggucugggguuucuuuuggggaugaugaaaaugcucuguaauuagauagugguaaugggugcaaaacucuauaaauauacuaaaaccauugaauuuuacauguuaagugggugaauuguauaguauaugaauuauaucuaaauacggcuuauuaucuauuuuuaaaauguggcuagaccccaucucuacuuugugcuaaaguguaauauaaacaccagauuuuuuuuuuuuuuuuuugagauacggucucacucuaucuccuaggcuggaguguaguggcucagucucagcucacugcaaccucuaccuccugggcucaagcaguccuccccucucagccuccugaguagcuaggaccauaggcaugugccaccacgcccagcuaauuaaaaaaauuuuuuuguagagaugaggucucacuauauugcccagacugguccugaauuccugagcucaaguaauacuccugccucagccucccgaagugcugguauuacaugcgugagccacagugccuggcuaacaccagauuuugaggacucagugcaaaaaauaggaauguaacacaucucacuaauuuuuauauugguuacauuuugcaauauuuggauauauuguuguaaaagaaauguaguaaaauuaauuauuauuauuuuuugagauggagucucgcucuguugcccaggcuggagugcacuggcgcaaucacuggcucacugcaagcuccaccucccagguucaugcuauucuccugccucagccucccgaguagcugggacuacaggcgccugccaccaugcccggcuaauauuuuuuguauuuuuuaguagagaugggguuucaccauguuagccagaaugguuucgaucuccugaccucgugauccgcccgucucggccucccaaagugcugggauuagaggugugagcccccgcaucuggcccuaaaauuaauuuuacuuguuucuuuaauuuuuuaaugugacuccuagacaauuuaaauuacauauauggcuugguuuuuaaaauuuuuguauuaaaaaauuugcuuuugguaaagaacacguaacaguguacaguugaauaguguuaaguauauucacauugcucuugcaaaacugaaauucuacgcuuguuaaaugaaacucccuguuuccuccuguccaguaguugcuggcaacuaccauucuacuuuguuuauaugaauuugacuaugcuagauauaaauggaaucauacugauuuggcuuguugugaccggcuuuuuuuuuuuugagauggagucucccucuguugccaggcuggagugcaguggcacgaucuuagucaugcaaccucugccuuugguuucaagcaauucuccugccucagccucccaaagugcugggauuacaggcaugagccaucgcgccaggcugugacuggcuuauuucacuuagcauaacauccucaagguucaucuaagucguaguauguauauagcuuacaguguuuuacuugcauuauauuucuuuucuuuucuuuuuuuuuuuuuuuuuuuuuugagauguagucuugcucugucaccugggcuggagugcaguggcacgaucucagcucacugcaaccucugccucccgguuucaagcaauucucuugccucagccucccgaguagcugggacuacaggcacgugccaccaugcccugcuaauuuuuguauuuuuaguagauaugggguuucaccauguuggccaggcuugucucgaacuccugaccucaagugaucugcccgccucggccucccaaaaugcugggauuacagacgugagccaccgcaccugccccuuuccuuauauuucuuuuucuuuuuuuuuuuuuuuugagacagagucuugcugugucgcccaggcuggagugcaguggugcaaucucggcucacugcaagcuccgccuccuggguucacgccauucuccugccucagccucccgaguagcugggacuacaggcgcccaccaccacgccuggcuaauuuuuuguauuuuuaguagagacgggguuucacuguguuagccaggauggucuggaucuccugaccuugugauccacccgccuuugccucccagagugcugggauuacaggcgugagccaccgugcccagcugccuuugccuuauauuucuaauggacaguacugcuguagauucuagauguucuuuuccuuugucguugcuaaauucucuuauuaguuauaguaguuauuuuguugguuucuuagguuuuucuuugcuuuuuuucuauuuuuuaaauuuuuauuagaaacagggucucucugucaccuagguuggagggcaguggugugaucauaacucacuguaacuucaaacuccuagcuucaggugaucccccaaccuuggccucccaaagugcugggauuacaagcaugagccaccacaacugucaguuucuuagguuuuucuguguacucaaucauguuaucugcgaacagagauaguuuucuuuccuuuguuuuuucugccuuuuauuucuuuuuguugccuuauuucauuggguaggaccuucaauauguuaaguagaagugguaacaauggauauccuuagcuuguacuugaucuuagauggaaaguguuuacuauuuuacuguugaauacaaaguuagcuauaggcuuuucauaccuucuuuuuaucagauuaaggaaauuucuuuuauuccaacuuucuuuuuuuuuuuuuuuuuuuuuuuugguugagauggaguucgcucuugucgcccaggcuggagugcaguggggcaauuucggcucacugcaaccuccaccucccggguuugagugauucuccugucucagccucccgaguagcugggauuauaggcaagugccaccaugccuggcuaauuuuuuguauuuuuaguagagaugggguuuugccauguuggucaggcuggucuugaacucccgccucgcccucucaaagugcugggauuacaugcgugagccuuggcccccaggcuauuccaauuuucuuagaauuuuuaucaagaguagguguuggauuuuaucaacagcuucuuuugcauguguugaaaucauauuuuucuacuuuuaucuaucucuauggugaauuauacugacugauuuucuaaugauaaaccccccuuggucaugauguauuauccacuuuauauauugauggauuagauuugugauuaauuuauuaaggauuuauauguuuauuuucuugaggaauacuacuuuguaacuuuuuucuuuuuuuuuuuuaagaauugucuuuguuagcuuuaaguauuaagguuaagcugcccucaaaaagaguugagaaauguuuccuucucuuuuuucuaagaguuuguauaggguugauauucuuuauuuuuugguauuugauauacuucaucagugaauuuaugaguuuucuuugugggaaaaucuuugauaaauugaauuauuuuauuuauuuauuuauuuauuuauuuauuuauuuauuuauuuucgagacagagucuugcuccaucgccgaggcuggagugcaauggugugaucuugguucacuguaaccuccaccucccagguucaagcgauucuccugcuucagccucccgaguagcugggauuagagaugggguaucaccauguugggcaggcuggucucaaacuccugaccucaggugauccccuugccucagccucucucaauuucuuggccaggcacagugggucaugccuauaauccuagcacuuuggaaggcuaaggcaggaagacugcuugaugccaggaguuugagaccagccugggcaauauagugagacccugaucucuaccaaaaaaaaaaaaauuaauuagcuuuaugcacuaauuagugcaauuucuaaccugguuuuuaaaaaauuguguauuuuucaguguuauaguauucauauuuauaauuuuguuguaagauauucuaucaagcuauacuguuacuuaauccuaagggguuuuaucaagguuuauaaaacugccuucaguguucagguuggagaaucuccuauaaaaguuuccuugcugucuugcacaauauacaguuaauaaaagaaauacauguaaaugcuuuuaauuuaaugguauauucccuuauauuuuuaaagcaguuucauccucaagaagagcauuuaagauaaugugaauuuuagcaaaauuugucucacuuuuagauacuauuuguauguauuauugcuguaucuauuugaacucagcaguuaaccacauuucucucucuguuuugaagcuaaauguugccagcuaccuacaaaugauuugcuuaacugagaauuuuagaacugauguaaaagacuuuguaaccuuguuaacugcaaauacuugugauaucagaaaaaguauccuuuacuuacaauucuggauuagaaguggagguggaguuuuagaagaacgaccauuaacccuuuaucguaaguugauuuguuauuaaagaaauuucuauuaugggacccuauuuaaaaaucugugcuauggcugggugcaguggcucaugccuguaaucccagcacuuugggggagugaggugggaggaucucuugaggccaggagguccagaucagucugcugaacauagugagaccccugucucuacaagaaaauuuaugggaggccaaggugggaggaucacuugaagccaggaguucaaaaccagccugcgcaagaaagcgagaccccugucucuacaaaaaaaauuugcaaaaauuagcugcgcaggguggcaugugccuguaauacuggcuacccgggaggcugagguaggaggaucacaugauccccgaagaguuugaggcugcagugagcuaugauuaugccacugcacuccggcccagacaauagagcaauacccuaucucuaaaaaaagaaaaaauuauuuauuuauauuuuuugagauggagucucgcacuguugccugggcuagagugcaguggugcgaucucggcucauugcaaccucugucucccagguucaagcaauucuccugccucagccucccgaguagcugggauuacaggcccccaccaucacgcccagcuaauuuuuuuugucuuuuuaguagagaugggguuucauuauguuggcuaggcuggucucgaacuccugaccucaugauccacuugccucggccucccaaaguacugggauuagaggcgugagccaccguacuuggcccaaaaaaaaauuuuuuuuaauuaaaaaaacucugugcuaugcuagaauaguugaaagauuauaaaaauuuuaagcaacuuguuauauuaaucuucaaaauaaauaugcacaugucaacuuuguucauaaaacauuuuggccuggcacagugucucacaacuguaaucucagcacuuugggaggccaaggggcauggauuccuugagcucaggaguuugagaccagccugggcaacauggcgaaaccccaucucuacaaaaaauuggcugggcaugguggugcgugucugugguccuagcuacuugggaggcagagauaugaggaucacuagaaucugggagaucgaggcugcagugagccaagaucacgccacugcacuccagccugggugacagagugagacucugacuaaaaaaaaauuuuugcagucaaugugaguaaauagaauuaaacuggaucuagaaaguuggauuuuuuuccuggcuaugcuacucuuuacaauuaauauauaagcuccaaaauucacuuuaccuuuuugagccuguuuuuucaccuaaaaaaggagagaucugaacuaaucuauaaguuacuuauucuuuuguaguugagcuuuuaagaugaucucauuguuuaauuuuaaaaaaacacacacaggcugggugcaguggcucacgccuguaaucccagcacuuuggaaggccgaggcgguuagaucaugaggucaggagaucaagaccuuccuggccaacauggugaaaccccaucucuacuaaaaauacagacauuagccggguguggcggcacaugccuguagcuacucgggaggcugaggcaggagaauugcuugaacccaggaggcggaggcugcagugagccaagaucgcaccacugcauuccaaccugggcgacagagugagacucugucucaaaaaaaaaaaaaaaaauuaaaaaacacacacacaaauuaaaaaacaaacacaaaaaaccucccacccuguucccccuuuccucuucaaaaguuuuucuuuucuuucuuuuuuuuuuuuuuuugagguagggucucgcuauauugcccaggcuggaguauagugacucuucaugggcaggaucauaaugcacagcccugaacuccugggcucaagcgauacuccuguccuagccuccugagaaggccacuguguucagcuuccuccccagaaauuugacucuuaaauuuucaaacuguuacuuauacauguauuaacauauauaaguacuuauaacauaguacuuauaaacaaaugauacuauaauuauuauuuaacaacuuuuucacuuacuaaaaacauuaauuuuucuauaugaguauauauauauauagguauauaguauucuuauguaacuauaacguacaaucacuuuuagcuucaggagucuuuaaauucugucuuuccuaaauacuuuauuauuucagaaaugcuuuuauuucuuauuuuuuuucagucaucauuguuaccuaauucaagugaguaccuucuccaugccaggucuuguguuuacaugguuaagacaugguuccuugccugaagaaguuuuaguuugguuuccaugcuccauagucacgguuuuguaguuacagauccuauucugguaaauacacaaauauuucaaggaaaccaaggugaaauuauguaauauuuauccuuaucaguuuuuucuucuaaugaguuuaacauuuuaacguauucuuuuucuuuuuucuuuucuuuucuuucuuuuuuuuuuuuuuuuuuuuugagacagugucucauucuguugcccaggcuggagugcaguggcagugcagcauggcucacuccagcuuaaucuccuggacucgagccgucuuccgcccugagccuccugaguagcuggaaccacaggcgugcaccaccacagcuaacuuuuuuaauuuuuuguagagacggggaucucacuauguugcccagccugguauugaacuccugggcucaagugauccgccccucuugggcucccaaagugcugggauuauaggcaugagccaccucacccagcuucauauuauucuuuuucaaaguagauaugccuauauauucuauucaguguaagcccauagcuuuaaccauuucucaaaaguaaauauaauacauaacacauggaaaauauccugguguaacaaauuaguuaauaacuuuuugauauaccacuagauauaaauuguuacagcaagaaacuuuagaagacacaaaauaacaaaauaaguacagcauaauuucucuucuuuucuuuuuuuuuuuuuuuuuuuuugagauggaaucuggcucugucacccaggcuggagugcaguggcacgaucucgguuugcugcaaccucugccuccuggguucaagggauucuccugccucagccucccaaguaauugggucuacaggcguguaccaccacacccagcuaauuuuuugcauuuuuaguagagacaggguuucacugaguuagccaggauggucccgaucuccugaccuugugauccgccugccucagccucccaaagugcugggauuacaggcaugagccacagcacuuggcuggggccaguuucucuucuuaaaaaucuuuuuuuauauacauuucaucccugcccuuaaaaaaaaaacagauacauaaaacaauauuccccuacuucuugaaaguagccacaguuagaccuuuaugcauguaacauaaagauacauacuuauuuagcaaaauuaaccaguauuauauauguuguuauuuuuaaguuuauuguuagcacauacgauccuaucccacugucuuucacagcugcaugcuuuucuauagaauagaauggauguaccguaauuuaaccguuacuuacagacauuuacauuaucuucaauuugucauuaaaauacagugaauaucuuuauacauauauccuugaaaaugucuguaauauugauggagagaauucuagaaguaugacugcugggucacaaacgguguauauacuuuacauuuugauaguuguugucagacugcccucugaugauaauuguaccaacuuaugcucccaugaauaguauaugaugguuuuuuuauguguacugcugacagaacuacauuauaauucuuuuaauuuugccaauuuaaaaagugaaacauguacaguaucuuauuuuaaaauuacauuuccaugcuuaguggugaaauugcauaucuuuuuauuaggucuuugaaauuauuauuauuauuugagacggagccucacucagucgcccaggccagaguacaguggcgugaucuuaguucacugcagccucugccucccggguucaagugauucuccugccucagccucccaaguagcugggauuacaggcacgcaccacuaugcccagcuaauuuuuuauauuuuuaguagagaugggguuuugccauauuggccaggcuggucucgaacuccugaccucaggugauccacccgccucggccucccaaagugcugggauuacaggugugagccacugcacccggcugaaauuacuguuucuuuuuucuucccccuuugaguuggagucucgcucuguugccgaggcuggagugcaguggcgugaucucggcucacugcaaccuccgccucccagguucaagcuauucuccugcuucagccucccuaauagcgggggcuacaggcaugcgucaccacgccuggcuaauuuuuguauuuugaauagagacaagguuucaccauguugcccaggauggucucgaacuugcccaggauggucucgaacuccugaacucaagugauccaccugccucagccucccaaagugcugggauuacaggcgugagccaccucaccuggccugaaauuaauauuagguauuuauuuuucuucugugacuugccugcucacaguccuugcacuuuuucuguuggauggcuuugaaagucccccaccaucaccucacuuaauuuaucucuugguagaaauaaugcuuauggccaggcgcaguggcucacgcauguaaucccagcacuuugggaggucgagggggguggaucacucgaggucaagaguucgagaucagccuggccaacauggugaaacccugucucuacuaaaaauacaaaaaguagccgggugugguagcgcgugccuguaaucccggcuacucgggaggcugaggcaggaaaaucgcuugaacccaggagguggagguuucagugagcugaaauugcaccacugcaauucagccugggugauagagugauacucugucuuuaaaaaaaaaaaaaaaaaaagaauaaugcuuauauuguacucuuaaugaauuaaacacauauguagagaacuaaauggggguauuuguccagaagaugucaaaggaucucaggcuuuaaauaauuguuugauacaauuuguuuaauacauauauagagcuaagauuuucuuuuauuuuguagguggaaauagcagaaauguacaacuaguuugcucugaacauggccuugauaacaaaauuuacccuaaaaauacuaaaaagaaacguguagaccuuccaaaaugugacaguggcugugcugagaccuuguuuggccuuaagaacauuuuuuccccaucugaagacuuauuuucauuuuuaaagguauuuucaaugucuguuuugcaauguugaauuuauauuccuuuucauauucccaacauuagccuccuaucuuuugaaucuuaaguuuaacuuaaaugugccuauaauuuguauaagccuuaggucucugauuuuaacacauccuaccacuuugacaaauggugcauaggcauugcucugaaugcauauuauaggauuuagaauagcauuuagaaaauuuuucagauagacuauuucagaaaagugguuuuaaauaaaugagcuucuaauaauauuggaguauauacuaaauacauagagaauuuaauucuccaaauuaaucgucuaaauuuaauuuuuagacauaguacuauuuugauauauuaaauauagauaaauaaaauuaugagggguagugacucaguacuuugaauuuagaauagggauaacacuauauucauacagguagaaaaguauucaaacuauguacugcuguaacauuucuuuacucaaaauuguuuuucagcacaaaaucacaaugaaggaagaauggcauaaauucauccagcuucuuacagaauuccaaaugcggaauguagauuuuuuauauaguaaucuugaguuuauucuaccauuaccaguugauaccauuccagaaacuaaaaacuuuuguggcccaucaguaacuguggaugccagugcagcaacaaaaaguaugaauugucuugcuaggaaacacucugaaagagaacagccauugaaaaagucccagaaaaagaaacaaaagaaaacauugguaauauuagaugauagugaucuauuugacacugacuuggacuuuccugaucaaucuauuagccuguccucuguaucaucuuccucaaaugcagaagaaagcaaaaccggagacgaagaaagcaaagccagagacaaaggaaacaauccagagacaaagaaaucuauuccuuguccuccuaaaacaacugcaggaaaaaaauguucugcccuuguuucucauuguuuaaauucucucucugaguucauggauaacauguccuucuuagaugcacuuuuaacugauguaagggaacaaaacaaauacgguagaaaugacuuuaguuggacaaauggaaagguuacaaguggacuuugugaugaguuuagucuugagaguaaugauggauggacuucucaaagcucuggagaauuaaaggcagcugcagaagcucucagcuuuacuaaauguucuucugcuauuucaaaagcauuggaaaccuugaauucuugcaagaaauuaggaagagauccaaccaacgaucuuacuuuuuauguuucacaaaagcgcaauaauguauacuuuagucagucagcagcuaauuuagaguaagucuuacuuccuuuacuuuuuauuuuuugguaauaaaucguaaaggggaaaucaauagaguuuuuucuuaauuuaaaaaugcuguacuauugaucaugguaagcccuuaacauuaauaauguagcuucuaaugagauagcuaaagagaccagcuugaucgcugggaagagaaauaaugagugauugggguggauuuagguaaugcuugaaugacccaggaaggaguuuggucuugcuguauaguuauugagauuuuuucaguaugggagugauugauguguugacaggaaauuaaucuggaaaugucaucuggucuagaccagaggcaaggaaacuaaacugguugugauugggauuacugcauuuuucuugggcauuaaaaauuaaaaacaaugcauuacuuuuacagcaaugcuuggaagaggauaucagucauuaaaaguguauuuucgagucgaucucuucucuauguggguaauagacaagcuaguauaauugaauaccugccaacccuucgaaacaucuguaagacugagaagcuaaaagaacaaggaaaaaguaaaagaagguaaaggcuuuauuaaaaacaacauuuuagauagcuuuuucaagauuaauacauauuuucauaagaugaaaauguuaauauuaaauuguauuuuucuuuguaauuuugacagauuccugcacuauuuugaaggaauucaucuugacauuccaaaagagacugugaauacuuuggcagcugacuucccuuaauguuccauacuaacaaugcuuuguauagauuaucaugugguccuuaagauacauuuuuauauuauguggaucuucauggaaaaguauauuucucgauguacauuuuaaacaaacaauuuguauauuuuuuuauuggcggguaaauauuuaaaauauuugaguuacaaauuuuauauaugauuguaauuuuuuuucugaauuuuuuguauuaucugauuuagcuuuguuggaguauuuuuuguaugugagugaacuguuucuggaagguagaguucauuaagaugaacucccuauuucaaguguuuauauuauauauuagcuuaauauucagauacauuaucuuggcugcuaacauuagugucac

SEQ ID NO: 192280 - RNA, 37458 nt, Homo sapiens
gguuguccacagucucguagcuaccaagugacaggccacgauuugaucucaggccaguguguuaaacuccaauuugcgugcuccugucccuccccgcgcgucggcggagcucggggccggacuggaccugccgagggaggggcggacaguccugacggugcggggcggggcuggcggcugcccaggccuggcugaggcgccgcggccgggucccucuccaccugccgggcggagcgcacgggccaugggcugagccccgcugagcccgccgggccggccaugggcgaucgcgagcgcaacaagaagcggcugcuggagcugcugcgggcgccggacacaggcaacgcgcacugcgccgacugcggggcggcagguaagggcgcggcggcgcgggcagcgcgagacccccggccggaccccaggcccacccgacuccuccccucggccccaccgggucccgcccucggcccccuggacccagacguggcaccugcgggccccgaccccucccacccacaccgugaaccucucacccgagccccgagggccgucuccaccacacccugccccggccccuacgagcccaggcucugcuccccucgcgggaccagaugcgcaucuucccacgugcuuggacccggacacgagagccggcagccuagagcccuuccagucccgcucucuucccuggccaggcacccgaccgcccgaguccgggcucucgaugucugcgcacccaggcgcgccccacgcccucggacucagacaucccagccagggcuaaacgucgggcccaggccgccgacaguccugugcccccugcccgcucccagacgccccccgaaggccuccccagcgccccaccucggggacgccgagggcccccuaacucagccuccccaccugcagcuccgcgccgagccccgcggugcgccccccgcgcccuccucucgguuccuucugagucccuucacuuccacgucgcgcagccucagacucucuccccgggcccugaacugccuccaggaucuucaccccggucgccgcgcagcggccggugggcuaaccagaaggugccaggcuggccgcuuaguucgccuuaggugggagaaggggcgccccaccugccccagugccccgagcccagcccugguuucuucaccgcgcuuuccgcucagcuccucuccugccucauccccugcagaucccgacugggccucuuacaagcuggggaucuucaucugucucaacugcugcggcguccaccguaacuucccugacaucagcagaguuaaaucugugcgacuugacuucugggacgacaguauuguggagguagaaaggcaugcccguggagagccauggaacugcgggacuggaguagaggcagcgggcagggggcucccauucuacagagggggaaacugagaaccagagaggggcaagucuagcuagaggaaacacagcuuauaagauggcagcuuagacagaggccgagaguucaaauucuggcucuaucauuugcuuacuuuuuuuuuuuuuuuuuugagacggagucucgcuguguuguccaggcuggagugcaguggagcaaucuuggcucacugcaaccgcugccucccggguucaaguaauucuccugccucagcuucucaagcagcugggauuacaggcgccugccaccacacccggcuaauuuuuuuguacuuaguagagacgggguuucaccauguuggucacgcuggucucgaacuccugaccucaggcgauccaccaccucagccucccaaagugcugggauuacaggccugaaccauccugaaccgcuccuggccaucauuugcuuaccuauaagcugggaggcccugagcuagguacuuugaccuagcuguggacccucaguuuccacaucuguauucaagggauaccaccaccauuucucuuuuuuucuuucuuccuuuuuuuuuuuuuuuuuuuuuuuugagacggaguuucacucuugucgcccaggcuggagugcaacggccaaucucggcucacugcaaccucugccucuuggguucaagcaauucuccugccucagccuccugaguagcugggauuacaggcacccaccaccaugccccgcuaauuuuuguauuaauuuuuagcagagacgggguuuugccauguuggucagucuggucucgaacuccugaccuuggguaauccacccuccucggccucccaaagugcugggauuacaggcgugggccacugugccuggccacuaccaccaaugucacagcacuguugugaagaugauuguaggcucaguccagacacaaagaaagcugucaguuaacaguugcuguuguacgggugugguggcucacaccuauaaucccagcacuuuggggggcugaggcugguggauugcuugagcccagaaguucaagagcagccugggcaacauggugaaaccccgucuuuacaaaaaauacaaaaauuagcugggugugauggcaugcgccugucgucccagauacuucgggggcuggggugggaagaucaccugagccugugagaguguggcugcaaugagcugagaucgcaccacugcacuccagccagggugagagugagacccuaccucaaaaaaaaaaaaaaaguugcuguuaucauuagugaagucuuggacugggggaagggaaauaaccugauuuguggucuaaaguccuccuuucccccuaggcagaaagaggaccacuuugcucuccugcccucuggggguggaggauacccucagccugcaugguaauuccauuuuggucagaaaaccuccagagagcaggcaguucugcacugugcggguuggcugaggguuuccaggacuauuggggaagcaggcugacauuuacugaaugccuacucugugccagguacugugcuagacagcaccggacuggaggcuuuagugugaccuuacuaagugcugggucuugggagagaacaaugaacaagauaaggucccuggccauacagagcuuacauucuagugugggagaaaggcuggaaaccaguaaaccagcacauaaaccugaaggauuuuauuugcaccuuauaacucccauguuauauuuucuuuuuuguuuuuuuuguuuuuuuuuuuuuugagacggaguuucacucuuguugcccaggcuggagugcaaugaugcgaucuuggcucacugcaaccucugccucugggguucaagcgauucuugugccucagccuucugaguaacuaggauuacaggcaugcaccaccaugcucggcuaauuuuguauuuuuaguagaauuuuuacuagagacaggguuucacccuguuggucaggcuggucucaaacuccugaccuuaggugauccacccgccucggccucccaaagugcugggauuacaggcgugagccaccgugcccagcauuuuuuuuuuuuuuuuuuuugagaugcagucucacucugucacccagccuggagugcagugaguggcacgaucucggcucacugcaaccuccaccuccuggauucaagcgauucuccugccucagucuccugaguagcugggauuacaggcgcccgccaccaugcccggcuaauuuuuuguauuuuuaguagagaugggguuucgccauguuggccaggcuggucuugaacaccugaccugaggugauccaccugccuuagccucccaaagugcugggauuacaggugugagcuacagcgcccaauccucuguuauauuuccuucuucuucuuccuccuccuccucuucuucuucuuccuucuuccuucuucuucuucuucuucucuuuucuuuucuuuucuuuucuuucuuucuuuuuuuuuuuugagacggagucucacucacucuguugcccagguuggaguguaguggugugaucuuggcucacugcaaccuccuccuccuggguucaagcaauucuugugccucagccuccugaguagcuaggauuacaggcgugcaccaccauaccuggcuaauuuauuuauuuauuugagagagagucuugcucuauugccuaggcuugagggcaguggcaaaaucucggcucacugcaaccucugccucccggguucaagcaauuauccugccucaccuuucuguguccuggcuaauuuuuguauuuuuuuaguagagacaagguuucaccauguuggucaggcuggucucaaacugcugaccucaagugauccccagccuuggccucccacagugcugggauuacaggugugagccacugugccuggccauuuucuucauuuuuacgggugagauuccaagggucacucaucaaauaaauggcagucaggaucugaauccugcucuguugggauccaaagcuggcgacacagccuagcggccccugcagaggagaagaggagcaaugcuccucuccugcaaaggagaugcccaagcgaugugaauugaaaaccugguguuucuucccacuucugcccucacccuagcuaugccacugcugccagggccacuuuuggugcaucagccucugggucucuugggugccaaagggcccuacuaaucauccugaccuaugcacuccaugaggcgagcacccacuucuuccauccuccagguacauuuaucuccugcagacuuucagggcugcuagggguccuggccaucuguggaaggcaugauaggaagaauaugagcuuuggagucaggucuggguucaaaucccaguucuccacuuauagcuguguuuccuugaacaaguaaccuaacccgucugagccucaguugacucaucuguaaaaugaguacagugauaugaaaauggcugagaggacccagugagcugaugugugagcacuguggaguccugugcccauaugaggcaugguuauaucugcccaugauuguuacaggcuggggcuucccagcaguauggaugaccaagcccggugggacaucuccuucuuggaggcaguuucuucugacucagccuaagucaguggccucauaguuucauuucacguuuuuucaaguucuaauauuaccucagguugcuguugucuugcaguuuaugauccacaauggaaaccuccgugugaaggccaaguucgaagccagagucccagcuuucuacuacaucccccaggccaacgacugccugugagugggugauuccuuagggacugggugaggggucuguccugguuccaccuccucccccucuccaucuuuggugucuucaucugugguggucucuucuaugggccuggugcgcagguggauccaggaaagcacuggauaccaucacagagagcacaugggaagacugguauaagccucuuucugccucuguugcuugggcgugucucuuccuuucucugggccucaguuuccacagcucuuaaauggaggauuuuucuguaugaucucuaugauuuuucucuaugaucucugccugugacauucuuguagcuuacagaugguggcuaacuugauaagaggggguaaacacuaguaucuuacuagaccaaguguguuucagcuacuuccuuuagagaaauaugucuagagcuggccaggcacgguggcucaggccuguaaucccagcacuuugggaagccgaagcgggcagaucacgaggucaggggaucgagaccauucuggcuaacacggugaaagccugucucuacuaaaaauacaaaaaaaauuuagccgggcgugguggcgggcacuggagucccagcuacuuggaaggcugaggcaggagaagggugugaacccgggaggcagagcuugcagugagccaagauggcgccacugcacuccagccugggcaacacagcgagacuccggcucaaaaaaaaaaaaaaauaaaagauagaaauaugucuagggcucugccaccuaagcucgggcuggcucuaaacaacuugccugagcugcagaucccuaaauacuaaccauaaaaauaagaauaacagccaggcacaauggccagugccuguaauccuagcacuuugggaggcugaggugggaggaucgcuugaagauaggaguucaaugucagccugagcaacauagcaagacccugucucuacaaaaaauaaaauaaaaugaacuuagccagggcauaguagcacgugccuguagucugagcuacuaggaagacugaaguggguggauugcuugagcccagauugcagugagcuaggaucacaugugucacugcacucuaguaugagugacagagugagaccuagcauuagaaaaaaaaaaaaaguagcuacuggcuggaugcgguggcucaugccuguagucccagcuacucaggaggcuaaggcaugagaauuguuugaacccggaggcagagggugcauugagccaagaucacgccacugcacuccagccugggcaacagaaggagacugucucaaaaaaaaaaaaaaaaaaaaaaaggccggauguggcggcucacaccuguaauccuagcaauuugggaggccgaggcgggcggaucacucgaggccaggaguucaagaccagcccggccaacauagugaaaccccgucucuacuaaaaauuaaaaaauuagcugggcauggugguacaugccuguagucccagcuacucgagaggcugagggaggagaaucgcuugaacccgagagguggagguugcagagauugcaccacugcacuccagcuugggcaacagagugagacuuugucucaaaaaaaaaauugcuacuaauauuauugagcuuugcuuaaguacuacgcccugugcaaaaugcuuaugugcauguauuuauuuaauucuuucaacaacccuacaaguacugcuacuaucccuaugcuauagaugaaaaaaccugagguuuguggaggcaauacuggucuagccugucugacaccagggccagggugacuguuucauggaauugggauaauuuuauauaagaggggggcuuugaagcagcaggaggguucagguccccuggaggugaggguuaguguggcacugguaccuaguggcccuggaccucugcagaucugacugccugagccuacgacuccuucccagggacuuagacuccccaccagggcugcuagacaguaucuuguguaaauggggagaaggaaucccuuuaggcugacccagccucauagcggguaugucuggcaaacagaaagcagcugcauuucagcugccgagccucagcaaggugcuuuugggcaguacacagacuauauaaccauaccuaguggucuuguaauuucucagugcuuagacaauuaagagcuaguaauguacucuggaguggcuggggaagcacagcuuucuacuuggaagaccucaguuuuguuuccuagcucuacugugaccuagcugggaggacgugggcaagucagcaaaucucucugauugucaacauccucaucucugaaauguaggcaaugaugccugcaucauagcauacuuguagagauuacaugagauaacuuauguagaaccuuucacaugccacccgacacacggguuugaauccauuucacugugucugcuucagaaugcuaccuguccauggccagcuguggggugugcugacucgagagggccugucucauccuggcucgcugcugccacucuguccuuugcuccaagugcucagugaacacgugcgcugugcuaggcuuccugccggcacuaaacagacauuacccaccaugacuccagcagcagcccugcacuuuaacccuuuuugucugaguacuaauggccaccuucaggaccaacauggguggcccuuggucuccauuccuucucccugcucugaucuugugucccaggguuuccacccucauggugggccaggugauucuccucagugaucugugggcugugcacuaggaaugacucucucucucuuuuuucuuucuuucuuuuuuaaauauagagacaagguuucacucuguugcccaggcuagaguucaguggcacaaucauggcucacugcagccccaaccuccucggcucaagugauccucccaccucagccucccaaguagcuggaacuacaggugcaugccaccaugccugguuaauuuuuguauuuuuguuuguuuuuauuuuuguagagaugagguuucaucauguugcccaggcuggucucaaacuccugagcugagcucaagccaucugccuguguuggccucccaaagugcugggauuacaggcaugaguuaccaugcccagccuggacucuugauuguaagcgacagaaaccuuauuuauuuauuuauuuauuuauuuauuuauuuauuuauuuuugugacagagucuugcucuuucacccaggcuggagugcaguggcacaaucucagcugacugcaaccuccaccuccuggguucaagcgauucuccuguuucagcuucccaaguagcugggauuacaggcacgugccaccaugcccagcuaauuuuuguauuuuugguagagccgggguuuugcuauguuggccaggcuggucuugaacuccugaccucaagugaucugccugccuuggccucccaaagugcuaggauuacaagugugagccacugcgccuggccagaagcccaguuuaaaccagcauuaaaaaaagaggauuuuauggguucuggggaucagacuaccugaaggacagugguggagcuggccucaggaaggaccaagccaggagcucacacaccaucaggucucucauacucucucuggcucucuuuccucuuucucucagacaggcuuccuucacacagcuggcagcaaggccacaagcaggugccaggcuauaccuuccagcgugacucuggagaaagcuccaucaaucucuccuucacuuuugacccucucaguccacacagcccagagcagcaaagagcucugaaugaccagguugggccagaugcccagcucuaggucauuccuguggcuaugggguaaggucauauauaccuuggaacacuucccuggaaaaggugagcaggaaccaaacaauuaaaauaacuccacucucggcugcaugguuuuucugcaggacucacggaugacaaucucugauugagaucacauuaaacaccuacuaugugcugaguaggugcuaggcccuuuauauacauuuaaaccucucaacaacccugagggcuaagugaguauaacaauagaggucuauuccccaaauucagaggaguuggguaacuugcucauggucacacaguggauaaaugauagagugagaccaggucccagguggucagauccuaagacgacugcuuuguccaguguagccugcccagacuucaugggcagguacaggaagaggcuccuggacucuccugccuaagcucaugaacacacagugggagcaggugguguagaugguccagaggagccaguaucugucucauugaccuagagagcugauacugggauuggaacaacucggugguucucauauagcccacugggagaaauauuucccccagaggacauuuggcaaugccugaagacauuuuugggugccacaacuggggagggggugcuacuggcaucuaauggguagaggccagaaaugcugcuaaacauucuguggagcaugggacaacccauaagacaacagaacaaggaauuauccaaccccgaauguuaacaguacugaggcugaggaauccuagguagcuggagcaggcagugaggcacugcugugauguucccacccucaacugcagggucuuggaaaagaaugcaucaguccaggcauggugguaaucccagcacuuugggaggcugaggcaggaggaucgcuugagcccuggaguucaagaccagcuuaggcaacauagggagacccccaucucuacaaaaauuuaaaaauuagccaggugugguggugccugccugugaucccagcuacuuaagaggcugagaugggaggaucgccugggccuaggaggucuaggcugcagugagccgugaucacgugaucacaccacugcacuccagccugggcaacagagggagacccugucucaaaaaaaaaaaaaaaagagaaugcaucaaacgcagcugaccucaggcucucucuuuuuagggucuuaaaggaacaauggauucgagcuaaguaugagagacgggaauuuauggcugauggggaaaccaucucgcucccagguaaaguuauuuccaucaccuuuugaaaucuauguuuuaaugagcucuagaaaaaccaagugccuaaauauuaggagcaagauccauccaagagaugccugcuguucucacuguggccgcagaggccaagguguggguucuucugacuuugaaauaacaacacaucagcugguggggcuuuaugcucugagcagcagagaagcucagagcuucuauggucuuugucucaggucuuugcagggucacaaguguguacagacucuuuuuuuuuuuuuuuuuuuugagacagggucuuacucuguuguccagccuggagugcaguggcacuaucacagcucacugcagcuucaaucucccgggcucacaugauccucccaccucagccucccaacuagcugggacuacaggcacaugccaccauaccuggcuaauuuuaguggcuuuuauuuuuuuauuuuuauuuuuuguagagaugggguuucaccauguugcccaggcuggucuugaacuccugaacucaagugauccuuucgcuuuggccucccaaagugcugagauuacaggcaugagccacugugcccagccagacucuuuuucuuuuucuucuucuucuuuuuuuuuuuuuugagacagagucuugcucuuguugcccaggguggagugcaguagcaugaucucagcucagugcagccucugccuccuggguuccagcgauucuccugccucagccuccugaguagcugggauuacagcaucaugcuuggcuaauuuuuguauuuuuaguaaagacgggguuuuaccauguuggccaggcuggucucgaacuccugaccucaugaucugcccaccuuagccucccaaaguucugggacuacaggcaugagccaccgcgcccagcaucaaacacuuaauguaaauugcagaaagacuccuccacuggacagaccaauuaggaaaagauaucccugcuccuggugagcuuuauuccuggugcagcucaagacuuggugaggaggaugggcuuaaauucagccucccuuucgaccauugugcaggguacaaccucuucuguggcccuggaccuguggcaguuucacccccacgguccugaguccaagcugacucugacccagacaguaaaguauaaaaaaucauucuuagagggccagaggcagugcucagcuauccuggcuaccaggaccacaaauuauucuauuuauuuauguauuuauuuauugagucagggucucacucuguuacccaggcuggagugcaauggcgugaacucggcucacugcaacuuccacaucccagguucaagugauucucaugccucagucucccgaguagcugggauuacaggcaugcacaaccacaccuggcuaauguuuauauuuuuaggagagucaggguuuugccauguuggccaggcugaucucaaacuccugacuucaagugaucugucugccuuggcuucccaaggugucaagauuacaggugugagccauugcacccagcccauaaauuauucuucaaaccagcagaugcccggagggagucucacugugucacccaggcuggagugcaguggcacaaucucggcucgcugcaaccucccccucccggguucaagugauucuccugucucagccuccugaguagcugggauuacaggcacgcgccaccaugcccagcuaauuuuuguauuuuuaguagagacgggguuucaccauguuggucaggcuggucuugaacucccgaccuugugaucugcccgccucggccucccaaagugcugggauuacaggcgugagccacugcgcccugccuuacuucuaaaguuucauuagguugaugucagcaugaaguugggcaggaccauauguauuuaguauguauuuaagugucuuucagaaucaguccaguuucucaggacuuugccuucuuaagggucuucuuaugagacagccugauacacagaaagucaaggaagaaagguuuuaggcagugggaagugccccugaagugaaaagacaucacaaaguuggccacagaugggauccuuguguucugcagcugaaauagggaagucugaguggagauacuuuggcagcagauggaaggcuuauuccacccuugagaaccucagagguuccugagcugcuugugaucuuaaggucacguguguucacgcuuugucauccuugcugcuuaagguaaccgagaaggauuccuguggaagcgaggaagggacaacucacaguuucugagaaggaaguuuguacuucuggcaagagaaggccuccugaaguacuucacaaaggaacagguaagaugccagaccaaugagagcaggucccuuccugagcacucucacccgacuaaggucuacauucuaaucaguggugcccuuuucuuguagauaaucucagccccugagaguuaggcacaacauuuggcuacuuuuccuuggcuauacaguaaauccaguccaccaaaaaucauacuuucuguccaccuagaaucagcuuagauagguccauguuuaagccuuugaugaccacuugguuuugcuucauuuauucauucacuuaagaaacauuuauugaguaccuacugugugcuagacauuauuccaggcacugaggauacagcagggaacuaaacaaaacucuuguucucagggagcuuucagucuagugaaaggaaagagcuccguaaucaaaacaucaauauauaauauaccaggaggcaauaguuuuauaaaguaaaauagaaguggcugcgcacaguagcucacaccuauaaucccagcacuuuaguaagagauugaggcagggggauugcuugaguucagaaguuugagaucagccugggcaacauggugaagccccaucucuacaaaaaauacaaaaauuagcugggucaagcacauacaccuuuguaugguggcacaugccuguagucccagcuacuagggagucugaggugggagaacugcuugagcaugggaggucgaggcugcauugagccgagauugugccacuguacucuagcaugggugacagagugagacccugucucaaaaaacaaaacaaaacaaaaacaaaaacaaaaaccgggcaugguggcucaugccuguaaucccagcacuuugggaggccaaggcagguggaucacuugaggucgggaguuugagaccagccugaccaacauggagaaaccccaucucuacuaaaaaaauauaaaauuagcugggcgugguggugcaugccuguaaucccagcuacucgggagacugaggcaggaguaucacuugaaccugggagguggagguuguggugagcugagaucgugccauugcacuccagccugggcaacaagagugaaacuccgucucaagaaaaaaagaaguaaaauagcggagagugagaagauagacaacaaugagaguguguuagggagucagggagugcugcugcagagugaucagggaaggccucucuggugacauuugagcagauaacugaacaaaugugagcacugaguuacauggcuauguggggggaagaauagaagaaaggggaggaacaguaugugcagaagcccugagcacagguauggucaaacacauacaccuuuguaccgauuugagaaagaugaucccuuuaagagggugcagccccugggccccagucucgaaaaucagaagccugguuugcaguuaccagucagcuaggagcuuuuuaugcagugcacaaacgacuuaaccauaagcugcaacccuggcccugagcuagaaguguguuugguggguguagggcaucaaggagggcagagcgacuugugcagagugagcaaggaaaaguguggagggagaugaagucacaugguggagggccuuguaggucauagcaagacuugggauuucuuuugguaacaguuuauugagauacaauucacauaccauauaauucacccauuaaaaguaugcagucaauuggcuuuuaguguauucacagaguagcacaacuaucaccacaauucaguuaaaaacuuuaaacaccuuaucccuuagcuguaaucccccaccccaccccaccacuagcccuaggcaaccaacaacuuacuuucugucucuauggauuugccuaaucugguuauuuuuauuuuauuuuacuauuuuaucuuauuuauuuuuuuagagacagagucuuccucuguuggccaggcuggagugcaguggugcaaucauagcucacugcaaccuuaaauuacuggccucaagcacuccuccugcuccggucucucaaagcacugggauugcagaugcauaccacuccacccagcuaauuuuuauuuacuuauuuauuuuuguagagauaggguuuugcuuuguugucuacgcuguucucaaacuccuggcuucaagcaauccucugccucagccucccaaaguacuaggauuauagaugugagccacuacgccaggcccauaucugucuuuuuuauaauagccgucuucauggguaugaagucguaucucauugugguuuugauuggcguuucccacauggcaaaugauguugagcaucuuuuuaaugugcuuauuggccauuuguauaucuuauuuguagaaaugucuauucagauccuuucccauauuggccgggcgcgguggcucacgccuguaaucccagcacuuugggaggccgaggugggcagaucaggaguucaggagauggagaccaucuuggcuaacacagauacuuuccccauauuuuaauuagguuauuugucuuuuuauuauuaaguuguaauaguucuguauauauucuagauacaagucacuuauacauguaggauuugcaaaaauuugagcuuuuggauuuuacugagugagaugggaagaaauuggaggauuuugagcugagaagugauauuauuugacuuaaguuuuugauugauugauugauuugagauggaggcucacucugucaccuaggcuggagugcaguggcgugaucucggcucacugcaaccucugccucccagguucaagcaauucuuugccucagucucucgaguagcugggauuacaggcgcgcaccaccaugccuggcuaguuuuuguauuuuuaguagacaggguuccaccaucuuggccaggcuggucuugaauuuccgaccucgugauccacccaccucacccucccaaagugcugggauuacaggcgugagccaccgcgcccggccuauuuauuuauuuuuugagaugggauuucacucuauugcucagguugaagugcaauggugugaucucggcucacugcaaccuccaccucccggguucaagugauuccccugccucagccuccccaguagcugggacuacaggcgugcaccaccacacccggcuaauuuuuguauuuuuaguagagacaggguuucaccauguugaccaggcugauuuagaacuccuaaccucaugugaucugcccaccucagccucccaaaaugcugggauuauaggcaugagccacugcgcccagccugacuuaagcuuuuaaaaagcagcacgcuggcugcugcuagggugaguagggaggaaggaggccagagcagaggcagagaaauuagucaggaagcuguugcaauaacccaagugaagaagaaugguggauccgaccaggaugguuagaaguggucagauucuggauauauuuuggaaguagaggcaauagaauuuauugaaggauuggauguggggugugagaguaagaggaaucaaggaugauucccagauuuuugcucuauaaaacuacaagaauagauuugcuauuuacuaagguggcaaagacuuagaccccuaaggggaugcucaaaaguccuuuuuauuuugagaugccuaugagucauccaguagagacauggggaaagaaguuggauguauguuuccugaauucuaaacccaaguggcagaaguuggaugucugauuuggaggcuuggagagaguuuggaacuggagucgucagcauguagacugguuuaguaaugggacuggcuaggaucaccuaagcaggaaaaagguguucaaggacugaguauuuugguuauguguugcugaguaacaaaccauccuaaaacuuaauggcuuaaaauaucaauuuacuauuucucacaauccuaugggucaggaauuugaggaggccucggcuguucugguguacuccauguggcaucagcugggcuacucugcugcccuuagcuggccagagacccaaagaagcuuucacucaugucuggugccuugguguacucuauaugggggcucugucuuucucauucaggagucuagcuuaagcuuucuuguggcuuggcugcugacuucccuaaacaaaagcaaaugcuaccagaccucuggaaggcuaaccaggagcugcauucuguuggucaaagcaagucaugcaacaagcccugauucaaggggaggggaaauagauucaaccucuucauggauagagggucacguauacacugggagggaaagacugggugagcgccaucuuuggagaccaucuaccccauugagcccuggggcauuccaguauuuaaaggacagaaagauaagaaguuuucagcaaagagaaugugaaauuguggccaacaaaguaagagaaggauaagcucugagcacuuuagccuucaccuuacucuauuuccuauauguagaauuauuauauauucccccuguugcuuuucuaggcagaccagagcaaugcuaaaaggucugucuauggggaggagaagggaggaugaagagaaguggguuaaaggguacaaacauuguaagaugcaaggaauaaauucaauauuugauaccagagugggguaacuaugcuuaacaaaaauacucuggugaccaacacccuaaauauccuggcuugaucacuacacauuauauacauguagcgaaauuucacauguaccccauaaauuuguauaaauaauaauauaaaaggucuguccaauguggccacagucugggaccaaguaaaaaguguuaagggaugaagaaucuuuacccuccaaguuagaggaagaauuuuuucccagucuucaauguaaagcacugaaaaauguggcuuuuucaacauuuuugcugaaaugguacaaaaggccggaagagaaagcgcuacugcaguuaggaaaggucaccaaaccccagcagcugcugcgaguuggucucucggacagggccucaucauugguugaaaaaaguugaucuguuuuucaguccuacgccaguucagucuagaauaguccaaaaauagaaugggcucccuauguucuuuuuuauuuauuucccaaaguggauauuuuaaaaucauaaagguaacuaauuuuuagguaaaacuuuuggguaauacaaaaaaggaaaugaaguauaaagaaagugaaacugaaaaaaaaaaaaaaaagccccaagcucuauacaaagcacuucaaaaaguucuuggaggccaggcucggaggcucacaccugaaaucccagcacuuugggaggccgaggcaggcagaucacgaggucaggagauugagaccaucuuggcuaacacggugaaaucccgucucuacuaaaaauacaaaaacuuagcugggcgugguggcaggcgccuguagucgcagauacucaggaggcugaggcaggagaauggcccgaaccugggaggcggagcuugcagugagccgagauggcgccacugcacuccagccugggcgaaagagcaaaauuccauuuccaaaaaaaaaaaaaaaaaagguauuggacaaaugagauuaaaauuaaagauauaaacuuuauuucucaacauaagcuccaucaaggucaagacacuuuuauaagugaugacaccagccauuuaguccauccccuagcaauugaggguccugggaauuuaaccaugccaaugcagucuuuuuuacauuuuguuuuuuuaugcuguuuucugagacagggucuugcucuuucaccaaggcuggaguacaguggugcaauucuagcucacugcagccacaaccucccaggcucaagcgcuccuuccaccucagccucccgaguagcugagacuucaggcacacaccaccaugccuggcuaauuuuuguauuuuuuggcaacgacaggauuucaucauguugcccagguuggucuugaacuccugaacucaaccgaucuaccagccucagucucccaaagugcuaggauaacagacauaagucaccacgccuggccuuuuuuuuuacacuauuaacugaagaaagauggguacccuuuacagauuuuuuuuuuuucgagauggagucucgcuucaucgcccaggcuggaguacaguggcacgaucucggcucacugcaaccuucgccucccagguucaagugauuguccugccucagccuccccaggagcugggauuacaggcguuggccaccaugcugggcuaauuuuuguauuuuuaguagagacgggguuucaccauguuggccaggcuggucucgaacuccugaccucaagugauucgcccgccuuggucucugaaagugcugggauuacaggcgugagccaccaugcccggccuccuuuacagauuuuuuaagauuagaaaacaaaaagaaguuagaaggagccgaauuuggacuguaagaugaugcauaaucacuucccauugaaacucucacaaaauugcccuuguuugaugagagaaauguaguugaagcauuguccugggggagaaggacucucuggugaaguuuucucagauguuuuucugcugaagcuuuggcuaacuuucucaaaacacucucauaaugagcagauguuauuguucuuuggcccucuagaaagucaacaagcaaaauaccuugagcaucucccagaaaacuuuaccauggccuuuguucuugacuggucugcuuuugcuaugacaggaccacuucaaccucucgguagccauugcuuugauuaugcuuugucuucaggaucauacugguaaagccauguuucaucuccuguuacaguucuucaaagaacugccucaggaucuugaucucacuuguuuaaaauuuccauugaaagcucugcucuugucugcaacugaucugggugcaauggcauugguacccauugaguggaaaguuugcccagcuuuaauuuuucagucagauuugugugagcugcaccaauugagguaucugugguguuagcuauuguuugugcuguuaauuauugcuucucuucaauuagggcaugaacaagaugauuuuuuucauuguaaauugauguagauggucugcugcugcaggcgccaucuucaacaucaucuugucccuccuuaacaaguuauccauuuguaaacugcuaauuuuguuggggauuuguccccguaaacuuuucugaaagcaccagugauuucaccauucuuccauccaagcuucaccauaaauguugauguuuguucuugcuucaauuuuagcagaauucauguugcucugagaggggcuguuuucaaguugaugucguauccuucuuagugccucaaacaaaaucccacucagacauguuauaacaaguuaguaugaguuuauuuuggugcaaaacaauuugaaauccaugcauagcuuuuucauacuauguguuuuccaugaacuuuucuaagucaccuuguauaagaguauuauaugaucucauuuauaugaaauuuuagaacaggcaaaacuguacugauagaagacaaauaagugguuaucugguguuggaaugggguagagauucugcgaagggggaugagugaagucuuuuggggugacauuuaggaugauaaguaauguuuuauaucuugauuguugugguuacauggguauauacauuugucaaaaaucaaacuauuuuuuuuuuuucgagauggagucuugcucugucaccaggcuggagugcaguggugcgaucuuggcucacugcagccuccgccuccuggggucaagcgauucuccuuccucacccucacuaguagcugggacuacagguguguaccaccacucccagcuaauuuuuguauuuuuaguagagacaggauuucaccauguuggccaggauggucucgaucucucaaccucgugauccaccugccucggccucccaaagugcugggauaacaggugugagccacagugcccggcccaaacuuaauacggguacacuuuauuguuucuaaacuacaccucaauaaauguugauuaagugaaaauuaacaaugagauacaauuccauacccaucauauuggcaaaaauuuuguaaucugguagugucaaguguuggugaguauauggggaaaggggaacuauucuauuucauugauggaaguaaauauugguacaaucacuguugagccauucagcagaauaauuuggcagucucuaguaagugaagauguauauaacugugauccagcaauuccauuucuaagcauacgcugugaccuacagaugcacucacauauguguaccagaugcacaaacugacugcaacauuacuuaugauagcaaaaaaucaggaacaaucucaauauauauaucggaacaaucuauuaacagaaaauagauugauaacuuuugguauagucauuuacaagagcaaacuagacugguguaucucagcauggguagaccucaaaaauauaauguugaaagcaaaaagaaccucauuaaaaugggcaaaagauguguacagacacuucucaaagaagacauacacguggccaacaagcaaaugaaaaaaugcucaacaucacuaaucagagaaauguaagucaaaaccacaaugagauaccaucuauaccagucagaaugacuguuaucaaaaaguaaaaaaguaacagauacuggugagguuguggagaaaagggaauguuuacacacuuguggcaggaauguaaauuaguucagccacgguagaaagcaguuuggagauuucucaaagaacuuaaaacagaacuaacauuugacccagcaaucccauuacuggguauauacccaaagcaauagaaauaauucuacuauaggccggaugcaguggcucacgccuguaaucccagcacuuuggaaggcagaggccggcggaucaccugaggucgggaguucgagaucagccugaccaacauggagaaacccugucucuacuaaaaauacaaaauuagccaggcgugguggcguaucccuguaaucccagcaacuugggaggcugaggcagaagaaucgcuugaacccaggagguggagguugcagugagcugagaucacuccauuguacuccagccugggcaacaagagugaaacucagucugaaaaaaaaaaaggaaagaaagaaaagaaaaaagaaagaauucuacuguaaagacacauguacauguauuuucaucgcagcacuauuuacaauagcaaaaacauggaaucggcccagaugcccaucaaugguggacuggauaauggaaaugugguacauaaacaucauagaauacuacacagccauaaaaaagaaugagauuggcugggcacaguggcucaugcuuguaaucccagaacuuugggaggccgaggcagguggaucacgaggucaggaguucaagaacagccugaccaacauggucaaaccccaucucuacuaaaaauacaaaaauuagccaggcauggcggcacgugucuguaaucccagcuacucaggaggcugaggcaggagaaugguuagaaucugggaggcagagguugcagugaccucagaucacgccauugcacuucagccuggacaacagagcaagacucuaucucaaaaauaaauaaauaaauaaauaaauaaauaaauaaauaaauaaauaaauaagaaccagauuggccgggggcgguggcucaugccuguaaucccagcacuuugggaggccgaggcgggcagaucaccugaggucaggaguuugagaccagcccggcuaacauggugaaaccccguuucuacuaaaaauacaaaaaauuagcugggugugguggcacacgucuguaaucccagcuacucgagaggcugaggcaggagaaucgcuugaaccugggaggcggaguuugcagugagccgagaucacgccguugcacuccagcugggcagcaagagcaaaacaaaacaaaaauaaaaacaaagaaaagaaugagaucauguucucucagcaacguggauugaucuggagaacauuaucuuaaguaacuaacaaaggaacagaaaaccaaauguucuaacauauaaauggaagcuaaacauugaguacacauggacacaaagaagggaacgauaggcugggcucaguggcucaugccuauaaucccagcacuuugguaggccaaggcagguggaucaccugaggucaggaguucaugagcagccuggccaacauagcgaaacucugucucuacuuaaaaauacaaaaauuagccaggugugguggcuagagugcaguggcacgaucucagcucacugcaaccuccaccucccagguucaaaccacucuccugccucagucuuccgaguuguugggauuacaggugucuaccaccacgcccagcuaauuuuuguauuuuuaguagagacgggguuuuaccaaguuggccaggcugguuucaaacuccugaccauaggugauccacccaccucagccucccaaagugcugggauuacaggcguaagccacugcguccggccaguaucugaauuucgauaugagagcaagaacauuuaaaacccauauauuuacagauugaugcuuguuugcaugaaggccuuggugaagguugaccagaagucacccuguggacugucagcgucuuucuuucucuuucucucuuucaggguaaaagccccaaagcugucaucagcauuaaggacuugaaugccaccuuccagacagagaagauagggcacccccaugggcugcagaucaccuacaggagagauggccacaccaggaaccuguuuguguaucaugaaagugggaaggugagaugccuggaguugccaccuccgccuccagcucgcaccccaggacuuggcaggugcagcucaccaccuccccugcucacuggugcugugcucagcugccucuugagauuuucugcuaccauuugccuuaaucuaucauugccucccagucugagauaaagauaugaggagggcagggugagaucagggagaggaaccuggcaaguaccauggcuauaucuggacagugcacagccaccaaugaaaguccaguuacagaagggacuaugcccagggaugcaaagccagguagggccagagguucugaauacgggggaggaacugauggacagucaggcagcagugcaccccgggacccugcuucucaacaugugguccuggcccaacagcauuggcaucacccaggagcucaaggcugagcaugguagcuccugccuguaaucccagaacuuugggaagccaaggcagguggaucacuugaacccaggaguucgagaccagccugguagcauaguaagacccccaucuuuacccaaaaauaccuccaaaauuagcuaagcaugguggcaugcaccuguagucccaacuacuugggaggcugaggugagaggaucgcuugagccugggaggucgaggcugcagugagccaugaucaugccacugcacuccaagccugggugacagagcaggacccugucucaaaaaacaaaacaaaacaaaacaaaccagaaagaaagaaagaaaaauagagucugaggcccacccuggagcuaccaaauuagaaacugcauuaaaaaaaaaaaaaaaaaagaagaggccgggcgcgguggcucacgccuguaaucccagcacuuugggaggccgaggcaggcggaucacgaggucaggagaucgagaccaugcugucuaacacggugaaaccccgucucuacuaaaaauacaaaaaaaauuggccgggcaugguggcaggugccuguagucccagcuacucaggaggcggaggcaggagaauggcgugaacccaggaggcagagcuugcagugagccgagauggcgccacugcacuccagccugggugacagaguaagacuccaccucaaaaaaacaaaaaaaacaaaaaaacugcauuguaacgggaucccaggugagucuugugcacauuaaaguuugagaagcacuauuuuuuuuccuuuggagauggaaucuugcucuauugcccagacuggagugcaguggcgugaucucggcucacugcaaccuccaccuucaggguucaagcgauccucuugccucagccucccgaguggcugagaucacacccagcuaauuuuuuuguauuuuuaguagacacagaguuucacuauguuggccaggcuggucuugaauuccugaccucaagugaucugcccaccuuggccucccaaagugcugggauuacaggggugagcuacugcgcccggcugagaagcacuauuuaauaguccaggaaaucugcccagucagagaugaauaagccaauauaacagaauaagcugggucagguccugagcagggucacauaacuaggcaggggacagagaugcugaguggggguggaugaaggugggugcugacauuuugugaccaucuauuaacuccccugggcacugcuuuuggugauugcuguccaucauuucuuaauccugaaaacaagccccacauuauugagucacggacauguuaguaacuugcucagggucacagcccugcacccacuuuaccugccaugugccucugcuguaggaaggacacuuggcagcaggagccaggaaccagaugcagggacuagaccuuccuaaggggccccuagcaccauggcccuagcccccucuccaugccaaucacugccauaaggacuuuuacugaggcacccaaggucucuggcacuuaggauacccagcucccuccuaucugcccaguauggugcaucugacaaccugggucuggccauucuucucuuuugcuugaugccccagccugucuguuagaugggcauaaaugagggcuccagauuccugccugcaggagucagggggugauuuaaaagcuaaauggacaggcauaagggauggggagggggcuguggcaaacaggaaaaccugcauggaggauugaaacaaacaaaacuuuaggagcaaacagacauguaugcagguuggauuuggcaccaggaucaccagauuaugacuggagagaccuuccaaggugaaggccuaggugugucuuuucuggacuggccccauucccuuagugucugagaccuaagguuuuuuuuugagacagagucucgcucugucacccagacuggagugcaguggugcaaucucggcucacugcaaccuccaccucccagguuaaagcaauucuccagccucagccucuugaguagcugagauuacaggcauguaccaccauacccggcuaauuuuguauuuuuaguagagaugggguuucaccauguuggucaggcuggucucaaauuccugaccucaggugauccacccgccucggccucccagaguguugggauuacaggcgugagccacugcaccuggccagaggguccuuaaugaaccccaggacaagagagcacagaucccuggaauacuaggccugugugcuucgccuaugagagagaaagagaaaugguuucauuccuuuuaaaccauauucagaugacuuucucaaucaccacauuauaucaaagucacaaacuaccacuauuugaacaagccuuuagccucccaauuccaaauuccugggagaaggaaucugauaagcccaguccagccucuguguugcuccaggccugguccaguugcugugguuaagcaggggcaggaucacagcaguaaauggggcugcaacugggguugggugaagauaggcgggguaguucucacagaagcagggcuugggcugagcaagcaccaaaaaucuaucuauuacaacaucaaaacuaaccugcgggauaaguggaauguuuugcguaaaaggugugugugggauggagcgggcuaagcagaaugucccgagaggaaggaacaguagguguugggagaauugcaaauaguuuugcauggaaggagcucagacagcaaaaucauaguaaagaacuuaagacuuuuuuuucugaggguaguagacaggacuccaagccagacugauuagauuuguaauuagaaaaucacucuggcuacaggcugggcgcuguggcucacgccuguaaucccagcacuuugggaggccgaggcgggcagaucacgagaccauccuggcuaacguggugaaacccugucacuacuaaaaauacaaaaaaaaaaaaaauuagccgugugguggugggcgccuguagucccagcuacucgggaggcugaggcaggagaauggugugaacccagaaggcggagguugcagugagccaagaucgcaccacugcacacucuagccucggcgacagcaugagacuccaucuaaaaaaaaauaaauaaaggaaaaucacucaggcugccaugagagggccagucagagagcagcugaucaaggccagcuagauacaugguugucuaugugggagaugaagguggcccaggcugcugagggacauguucucucagagugacagcagaaggggccaagccagcuuuggccuaaguugccaugagcauccucauuagaggagcauccccaggcauaacugcuccccacccaaaugccaaucuuugacaucugaggacaaugauuuccuagagccuugcuccuuagagugcauuccacugacuagcagcaucauaucaccugagagcguguuaggaaugcagagucuugggccccauuccaaaccuacuggauaugccucugcauuuuaacaagagccucaggugauuuugcacgcauuagaaggugaaaagcacuguccgaggccauugcagaacucccaugcaguucacucaauccuuuuccagggcucugggguuaucccugucagaggcuuccugcuugcccggguuagcccacgaggcucugacacaauccucccuggaugccccugagccgagcuguggggugugugcaggugcugaauauaugugccccacacccaaugcccagcuagcuucccgccaccagagguagcuucccacccaccccaucucacugcuguguguguguccugugcacuucucuccgcaggagauaguggacugguucaaugcccuccgugcagcccgucugcaguaccuaaaaauggccuuuccugaacucccagagucugaggugagcuaaaugcggaccccaauuucugaaucuccucuuggccaucuccuucuuucccugucuguugaccucgaagacacucagaagccagacuagggcugggcgcgguggcucacgccuguaaucccagcacuuugggaggcugaggcgggcggaucacaaggucaggagaucgagaccauccuggcuagcacggugaaaccccgucucuacuaaaaauacaaaaaaauuagccaggugugguggcaggcgccuguagucccagcuacuugggaggcugaggcaggagaaugguguuaacccgggaggcggagcuugcagugagcccagauggcgccgcugcacuccagccugggugacagagugagacuccgucucaaaaaaaaaaaaaaaaaaaaagaagaagaagccagacuaguuuuguuugcaggcaagaccucgagguugagggcugggcugcucagagggaagcccaaggcauucuccaggggagccugcggggguuacagccucacauacgacaaggcggccucccaaaagcuggucagugucuccccuucagaagagugucaaggggcucagcaauuggucaucucuuucugaacccuucucccucuaaaauguacaaaugaucccuaacauacugcuuacagagugcuuugagcccauuuugucuugugaaauggcagccaggcaggggugauuauuuccauuucacugaugaguuauacagucccaggaagggcaggugaauaaccaaaggugugcuucccuuucuaaaauccccucuuugcccugugaugcucugggcuugggaaagccugggauccucuccauuacaguuguaacaggagcagguaugcccuucauggccaacaucauggggagccgagaacuucauuuugauugucuccagacuucuggggccuucaucucccuaucucaggcugggccagggagacccgcaugguguagggcagaggaugcugucucgagccaggaagccugggcucucagggaugcucuauugcucacuugcugugugaccccugcagguccuggcaccccucugagcuucuauuuccauauggguaagauggcgguuaguccaggucaucuucagggucccuuccgccucugagauucuaugcucugguccucuucaagaggcuccccuccaagaggauuuuauaagugauggggcuggaaaaccauuuuaaugcugggauuuucuuaaucucaaccauuagaguuuccuugaaagccuaaaugcuccuuaauuccaagguuuguagggagccaguugucuggaauaggguccccuccaggcccagggaugugcugagauggcagcucucugggagcaauuccagcaaggcccgagucagagcccuugagucagucugcugaguuugcacccagaacugguuaaugcuggcucccaugggcggggaguggagacugcugacugcugacuaugaggagggaggacaaagugcagaugcucagccuuauuuaaucugggcaagcugcccaucuuugcugacauguguaaaggaaauugcucuuuggucaacauccucaauguuccccugccucucucauccacugucgguaccugauauccaucccgugucuuuccucccauuuaaugucuguguauggugugagguucugagcaaucaccaggccuggcucaagcuuuagggguccacauguuggaaacccagggcaucccaguggggucugugguccuguaauaaaugcauauggucucuuggacuucagagaaaguagguuuugucgccauggugacagaugagugcaucgaggcucagagaggugaggugacuugccuaggugauaguaccuacuuucuagggcuauugugagacuccagcgagccaaggcaucagaaguacaggaagcagugcuccagccaugugacuuuccuuuuuuucccaaugguuucccuaggccucugcuugcucugugcuggcucaaauuccgaauauugagcaguucgggacuccaucuguuuucuccaaauggaacaauuaaagccuagugaauguauuuuaagagaaggggaguaguacaguuuauaucuuguuucuuacauuaaaaauuuuuuuuuaauuuuuuauagagaugaugucucacuuauguugcccaggcuggucucgaacuucuggccucaagcaauccuccuaccucggccucccaaagugcugggauuacaggugugagccacugcaucugaccaauauuuucuuuucuuuucuuuuuuuuuuuuuuuuuuugagacagagucucgcucuuucgcccaggccagagugcaguggcgccaucuuggcucacugcaagcuccgccucccagguucacgccauucuccugccucagccucccgaguagcugggacuacaggcgcucgccacugcacccggcuacuuuuuuguauuuuuaguggagacgggguuucaccguguuagccaggauggucucgaucuccugaccucgugauccacacgccucggccucccaaagugcugggauuacaggcgugagccacugcgccuggccuaauauuuucauuuuuggcucacaaauuucccccuuuuaaacuucccauagcuguuccccagaccucacuuccccugugccucugcccugggcccuggagcucuggagaagccucucuguucuuugaagccuggacugucauuugaagcucuagacuuuccagguugaugccuaggagcauaggaggccaucaucaaccccuggaaacaucucugggcguaggcugccaggcuggaagggaugcuggggaucacaugauccaggcuguuuaucacacaggggagacauaaggccucgagagacagaaggucuuaacaaagguaaugcagcugauggaggccagaacuggaauuagaaccaggucucccgacuucugcuucagaacuuucucuguccacucuggcaucauuuucuuuucuuuuuuguuuuguuuuguuuugagauggagucucccucugucacccagacuggagugcaguggcacuaucucagcucacugcaaccucugccucccaaguucaagggauucucuugccucagccuccugaguagcugggauuacaagcgcgugccaccaugcccagcuaauuuuuauauuuuugguaaaggugggguuucgccauguuggccaggcuagucucaaacuccuggccucaagugaucugccugccuugaccucccaaagugcugggauuacaggugugagccacugcacccagccucuggccauuauuuucuuguugcuuggugucagaauccugaccaggccuuucccaagguccugcucagagggcccuggcauauuuauacuuuagcaccuaguguagugguaggaguacagucuagugucauuggcccugggccugaaucucagcucuuugugcuaccagugaugugacuuugggaaaauccccagccccuucucuguggccugguuucuucagauguguaaugaggcuggugauacccaccucgcagggugauugagaauugcaccuggagccugaugcaaaguggacccucagaacauguugccugacaccaagagggucucugcagagccuugccuauguccacacccugggguuacugaaggaauccuuaaaccaaaacucggccgugccacuaagcucugcaaacaucuggggugcugucgacuggcuuuguugaaauauuaauauuaugaccauugcacuuuccaaauauaauacugugagccaugagcguacauccuuccccauuucaaacuuccccuuugucgggagccaagcucggcgggaaccuggagccuuggggugugaguugggggucagugucugucucucuuccccagcucgugccauuccucaccaggaacuaccucaaacaaggcuucauggaaaagacugggccaaagguaccuucuaucacucccuggggaacuuaauaugguuuaauguauauagaagguuucauguguuuaugggaugauuguuaagaggacagugaaagguguuaggccaagcuuguccaacccacagcccaugggccacaugcaacccaggacggcuuggaaugaugcccaacagaaauucauaaacuuucuuuuuuaaauuuuuuugagacagagucuugcucugucacccaggccagaguacaguggugugaucucggcucacugcaaccuccgccucccagauucaagcgauucuccugccucagacuccugaguagcugggauuacaggugcccaccaccaugcccggcuaauuuuuguaauuuuaguagagaugggguuucaccauguuggccaggcuggucucgaacuccugaccucaagcgaucugcccaccucagccucccaaagugcugggauuacaggcaugagccaccaugcccagccaaauucgugaacuuucuuaaaacauuaugagauauuuuugcgauuuuuuuuuuuuggcucaucagcuaucauuaguguuaguguauuuuauguguggcccaagacaauucuuccaauguggcccagggaaggcaagagauuggauauuccuguguuaggcaaucaugaaagcaagccuugggcagguggaaaaagcagucaaaggguuguuuucagagaggcgcagccccuccgccugguucuuguugcugggcuuucucucccugaccuagguuagaauuuggccaaggccagcacuuucagccuugccaagcaguagccacuucugauuuuuuccaacuuccuuuccggcuucuuugucuacagccugaaaaagaggaaggugccucuuccaaguugaggcagcagggugaagcuggcaaaggguauggugggguuggaaggggaaugggcagaaccuucagagccugagggcuccuauccaggccccagggagaagcacuaggaugucugacugaggaggcugggcuggagaaccagugggacuggccagcuccuuugguuugggcugggcuggccccugaccucuauccucagaaacugaccuggucaucugugguaagaaguucccucuuuugcagcagaaagaaccuuucaagaaaaggugguucgcccuggauugccaugagcggaggcugcucuauuacaagaacccacugguaagagccacuccugcucccuccccagggcuuccucaaacauugcuggguggugcuugucuggaacuaugugaaagcuacagauaaacacaucucccagagccccagagcuagagaaaccuugagaggaaaaccucuaccccuuguuuuuguuucucuugaguaaucuccuauggcaugaagcuucuccucgcuuucaggaagucuauuaugaguauccaaaaugcugcccaugguaguuaaauaugguguaucucuuccucuagucuccagggcucacuucuaaccaagaggccgugauguguaguaguuaggagugugguggacucuagaaccccaccgucugggcucuggucucagcccugccacuuguaguaguguugccuugagccguguacuuagugcucugugccucgguuuccuccucugaaaaacaggcuuaauaagaaugccuuccccagagguugccaugaugguuauuuaaguuacuauauauaaagcauuguaauuccugaugcugauuuuaauaagugcuccguaaauguuagguaucacuuauuuuuuuuuuuuuagagacagagucucucucugucacccaggcuggaaugcaguggcacaaucacagcucauugcaaccuugaacuucugggcccaaguuaucuuccugccucagccuccuaaguagcucagaauacaggcaugcaucaccaugcccagcuaauuaaaaaaaaaaaauuuagggcuggaugugcugccuuuugucuguaaucccagcacuuugggaggcugagacaggaggaucgcuugagcccagaaguucgagaccagccugugcaacauagugagaucccaucucuacaagaaacuuaaggccaggcacgguggcucacaucuguaaacccagcauuuuggaaggcugaggcggggcagaucacgagcucaggaguucgagacuagccuaaccaacauggugaaacccugucucuacuaaaaauacaaaaauuagccggacgugguggugcgugccuguaagcccagcuacucaggaggcugaggcaggagaaucgcuugaaaccgggaggcagagggugcagagggugcaugccauugcacuccagccugggugcagagugagacuccgucucaaaaaaaaaaaaagaaagaaaaaaaaagaaacuuaaaaauuagucaggugugguggugcaugccuguaguccuagcugcuugggaggcugaggugggaggauugccugagccugggagguugaggcugggaugagccaugauugugccacugcacuuccagccugggugacagagugaggcccugucuccaaaaacaauucauaauaauaauuaauaauuuuuuuuuguagagaaggggucucacuauguugucccgguuggucucauauuccuggccucaggcaauccucugccuuggcuucccaaagugcuaggauuacaggcaugaacuaccaggcccacccucgguaucuuuucaauagaugauguguaugauuuauuuuaggguuuugaucuuucaaauucugggucccacuuagcagaaaucccagcagggaccucauaccccuuucccaaaauaaagcuuggaggcugucagggcugcagggccccucugcccugggggcacccucugaugacccuguacucuccauuuucaggaugccuucgagcagggccagguuuuucuugggaacaaggagcagggauaugaagccuacgaagaccugcccaagggcauccgaggaaaucgcuggaaagccggacucaccauugucaccccagagcggagauuuguccucacuugccccagugagaaggaacagcaggaauggcuggaaaguuugcgggguguccuguccagccccuugacgccccucaaccggcuuaguaagaagcaggaacugagggguguucuuuuggacaagggcagaggacagaaaauugcuucuucacuuagguucagcuuugauaccacaaaagauuccugauuccugacuaugcucuuuucauugucuucucuuccugcaaaagaaaagcacagacaugccauuauugccaaaaggucuccucuguccacucuggguuccccuaaccgagcccuuccccaggagcuuuuagaggaguuuggcccuggcagaaccccugggugcugucuguaccccuugcggugugggggcuaagcagcuucucuuucccuccaccgugcucuaugcugauccuuuuucucgugagaaaacgcuggccuguuauuauuagcuaaggucacacccgcugggcagcuccugggauuuuuggauuccuccccacuccagagggaaggcuauuucuaguggcuucuuuucuuugaguccucccuucugucugccucucuccuguuccuccucuuuaccaguagggcuuccucaaugcugacagcccugugaaaaaaggggagacaugccgagcuccggcaggaaacugcuggcccaggaccuggcuucuggggcacaaaggagaauuucuguguuuggaaaaguacagacugagcaggugacccccgcacagccccuugggggaaacacuugugcccuuugagucugacugauauaaacacagacucucuugacugucccauaaaggccaaagccagagaaccucagaaagggacuugcaaauugugagugaggcauaucagcuggugcuuucuuuucucugugggcugccauuuaugaaucucuugguuucucucugucucugucccuccacuuuucucuccuuugcuggugugugcauucccucugacgcccuggcucucacucuuucauucuguuuuuuauucuggcucccucugucuuuguguuuuuuuuuuuaauuuucuuuuuuugagguggggucuugcacugucacccaggcuggagugcaguggugcgaucucagcucacugcaaccucuucuuccugggcucaggcaauccucucaccucagccucccaaguagcugggacuacaggcucgugacaccacaucuagcuaauuuguuuuguauuuuugguagagacagaguuucaccauguugcucaggcuggucucgaacuccugagcucaagugauccaccugccucggccucccaaagugcugggauuacaggcaugagccacugugcccggccauggcucccucugucuuuguacgccugucccuuugcugucccucuccuccacaggacagcauuggcauggccaccucccucagcccucuucauuucccuugcagcugcaucaacagagaguggccgcagcagcaggugacccauuaacugaggaacuggcugccacugaacaccuggaacuccuugugggaagaaguuugcaccucggcccuggcugcccaccaucagugccccgcagucagcagccauuccuggcagugaacucugccaggacugaagcuguggcuuuauccaucagcucccugggccuuccccgcaacccaccucggggaucugaggaucuggugcauagaugaacaucuauccccuccucccccauacacaccuaggcuugaaaugcccuacaggcccagaacuuucucacaucugaaauggaggcauugcaaugaaaaggcacccacagcaucaugcaaguggcaucuuguaaaaaaaaaaaaaaaguuuaaucugaaucuaaccaugaggaaauaaucagacaaauccacauuaggggcauucugcuaaacaucugacccagacucuucaaaaaugaagagugaaagauaaaguagucaauggccgggcgcagugagauugcgccauugcauuccagccugggugacagagcgagacuccguaucagaaagaaaaagaggaacugaaugaaaucucagauggcugaaauguuagagaaacagagcaccaaguccccugcucugugacucguuguuccuuuccucugucuucaagcaccacgcagaaauacacuggauguucucucuuugcuucaauggagacccaaggagcugggaggucucuuaagagacucucugauucuccguggcugggugugauggcucaugcccauaaucccagcccuuugggaagcugaggcaggaggauugagaccaggaguucgagaagagccugggcaacauagugagaccccaucucuacaaagaaaaaaaaauuagcuggacaugguaaugaaugccuguagucccagcuacuccggacacugaugugagaggaucacuugagccagggaggucauggcuacagugaccccucauugcaccacuuuacuuagccugggugacagagugagacccuaucucaaaaaaaaaaaaaaucuaugcauuguaugggacuuuccuuuggaucccccaaucaaaggauaagcaaugcguaagccuguguccuuccugaagcuucucgacugcccagauagggaggugaguccucucuaucuccucuggcucuggaagcaccuugaaaaugugcauuuucaaggacacuugcuggguugugcauuaagggccaguuuacuugucugccucuuugaccaccugugaacucuguuggguguacucugcuaaguucuggggaugaggaaauuaauaaagguacagucuugccuucaa

SEQ ID NO: 192281 - RNA, 13769 nt, Homo sapiens
gauaccgacggcugcacgggagcaggggagcgguuuggcggagacacagggccgcucagaggccgccgcaaugcuccccucuuugcaggagucgauggauggagaugaaaaggaacuagagagcagcgaagagggaggcucagccgaggagcggagacucgagccgccguccagcagccacuacugucuuuacagcuaucgcggaagcaggugcuggcgcccagcucggccugccagcccgcccgccccugcggccccgcccccggcccgccgcccggccuugcaccccacccccggcccagcggcccggccgcuccuaaaagccaucuucuccucucccagccaaggucucuggccugaagggcgcuccucgccucccgcugcucuuccuggcccccgucguggacuuguaugccuggcccaaccaugccugugcccuucaucugccccuauaucaucccagccucuuacucucgcggcugcccuuuguuuagcgcagugccccgcaugcucaauaauuucaguucccguccccucuccuuucugucauuaucuccccacuucucccauuucugucacacacacccccauccccacccucugguuuuccucuguucuugauuccucuuuuuccuccuucugacuuuccuggaaccuucuuggccuugucaaguuugguuuuuaaaggaguuuccuugaaccuucuggguauuuagccuuuccuccacccguuaaguggccuggagagagaaggggcucuugucagcacugcuguauggguuuuccuugucaugaggauaggcagugcacuuccaccuugcagcauuuuuaguugacuccuugccuuacccugcuugccaggcccccauacuccucuugguuuagagcccauaauugauagcacuauugguuuuguggcuuguagauuggcacagcaacgaggggacagugaggacggaagcccaaguggcacaaaugcagaaacucccucuggugaugauuucagguaaaaagagcuucagcauaauucaugcaugugcuuucaucuucccugcaucucuggccuguacaugucaguggauacucuauuuccacugagcuuucccugagucaaaccgucaauuccuccuauccccuaggaaccucauccugauuuccucauuggcugguucauucaaggcuggggcaaacaaauccacauacugauagugugcuuggugauuagccaaaaagaaauccuuuuuuuuucuuuuuccuuuuaaauugagacagggucuugcucugcugcccaggcuggagugcaguggcaugacuuuggcucgcugcagcgucaaccuccccggccucaggugauccucucaccucagccuccccaguagcugggacuacugaccaccacgccuggcuaauuuuuguauuucugguagagaugggguuucaccauguugcccaggcuggucuugaacuccuggacucaagugauccgcccacuucugccucgcaaaguguugggauuacaggcaugagccaccuugcccagcccugaaaaauuuuuuuuuuuuuuugagacagagucucccucuguugcccagucuggagugcaguggugcgaucucagcucacugcaagcucugccucccggguucacgccauucuccugccucagccucccgaguagcuaggacuacaggcacccaccaccacgcccggcuaauuuuuuuguauuuuuuuuuaguagagacgggguuucacuguguuagccaggaugaucucuaucucuugaccuugugguccaccugccucggccucccaaagugcugagauuacaggcgugagccacugcucccggccccagcccugaaauuuuuaaaucaucaauuauaccucaauaaaguugaaagauaaaaaagauaagaaugugugcaggggugugauuauaaugacugaccauggaauuaaggcagaauaaggagggaagugagaugagaaacuugagagacugaaaaagagguagggucaguggauuggggguuccaguggagucacaguacuggagagaaugagcuggaaagauaggaauauuuuaagcuauuugaugagguagaucauacuuagugacauacauuccuagaagccucaccaauaggggucauaaggacagcuuuccccaguccuuaaaagagccccuggcguugguaccauucugucugacuuaaugggugugaauacccuaguccacugguaaagaaugugugucuuucauuugucaagccucuccuuggcagauacuaaucuaccauccgaaguggagccagagcugcgcaguuucauugcuaagcgucuuucaagaggugcagucuuugaagggcuggguaauguugcaucuguggagcuaaaguaagugcaaaaugugcuguguccugaguuuuuauuucugaacuaaauaugagaagugaugagaaacuccaaaagaucagcuccuacuagaccugcagaauuugucuuuauucucuggcagcccgagcacugggccucacacauaaacauuuguggaauggaauuaauugaauggcagagacccuggcacccaauugcacuuuauuuaauuaguuuauuuuuuuuugagacagggucuugcuuuguugcccaggcuggagugcagcggcccgauuacagcucacugcagccuugaccuccugggcuuaaucaauccucucaccucagccucccaaguagcugggacugcaggcaggcacuacgaugcccagcaauuuuuuuaauuuuuuuuuuuuuuuuuuuuuagaaaugggguccuaccauguugcccaggcuaauaaguuuuguacuuagaagaagaaaaguguugauuauuaaaacuaaauuuguauacaguuuguauuuucacaaacuuuuauguaguuuuccuuacaaaggggaaauauagcagauacucucuuauuuucauuuucagaugaggaaauaaacucagaguuuauguaaacuuaagucaugaggcuggucaaauugauggaguucaggcuuaaacaugagcauucuuaguccaauuccaacugucuuuccauuacaccucuccuuuuuuguuuuguuuuguuuuuuuuaagacagagucucacucuguugcccagacuggaguacaguagcaugaucuuggcuuacugcaaccuccgccucccugguucaagcaauucuccugccucagccucccgaauagcugggauuacaggcaugcaccaccauacccggcuaauuuuuguauuuuuaguagagaugggguuucaccauguuggccaggcuggucucgaacuccugaccucaggugauucacccgccuuggccucccaaagugcugggauuacaggugugagccacugugcccggccuccauuacaccucuuuauucuaguucaacucagaccgugaaguuagcauacagguccucaggaguuugaggccacuucccaaggauaaggccaccuucaggcacaucugccuuaaacaucaauuugugaagcuuugggagaggggagaacauacuuuuuuuuaauauaaacauggguaugaacuagagugaaauuugugugaauuuuucacauaagacaggagaauucaaagaaauuucauguauguuaguggcugcuuuaacuaaagcccuccaggguauacauucauuuuucuuugcugcugcaaguacaccaacgagaagucugggaagcucugaguuagugggcaguuuaaugguguugccagaucaagaugaccagaauucagagcaguccacaaaauuauagaugcaugaguaaccaaaauaaugcauuuuacauuuucuuucuuuucuagaauuccagguuaccgaguugguuguuauuacugccuuuuccaaaaugaaaaacugcuuccugaaacaguaacgauagacucugaacguaacccuucagaauauguggucuguuuuuuaggagggucugaaaaaggacuugagcuauauccuuucuuugguuuuugagaacaucaggaaggaaaacaugggaaggcagguggaagaauauuacuaccaaccuccaaaaagcuuuucuacuccucguguauuuaguugaauuucauaccuucauguggccauuuugccuuggcuuguuugcauuugcagcucacauuauuugagagauuuuauauuucuuguugagagaugaaauacugucuucauuauucauccuuuauugcuuccuuaagaacauacuuucaggcuugaauuggacaaguacauucaagggcugaaaaauaacaugaauugugagguaaggugacugacuuaaugguuuuuaaagacugaaauggggccaggcucaguggcucacgccuguaaucccagcacuuugggaggccgaggugggcagaucacaaggucagagaccagccuggucaauaugaugaaacuucaucucuacuaaaacuuagccaggcaugguggcaggcaccuguagucccagcuacuugggaggcugaggcaggagaaucgcuugaacccgggaggcagagguuucagugagccgagauugcaccacugcacuccagccugagcgacagaguuaaaaaaauaaaauaaugacugaaaugauuaauauacugugauugcucuacuugucaaaucauauagguagacacaaagacgccuguauucuagaaacuugccaccuugugagcuaguagagaggugaauuuuuuuuuuuuuuagacagggucuugcuuuguugcccaggcugcagggcaguggcgcgaucaggcucacugcagccucagcuucuuggggcucaagcagucuucucgccucagccuccuaaacagcugggacuacaggcaaauaccaacacgccuggcuaacuuuugguauuuuuugucgagauggggaucucacuuuguugcccaggcuggucuaggauuccuggccucaagcaauccucccuccucagccacccaaagugcugagauuacagacacgagccauugugcccagccuacaggugguuucuuuuucuuuuucauuuuuugagauagggucucacucuaucacccaggcuggagugcaguggcacgaucauggcuuacugcagccuuuucugggcuccagcgauccucccaccucagccucccaaguagcugguaccacaggcaugcaccaccaugcccagcuaauuguauuuuugguagaggugggguuuugccauauugcccaggcuugucuugaacucuugaacugcugagcucaaguaauccaccugccucggccucccaaagugcugggauuacagguaugaaccacugcacccagccuacaggugaucuuaaagggauacaggaaacauaguccuguaagugcugaaaguuucacaagacuacgucugauguuuuguaucuaugaaaaauucgaucuauucaauggcauguaguaacaugccuggcgaggaagaggauguccuuuuccugauuucuaggcauauaagauuuauauuauggucagaaguacugguccaugcagccucuggcaccaaagacaugcuaugcaauaguauggcuguucuugaacuaaacaucaaagauucuuaaaaacauucuauuuucauuaauugaucuuuuaugaauuaggcauauccauaucaacuuauucaaaccuuugaaaaacuggcugggugugguggcucacaccuguaaucucagcacuuugagaggccaaagcgggcagaucacuugagcccaggaguucaaggccagccugggcaacaaagugaaaccccaucucuacaacaaauacaaaaauuagccaggcaugguggcacgcaccuguagucccagcuacuugggaggcugaggugggaggaucgcuugagccugggaaguugaggcugcagugagcuaugauugcaccacugcacuccagccuggaugacagagugagacccugucucaaaaaagcaaacaaaaacaaugcuuucagcuuguagcaguuguuagucaugacucucacaaauuuacuacccauuacauauauaguagaaguuauacuuuucacauacuuagaagauacugcaggagagaggaagggauagugcaggagugagcaacugaugcaagucuaauagaguuguucucccggacuagagcucuucgugugugacacuagucuucagggagcaguauagccuagaaagccagaugugcucacgguagcaugucugacaucuggaguggaguggagugcuuugaugaguuacuuguauccuuccccauucacauucugaauacgaaugaauucucuaucuacaugacuaauucaaaaggcacuuaauaagcucauacuaugcauguuuuagacacuguaccacaggugccagggaaaugaggauuauugagugaguaucuccauugagugcacaguacagugggaggagagggacuugugagugcccaacucuucccugugaagaaauagcauggaacccuauucagucucuucauuuuauagaaugcauuucuugguguguuuuaaauaaauucaguacagauuuaacccucacccugcccaacaagccaggaaagguauaucacaauuucuuuuuuugaauuggugguguuagcuuuaaaaagggaggugucuauccuggucuuuuucaccaucaaggauaugaugaagaaaauaugaaguccacuaaaggaaaggcuuauauuaaagcaaaugauguucuuucuugauuuaggcaaggggccuggagagucacauaaaauccuaucugagcagcugguuugaggauguuguaugcccaauccaaaggguuguucuucucuuucaggaaaagcuuaccuuucugcuacaugcuguaaguacugccaaaugagagcauuuccuuaacugagaaucacuuuggaugauuuagaaacauacucauuuucucugaacaugacucccaucccuccccaaauauucaaacuaugcuugcuaucaagauagaccacacuuuauuuucucagaucuagaaagugauauuacuaagguagaguugaauuucaaaugcugagucuuccuaauaggauaaaacauuuuaaaauaauuacuuuuccaagugaucugggaaagguauaguuuccaaaacaauuugaaaaggaaaacaaaaauccagagcaauuuugauucuauaaaauguuaaugagcaguggcugaacaaggcucuggagagcuugugaccagugcccaucaauuguuguccagugugguagggacuuauggggacauuuagucaugaguagcugcucaagaaaaacuggaauauauguaccaaucaggcuuuauuuuucucucauaggcuuugaguuacacuccuguugaaguuaaagaaucagaugaaaaaacaaagagagacauuaacagguaaagaacaguuuuuucaaagagaaaagcuuuuccacagcaagauugacaucuguguuuguaaacugcuccuuccaucccuuccccaccagcccagugcaaaauaaauuuguuuucauccuuccguccugcaauauuguuuguggaaauggacuuguguguguggcagguuucugaguguggccagucuucaaggacuuauucaugaaggcaccaugacuucuuugugcauggccaugacagaggagcagcauaagucuguggucaucgauugcagcagcucccagccucaguucugcaaugcaggugagcuacaaccucugaagcagccuuccuacaucucuugcgaguccccaucuuugcacugagagccuaugauacaaccuuauucuuccugccuugugcaguuuuacaugguuaucucaaaccaugagaaaccacuuggugaaaacaauauaauucuagaaacauggaaaucaugccaugccuagcaauuccacaccuagguacauaaagaaauucuaguauguguacacaaggagaugaauuuuaaaauguccauaaaggcauuacuugaaaaagcaaggaauuggaagcaauuuaaguguuuaucaacaagaaaacugauaagcugcuauauucaugcaauggaauauaacagagcagugaaaaagaaugaacuagagcuacuugugucaauauagcucucaaacauacuauuuagugaaauagccauaaaagaaaaaauacauaaaaguuuuaacauaugcagaauaauguagauaaggcuuacacgugcaaagguauaugggaaaaguuuaaagacgucugugggaaugauuauccucucugaugggaaaggaagggggaugugauugggaaggggcauacagggggcuucagccauuuugguauuccuuagccauguggugagcacacuguuuuuuuaggccauuauacaugucuuaaauaauucauuauagguguuuuuauaaagaaauaaaugggucaggcgcaguggcucacacauguaaucccagcacuuugggaggcugaggcagguggaucaucugaggucaggaguuugagaccagccuggccaauauggugaaaccccaucucuacuaacgauauaguuaguacuccggcugcacuccagccgggcaacaagagcgaaucucccgucucaaauaaauaaauaaauaaagcuuuguaaaauuucauuuuauuuagucucucugaaauguuuuauaggaaguaaccgguuuugugaggauuggaugcaagcuuuuuuaaauggugccaaaggagguaacccuuuucuuuuccgacaaguacuggagaacuuuaaacuaaagguaauuaguuggcugugugccaagugccacaugaaauuuuugucugaauuuuaauuaguaccagugacagaguaacaaauugcuuuauagcugugaugucuguuaauuaggauguucucaaaacuggaauuaucagaagacauuuacuuuauuuuuuggcagcuucuguauacauaucauuucuaauaaauuggguugaaugcuugcuuauauuuaaggaacaucagucuuacaauuugugacuuaacuuaguuggaaagcacaaaaaaacugguucaguggcuaaguuuucaaaauucugaugggggcugggcgcaguggcucaccccuguaaucccagcacuuugggagaccauggcagguggauugcuugaggccaggaguucaagaccagccuggccaacauggcaaaacccuuucucuacuaaaauuauaaaaauuagcugggccugguggcgcaugccuguaauccuggcuaugucagguggcugaggcacgaaaauugcuugaacccaggaggcagagguugcagugagcccagauugugccacugcacuccgaccuaggugacagagugagacucugucuaaaaaaaaaaaauucugauggggacguguugucaccuuauuuaguuuuguuuguuuguuuuaagagacagaaucuuacucugucacucaggcuagagugcaguggugcaaucauggcuuacugcagccuuaaccuccuggguucaagcagucuuccugucucagccuccugaguagcuggaacuacaggugugcaccaccacacucagcuaauuauuuuuauuuuuuguagagacggggucuugcuguguugcccaggcuagucucaaacuaccggcccuuaggcaauccuuuugccuggggcucccaaaguguugggauuacagacaugagccaccaugcuagguagauuauuuuaaaguauuuuuauuuuguauaagagauuuuuggcugcgcgugguggcucacgccuguaauuccaacacuuugggaggcugaggcggguggaucacuugaggucagaaguucgagaccagccugaccaacauggugaaaccccgucucuacugaaaauacaaaauuagccuggugugguggcacacaccuguagucccagguacuugggaggcugaggcaggagaaucacuugaacccaggaggcagaguuuguggugaaccgagaucaagccauugcgcuucagccugggcaacaagagcgaaacaagaaaaaaaaggagauuuucuucuucuaccaagggcaaagcauacugcaauuuaaauuuuggaaauauuuaauaugaaaagcaaacaauucaggaagauauguugaguucucagcuggauaggaguuauuuuuugagcuucauuauuauuucacuuaacacauuuuuaacuggguaaucauuuucuaggccauacaagacacaaacaauuugaagagauuuauccgacaggcagaaaugaaucauuaugcuuuguuuaaauguuacauguuccuaaagaacugugguaguggagauauacuuuugaagauuguuaaaguggaacaugaagaaaugccugaagccaaaaaugugauagcuguccuugaagaauucaugaaagaagcucuugaccaaaguuuuugaucauauguuuugagauaauuguaugaucaaguuguauauuuaagucuuaguguuugaaauugcaguuauaauuguucauaggauugcuauuuaagaugauuugaaacucaauccagauuuucuuuuuguauuuuaccaauuuaacuuaaauaaaaaucugaagaacaucuucacugaguccuagauagauaauguaugugagaguugugaaauuuuagugucucacuggccccauaaauuccacgcuucaggaaguuguugcuuaaaaaauuucagagaugauuuuguuuguggcuuuucucaggaaaagccugaguuugcugcaguauuuagcaacuuuucuucucagaaaaaccauaauacuuccuuuucaguggacuguagcuucuuaaaaaaaaaaauguaauucuagucuuagaacagauuaauaccacuacaccaguucagagauagaucugugcauccugugggugcuugauacauuuuuuugucuaguugauaacggcauggaugauaaagucagauuuuaagucaauaugcaaauccugaguauguagaaaauuaaaugagcuuuacaaaucgaugcacuagcuucaagauaaaauauuaucuuugagcugggcgcaguggcucaagccuguaaucccagcacuuugggaggcugaggcgggcagaucaugaggucaggagaucgagaccauccuggcuaacacagugaaagcccgucucuacuaaaauacaaaaaauuagccgggcaugguggcgggcgccuguagucccagcuacucuggaggcugaggcaggagaguggcgugaacccaggagguggagcuugcagugagccgagaucgcgccacugcacuccagccugggcgacagagcgagacucugucucaaaaaaaaaaauaauuaucucugagagaaagcuacugcagaaaucgccuucagucaccauuucauuuauuuguucacagguauuuaugaagagccuguguuuucuuuuaggugaaaaugcuggaguuuuaaaacaguguugagaaaagaaacaaaguacauacaguuuacaagcaaacuguaacauaaggaaugcaaacaguuucuuccuauuagaguuacucauugauuuuaguuuuuuguacauuuguuacaagccucagauuguuuuacucugaaucaauugaaagugcccucagcuagccauuuacaauucccauggaagccuauguagcuacauacauacaauugcaauuugcucgggauagcucuuuaauaaauucauuugauaaugauuuuugcuuagaagaacagaagucuuguguucucacuucccugaggaugcucagaggagcacaaacccauaaaacugaggaauccucucuuaaauggaucuaaauucacauuaagugcugaguuuuaacuuucaaaaugacugacaauggccuucugcuuucuccucuacauaagccucgggacaugacucacauuucuuuucuuuuaaugagaaauacaauucagaaucuucauaaaugcuuucauacgguuuuaaacuuuaauaacuuggaauguaggcaguauagaaaaaaaucuaaguagcauuuuucauaguauuaaagugagaguggcugggcacgauggcucaugccuguaaucccagcacuuugagaggccgaggcagguggaucaccugaggucaggaguuccagaccagccugaccaauauggugaaacccugucucuacuaaaauuacaaaaauuagcugggaacuguggcaugugccuguagucccagcuacuugggaggcugaggcaggagaaucgcuugaacccgggaggcagagauugcggugagccgagaucgcgccacugcauuccaaccugagugacagagcgagacucugucucaaaaaaauaaagucagggugacuaaggaaaaccagcaauuuuaugacacuguccuugaaucugacugucuuuucccaauguaguugguuccccacuuggaaaucauuuuuuaaaguaagcuacauuagcacaucaacguuuuaagucugaaaaaauacuucauuuucaaauucaugucauucaagagucuauguuguaaauggcauuuaaaagcaaauguguuaccugcuucaaaucauuuauggauauaggcaagguguaauuacauauucucugugugguuguauauauuuuuguaauguaggcucacuacauuacacagcucuauaugauagucuuauuuuaucuuuuuuuuuuuuuaaugaaauggggucucacuauguugcucagacuggucuuaaacucuuggacucaagcaauccucccaccuuggccucccaaacugagccacugcacccggccucugguagucuuauuuuaaaaaaaguaagucugggcugggugugguggcucaugccuguaaucccagcacuuugggaggccuaggcgggcagaucaugaggucaggagaucgagaccauccuggcuaacacggugaaaccccgucucuacuaaaaguacaaaaaauuagccgggcgugguggcaggcgucuguaguuccagcuacucgggaggcugaggcaggagaauggcgugaacccgggaggcggagcuugcagugagucgagaucacaccacugcacucaagccugggcgacagagcgagacuccgucucaaaaaaaaaaaaaaagucugacaaacucuguaucacuacuguagacaaggaaaauggugucauggaacugaauaucuuggucaugagaagaaaccacagaguucaugacuagaaacauguacuguauucaaauuuuaauaagcuacuaucuuggcuuuuaaaguuguuuuuuuuuuuguuuuuguuuuauuuuuuaagacagaaucucgcucugucacccaggcuggagugugguggugcaaucuuggcucacugcaaccucugccucccagguucaagugauucuccuuccucagccuccccaguagcugggacuacaggcaugugccaccaugcauggcuaauuuuuuguauuuuuaguagagacgggguuucaccguguuagccaggauggucucgaucuucucaccuugugauccacccgccuuggccucccaaagugccgggauuacaggcgugagccacugugcccagccagcuuuuaaaguuuuaaaaaggauuuguucagacauggaauauauuuguguauauuacuugugugcuguacacacagaggaaauguauguuugucauguaugaagaauggcuucaguuucucuguaauuaauuuguaauuauaauaauaaaacuuagcuucucaucaa

SEQ ID NO: 192282 - RNA, 6011 nt, Homo sapiens
gcccuggcaagguugugggggacaucuugagcugaagcaggguuuugagccacugcugcugcugccauugucaccauggucucagcucugcggggagcaccccugaucagugagcccccuuucccuucuuccuggggcuguuaacaggggcgcuggguuggucuggccagagaccagguggagaaaaacaagguggugguuagggugggguuauccuggccuggaagagugaccagcugagagaggagagagagagagagagagaaacucuggagcuguugugaaaugcucaggauggaauuccuuuuaagucacuuuucuacaaaaaaaaaaaaaaaaaaaaaaucaaaaacaguccauguguagcagucaauuuaguuuccuccucuacaacuuagggauauuaaccccacaccuuucaauugcugagaggauuggaugagauuaaguuggaaaagcucugggaaaggccuggcacaguguucaaagacuugacaaacuccaccagguuggcugccuccuccuucucacuccccucgcggugagaagaaggucucaugucccuguggccacgccuuuuguggacuugaguuucagaagcagccacagagcagcuacuccaugccagcaacucugcagauaaauaagacaugcagauaaauaagaccagccgccguucuucagaaguuaacuuuguggugggaaagacugacaucuauuccagccucgugugacagaggauguggaagaucgggugugugagaguguggggggugguggcaugccaggagacucucacuggggaacacaccucugauaagacccuucaaguaugagucagaguuaaccauguagaggaaaggagagggugaauguucuagaaagcaaggucauugugagagaacaagguggcacugcugaaacauaacgugugaaugagggagugggccgcagggcugggcugugaagggucgugaagggccguguggaccucgaaggggcaguuauggugggagccauccaaggugucacagggcugggcuuuucauuuaacaaauuuguucugauggauguguauagaauagcuuggaagagugguugagacaugauacaagaagaccaugaaggaagccaggauggaggugugaaccuaggaaaggacggugcucucggagggaagguggaauccacaggacauugggacugauugguuggaacugggugaaagaugucauggggaaggagugaagaaugacauucauauuuccaguuuggguaaauguguggcccaucauguuuuaaagcacauaaggaaagucacaaggcagaagaaggcauugauggaaacagugguucuguuuagaugugcuggguuugaggugccugcagggcauucaaguggaaguguccugccaguagcugccucugaggucuuggggaagaugccacagggguugccagccuucaggcgguggcuaacagcagggcugcccaggggguuuccucaaaguggaagagaagagggcucaaggcaggaaggccuuagaaagcauaucagcguuuauggccugggcagaagugaauuccacggaggauaaggaggagagucagccagagagggaggaggaaaccugggagaagggagcaucguggaaaccaggagaggcaagccuuucaacagcggguggcggacggcaugaguacagcugagagcucccaugagacagagucgaagggggccuccuuggacccgcagagcaguuucagcgcgcggugauggcagggaggccaauucaccagguuggaaaacaagcgggagggagaaaguggcgauuuuccccaggaguuugggcgagaagagggggaaagagacaagggaguagcagucagcaugagacuugagggaaggcauuuagaagauggagacugagaaagucucuacgagcaggggaaggaggagcaggaggggaacggugcuagcgcgccgggagaggagggacaacggauggagcaaggcuuggugaugggaaggacaaaucuagagcuuagagggaagaugggccugcaugagauuggaggccccguacccaaacaaugacgggguggagaugagggcgaggaggcuacugaugaguuugcaagugagcagggcuaaggcagaaagaggaagaaauuccacaagugagcaccuugcuuuucuuagugcagcaggagacgagaucauguucugagagccaaggggugggacagcguggcgugcuaaaggacaauacugaggguuuucauuuccugugagggaaaugggagagagaagucugagcagagacaagcgcgaguaccaguguuaguuguaguucauaacagaaacaacaacucacuuauuuuuagugccaagagcuacgcugugcccacgccuuuucucauuuauucuuccaacaaucauaugaggcagguguuacucacguccucauuuuauagaggaagaaacaagccucagggagggcccaaaaucagagauggagcaaggagcagaggggggcuuccaacccgaaccuugcugcaaagccaugaccucaaccacuuugucauccucgggggcauucaaggucccguggagguuggagaccagggacaccaauuggcacaaacaagaguuuguacaacucuuucacuuuuugacucugugaagguggagagcagguguggaggcgcagaggucaagagaagcaugggaaggcuugucagagguggugggcagugggauaggagcucacagagguggggaaaugcgggugaggacaagaagcagggaugaccagggcaggggagggacuggcugagacacagaggaacuggaggggacuaggucuggggagaugaaggagcccugaugcugugacacccaggugcuaauguccucugugauuugggggacuggccacacacagccaaugaugacagggcagggaggucaaaccagacgggcaggcugggcuuccagggagaagggcuuuuugcagguuaugguuuagaaguggugguggggguggaggagacucucgggacaucuuggggucuuguguguggagaaagagcagcuuccccuugagcgggcuauaggggagcaguguucugggggagaccuuguuucaguuaagaucuggagauggagggucaaugccagaagggcugucccuugacaguugggcugagagacccaugaacacaccgccuggccauccccuccgggagcaucugcucaguggggcuuuggauuuauagaacuuugucuccauccaaacuucgccccuuccuaguuauaaaaucuugggccucaggacuaaauaauccguaacguguaauauggagcuuacaauagguuaguuuucuuccugucucuggccuggguggugugaagcaggauggggaaggagaggggcuggucucggggucagggugaugcugaucaggaaugcaagggggcugauacgugcugcuggagccuggccuucugcccaccccuucucuccucuccccuuucccaggggugcacucaagcccuguuucuucuccuucugugaguggaccacggaggcuggugagcugccugucaucccaaagcucagcucugagccagaguggugguggcuccaccucugccgccggcauagaagccaggagcagggcucucagaaggcgguggugcccagcugggaucauguuguuggcccuggucugucugcucagcugccugcuacccuccagugaggccaagcucuacggucguugugaacuggccagagugcuacaugacuucgggcuggacggauaccggggauacagccuggcugacugugagaaccccucucccuggcgggcccugacuuccccacaccucccucccucuuucccucccucucuccuucucauucaagggcuguggcuucgggagcuuuuagagcccuucuguaaacugaagaugauuugagauggcagguagagaacagccagcacggaguaaaacacgcaguaggcaggcagcaggcaaccaaauuggagucaccccuucauuucccccugcugcuaaagucggggucaaaggaaacaaacagcucaguccccuaaacuuaacuauggccacaaggaucagacauuccuucugaaauuagaaaagacaaacugaacagagcagucaugccaaacuuuucaagcugguggcaguuuuagauggccaugugggaagggcagucauaccggggcucaucuuucuaacaggucgagcacccucuauagauuccaccugggucuuccuaaucuuguuacugaagauuuagcacuuguaggcugggugcaguggcucaggccuguaaucccagcacuuugggaggccaaggcagguggaucacucugaggucaggaguucgagaccagccaggccaauauggcgaaaccccgucucuacuaaaaauacaaaaauuagcugggcaugguggcagcuaccuauaaucccagcugcuugggaggcugagacaggagaauugcuugaacccgggaggcagagguugcagugagcugagaucacgccacuacacugcagccugggcaacagagugagacuccgucucaaaaaaaaaaaaaaaaaaagauuuagcacuuguagauucauucaacaaauuuauugggcccuacuaugugcugaacaaugagauaaugggaagacugcugggcuaaaagucaagaggccugaggccagccccaacccaugcuauuugguagcuggaugggacccugggugagucgcugugcaccucuaagccucgauugauugguuugcaaagcaggugggaggcaccugccccaaucaccuugaucaggcaggagaggcucgguggagccagcgugggaccugugcagugagcacccuggucugggguggcuguaaccaucugacccccaggccuaugcucugcccuaugcaggggucugccuugcuuauuucacaagcgguuucaacgcagcugcuuuggacuacgaggcugaugggagcaccaacaacgggaucuuccagaucaacagccggagguggugcagcaaccucaccccgaacguccccaacgugugccggauguacugcucagguagcugggccugggcccagggcuggcaggagucaggcccugcauuagcuuuuguuccauucccaguuuaguuugcuacccccaucucugagugaggguucccccacaucaggcugggcccacggaggagagggagaugggacaagggaugaggguaggucuuccaucagucugaauuggggucccagauaggagacugccuuagggcuauaggaauggagggaggauuguuucugauggagggggagagggauaggguuguaccugugcuuccggagugguugagacaggauuggauuuaggcgaguggaguguguguguguguguguguguguguguguguagagagagagagagagacagacagauacacacucacacacacacacacacaccuggaugucuccuguucucucauuguguuucucugccuaucaccccagauuuguugaauccuaaucucaaggauaccguuaucugugccaugaagauaacccaagagccucagggucuggguuacugguaaguaacuugggcuggagccccgcagcggugguaugguuaggacuggugggcagcagcagggaacaaaccccuuuccuuccucacuucugguuuagagaccacacucuccuucuuguucuucucugggcggugacuggcaacugcagcugauauuaucucuccucuucccuguucuccauccucagggaggccuggaggcaucacugccagggaaaagaccucacugaauggguggauggcugugacuucuaggauggacggaaccaugcacagcaggcugggaaaugugguuugguuccugaccuaggcuugggaagacaagccagcgaauaaaggaugguugaacgu

SEQ ID NO: 192283 - RNA, 13742 nt, Homo sapiens
auccccugugugggaccugcccagguaggcgccaaccauugguuauaagaaccugaccuuggcgccuccagggaaacgcggaguguccuggagcuugacgcgcuggagcuugagagguaagagagggucccugcuccuacggggacugcggagcucccguuuguacccacgcccuagggucuaguccggcacgacccuggacuggcguugacucggauggggagcaagcuaggagagcaacccccgccccccagcuccggccagccgguggagucgggguauuugcgugcuucuccccugccuuugggguucggcuaguuugcugagcaaauucccuaaaaggcuaugaggacuugaucgcggcgcggguggaggcggggcgguggggagggacggugcggagagcuaaagggguuggaaggugucgccggcggcuuggcgggcuaucuguguuccuguuccggcugcaaaacagaaagccccugcccagcgagcagcgguuuccgcgggggcggaacaaacaggcagagccaagugcguccuggaggcuucccccguugcgaagguugggacucuuguuucaggguucuuggcauugacucacuaaccacuguaaauuauuguucuuaaucuaagaguuaaaaagcagaauuaggccgggugugguggcucaugccuguagcuucagcacuuugaaaggccaagugggaggauuacuugagcccaggauuucgagaccagccugggcaauguagggagacccuaucgcuaugaauaauaauaauaauaauaauauaauacuaauauuaauaaauuaaccgggccugguggcgcgcaccugugguuccagcuucuccggaggcugaggcaaaaaucgccugagccugugauggcgccacugcccuccagccuggacaacacaggaagacauuguaucaaaacaaaaacaaaacaaaacaaaacaaaacaacaaaacagaauuagaauugccauuacccuguacccauuauccugauuacccugcaaucuagaaaggggagaaaugagaaaaaugucucccucccaacgucuguaaaauacagagcugcuaucugagaaggacaaagagcucuguguuuuauuuucccaagagggagccucugucgcagcuguuuccuucuguuucugccugagacuagccaguccccaccaguuuuccucagugggguggggggcuugggaguggaugggaggauuuguguuguucugauuuuaccuacaguauaccuguguaggaggcgaaacuguuuccaucaauuuccacagagaagcaagggcaagaauuaucucuaauuauucccaugcauguguaggggggguucaaagaagucugaaucuugaccccugaacucuacugccucucucuacauguuucugcauacaggucuuucaggacugauuuugguggaagaagacagcaggcggugggcauucacugugcuggugggaagucugguuacauuaagaaaggaauucuagcaaaguuauucuguaaauacaacagaaucaguugcuuuuguuaaauauauugguaagcuuccugauuuuuuucaccugaauucucaauuuguuauugaauaguucaguuuuauuuaggguuucaauuuuauuuaggaaacaauaucucuaccuuacaaagaaucugcaaguagcacugacuauaauaccuuuauacccaaaggaagagcugggauagagcucccuaagacuuuucugccugcaaaagauaugggugggguugccauuugaauacaguuaccaaugaaaaacuaucagcuuaucuaggcuuuaacaauaaaguucauggggguaaagagaaaagauuuaacuuugaaguccccauauaucaaaaagaauauuuuacagguaacuugacaaagauguuucaguggucucggaaugcaagacagaauccugacgguagaaauuucuaggcaagggucuaaauuaggcaaacugguaagauugugaaugucccagccuuuauuucugaaucuugaccucugaacucugcugccucucucuaaacauguuucugccuacagguacuucaggacugauuuugguguaagaagacagcagguguacacuugaugaugcuacuuccuuaccucucauucauuccucaacccauuguaaaauaaugucaauuaauauagguuccuuugcugaacaccugugaaccaaagcauaguuuuaaaugcuuguuguaaacuaucugaguuaaucuucauaauaacagucacagguggcugcaccauguuuuauaguaagaaaauagaguuagaaagaguaaauaucuagacuaauauaacaguacuaaauggcagaacuggaauucaagccaucuucauugacucuguucuccaagaccuuagccccugguuuauugccuccugaugcccauuucccaggugucugaagagcauuuuucaaagucacaguuaaccuuaauuuuacuaaacuuagguuuaguaacacuuuccagucauuaccuagcuguaucugucagcaguauuagacaucuuaaaaccuuggcaggugacuuuguuccaggcuuuguuaauaccaaauacccuugauuuuucucuuacuucuuugauuuuucauacucagacuuuucuacagucuccuuuucaauguggucuucuuuuacuuaucuucuaaaguugauguucauggagaaucuguuccaaaccuagauguucucaugccaugguacacaugccccucagcugauccacuacuucuguguuucaaugcuaaugauuucaccuggccaguucuagugcaucuuuuaagucuuggccuaaauggaaccuacuccuggaagucuuauggaaccauggucuccagauucguucagauacccuauucaauguguuuucccucuuagagcccaugucacagaugaugguaaaggcuaauuucauuaguucccuucccugccagccagucagcuccuaaagagacuauaccugucuuucuugcuauugucuuaucccagcacauauuagacacguuuuaaauauuuucuaauaaaugaauugcaggccuguaacaauuuuuuaaucaaaaaugaaacaaauauucuaauacuuuaaggugcaaguucaacauggaggcaaaucacugcucccuggguguguauccaucuuacccagaccuggucaucgaugucggagaagugacucugggagaagaaaacagaaaaaagcuacagaaaacucagagagaccaagagagggcgagaguuauacgggccgcgugugcuuuauuaaacucaggaggaggagugauucagauggaaauggccaacagggaugagcgucccacagagaugggacuggauuuagaagaauccuugagaaagcuuauucaguauccauauuugcaggcuuucuuugagacuaagcaacacggaagguguuuuuauauuuuuguuaaaucuuggaguggugauccuuuccuuaaagaugguucuuucaauucccgcauuugcagccuuaguucuucauuauacuguagaucuggcaccucugugcuucacaugaauucaagacaggcauucgauuuccugaagaccaaggaaagacaguccaaauauaaucugauuaaugaagggucuccaccuaguaaaauuaugaaagcuguauaccagaacauaucugagucaaauccugcauaugaaguuuuccaaacugacacuauugaauauggugaaauccuaucuuuuccugagucuccauccauagaguuuaaacaguucucuacaaaacauauccaacaauauguagaaaauauaauuccagaguacaucucugcauuugcaaacacugagggaggcuaucuuuuuauuggaguggaugauaagaguaggaaaguccugggaugugccaaagaacagguugacccugacucuuugaaaaauguaauugcaagagcaauuucuaaguugcccauuguucauuuuugcucuucaaaaccucggguagaguacagcaccaaaaucguagaaguguuuugugggaaagaguuguauggcuaucucugugugauuaaagugaaggcauucuguugugugguguucucggaagcucccaagucauggauggugagggagaaguacauccgccccuugacaacugaggaauggguagagaaaaugauggacgcagauccagguaagagggaaccagauucucccuuccugaccuuucuaccucuuccccaauaccacuuccuucuuuauucucuaagcuugaccuucucacacccacugaaauuuacuuucucuaaaucuccaugcuuuucauagaugggaaguuuuauugggugagaaaaagccaaaaugagauauuuugugaauggugauuucccacaaaagaagaagcaaaggaaaaaccuuggaaauugguuccuuuaauaaaaccauugaauuggaaucuguuggagccucauaauagugauuagcuuguaccucagauuagcauaaaaucaacucugggagacaagagcuaguguugguugagguuuguuuaaguugagguuaguggaggugcgugcacagggauauaaaaaccugaugauuauaacuuaaagagaguuuuuuuccacugcaauucaagcaaagaacuauucaaacauggaagagggggcauuauauugcauggggaaacaccauucaaggaucagaaaaagggcuuuuaaugaugaaucuuugggaaccuggacauagagucaagaaaggguaaagcaucugacuuuguggccugacuuguaccauguuagaugaaauuuagacacagccuuguacagccuauuccaauagcgagacaugaaaucauauaguguaaauuaaaauguucuuucuuucagaguuuccuccagacuuugcugaggccuuugagucucaguugagucuaucugacaguccuucacuuugcagaccaguguauucuaagaaaggucuggaacacaaagcugaucuacaacaacauuuauuuccagguacugacugccaguuuuuacaucaggagagaaggaagucauuuaauacauuucguggaaaacaaauccaugaaagauuguguccugcagauccagguguacacagugacaaugccacaagccucuuggggaugaguuucaggugccuuuagaaaucaucuggcccauugguugccacaucuggcugauuauuagaaaugccauggaagguaguuaaacaugcagaucuccaggcccacaccaagaacuuaugaacgcuuaauuuccaggggaaaggccuagccauaugcauuugggcaagcuucccaaauuauucugaugcccugcuggguuuggaaaccagugaucuaguacaacuacaaggggaacaauggaauaacuagccacuucuggucuacuuuucaaggauggaggaauuaugucuguaaaaggaauaaaaacauucaccugguagaauauaagaauauagaaaaaccacaaauaauuucucuuuggaagaggcuagagggaacgacucgcuaaugcuucaaagguggcaccaaauaauaauucaagcccauagacaauguuauguaaccccucucccugcugcccaaacauuuuuuagcaagguuuuuuucucggaguuccuacuuacaaaaugaaaccuagauuuuucaaggagggaaauggcuuaacuucauacauugaacauauuaaguaugagauuugacaaaagaauaugauacacaaauauccuacguauguccaaacauuuaugaagggcaagguaauucauauauuaggccuuccuuaggucuguuuaccaccaaauaguuucuuuacuuaccugagagcuuuauagucauuagcuuaucagaaaaguuuuuaaacauuccacauuaagaauccaaggugcaagaguaauugaauacauggcuuucacuuucucaggcucaguaaauugcauuucaguugacaugcuccacuguccaugagauacauagaagggugacaucauucauuuuaccagauuuguagguuguggguuaaagagauaugcaccaggcaaggcgugguggcucaugccuguaaucccagcacuuugggaggccgaggcgggcagaucaugaggucaggagaucgagaccauccuggccaacauggggaaacccugucucuacuaaaaauacaaaaaaauagccgggcgugguggcaggagccuguagucccagcuacuugggaggcugaggcaggagaauggccugaaccugggaggcagagcuugcagugagccaagaucgggccacugcacuccagccugggcgacagagcgagacuccgucucaaaaacagacagacagacaaacaaacaaacaaaaaaccagagaugcaccagaaggaauuucuguuaaauuguacaauucuuugggggcuuuccucugucuuuuaaauguaacaugugauucauacaaaaucacauaaacacagugaaaacaucuuucuauuuucuuccugucuaguuccaccaggacauuuggaauguacuccagagucccucuggaaggagcugucuuuacagcaugaaggacuaaaggaguuaauacacaagcaaaugcgaccuuucucccagggaauugugauccucucuagaagcugggcuguggaccugaacuugcaggagaagccaggagucaucugugaugcucugcugauagcacagaacagcacccccauucucuacaccauucucagggagcaggaugcagagggccaggacuacugcacucgcaccgccuuuacuuugaagcagaagcuagugaacauggggggcuacaccgggaaggugugugucagggccaagguccucugccugaguccugagagcagcgcagaggccuuggaggcugcagugucuccgauggauuacccugcguccuauagccuugcaggcacccagcacauggaagcccugcugcagucccucgugauugucuuacucggcuucaggucucucuugagugaccagcucggcugugagguuuuaaaucugcucacagcccagcaguaugagauauucuccagaagccuccgcaagaacagagaguuguuuguccacggcuuaccuggcucagggaagaccaucauggccaugaagaucauggagaagaucaggaauguguuucacugugaggcacacagaauucucuacguuugugaaaaccagccucugaggaacuuuaucagguaagcaguuggaucuuacgucuuuaaguuuuauuuaaucuggguuuaauuuuuucugcuaagucaccuucuuccuugagaauugagugguaaaaugaucuguggcaauauacugugcucggaggaacaugauacaaucauuuucuccccuuguuuucuuagagaaaaccugaguguauucuuuuaauuuuuacagugauagaaauaucugccgagcagagacccgggaaacuuuccuaagagaaaaauuugaacacauucaacacaucgucauugacgaagcucagaauuuccguacugaagauggggacugguauaggaaggcaaaaaccaucacucagagagaaaaggauuguccaggaguucucuggaucuuucuggacuacuuucagaccagucacuugggucacaguggccuucccccucucucagcacaguauccaagagaagagcucaccagaguaguucgcaaugcagaugaaauagccgaguacauacaacaagaaaugcaacuaauuauagaaaauccuccaauuaauaucccccauggguaucuggcaauucucagugaagcuaaauggguuccagguguuccaggcaacacaaagauuauuaaaaacuuuacuuuggagcaaauagugaccuauguggcagacaccugcaggugcuucuuugaaaggggcuauucuccaaaggauguugcugugcuugucagcaccgugacagaaguggagcaguaucagucuaagcucuugaaagcaaugaggaagaaaaugguggugcagcucagugaugcaugugauauguugggugugcacauuguguuggacaguguccggcgauucucaggccuggaaaggagcauaguguuugggauccauccaaggacagcugacccagcuaucuuacccaauauucugaucugucuggcuuccagggcaaaacagcaccuauauauuuuucugugaagugacuauuaggaagaacuccaaaccaaaauacuguguaaaugucuaugggugacagucugcugaugguagaaaccuuucuuuuuaguucacaagucaguuagagauuuggacagagcugacacaaagaguuuggagcucccccauuucuggcucuccuuucagggguuccucccccaacucuuuucagcagugguggcugccccccauucugaccccugacucuugcagccagaaagauggugguuuucuaaaggaacuuuagcugugcugcacaaugcagaccugugucuugcucucuggguaaaagccauaaaaauaagaaacucagccuguggccuuucuuccaaggcuggaguucucgaguucuuuuaugugacuucguguaguuuguugcuuuaaaaaauuuguccagaauuguuuucugcagaagcauggucuguuaggagcuuacaggccauaggagaagcaguuguuuccugaauuuaucuuugcuguauucauuuagggcuugggagagucccaagauaauucagucacugucagauuaaucauuucggcagaacaaacaauauuguuaugauuauuuaauccuuaaaauugugaucuccagaguuuguuaucagaauaacccagaccaaggcuuaauuguaauagugaacauuaaugguaccuuuacagagaaauuauaggccaagagaaaaugcuggcuuucaguagaaguuaauauuagaaacccaaaucugguucugaaaguguguaucagauguacggugaacaaacuugggaaagauuuucuuuaaaaaucaaugagcguuggccaggcacgguggcucacaccuguaaucccagcuguuugggaggcugaggcagguggaucaccugaggucaggaguucaagaccagccuggccaacauggagaaaccccaucucuacuaaaaauacaaaaauuagcagggcaugguggugcaugccuguaucccagcuacuugggaggcugaagcaugagaaucacuugaauccuggaggcagagguugcagugagcugagaucaugucacuguacuccagccugggcaacagagugagacugucucaaaaagaagaagaagaaaaaaaaugcagugaguuuauguuguuacauuguaacaucucagcguagcuguaugcauuacucuauagcauaacuacuuaaguuuuaugucauucuugaacugugauuuuuuuuucuauuugcuuucauaguuuggugggccauuguuauggacugaauguuugugucccauccucaccccuaaauucccauguugaagccccaaccuucacuguggagcuggggcugcuaaggaaguaauuaagguuacacgaagucacaguggagaaucugaucugcuaagacugguguccuuauagggagagaccccagagagcuuguucccuuccucccugugcacacaaacaagagggcaugggagcacacagagagauggcagccaccuacaagccaagaggagaagccucacaaugaacccccccccccacccugcuggcaccuaugucuucgacuuccagcccccagacugugagaaauaaauuucuguugguucagccauccagucucuaguguuuuguuauugcagccugagaacacagcuguaugaucauucaucaaacuaaaaacacugauacuuaacaaugcuaaugcaauuacuuauuugcuuuucagucucuacaaaacauucuaaaacacuaaucuaaauacuaacaauaaaauauuugcauaacuaaugaaaauuaagaaaccacaugcccaauauuccauuuauaaguaauccuauuuggcugauuucccuccauauuguaaguuuugaacuuuucugccagucuuucuccuauuuguguuaacucauggaauuccaguugucuagccuugaaauuguaggcucuucuaacuugagcaaaaucugacagaucagcaaaauaaggagaaaaauauuucuucuuucuuucuggcugcauuaaaugagauacagcucagcaccaaaaagcuaucuuuguaaauguucuuaguaaacucccuggucuuuggaguuauuucagccuuugagaguaauucuuuaaaagucuaauucugacugguugaaucucucuauaugauuuauugcccuaguaauauuugaaacaguaucauauuuuaaaauauauaaauauuuaugaauuuuuguucagcccaaagaggauuacugaugcuuucuucuuuuuccauaugaugaggaaauguuuagcuuauauauuuauugcauuucuguuuuaaauaaaaaauugagaguuuguguuucauuaaacugaaaaaaaagguucuguaaaauaaaugauuaaauggaggaaaaggagaagacugaggccagcaacuccaugauacagccaaaaaugagccaguaaaagauuaagcaagauuaacuguaaauuuuuuuuuuuuuuuuuuuuaaagagaaaaggucucacuguguuucccaggcuggaggguaguggugugaucauaguucacuagagcccugaacuccugggcucaagugauccucuugccuuagccucccauugcugggauuauaggcaugagccacugugucaggcuuaauuggguuuugauggguaccugccuaucucuguaauuuggcucuagucauauaggaccugcuucauuaaagaucugaaaaucuauccagccauuguaaaaugaaacaaaauguuuugaaaauuuaaauuagccuuuuauuuuaguucagacauauagaaaaguugcaagcauaguacagaaaguuccuauauaccccacuuagugcccuccuuuuuaaaauuuuuuuaaaccuagcuuauuuccuuuaagauuucugagaauuccaggaaugcucacagaucuguccuuguagucuccugccacuucuugcuauggagugcuguaccaaggucucugcuaguuucuaguuggcuugacauaaugacuuuccuaaacuucuucugcucugaaucucaagcauggaaagcggucacaucuuuuguuucacgaauuaacagucaacaccuggcccuacuuuuaacaaaacuuaguaaagccuugagcauagugaaagacaaauauuuaaauuauauauuagcaggaggcugaggugggaggaucauaugaggccagccugggcagcauagcaugaccccccccucgagaagacaacaaaaaauuaucugggugugguggugugcuccugcaguccuagcuauuccagaggccgaggcgagaggaucgcuugauuccaggaguucaaggcuguaguuagcgauaaucgugucacugaauccuagccugggcaacagaauaagaccccaugucuaacaaaauaauaauaaaacaaucaaaaguuuaaaauuaguuauuaaaugucagugugcccagaguccuuugaccacagaugauccugauggccuucucucgccuugucccugugccuccuucuaccauuuuucuuccugagauucaaaaguaaguagcggacaggguucccauuuaccacuaaauacuucaguggguguuuccuaaaaggacauuuauaguaccaucaucaaaaucaguaaauuaacccugauacuauuaucuaaucuguagacuuuauugaauuauaucaguugugccucaagugucuuuauguuuuuuucucaaaagagaaaaaguucugguccaggauuugaucuaagaucaugcauuguauugagcuuuccuuucuuuuaagucucauuuaaucuggagauguuaaucugucuuugucauaucuuugacacuauugaagaggacuggccuauuauuuugcagaguaucugauuuugggucauuucauguguucucaugauuagauucagguuaugcauuuuuggcaugaauuccauagaagggcuguuacgguucucaguucacgguauuagaaggcacuugauagugauuaguuccauuccugaugauguuaacucugaucauuuggauaaaguggcgucugccagguuucccuacugugcaguuacaauuugcuuuuuguaauuaauaaaguguguguguguguguguguggaggggggguguuuuugcuucugaacgcauaauauuugagauuuuuuucuaauuaaaaaguaauuauucaaagaguucagagaacugauacugaucacauucuuugaccccacaugcaaauacauuauaaacuaguaauaaaacgguaacuagaaaaauguucauaucuuuuggaauuaaaaaaguguuuaacucguggaucaaagcagaaauucuguaaccauugucacagcagguucuaacaagcaaguuuaaggaggagagaauuucaguccuagagaauuucagucuuauucaaaugcuuuccuagaaagaggaaacaguuccuaacuaauuucaugaggcuggcauaaucuugauaacaagucugauagguaaaguaugaaaggaaaauugcaggucacucaauuaucacucaaauaucuacaugaaaaauucuaaacaaaauuuuagcaaacaaaauccaacaauuuguaaaagugauaauacaccacgaccaaggugguucaagucaggaauucaacguugauuuuggcguuaaaaaaucaaucaucaggcccagugagguggcucacuccuguaaucccagacuuucuggaggcugaaggaggaaagauccuucaggccagaaguuugagucugcacugagcugugacugcaucaccgcacucuagccugggugccaguuugagacccugucuccaagaaaaaaaaauuaaucaguguaauucaccacagauuaagaguucaaaagagaaaaaucacaugaucaucugaauagaggaaaaagcuuuugauaaaguucaacauccauucauaauaaggacucucagcaacuuagaaguauaaaaacacuuuuggaaaucaacaaagggaauuuacagcaugaacaaacagcaagccagcaugguggcucacaccuguaaucucagcacuuccagaggccaaggcaggagaaucacuugagcccagggguuagagacaagccuuggcaacauagcaagauccuggcucuacaaaaaauaaaauaaaaugaaauaaaauuuaaaaauuagcuggguuugguggugugugccuguagucccagcuacugggaggcugaggugagaggaucacuggagcccaggaggugaaggcugcagugggcuaaaaacaaccagaacaaccccccaacccccuccccgcaaaacacuauaaagaauagcaacacaagguucaauguaaacuuugauaugguguuuuaccucugaggagaggcuuauuguuaauauucuuuagccguguaagggguucacagauguucauacuuuuguucuuuauaccuuauauguauucuauaaauauuguuucuacucaauaguuaauaaaaacauaauuuaaaaguuc

SEQ ID NO: 192284 - RNA, 12817 nt, Homo sapiens
auggaccucgccagguucguucucuuuuucuuuaaauaacuuuuuuuucgccuuagaaaauacaaauagguacagacgaaacgagaacuucuccgugaucccucagagcuauucacgugggcguuuaacuuucaguugcuuaagggcccgcgcuggcacagcgccugcaaggaauccuguuuccagggaauugcuggcagauaaauucgucccgcuccacugccaaaccuuccagccuccguuucuuauuccggggguccggggggggugguccgugggcuccgggacgagguggggcgcugccagagcaaccccaccgaucucggggagacccgaggcugcuuucucucccuucugggaaaguuggcuccugucucuguagcaaugucugucaaaaccgcaggcuguuguagacuuagcaauggaggacuugaaagcuguagaugacaaaacuuccgcccgugcgugggcuggggagcgccuuaaaaagccgcagggcggccgggcgcgguggcucaagcccgugagguguuggugcagagcuggagaaguggggagugcuguauggacaggccagacuuggcagguguccaucggauggggguugcccacccuccuggaguccugagcauucagggaguuggggaauggguuauuuaggugaaaugugaccaggcacugacgaacugcgcccuagauccugaaagaaaaaccaagcacccucuugcgcugcugguuuaucaucuagaagagggaaagggugaaagcagugcuguuccgaacuaaaugcaaagugguauccgaagacggcaaaucacgcucuaugcuuuuugcuccccaggagguagcucuucugccuccugucccacccuuguggguugcaguucuuacuaaccuguuguucuggcauaacucuaaggagauaugaaugccacccccauucccauuaaagauagccaacaacauagccuaaaucaugaguucaggucugauagaauuuccccuauagucaaaaguauaaaggauuucaguggaaacaucuaaccuguaaaccuagacccaagguuuaagggaggccagugaguuuuaggcccuagagauuuggucggcucaguccucagcucguuuuuauuuauuuauuuauuuaauuuuagcauuguguuccagauguaugccugaagccugagguuuugaaccauggaaaguuuuacauggcugcagguguuggacucggguggccaggaucccaggcuaguccacaagugcucgguccucuauaagguggcucaacugcagcucccauggguuccaaguuucccagugguaugcguacccuccuuaagcaaucugagggugagaugugauuucugucaccuucuguguauggugggugagccaaaaggguucauccagggcaaggccugauacagacagugcaggaaguugggcugggaggaaaggggacaggacuccaguuacagaggcugcaagaagaauuggagagcaggggcuaaucaaggaggugaaagaacuuuacgaggagaacuaugaaacacugcugaaagaaaucauagacgacacaaacaaaugcaaaagcacuccaugcucauguguuggaagaaucaguaucauuaaaauguucacacuccccaaaacaaucuacagauucaaugcuauuccuaugaaauuaccaaugucauuuuucacagaauuagaaaaaaugauuuaaaauuuguaugcaaccaaaaaagagccugaauagccaaggcaauccuaaacaaaaagaacaaaacaggauagggagccuuacaccacauuacugcauuucaagcuauacuucaaggcuacaguaaccaaaacauaguacugauacaaaaauagacacguagaccaauggaacagaauaaagaccccugaaauaaagcuucacaccuacaaccaacucaucuuugauaaaguccaccaaaauaaccaauggagaaaggacacccuauucaauaaauagcuaaccauaugcagaagaaugaaacuggaucccugucucucaccauauacaaaaauuaacucaaaauuaagacugaaauguaagaccacgaacuauaaaaguucuagaagaaaaucuaggauauacucuucuagacauugcccugggcaaauaaauuauuauaaagaucucaaaagcaaaugccacaaaaucaaagauagacaaaugggacuuaacuaaacagcgucugcacagcaaaagucucaacagaguaaacagacaaccuagagaaugggagaaaauguuugcaagucaugcauccaacaaaagacuaauauccagacuuuauaaagaacuuaaaugaaucaagaaaaaaacaaacaacuccauuuaaaaaaugugcaaagggcaugaacagaaacuucucaaaagaaaacaugcaagcugcucacaaacauuuaaaaggucaacaucacuaaucaucagagagcugcaaagcgaaaucacaaugaaauaccaucucaucuagucaaaaugacuauacuaaaaagucaaaauauguaggaaaaaauuaaugaaaaauaaagaguugguuuuuugaaaagaucaagauugacaaaccuuuagcuagauugaugaaagaaaaaacucaacuaaaaucaaaaaagaaagaagagacauuacuauugauuuuauagaaaucaaaaggauuauaagaguguacuguaaaaaauuguaugccaacaaaucaaauaaccuagaugaaauggacaaauuccuagaaacacaucaccuaccaacacugagucaggaaaaaacagaaaaucugaauagaccuaugucuaguaaggagauggaaucaguaaucuaaaacccaacuaagaaaggccauggaccagaugacuucaguaauaaauucuacccgaguaaauuuuuuuuuugugagccucugucaauauaaacaauuugaauaaacccaaaucagcauuaucagcaccauccuggcaauccaaucugacuugauccugugaaagaaauccugcuccagauagugagagcaaugcacuugccaggcuauucuccuggaauaggaccuagccaugagguccuaggacaaccccacagccacaagucccaggguuucuugggugaagggccauugaguuucccagauggaaggaacagggaugcuaguaguucuguccagucuggggcacccugccaggaugacacugcuggugcugauugguaccuggcacuggaaaugguuuagauaauuucaaggagggcauuccagaacauggaacgugcuuugaacccccugagguucagugucuaagguaggaacugaaccaaagcuuuuccuucuggugucuuaaaugauugggaguccucgcuugauuuccugcaguuugaaaacaacugcucuggccacuucacugcuuuguuucuaaauauuucccuagaucuauggugaaauuagugccaaguauagguacaaaguuaugugggaguagcagagagugaaggacaaauaugggaguucugggauggaugauagagaguuuaucaggugacaaagguggaggaaaacauuagagucucagagcacaccuaugcaaaagcacagaguccccaaaucacauggggaguggugacuacucuggugcacaaggaguugugucauuuauugaacaucuacucuggucccuguaaauuguuaaguguuauauggaauagacgguucuuuuuccucuguaugucaccaccaugauuugcauaugaauucucuugauguaaccccaauuguccaaaugaucuggggccucaauuuuauuauuguuuacacaugaucagaaauuuauagagacaaaggugguaucuacaaccuuagcugaguaucugcgugauaguggucuagcaguggacaggaauauucugaccccuuuauagcccuuuccuaguguagugauuacuaccuaugauggacuuuacucucaacugucucuaggccacuugacaaaccuacagucuuuagguuuucgucuauagcaaaacagugaucccaauagauuuuaaaggaaaagagcuaauggauuauguauacauagacuaaagcacacugucuuagucuguuuggccugccacaacaaaauaccauaaauugggugacuuauaaauaacagaaauuuauuacucaguucuggagccugggaaguccaagaucaagauaccagcaucauuggauucuggugaggaccuucuucccauugcagacugucaacuucuucuguguuuuucauauggcagaaggggugagcuuguguuacaggaucuucaggguguugauuuucuggccagaaaccucuguggcuggcggcaccuuugccagaguucuuguccuguguccaggaagaaugagguaugcagacaagugaagggugaacaagacgaagaugagcuuuauuaaauguuaggacagcucagaggagaccugcagugaguaacuccucucuguaggcaggucaucccauggaauguucagcucucagcagaggggaggcccuggggaggguagcuucuaucugcuacugguccuuccuacguuugcugcucucagcagagaggaggcccuggggaccguugcuucucucugcagccaaugucucuucaggucucugaagcgcucagcagagaggguaguuccacucugcggcugguuguccuguccucuccugcuaucagcagagaggguaguuccucucugaaguugguccucucuucaucucuuccuccucugccccugcucuggcugagcccagggcuuuuauggaccucagaggggaggaagugugugccauugguccacaugcagccccagaagaggcaccacaaguccccacagucuacagcacuggcagcccgguccccagccuucaggcccucccaggccugaagguguggcccuacuggggacccgccgccuuugacccaggaaucugucugccucccacugccauuuaugucuccggaguuuggccagccuuugcucccagaucagagugggcaccgacagcagggagaaggagaagccaggcagugggagcaggcacuucugagccugcgagggcagggggaucuucucaggccccaagagugcagagaugccugaaucugcaaucucgauuuggguggcugcagcugcauggggcaggguuguggggcaggauucuagcaugcugcagagagcgggaggccugggucuacaguggugguuuggguggcugcagcagcaccuggggagcucacgucccaacuuggaagaggcagggcucccacgggcuccagaaagugugcagcccuagcugccccucccugcugcagccuuugugauggcaggcugccaucccuagcuuucugaagucccuuuuagaagagcacuaaucucauucaugagggaucuacccuuuaaccuaaucaccucccaaacgcccaucauguuggguguuagaauuucaacauaugaauuuugagaggaugcaaacauucaagguagagcacagguguuuuguauauaagaauauuaccuugacugggcauuguggcucaugccuguaaucccaaaacuuugggaggccaaggcagguggaucaucugaggucaggaucaucaucgagaccagccuggccaacauggugaaacgcugucucuacuaaaaauacaaaaaaauuaggcaggcaugguggcaggugccuuaaugccagcuacuugggaggcugaggcaggagaaucccuugaacucaggagguggagguugcagugaccugagauugugccauugcacuccagccugggcaacaagagcgaaacuccaucucaaaaacaaaaacaaaaacaaaaaacaaacaacaaaacaaacaaacaaaaaaaccaauauuaucugugggguccagcccuacagggucuguggguuuuucuccucgugugcggagacgagagauuguagaaauaaagacacaggacaaagagauauaagaaaaacagcugggcuggggggccacuaccaccaaggugcggagccugguaguggccccgaaugccaggcugcgcuguuauugauuggauacaagacaacggggcaggguaaggagugugagccaucuccagugauagguaaggucacuugggucauguguccacuggacagggggcccuucccuguuuggcagccaagauggagacagagagcacggcuuaugccauuauuucuucuacgcauuucaaagacuuuuaguacuuucacuauuucugcuacugcuaucuagaaggcagacccagguguacaggguggaacaugaaaguggaccaggagcaugaccacugaagcacagcaucacagggagacgguuaggccuccagauggcugcgggcaggccugacugaugucaggccuuccacaagaggugguggagcagagucuucucuaacucccccggggaaagggagacuccccuucccggucugcuaaguaacaggugccuuccccaggcacugaugcuacuguuagaccaaggucugcuaggugacgggugccuucccuggcgcugguguuaccgcuaggccaggcagcccucuagaagcccuguccgggcguaacaaagggcucacacuuguuuucuggucacuuuucaucaugucccuucagcuccuaucucuguauggccugguuuuuuucuagguuauaauuguagaacaaagauuauuauaauauuggaauaauaauaccacaaacuaaugauuaaugauaaucauauauaaucauaucuauaaucuauuuuuaguauaacuauucuuauucuauauauuuucuuuauuauacuggaagagcuugugcccucagucucuugccuuggcaccuggguggcuugccacccacgauuaccuccuuguaaacguggauguuugauagggaaagggcacaaggaguuggucuguuuugcuugcgaucaaugcccaaaauuugugaaucuaauucauucuuauaagaauaaaaaauaauuaagauuauuauugcuggacccucuuagacccuaucuggcaguuuuccaaaaggauuucccauaaaaggagauaauuaaugaauguaaaagcuaaaauuauuaaaauaaaaaguaaagaagaaauaauaugcaugacuaaaaccuuguccacugagaaaauaaaaacauagaaucccuccagggauuuacuuaaagaaagaagagagaaaacaaauuguacaauauuagugaugagaaaggacacaacgaacacauaaagacaagauuaaaauuauuagaauaagaucguauaaaacaguuguaacaaauuugaaaauucaguaggaguauaaauuaucacagccuuagcucaaaauuuguuagaaauuaguuaucucagacccauauacuuaccagucuaguggaaaauauacaguaaaggauuuuucuacguuugccucauaaugcagaauuugcugucucucaggcuuaacuccuauucuaacggcucuauuuuacagaaaagaauuucugcguggaaauggcuuagcugcugggaaaaugaacaucaguauugauuuagacacaaacuaugcugagcugguucuaaaugugggaagagucacucuuggagagaacaauagaaaaaaaaugaaggauugucaacugagaaaacagcagaaugaaaaugucucacgagcugugugugcucugcugaauucuggagggggagugaucaaggcugaaguugagaauaaaggcuauaguuauaaaaaagauggaauagggcuagauuuggaaaauucuuuuaguaacaugcugccauuuguuccuaauuuccuggacuucaugcagaaugguaacuacuuucacauuuuugugaaaucauggagcuuggaaaccucugguccgcagauugccacguugagcuccaguuuguacaagagagauguaacgucugcaaaagucaugaaugcuucugcugcacuggaguuccucaaagacauggaaaaaacuggagggagagcauauuuaagaccagaauucccugcaaaaagggccuguguugauguacaagaagaaaguaacauggaagccuuggcugcugauuuuuuuaacagaacagaacuugguuauaaagaaaaauugaccuuuacugaauccacacacguugaaauaaaaaacuucucgacugaaaaguuguuacaacgaauuacagagauucucccucaauauguuucugcauuugcaaauacugauggaggauauuuauucguuggucuaaaugaagauaaagaaguaauuggcuuuaaagcagagaagaguuaucuuacuaaguuagaagaaguaacaaaaaauuccauugggaaacugccugugcaucacuucuguguggagaaggggacgauaaauuacuuaugcaaauuccuuggaguauaugauaaaggaaggcuuuguggauauguguaugcacucagaguggaacgcuucugcugugcaguguuugcuaaaaagccugauuccuggcacgugaaagauaacagaguuaagcaguugaccgagaaggaauggauccaguucaugguggauucagaaccagguugaggaaggaggauuggcaauaaggauaccuuuggcuuggguggcaggaagguuuuauuguaucuuugggauuagggacaagauuaaaagucuucaaauuucaacaucucugguggauacaaccaauacuucccugccucuuguuuucuucugcacacuuagaagauagauauuccauacaauaacuaaauaucuacucuuaguagccuuaucugaugcaaagauucuagauguuucuucucuaccauuucuuuacucacuuucaaggaaagccuguucaauucuuuucguuuuucuuucagggcucauuuucuguaacuaaccauugcuuucuuuugggaacacuuacucuuuuacuugcuugcucuuucaucuuucuuuacccacuuuccauuuauuuccuguaaagacuuccccucuuccucucacauuuaugagccaaagaguaaccuaaauuguaccaauaagagaagaauaaugcugauauuuuaucugguuuuggaaaaggaaagccuccagugagauuagaccagaacuagcaacuuacaaaaucucugaaaaugcaaacuuguuccucagaaucugcauaaaacccaguuuuccuucacuagccaucacauucuucuaauuuuaacuuguuuuaaaauaaacucaguuauauggcaauguauuaaauugcuaucaaugcauuuuuacuguuaauuuuccuuccaaguauagaguguuucagcagcaucaagaguuaauuuuacaauuuguaucugaccuaggaaucuaaccacaauauguaaccacaauaucuaauguucuguauugggaaugcaggaucaguucuaaguagacguuugguauacugugcauuaguuagcuugagucucucccaugccaaauuaagagcgugauuuuuguuuucuaacauuauuccauaguaugugaggaacugcccucuccagcaaguacaucaucaccugucucccagaguuauccucuucgugaauauauuaacuucaaaauucagccacugagauaucaccuuccagguaauuuaauucuggcuuccguggaguuguugguguaacuguguucaaaccuccuucucuucaaaccagcucugucuugauauuuguuauggaagcacauucuuuuguuuauggaaauucuuugguguuuuuagucauugaauuugucaaauucuauuucuuuaggugccuaaguagggguagaauuguucguucaggcagugugugaauauuuaaguaauaagauaaugucaaauuauuuccaaaguagauagcucacuuuacuuccaccagcaauauauuggaaaugccacaucuuuuccaaugccagacuucucucuucaucuuucuacuugaacuucuuuucucuugaacuucuuuucuuccucagucaaaucgguauuuauuuggguauauacauggaagaaaauaucucccauagaagauauuuuaucuucuaugaaguggcgauucugucuuuugcucauuuuuguaauaggcuuuaucuuuuucuuacugauuucuaggagcaauucacagauucuaacauaaaauccucguuuagucacagauaguacagauuucagacgucuucuccaaguucaugacuugcauuuucucuuuucccaaggcauauucucccuagcaguuuuaaauuggauauagucaaacuugccauuuaaaaauuuugugguuuagugcucuuugugccuuguguaagagauccuucccuaccccgggguuauaaagauauuucuguuuauuuucuuuuaaaaauuuuaaaguuuugcacuuaacauuuaacauuuaaauauguaauccacauccauaaacggugauguagggggcuauuucauuuuaucccauguggauaaccacuuuuccuagauccaguuacugaaaacucaguuucaccugcugaucgccaccucugggauauuacugcauacaacugacccuugaacaaacuggggcuuaagaccaccaaaccccugaugauuuuuauccauugauuucaauuuucugagccuguaagaggaucaggacaucuucaucuuuucaccuauuuuauuuuugggggguuuuaaaaaagauguaacaguuauuuuaaagucccucuuugaugacuccaaugucugaagcacuugccagucuuuuucuauaauccaguuuuucucuuauuuucuaguaauuuguucugauuuuuauccugucucuuaauuuuguauaguauuauggauuacaaauuguagagacuuuaguagauguuacauuucuucagauaggguuacacauuuuuuuuuuuuuuggcagacagaacaccagugauaacuuuuacucuuuugaaguuuuguuuuaugcuuuucuagguauaguagcuuuuaauuuugcacuaauuacuaggucauggcucuucuggggucuuaaagucugggguauuuaccaagacccuucuacuuggcugggaguugaauuacaauuuguguuuccugagcaccgugaggcugaugaaagugauguucagcucuuuaaucucccaguugaucaguugauauuuucuccuuccuuccuucuuuccuuccuuccuuccuuccuuccuuccuuccuuccuuccuuccuuccuuccuuccuuccuuccuugcuuucuuuucuuucuuuuugugacaggguuucaccauauugcccaggcuggucucaaacuccugggcucaagcaauccaccugccucggccuccuaaacugcugggauuacaggcauaagccaccacacccagcccuaguugauauuuucuucuguguuucuagcaucucaccuguauuagccagugaguugagggaaauuuguggguagauuuuggcuucuucucuucaguuucaucuucucugggauuuuguuucugaaaucccagcuccucuggcagcccugaagucugaccucuguuuucuuuagcccaguaaaacugcugauuucugcaugggcucuauuuacccaugcugugauauggaaaaucuccuuagggaaaaagcagaggugaaugugaagcuacuuccugugauucuucuguauuaaagauuguagcccuuuaaguccugcuuguauugguugcucuccaguccuuuaaauuauaguuuuaugauauauauauauacauauauauaaauuuaaaaaaauauauauauauguagaauuuuuuugagacagaaucucaugcuguugcccaggcuggagugcaguggcaugaucucagcucacugcagccucaacuuccugggcucaagugauccucccaccucagccucccaaguagcugggacuaccagcaugcacuaccaugcuuggcuaacuuuguaaccuuuuuguagagaagaggucuuacaguguugccuagacuggucuugaacaccugggcacaagugauccuccugccucugccucccaaaguguuguuauuacaggugugagccaccaugccuggcccugauacacuuuuacauagcuuuuauaguugcuuuuggugggagaauuaaucuaauacaagcugcuuuguauccauggcuuaaguuggaaguucucagucuuuuauaauuuaucauuauuuccccaucuagggcuaucagaaaagauaacuugugcuccaaaaaccuucugcagaaaucuguucucacaacaugaaggacuuaagcaauuaauaugugaagaaaugggcucugucaauaagggcucacugaucuucucuaggagcuggucuuuggaucugggcuugcaagagaaccacaaaguccucugugaugcucuucugauuucccaggacaagccuccaguccuauacaccuuccacaugguacaggaugaggaguuuaaagacuauucuacacaaacugcccaaacuuuaaaacagaagcuggcaaaaauuggugguuacacuaaaaaagugugugucaugacaaagaucuucuacuugagcccugaaggcaagacaagcugccaguaugauuuaaacucgcaaguaauuuacccugaauccuacuauuggacaacagcucaaacaaugaaagacuuggaaaaggcccuuucaaauaucuuaccuaaggagaaucaaaucuuuuuguuuguuuguuuguuucguuuuuguuuguuuguuuguugguuuguuuguuuuuucuugagauga

SEQ ID NO: 192285 - RNA, 9190 nt, Homo sapiens
gggcgugcacgcgggcgcggcugcgugagaggcgcgcggcggcgcaguaaacagucuccuuccacaaaaccauggcgucgcucaaauguagcaccgucgucugcgugaucugcuuggagaagcccaaauaccgcuguccagccugccgcgugcccuagugagcggggaggucgcgggguccaggggcgcggguguccggccauggcgggagggcgggaggccgggaggccgggcgggagcgggcgggcugcuggaggggccggggacccucggggcugacgcggccuguggccucuguuguuacagcugcucgguagucugcuuccggaagcacaaaggugagccccguccccgccagcccucguaccacugcgcacggggcagcccccacguccagccuccgucuugggggcguggacccuugggcugcgcuuccuuucccgccucgggucuccgcggguucugcaggaaccuugcuuccucugacuuggucccuggugucucugugugucggacaguucccucuguugucccugccuguaaucgcucucaggguuuuggucaguagccuuucuucuaccccgcuucuccuucugcguguuacucuuuuuugcuuagaaauaguuuccgauugcuuuucccaccgaggucuacccuagcaguuucuuccucaguauucugauguagccccucaccauuuggcugaaacugcgcuaacuuuaacaguauuuucacucguguaaauaaugucuuguuagaaacaaagagguaaguccauguacaauacaaggagacguccuugauuuguuaagagaaaaaaagaaccaaguaaguucuguguaugaugugaacacacuuuuguacaguuaaaaagaagugaccuggccgggcgcgguggcucacgccuguggucccggcacuuugagaggccaaggcggguggaucaccugagcccaggaguucgagaccagccuggccaacauggugaaacuccgucucuacuaaaaauacaaaaauuaggcgggcgaggugcgcgccuguaaucccagcuacucaggaggcugaggcaggagaaucgcuugaacccgggaggcggagguuguagugagccgaaaucgcaccacugcacuccagccugggcuacagagccagacucagucuggaaaaaaaaagaaaaaaaaaaguuugauguagguggggcgcggugggucacgccuguaaucccagcacuuugggaggccgaggcgggcggaucauuugagcucaggaguuugagaccagccugggcaacauagcgaaaccccgucucuauaaacaaacaaagccaggcgugguggccugugccaguggucccagcuacucaggaggcagaggugggaagaucgcuugagccugggaggaggagguugcagugagccaggaucguaccacugcacuccagccugggagacagcaagacugucucaaaaaaaaaaaaaaaaaagcuugauguagauucuuucagcuuauuuccacucuuguaccaauauauagaacuuuuuuuuuuagcuuuuagaaucucagcaaugagacuguacccaacauccucauuugaguuuauauauugggcacuuuuuaaaaccuagugcauacaggcugggcgcaguggcucaugccuguaaucccagcacuuugggaugccaagguggguggaucaccugaggucaggaguucgagaccagccuggccaacauuaugaaaccacaucucuacuaaaaauacaaaaauaagcuggguguggaggugcgcgccuguaaucccagcuacuuaggaggcugaggcaggauaauugcuugaaccauggagacgcagguugcagugagccaagacugcaccacugcacuccagccugggcaacagagugagacuccaucuaaaaaaaaauuaaaaaaauuaaaaauaaagacuagugcauacaaguucuagcucacugacuuaaaggacuguauguuauuucauuauauaguugguacgaccauuauuuauauaaagccuccuauugguugauuuuucuuuuuaauauuuguuuuuaauugacacauaauugcauacaauuugaguuacagugugauacuucgauaccuguauacaauguuuaaggaucaaauuaggguaauuagcauauucgccccaaauaaucauuucuucauguugggaacacucgcaauccucucuuguagcuauuugaaaguauaaauugcugccaacauggucacacuaagguacuguguaacacuagaacuuauuccucccaucuagcuguaauuuuguauccauuaagcaacuucucccuagcccccuacacucuacucuuccuagccuccaguuaccacuauucugcucucuacuucugugaaaucaacuugcuuagcauccacauguuaacaagaacaucuuauggugccuggcuuguuucacuuaacauuauguucuuugggcucauccauguuccugcaagugacaggauuucaugguuuuuuauggcuaauauccaguguauauauguaccgcauuucuuuauccaucuguugguggauccuuagguucauuccuuaucuuggcuguugugacuagcaguaaacgcaggagugcagguaucucuucggcagacugauuucauuuccuuuggauauauauacaguagugggauugcuggaucauaugguaguucuauucguaguuuuuuuuuaggaaccucuaugcuguuuuccauaaugacuauacuaauuuacauucccaauaacagugcaguguauaagaguucccuuuucuccacauccuugccaacauguuuuuuucuuuuugauaauagccauucuuacuguggugagaugauaccucauuguggucuugacuugcaugucccuaauaauuagugauguugaacauuuuuucauguacuuguuggccauuuauaugucuucuuuugagaagugucuguuuggcucauuugcccauuuuuuuuuuuuuuucuuuuugagacagagucuugcucuugucgcccgggcuggaguacaguggcgcagucucugcuuacugcaaccuccgcuuccaggguucaggugauucuccugccucagccuccaaaguagcugggauuacaggugccugcuggcugauuuuuguauuuuuaguagagacaagguuucaccauguuggccaggcuggucuugagcucuugaccucaggugauccaccugccucggccucccaaagggcugggauuacaggggugagccaccaugcccggcccauuuguccacuuaauuuuuuuuuuuuuuuuuuuuuggcuguugagcuccuuguguauucuagauauuaauccuuugucaagugaauauuuugcaaauauuuucucccauccuguggguugucucuucauucuauuguuuccuuuguuguacagaagcuuuuuuguguaauagaauuccauuugccuauuuuugcuuuucuugccuguguuuuugagauuuuauucauaaaaucuuugccuagaccaauguccugaagcauuuccccuguguuuucuuguaguaguuucaggucuuacauuuaggucuuuaauccauuuugauauuuauauauggugacagauaaggaucuaguuucauucuucugcauaugguuauucuuacaguuauccuauuuuuccaguaccauuuauugaagagugcuuuuuuccccaguauaugcucuuggugccuuugugaaaagucaguuggcuguaaaugugugaauuuauaucuggguucucuauucuguuccauugaucuaugugucuauuuuuaugcuaguaccaugcuguuuagauauuauagcuuuguaguauauuucgaggccaaguaguggugaugccuccagcuuuguucuguuugcucaggauugcuuuggcuauugggggucuuuugugguuccauauuaauuuuagaauuuuuuuuugacauuucugugaacaggaucauugguauuuugauagggauugcauugacucuagauuacuuuggguaguauggucauuuuaauauuuauuuuucuuauugguggauauuuacauuaauuuugccuuuguugcugcuauaggcaguguuaaagugguauuuaauaaauaauuuuuaucagaaauuucuaauagccacaucuguuguacacuuuucauuugucuuuuuuauuuuuuugcaacaaagucuugcucugucacccaggcuggagugcaguggugcucacuauagccuugacuuccugggcucaggcaguccuccuaccucagccucccaaguaguugggacugcaggcgugugccaccaugccuggcuuauuuauuuuuaauuuuaauuuuuguggagaugaagucucacuguauugccugggcuggucuugaauuccugggcucaagugauccuuccaccuuggccucccaaagcguugggauuacagacgugagcuacccaugcucagccugucaucuuucuugauucccaugaauaucugcuguguuuggcuuuuucuuucuugauauucuuuggaggcugggaagauaccgcucugugguauucucuccucccuuucucccuucgaaguccuaaccaggccugacccuguuacagcuucugaggucagaugagauagggugcauucaggguggcuuagcuguagacucucguuuucuuuuuuuuccuuuuuucgagacagggucuugcucuuuugcccaggauggagugcaguggugugaucacagcucauugcacccuuggccuccugggcccaagugauccucccaccuuagccuccugaguaacggagacaaacuuuaucuauuuuucguagagacagggucucacuguauugucuaggcuggucuuggacuccugggcuuaagcaguccuccugccucaaccucccaaauugcugggauuacaggcaggagccacugugcccagcuucuccuuccuuuugcuagaucucucucuugaaaugugguccuugacuuuuauuccuagguaggugaucucucuuucacuuuaaacuuuuuuuuuucuugcugacauccaacuguuuagcuccagccucuuuuugagcaccuuagacacaaauguauuuuggggucagguacaacccagaaaauucaccucuccuucagucccuccugcuguguuccuuacacauauagcauagccguaaaguuagacccggauuccaaaucugccucugcuacuuacuagcuguggaccccaauggacaaguuuauuacaagaaaauuuaauccuuucaucuguaaguggaauuaacagucuccaugucaugggggcuucguaaagguucauugagccacuauguaucucacuguguaccuggcacagugcucggcacuuagucacuggcagcuguuguaacugccaccuacaugacuagaaccuuuccguagcauauugucaaaucuacauuuuaagucucuacaaucugguccugccuuuauguccucagaacccuuuccugugacuucaugcucuguugauacugucacccaggcuggagugcaguggcacaaucacagcucacugcagccuugacacacugggcuuaagggauccuccugccucagccucccaaguagcugagaccacauguguguaccaccaugccuggaugauuuuuuuuauuuucuguagagacauagucuugcuagguugcccaggcuggucucaaacuccugggcucaagugauccucccaccuuggccuccgaauguuaggauuacaggcgugagccagcacagcuggccuucuguugacucuguaaguucuuuggugguuuugccccuaguuuuaucccaucugguaucugguuuacagcagcuauuucaaacaccucaguuaauuguggugagaauuuuguaagauucggcaggguagggaggauggggacagguucuuggggugcaugaaugaguccugcuuucucagccugcuggcgguuuuccuuaaucucucucuugcuuugaucucucacuucuuccacauuccugggcacccacccacaucccuuaccccagacacuugcuuccuaccuagaugcuaccuugguagggaggugcagccuugucgcugaaauggagguaaugugggccugggauuugugucuuuuucagaacagugcaacccugaaacucguccuguugagaaaaaaauaagaucagcucuuccuaccaaaaccguaaagccuguggaaaacaaagguggguugguugacuucaaacaaaucuacaagggacuucacauagaauaagucgaaggaaaaggggagaguggggcuggucagggaauccagaacaauagcuucauugggaaggaacagcuuccuuagccuugagcaucaggaguggggccaugucaucaugggugauauugaggcaacagccugaaagcaguauucaggagaagaaaaaugggcagaagacagagaugagaaaggccauggcugugguuuggggguuugcggugggcccugcuggcaggagccuucucuagcccauagcugcuggucucccuccaugaaucuggcugggacugucaguucaccugaacucagcccaggcaggaggcuuucuuuguccuagaucaucucgcugcugcuggggguucagagcucacagcaguagugggcugucaacccauccguccagccaucuaaacguucuuuaauaccuccuggguggcaagcaccaugccaggcucugaaagcagccccucuggugccaccaaagagguauugaacauucacuccaaaggcauggcccauuuuugcccuuugagaaauuuccagguuggguucaggcaaugccagcaguuucugcccaugcugaaagcacaggagauucuacuuggcugguuuuuacagagcauccaguuaauuggcccaucacaggguuggagccauguugagguggggauggguauuaaguuauuagacaaccggggucuaagccuaaagaccacaggaccacauauacaguaaggcugugaacacuagagugcauuuguuaaaaucaccaauucuuucacuuagccucccucuucuaaaaaaggaguguuaguauagucacagacuccggagaagaggauuuuugucuguaccugcuugaauaccccuaucacuaucacaugugcgugcacacauuuuuauccuguucaaguagugguuaaaaucuggugcccaggccuccuuuuuagccaugagccauugacuguuuuguauuccuuagaugaugaugacucuauagcugauuuucucaauagugaugaggaagaagacagaguuucuuugcagaauuuaaagaauuuagguaagucugugcuaugcuugucaaucguugagauacauuuacuguguuguaaggauugugauuuuuuaaaaaguuuuuaauuucuugaauaaguauggcauguagggcucuuacuaucuagccacauaaucuguaaacauacaggguuucacaccucccagccugcccacaccauuccuucugccuggaauccugcuggucuuguggguuggcaaaauucugcuccuccuucaagccuugguucaaguuuucuucacucagcuaagcuuuucuugaccuuuugugucucuuucagaauuaggcacuuuuuugguuucccauagcaacuuggacuuaauaguaauaaaucacuguuacauuucaugguaauuugucucucacauaccgauuuguacagcagggaccuguauucccagauccccagugcucagcucacaguccagcccuuaacacaaacugguuaucacaugauuugauuuagggggaaacagguguugccauuuuuguagcacugcuuauucaguccuuacaacauucuguuacaugugcauggggucuguuaauuucauucuucccauuucacagaaucauguuaaaagguuauguuuugcacuuagucucaugguaaugauuaguuagacugaguuuggagaugagcuaguaauaggugugaaaaauuuuacagacugugaaguaccaugcagguauuauuguugguucccugcuacuggugcugcugcaugccaaauggcaugcuuagacaucauucagauuauuucguauagccgucuucaccacuggcaacuuuuauggcuagaaagaaagaaaacaugccagcagcuuaaugcuacuauuugcuuugugauugugcugauaaagcauuuuuuucuuagcugaaguggcacgaaguuacaauauuuacaaagauaccaagaacugguaucuguuacugcauuuaaugcggaaauaguuugauaugcuggucuuaccuuucauuuuauagagguggggucucgccauguugcacaggcuggucuugaacuccugagcucaagcaaucugcccaccuugaccuccccaguugcugguauuacaggcaugagccaccacaccuugcugauaguuuuauuacacuugaaauagcucuucacuuuucagccaucuccauguguuuccacuugaacucagacuggcuuuuuuucuuguuaauuuuuaggggaaucugcaacauuaagaagcuuauugcucaauccacaccucaggcaguugauggucaaccucgaucagggagaagacaaagcaaagcucaugagagcuuacaugcaagagccuuuguuuguggaguuugcagacugcuguuuaggaauuguggagccaucccagaaugaggagucuuaagauggauuauugugcugcuugcucaagcgugugcuugacuccuggaaccugccugcucccucucccagaccagcuaguuuggggcuggggagcucaggcaaaagagguuuccaggaugcagauuaggucaugcaggccuuuaccggcauugauguggcucauguuucaggcagacuugggguccuuaagguggcaaguccuuuauggagagaaaacuugacauucagaugauuguuuuuaaauguuuuacuuuugguacaguugauagacaucauaaacgauaucaagcuuacacuucauauggaguuaaacuuggucaguguuaauaaaaucaaaacgugauucuacuguacauugcauuauucauaauuuaauuguuugaaauuacauuaaauaaaucaacuaauuaaauac

SEQ ID NO: 192286 - RNA, 83061 nt, Homo sapiens
gagaucagcgcugggacggaacccggguuccucucgaaccgggauugugacgcuuuuggccuggcuggccgcuguuuucugucccacuuuuuacucgggccugcguccgcugccgccgucccucaguuugcccccggaggaggcagggcggccgugccuucugccgugcgcccgcguggcugccaccgccccuccgaauccuccggggccgcagagggguucgcuacggagggaggugggggccuucgggaggaggaggcggaggaggcggaggaggagggaaggaagauggcggccguggaacuagaguggaucccagagacucucuauaacaccgccaucuccgcugucguggacaacuacauccgcucccgccgagacauccgcuccuugcccgagaacauccaguuugauguuuacuacaagguaugcgccgugggccuccucucugcucuccuccagcaaccccgggggccgcacccccuuccacgucugcgaacccccgcaguuaaccccucaccccuuccggcagacuugccucccgaaacgucuggugcggugucugcauugccaguggagaagcaccccaucucccuaugcccugucucuuaagcuuuggggccuugaaguaaucuuggggagucuugcucccuguugguguucccuucuacacaguggcccucuuggguaggccuuuugcguggacuuacucuaucgcgccccugucccaccuaguccuuuccuucuagcccguaucuucaggauauuuuccauccucuccuuccaauuaagugucagcaucagcuggacuuuuuuccgugcuccuccccccacccauuccuacuuucucaucucgccgccuuccuuccccgaguguuuugguguuuuugcuucguguuccuucguuucuccuuucuuuucccaauugggaaggaguuagggauuauuggaaauaaucuguguguuuuauuugcauauucuuuaaagcuuugauuuuuuugugggagaggaggggcucuauacuugaauuagggauuuugugaaaaugggagugcugaucaacuguuugaagaggacagggagagaucuuuacugaaagaaaaaaacacuuuagauuauguuccuguguuugaaaguugcaaucuugcagcauucuuaaaucacucccccucaaaaaucugaacagcaagucucccaagccacucuccaaggaguuucaaggguaaguguccuuagauguggacuauuuuugcaguguuuucagaguguggagaacuuuauggacucagagccugcccuuuucucucccccacauuugaaugugaacacuggauuuauuauucagucuuccuugucuugaauccgcgucgauaacuccuaguguccaguagccacccaugcaaaaugugacuaaaaguagaauguaauuuauuuuuuagaccuuaaauacuuccucuugaucuguaaguuggcuggaacaguguaaacugauauuuuaacagauguuuauguucuuacguauguacaguguuuuguggcaguuguuuuauugggaagauugccugcuuucuccaccccuagauuuuuuuuuuuuuuuuuuuuuuuuuuucagaauuagcaguugaugggcugcguucuacuaaauccagcugcuuugcaccaauucuaacaauuaaagugggguuuccccccuaaauauuuggagaagauucauuuaggucaugcguauuauuauuuuggauuucgagaaaaagcucccuuuuuuccuaaucccuuugauacauugauuuacuuuuguguauucuaaggaaauuuuguucauuuaagauacauuccuccccaggaaggacaaauuagauuugucuuucucagccugggaaacugcagcuuugugugugcucucuguccauuuuauuaaaucauguguaaucuuguaccucauauguaaucucucagaggaaaucauugggaauguaauccaaguguauuuacuaguugaauucguucaaaauacuugaauaucuuuuaguaacuuucacuucuaauugaagcuuuucauuugaagauuauuaguaugaauagauggugcuuuuguuagaauuucuguuucacauaguucacacaguuuuaauauugcuccuuuuugguacacuuuuacuucuuaauaguuguaugcuuauugggaguauggcacugugcuaagaugagggaaguguuaaacaugugccuguaacuauguugugcuuuuauguguuauuuuguuuaaucuucagaauuaaacugugaaguagaguacaguauaaccuugcuuuauuggugagaaaguuaaguaauuuaauuaaggucucaaaccugauauuuaguuccugaguuccuugcucuuuuacuuagauaucuaucuuaagauaguagauuauuuuaaugaaagauauuauaacacuaauuuuuuuauuagcuucuauggaaguggagugaaagucagucccaggacucuauucuaaucuuuaauggagauguaagaagaaauuauucuuuuuauuaaaauuuaaaaaaaauagagauggggucucgcuguuuugcccaagcuggucuugaacuccugggcucaagcuauccuccugccucagccuacugaguagcugagacuacaggcauaugccaccgcaccugacuuuucuuccuuuuaaacacuauuagcauauacauauaagaaacuuuuuuuguggagacaggaucuugcucuguugcccaggcuggagugcaguugugaucauagcucaccgcaaccuugaaccccugggcuuaagcagucuuuccaucucagccuccugaguagcuggaacuacagguguaugccacccaugccuagcuaauuuuuuuuuuuuuaauuuuuaguauagaugaggucuugauauauugcccaggcuggaaaaacuuuuuaaagcaauauaacugcacacauaaauauaagauacucacccccugcccaacuugugaaaauuuuaggaggcuuacuguuuccaauuuccaauuuucugcacuuuaaagccaaggagaaacucauaauuacaucucucuugcaguccaaauuuccaucaguaggcauagucauagacaaaauuggaguauuuguggaaucaaauuuccccauucugcuuguuugguguacuacaguaugacuguguuaauuuuuguaauagcuucagauaaaggcacaaucguaaagcauuaggagaugggguuauggaaugaauggaagguaaagaagcaggaauguugacugcuguauaagcagggaagggagagcauagaaaggguaaaauaugaaauguuuuuucuuuuuuuuaaaaaaaaaaaagaauggaagacacuagaauauauuuguuggcugaguggcagaaaccaagagaaugagguugaguauccaaguguggugggaaauaaguuacggagcaaagucccugagcaggaacaugaguugaugagucuugccuguuuuuggucuuuccuccuucaccgugcauaaauuaagguauuauccuuauauuggaguuggggaaagaacucuucuucuaagaucagaacaaaagaauuaaagauguaaaggcgcagggcucacacucauaauuccaacacuuugggaagcugaagcagaaggaucgcuugagcacaggaguucgagaccagccuaggcaacauagaccccuucucuacaaaaaguagaaaaaguuauccaggcaugguggugcaugccugucaucccagcuacucgggaggcugaggugagaggauugcuugagaccaggaggucagagccugcagugagcugucauugugccacugcacuccagccugggcaacagagggagauccuaucucaaaacaaaacaagucguuaauauagguaaguuuguaagaaugauugucaugaauuaggaggugaguucauuugcugcggguaagugauaggagugguagcuuuuauacaggaagucuaaacagaaguugggaaugucuacugagguguaugagaagggaaggugacuaaaaauguguaaaagaauaguuaauaaaaaucagaacccuacacaauacagucauguguugcuuaaugacggggauauguucugagaaaugcauuguuaggcgauuucaugcuugugggaacaucagagaguguauuuacacaagccuagaugguauagucuacuacacaccuagguuaugugggauagccuauuguucuuaggcuacaaacucauauagcauguuacuuuacugaguaccguaggcaguuguaacacaguauuaagugcuuguguaucuaaaccagggguguccaauguuuuggcuucccugagccacauuggaagaagauaaauugucuugggccacacauaaaauacaauaacgauagcugauaagcugaggaaaaaaaaaaucucauaauguuuuaagaaaguuaacgaauuucuguugggucucauucaaagcuguccugggggcuaggugcaguggcucaugccuguaaucccagcucuuagggagacagaggugggaggauagcuugaacucaggaguucgagaccugccugggcaauaaagcgagaccccauucuucacaaaaagaaaaaaaaaaguguaacugaaagcugaccugggccacguguggcccgcuggcugugcauugggcaagcuucaucuaaacauggaaaagguacaguauaaaagauaagaaaugguacaccuguauagggcacuuaccgugaauggagcuuuuaggacuggaaguugcucugguaagucagugagugaguggugagugaaugugaaggccuaagacaucacuguacacuacuguagauguuauaaacaguguauacuuagacgacuauaaauuaauguuaaaaauaaaguaauucaacuacaaugucucuaggcaauaggaacuuuuuggcucuauuauaaucuuauggggccaccuuuuuauaugcagucgguuguugacugaaacuuuauguggcaugugaucauaaugcuuggauucugaaaguuuucucuccaagggcgugcaaccauuuugguauaaaagcagguaagaugaagugaaagaauugugaggcagauggagugauauaugccuguagucccauccuagcuacucaggaaucugaggcaggaagaugguuugagcccagaaguuggagguuauagggugcuagcugcggucgugccugugaauacugcacuccagccugggcaacacaauuaucucuuaaaagaaaauucuagaacucuauacagagugaaaggaaauagagacggggcuguguucuuauucuaaagaaugaaguuuauggccaggugugguagcucacaccuguaaucccaacaguucgggaggcugagccgggaggaucucuugaguccaggaguucaagacuggcuggggcaauguagugagacuccaucucuuuaaaaaaaugaaugaaguuuaugaucuuuuuauuuuaacuacugaaggucuauuuuguguuuuuuccaaauacaaagugugccguagaguuaaacuuugucugggugaaguguuucagcaguguguucuauguauuguuuucacaaucuuaauuuuuuuuuuuuuuuuuuuuuaacagagucuuguucuguugccugggcucgagugcauaggcacaaugucggcucacugcaaccucugccuccuggguucaagugauucucccgccucagccucccaaguagcugggauuacaagcaccugccaccacauccagcugauuuuuguauuuuuaguagagaugggguuuuaccauguuggccaggcuggucuugaacuccuuaccucaggugaucugccugccucggccucccgaagugcugggauuacaggagugagccacugcgcccggccuccuuaaugauuuuuuuaaaaauuaaaguauuaugcugaaaagaaaaaacaaaauaaaaauaaauaccaugcugaaaaccauacuaauuagguucugauuuaggaucggaguuaauuuuuucuuuuucucuguauauuucaguuguauagcuacauacagccugaacuaacauucaguuuucugagaauuuaaaaaaauacacugauggccgggcaugguggcuuaugucuguaaucucagcacuuuggggccauggugggaggauuuugcuugaguccaggaguucgagaccagccugggcaacauagugagaucccaucucuagaacaaagaaaaaaauuagccaugugugguguugcaugccuguagucucagcuacucaggaggcugaggcaggaggauugcuugagcccaggaggcugagguugcagugagcugucauugcaucaccguacuccagccugggugacagggugagaccuugucucaaaaaaaaaaaaaaaaaaaaaaauuaaauuuggcuacuaaaauuauaaaaguaucagaauaaauuauugggucaauauuuugcagugggaaaugaccaaaauuucuucuuuaaagaaauuguuuuucuuucuuuuuuaagagacaaguccuccuucugucucccaggcuguagugcaguggcauaaucauaucucacugcaaccuuggacucuuggccccaagugauccuccugccucaucgucccgaguagcuaggacuacagaugcuugccaccacaccugguuaauuaaaaaaaaaauuuucuccuuucuguaggagauaacaacaaaaaaaaccuuaaaaauuuuuuuuuuguagagaccgaccguaucucacuuuguugcccaagcuggucuugaaccuuagccucaagcagucuucccaccucagccccguaaugugcugggauuacaggugugagucacugugccuagccuaaaaaauuauuuuuaagguaauguacaaaucaugaaaaugucaaacacuauaaaaauaaguggccaggagcaguggcucaugccuguaaucccagcacuuugggagaccaaggcaggaggauugcuugagcccaagaguuugagaccagccugggcaacauagggagacacugucuuuaccagaaaaaaaaaaauuuauucaggugugguggugcaugccuguggucccaguugcuugggaggcugagguggaaggaucauuugaagcuuggcaagucgaggccgcucagugagcugugauugugccgcugcacacuagccugggcaacacagugagaacuugucucaaagggggggaaaaagguaauguaaaaauaauuuuaaaaucuaucuuuaccucuugucuuaccuugccaacacuguaaugccaucuuggcaugaagaaggcauuucuaagaaugaaaccaaagcccagaaggaaaaaaaagaaauugauguguuggaaugcauuaaaaaguagagcagggagcaguggcuuacucuuguaaucugagaacuuugggaggccaaggugggaggauggcuugagccuaagaguucuagaccugccugggcaacauagggagacccugucucuacaaaaaaauuaaaaauuagccagacaugguggcacaugccuacggucccagcuacucaggaggaucgcuugggccugggagauucaaggcugcagugagugguuaucaugacacugcacucucagccuccagagugagacccugucucucucucuuucacacacacacacacacacacacacggcugggcaugguagcucaugccuguaaucccagcacuuugagaggccgaggcaggcagauuguuuaagccuaagaguucaagacuagcugucucucucucuuacacacacacacacacacacacacacacacacacacacacacgcacgcacacacggcugggcaugguagcucaugccuguaaucccagcacuuugagaggccgaggcaggcagauugcuuaagccuaagaguucaagacuagccuggguaacauggcaaaauggugucucaaccaaaaacaauaaaaaauaagcuaggcauggcgacauacaccuguagugccaguuacuuggcagaauugcuugagcccaggaugcggagguugcagugagccaagaucaugcuacugcacugcagacaggaugagacugucucaaaaaaaaaaaaaaaaaggaaauuguaagaacacuuuaaaaaaacacuaugcagaugacagcauuugacagaugaagggcauguuuucuaauacagaaagaucuaauacuaaucaguuugaaaaaggcagcuaaggcaacuaauucaugucccaaaaaccaguuuacagaagaggaaauaugaauggccaaugaacauuaaaagauacucaacugaaauacaaauucaaauacaagauaaagccagaugcaagguaaucaugacgaugaagaaagaaaaucuggaggaauucaacuuguuaccuggcuauaacaauuaagguaauaugguauuggcacauggauugacaaauagaccaauggaucaaaaucgacaguccagaaacagacugacacauauacuaucaccuguauuaugauaaaagugagacagcacuaugauagggaaaggaaagucaaauuaaugguauugguuaauuaauuucuguaucagggaagaaaguaucuugacuuuaccucacaccacacacaaaagucauuuccagauaaauugcugaucuaaauaugaaaaaaguuuuuuagaaaaaaauuuuaugucagcaaagauuaauuuggaucucaaagugguuaaauauaaaggaagugugauaaauuggugcuauauuaagaucaagaacaucucaucaaaagauaucauuaagcaagugaagagucaagccacagagugggagaagauauuugcagcaccuguaucugacaaaggacucauuguacaccuaaagaaagaacuguacauuaauagcagagaaaaggcccaacaugguggcucacgccuguaaucccagcacuuugagaggccaaggcaggggaucaccugaggucaggaguucaagaccagccuggccaacauggugaaaccccaucuccacuaaaaauaaaaaaaauuagccaggcauggugacaggcacuuguaaucccagcuacuugggagucugaggcaggagaauugcuugaacccaggagacggaggcugcagcgagcugagaucaugacauugcacuccaggcugggcgacacagcgagaaaaauacucaguuuuuuguuuguuuguuuuuugaagagaauuugaauaggcaucccaaaagagaauauucaaaaggccaaacauuuagaaagaaacucaaccuuauuuugucuucagagaaguacuguuuuacuguacacccaucacagugacucaaugaaaauguuagcaaggauauggagaaauaaaaaacucucauacauuguuaaugggaauauaaguugauaugccauuuuggaaaagcagcauuaucuacuaaaacugaacauaaacauacccuguaacccaguaaugcuacuucaagauauauacacuuaugaauguucauagcacugcuauucauaauagcccaaagguggaaacuguccaaauacccaucaauagaagaauauuaauaaauagugggauagucacguaguagaauauuacacaaugaaaaugaaugaacaacaacuacuugaaauaauaugaaugaaucuugcaaaugauaaugagugaaauaaaccagucacaggaauauauaccagagguuccuaaacuuucucccuuuauaacccuugguucauggcaaccccaggccaaaagaaauaccugacaguucuguuuauuaaguaguuagauccaaaaaacuucauauuauuuauguccuaacaacuuaagaucuguuucuuaaaaugcacaaaaauugaacgaaaaaacuuucauucuuagacaaccacauuaacuaaugggauguuuguuuauugggcacuguacagcgucucaaaccuuggaaucagauuggauaccaccacucucaucugguuuuuuuuguuuguuuuuuuuuuguuuuuguuuuuugagagggagucucacucuuccuccgaggcaggagugcaguggcaugaucucugcucacugcaaccucugccuucuggguucaagcaguucugccucagcuuccccaguagcugggauuacaggugcgugccaccacaccuggcuaauuuuuuauauuuuugguagagacggguuuucaccauguuggccaagcuggucuccaacuccugaccucaagugaucugccugucucggccucccagaguguugggauuacaggcgugagccaccgcacccagcuucaucugauguuccuuauugacuuuuuauauuacucuuuuuaucacagcaaccacugaaaacacagcuucauaaagaucucauugaaagcaguguaguauaccagucuaguaguugguauagcgcauugcagaugcugaauguuguuucucucaaauuaagaauaucuagcagggccucagggcaccuuggugcacaguuuggaaacuggauguauaauauaugaucucauuuauaugaaguucaaaacaggcaaaauuuaguuguugaaaguuaggagacgcuauucuuggacaguagugacgaugcagggacagauaugaggggagccuucugagauugugguuauacuuuguuauuaucuggaugcugguuacaagugaaaaauuuaucaagcuucacauuuaaaauaugaguugugcgcucuucuguaugcauguuauacuuugauuuaaaaauguuaaaauaggcugggcgugguggcucaugccuguaaucccagcacuuuggaaggccaggguggguggaucgccugaguucaggaguuugagaccagccuugccaacauggugaaaccccgucucuacuaaaaguacaaaaauuagccaggcaugguggcuggugccuauaaucccagcuacuugaaaggcugaggcaggagaucugcuugaacccaggagguggagguugcagugagcugagaucgugccacugcacuccauccugggugacagggugagacucugucucaaaaaaaaaaaaaaaaaaaaauuuaaaauaggccaggcgcagugguugaugccuguaaucccagcacuuugggaggccgagguggguggauuacuugaggucaggaauucaacaccagccuggacaacauagugaaaccccgucucuacuaaacauacagaaauuagcugggcaugguggcggauaccuguaaucccagcuacuugggaggcuaaggcagaagaaucacuugaaccugggagguggcaguugcaaugagcugagauugcacugcugcaccccagccugggcgacagagugagacccugccucaaaaaaaaagaaaaguuuuaaaauaacaucagccuucaccugucagauugucaugcuuuaaaaauucaaaucacucauacccuuuaaccaacaauacaauuuaaagaauuuuucuuccaggaauacuuguugaauguguggaaaauccuguuagaggauauucaguguuuguucauaagcagcauuguuuaugauggcaaaaauugaaaacaaccauaugcuaaucaggaauggaauaucauagugcauuuauaaagaaugaguauucuauguauacuagagaugccagaacauagagcaaguagggagaauaaaaaguuuguuacaaaguagugugaauagaaucaucuuauguguguguuuuguuuuuguuuuuuugauagaaacggggucuggcucuguuguccaggcuggucuugaauuccuggcauuaggcggucuuccugccuuggcuuccuaaagugcugguauuauagguaugagccaccuugccuagccuccauuguggguuuuuuguuuguuuguuuugagacagggucuugcucuguuacccaggcuggaaugcaguggugcaaucaccacuuacuacaaccuccaccuccuaggcucaagugauccugccuaguagcugggacuuacagguguguacugcaugcucagcuaauuuuuguauuuuuuguagagaugagauuuugccgcauuguucaggcugguguugaacuccuggguucaagugaucuuccugccacagccuuucaaaauguugggauuauaauggugugagccaccaugccuggcuguguuuuuuuuuuuuuuuuuuuuuuaauguggggaaaauauguauauguguuugcauugaaagaagaauauaggggaacacaacaaaauuuuaaugguguuuacuccagggguaggaucgcaauugcuuuuuacuuuguacauauaugcucuauuuucuuuuuuuuuuucugagauggaguuucacucuucuugccgaagcuggauugcaguggcaucugcaaccucugcuucccagguucaagugauucuccugccucagccucccgaguagcugggauuacaggcacccgccaccacgcccggcuaauuuuuuguauuuuuaguagaaaugggguuucaccauguuagccaggcuggucucgaacuccugaccucaggugauccucccgcuuuggccucucaaagugcugggauuacagaugugagccaccgugcccgcccucaaaauaaaaauguagaaaacauugauuuugguggaucuaucuugacaaccauauuucuccgugagaagcuucagcuguuccuccuucuucguguccaucuucugaaaugcccuguuggcauuauaguacaaaaccacaaguuaucugucacaaaaauugaaucccgauaggugaucacaagcauucuuggcaacaaagaugucuucauagaccacauaagcuguuccucuaguuucagguguguuuuccacucugauuugaugaauagguccauauuucccaaauauacauugauugagcugugauuguguauggcaaauuucuuauauacaauaucugauuuacuucagguggaagucgaaugcucgcccucuuggccgcuugcacugcugucuuggcaggcugaugagguuacuguagcaaauacugaaauucuucuggacaccuuccgagcucgcuggguuucaggcgcugcacagcaucaggggugggacaucaacacccaaguacugcuggaaccuguuauagcacccacggaauagcgcugucucacgccaagaugcgaccauguagcguucccuuuugaauaggcucccagggucaaaaaaaaaaaaaaaaaggaaaagaaaaauuuuuuuuuuaagugaagacuuucagacuuauuucugaaacuguauacuagauauucagcauucuuuuuuuuugucguuucuuuuccuuuccuuuuuuuuuuuuuuuuuuuuuuagauggagucucacucuguugccuaggcuggaguguaaugggcagucucggcucacugcaaccuccgccuccugaguucaaauuauuuuccugccucagccuccugaguagcugggacuacaggugcgugccaucacacccgacuauuuuuuguauuuuuaguagagacgggguuucacuauguuggccagucuggucuugaacuucugaccucgugauccucccgccucagccucccaaaguguugggauuacaggugugagccaccgcacccagcccuauucaacauucuugaggugcuaaccaguacuguuaaaauaaguaaaaagccagcaaagucaacugaaaaacuauagcaguaagauaauucaguaaaggggcugauuacacguuuauaauuaaaaauucaauuuuucuauaugcaauauaggaaggauuauaucugacucaaaauaauaaaacaccucuuugggaggccgaggcgggcggaucacgaggucaggagagcgacaccauccuggcuaacacggugaaaccccgucucuacuaaaaaauacaaaaaauuagcugggcgugguggugggcacuuguagucccagcuacucgggaggcugaggcaggagaauggcuugaacccgggaagcagagcuugcagugagccgagauugggccacuguacuccagccugggugacagagcgagacuccaucucaaaaaaagaaaauaauaauaauaauaaaaaaacaccucaaggagugagaccaaaaagacacccaaaagucuucaauaaauguagaagagccaauauuuuguuccuagauuggaagauuugggguuucaaagauguaacuuuucccagaaucuauauauucagugugaacuuaaucagaauccccagaacaguucuuagaaccguuaaaaauuuuaaaaauguguagugggaaaaaauauaucuuuauauaauagaggauuaaaguuuauuaagcauauucaaaacucuugcaaaucaauaagaaaaggagaacuggaaagaagugugccauuauguugacagugauuuuccucuguagauggaugguaaaaaucagcaauuauuuuugaaauucccugcauuuucuaauguuuuuaaaaacauaaaugcugaaaucagaggaaacaaguguuuuacaguugguuaucuagaauacagaaugaguuuucuuauagagacaggaaguguuuucuuuuuucuuuuucuuuuuuuuuuuuuucaauggagucuugcucugucgccaggcuggaauacagugaugcgaucucggcucaccgcaaccucugccuuccgaguucaaguguuucuccugccucagucugcugaguagcuaggauuacaggcacacaacaccacgcccagcuaauuuuuguauuuuuaguagagacgggguuucaccauguuggccaggauggucucgaucuccugaccucaugauccacccaccucggcuucccagagugcugggauuacaggcgugagccaccgcgcccggcagaaaguguuuucuuauagcuauacugcccuauccuuuugucucauggaaacacuuccgauuuucaccacauauugguagugaaacuucaagaagagaagcugagagacuuaucccaaauauagagauugcugguauauauuguguuauguaugacugguuaucacugacuaggccuuacaucuaacuagauuuuuguuuugaacuuccauuugugcugugguaacaucuccuaccacuaacaaaaucauacuaucuugaaaauuaugccauugaccuauaaagugagguauagaguuggagcaucuggguaaauacacauaaguucauucuuuuaaccauugggggggaaaacucuuaauuucuuguuucauggaugauugaccuagugacaucaucaucauaaauggacagcauauuuaaguuuuaguaaaggguugcccuuuuauuugaauauuaucugaaaugacacuuuaaugaagcaacagauaaaggacauuaaauguaagguauaaaguacaaagaaaaggaauaucaauauucuaauauaauguuuuucagaguacauuucagaugauuuuuuuuuccccagaaacaggaucucacuuugucucccaggcucugguguaguggagcaauuauggcucacugcggccucaaccucccaggcucaggcaaaccucccaccucagccucccaaguaccuggggcacacgccaccaugcuuggccaauuuuuuuuuuuuuuguagugaugggggucucccuauguuguccaggcuggccuuaaacuccugggcucaagcaguccucccaccuuggccucccagagugcugggauuacaggugugacccaccacgcccaacaucagaugaguuuuuuacuuuuuaaaauuauuuguuuugaggcaggauuuugcuguguuguccaggcuggaguccagugguauaaucaugacucacugcagccuugaccuucagggcucaagugauccuuccaccucagccacccaaguaguucagacuacagauauguacuaccacgucuggcuaauuuuuuauuuuuuguggaguugggggucuugcuacauugccccggcuggucucaaacuccuggucucaagcaauccucuugucucggcuugccaaauugcugggauuacaggugugagccacugugccagccuucagaugaguuuugagaucagagcauaauaauaaaugaaucauguaagugacgauaacucauguuuguuaaaugaaacauauucuuuuauguuagagguaaaggauacauuuacaagacuuccuuuuuuaaaaaguuaaauacauacagaaauagaauagaauaaugaauuccuaugucuaucaccuagcuuuaacaauuaucgauucuggccagucuuguuacugaaucuguucucccauucacuuuccccuuucaugugauauuuggaagcaaaucuagacaucagaugauuucuuuguuguuguuuuuuguguuuuuugagauggaguuucacuguuguugcccaggcuggagugcaauggugcaaucucagcucaccgcagccuccaccuccuggguucaagcaauucugccucagccccccggguagcugcgauuacaggcaugugccaccacgcccggcuaauuuuguauuuuuaguagagaugggguuuuucuauguuagucaggcuggucucaaacucccaaccucaggugauccgccugccuaggccuccuaaggugcugggauuacaggcgugagccaccacaccuggccagguaauuucaucuagaaauauuuuaguaacuaccacacuauuauaacaccugaggaaaaugaacaguaauuccuuaauguucuuaaauguacagucacuguucaaauuuucaguuguuucaaacauguuuuuuuuuuuuuugagacggagucucgcucugucgcccagguuggagugcaguggcgcaaucucggcucacuacaaccuccgccucccagguucaagcaauucuccugccuuagccuccugguagcugggacuacaggcacacaccaccaugccuggccaauuuuuguauuuuuauuagagaugggguuucaccaugcuggccaaguuugucuugaacuccugaccuugugauccaccugccucagccucccaaagugcugggauuacagccaugagccaccacuccuggacucaaauguguauauuuuuauaguuugcuuguuuggaucaggaugcagguaaguuccacauguuagcauuuucuugauacaccucuugagucucucuugaucuauaguuuaccuuuccuucuguuuuauuuucuuugcaauuuacuuguuaagaaacacauucguuuguccuguagacuuuaaagaguuuccugaagucuagauuuugcugaucaguauauacagcauuuucaucuccccucagaaacaccuggguguuuuugcauuugucugucuggggacuucauggguuucacugguuucaggcuaguuuuuaaugccagauucugaguuuggggucuguaaaucaucuagguaguaucaauuuggacuagguacccauguguguccuggacuggagguuucaguuuuucauaggagacugcuaaagcuagaggagauguucuagacuucuuuaggcagguaguuagacuucuuuaggcagguaguuaaucuccaggucucuuugcuuacaggauaugcugccucagcuccuuucuggucuuugauacucuagcuugaaaccauucagagguauaaacuacucuguuuuccuucuuuccuagcugcuuucaaguuuguguuuucuuaauuuuuggcaacuguggaguuucuaugcuugguuucaauuuagcuauuuauccaaaaguuauuuugugauuuuuuuuaaauauauauccagccuuucuguguccgaaaaaggguugaaagguuagcaucuuugucagugcuaugugccauauugcuagaaguguuacuagcaauuccucugcaucugaaguucuuggaguggauauuuuaucuguauucuuaaagcaguuugccuaccuucaucauauaaucugugaacauuauuuuucuguucugaaagauucuaaauuuuuugaaaucagagaacaguucuaccaaaaacuacacaaauuagccaggcauugguggcucgcaccuguagucccagcuacuccggaggcugaggcuggagaaucgcuugagcccaggaagcggaggcugcagugagcugggauuucaccacugcacuccagccuggguggcagagugagacccugucuccaaaaaaaaaaaaaagaaggaaaaaaaagaaacaacuuggcuggguguagcagggugugucuuuaguuguagcuacuugggagguugaggugggagaaucucuugagcccaggaguuggaggcugcagugagcuaugaucacgccacuguacuccagccaaggugacagugagacccugauucaaaaacaugaaaaugaaaggugcuuauagucugauuggagaggcaguagucaacugugugaaagugagguuuuucccaaaguaucaaauuuaccaaccggguuaaucucgauaauuucaguaaauaaggauguaauauaauaacaauacuaaauaauugauucccuaauuauaaacuccagaguagagacugugucuugaauuuuuuugugucuucugagguucugaguuccauccaaaguaauuaaguaccaauuuggguuauucauuuagaaaauauuuaagggggccaggcauuguggcucaugccuguaaucccagcacuuugggaggcugaggugggcagcucacgugaggucaggaguucuagaccagccuggccaacauggcaaaaucccaucucuacuaaaaguauaaaaauuagccgggcauggugguacaugccuuuaaucccagcuauuugggagacugaggcacgagaaccacuugaacccaggaggcagagguugaagugagucaagauuuugccacugcacucuagcuugggugauggaaugagacucugucucaaaaaaaaaaaaagaaaaaagaaaaauauuuaauguggcaaggauugaaaaacuacuuacuggguacuguuuugcuacuuggguauggguucacuugaagcccacaccccagcauuaugcaauauaaccguguaacaagccugcaaauguaccccugaaucuaaaauuuuugaaaagagaagaaagaaaaaauuuuuauuuuuuugagauggagucuugcucuaucgccaggcuggagugcaguggcgugauuucagcucacugcaaccucugccucccagguucaagagauucuccugccucagcuucccaaguagcugggacuacaggcacccgccaccacgcccagcuaauuuuuguauuuuuaguagaaacgggguuucaccauguuggccaggauggucucgaucucuugaccucgugaucugcccgccucggccucccaaagugcuggcauuacaggcgcgagccaccgcgcccggggggaaaauguuuuuuuuaaaaaagaaaauauugaauguauaucuuguacuaggcacugugcuagguauugggaauauaguggugacuguagucaccucauagaauguagagugugauggaauaauauauuuaacaaaugacuguuuaagugaaugcaugcaugucuuaaugcuacuguggagguaaaaaaaacagugugucaugagaaaguuuaacaggacauagaauuuagauugcugagucaggggaagagcucugugaggaagugacauaguguaguugagaggauuuggaugaguuauaaacuaaccaggcaaagaaucauguuaccagugcuucauguagagguaguagcauaugugugcaaaaguuaugagccaaaagaaagcuaagguggcaggaguguaggagacagggagaaacaauaguaaacgaugaggucagaaauauaggcaggcgucaaggccaggggcaguggcucaggccgguaaucccagcacuuugggaggccuaggugggaguaucacuugagcccaagaguuuguacaccaggcuaggcaacauagugugaccccaucucuacagaaaaaauggaaaaauuagccaggcaugguugugcaugccuguaguaccagcuacuaucuggggcugaggugggugcauugcuugagcccaggaaggagauugaggcuccagugagucaugaucaugccacugcccuccagcuugugagacagaggccagacugucucccagggagaaaaaaaaaagaaaggccaggcaugguggcucacaccuguaaucccagcacuuugggaggccgaggcagguggaucaccuaggucaggaguucgagaacagccuggccaacauggugaagccccaucucugcuaaaaauacagaaauuagcugggcaugguggcgggcgccuguaaucccagcuacucaagagacugaggcaugagaauugcuugaacccgggaggcagagguagugaucccaaguggcaccacuacacucuagccugggcaacaagagugaaacuccaucucaaaaaaaaaaaaaaaaaaaaaaaaaaaccgcaggggucagguggcuuuuaggaucucagagguaacauuaauaaagauuuuggauuaugggccaggcgcgauggcucacaccucuaaucccagcacuuugggaggccacggugggcggaucacaaggucaggagaucgaaacuauccuggcuaacaccgugaagccccgucucuacuaaaaauacaaaaaaugagcuggccaugguggcaggcgccuguagucccagcuacucuggaggcugaggcaggagaauggcgugaacgcgggaggcggagcuugcagugagccaagaucgugccacugcacuccaaccuaggcgacagagcgagacuccgucucaaaaagaaaagauuuuggauuauguucuacauugggggugccauuuaaauaaagguuuuaaacaagagaauggcaugauaugaguuacuuuuuuacaagauuauucugguuacuguguggaccguaauuuugagggagacaagagugguaauggagggacuaauucuaucaaaccuuuacaguaaucuaggugaaauauuugagauauuaauccuauaccauauauauaagcauuguauuauuucagauuuuuauauggaugcauauauaauguagauauacaauuuagaagcaaaaguggaauuuuauuacacguuucaggaacuuguucacuucauauaacauggccauuuuuccuugauaacaaccccuuuucauuucugaaguuuuggcuauuuaaagacucucugagaaaguuccaaacaugaaugagaugcacagguuucauugguaugugugagugugugcaugcaauuaugugccuucaguuuuucuuagaacauagguguuuuuugguugguugguuguuuuugagacaagagucucagugucacccaggcuggagugcagugcgcaauaucagcuuauugcaaccuccgccuccugacuuugugcaauucuuaugccucagcuucccaaguaccugggacacgcagccaugccgggcugauuuuuauauuuuugguauagucaggguuucgccauguuggccaggcugaucuugaauuuuaugugaugugaugcuuaggaaagcaauguuagcagguagcuuuuaauacugcuaugauauaauuuuuuaccauuuaaaacuuugauaaaucuggaauuccuuuuuguuacauuuuaucagguaggcaucuuuguuuacccauuuuuaugcacucuuuauuaaguaauuuuuuucuuuccucagugaucuuaaaaugcuucuuuugucauacguugauauuuauauacacuaaggucuguuuuugaacuuugcauuuuguucuguugguugaucuaucuucauaacuguauaauacuguuuuaauuguauuuuauuaucuguuuuuauaucuggugggugauaauuugccuacuucuagaaauaagcuuguuuucccuuuuguuuaagguaggaacagcugaaagugguugauauagcccuuuaauagcuucauuaugcuacggguacauaauauaaacuaaaauaaguuuuaaaaaucuuauaugagaaucauuacuggaacaaaaaguaucaguuuccucucuucuaagcucuguuucauaagauguuugaaucuaugaggggauuaaccuuuaaaucuuccaucauuucuauaaaaauauuuuaaauuguccauuuaauacuuuuaaaaauuuccuuuuauauuaucuucaagaggcaauauaggguaaguuguuaagaacauggauguagggacagacugccuggguaagauuccugcuuugcccauccuaauuauaugauuuugagaagguuauuuaacuguauaugacucaguuuccucaucuguaaaaggauaaaaugaauaauuuaugaaaagcacugacaacagugccugacacauaaaagauuagaaguuauuuuuuuucuggauugguauccaaaaaccccuuuaauucauaaaaugucuuaauuucaggccgggcacgguggcagacaccuauaaucccagcacauugggaggcuaaggcaggcggaucaccugaggucaggaguucaagaccagccuggccaacauggugaaaccccaucucuacuaaaaauacaaaaauuagcugggcgugguggcgggcgccuguaaucccagcuacuccagaggcugaagcaagggaaucacuugaaccugagagguggagguugcagugagucagucacgccacuguacuccagccugggcaacaagagcaaaacucugucucaaaaaaaaaaaaauuacuuugcauuuuuuagauaaacuugguaaggaugaguugaaacaaauuacccuuucccgucaauuuaaaugugagcgcauuuuaacuagagaaacucaugccuguaaucccagcacuuuggaaggcugaggcgggcggaucaugaggucaagaaaucgagaccauccuggcuaacauguugaaaccuugucgccacuaaaaauacaaaaauuaccugggcgugguaucccgcgccgguaguccaggcuauucgggaggcugaggcaggagaaucgcuugaacccaggagguggagguugcagugagcugagaucaugccacugcacuccaaccuggugacagagugagagacucugucccaaaaaaaaaaaaaaaagaaaauuuaaacagccaaauaucaaauauagacucucauuuaguaggauacaccaguuucagucauuaaaggaaugcagugaauuguaagauaacauaaaauuuuguuuuuaggcaaaguaguuguauaacuuguuuuuguuuauucuuuuuuuguuuuuuuugagacagaguuuugcuccaucacccaggcuggagugcaguggcgcgaucuuggcuccuugcaaccugucuuacgaguucaagcgauucucucccagccucccgaguagcugggauuacaggugccugccaccauggccuguuuaauuuuuauauuuuuaguagagacaggauuucuccauguuggccagucuggucuugaacuguugaccucagcugauccacccccccuuggccucccaaagugcugggauuacaggcgugagccaccaugcccagccuguuuauucuuuuuuuaaaaagaaauucuaagccuuaaguuugauaaugaaaagucagucauuuugguaagaagcuaagauuguugucuuaguguuuuuggaguguauguuuguauuuauuuugguaacuguugugucgcaaaucagaaauuuaucaccuuguuaagcccauguuauaagaauguggucguaaguucucagcuuuacuuucccugaguuauucuguuuugguugucaaguaaauaagacagcaguuaauaguagugaauuuuacagcaugcauucccagaagcucuuacuuuucuauagcagaaaacagaguccucuauaaggauagcaaauauaggcugaacgcaguggcucacgccuguaaccccagcacucagagagucugaggcaggaagaucacuugagcccaggaguuugagacugcagugcugcauugagcuauaauugugccacuauacugcagccuggaugacagaguaagaccauuaaaaaauaaauaaauaaauaaauaaaaauaacaaaucuuucuugcugaagguuuuaauguuaacauaaaugucuaacuauuacaugaagauaacauuucugccuuuccuucgugagcaugugguggucccuguccccucuccccuccaggaguuacagauuuuuugaagcagucauuauggauuuggauuaauauauuuaccuaauucgaccugaccuccauugugacuagugauuuaugcccaggagugugcugagguuuuauuauguuuuccaugcaccaaguaaacuggcccauuuggagagugaccuuguuuucuuuaugaaacccauguucucaucaacugagcuguuaaaugccuguaauauaaagucaaauaaauccugcuuucuaaggcacuguauuauuuauauagcauguguaaauuuagaagcauuuggucuugaggucaggaguucaagaccagccuggccaacauggugaaaccccgucucuacuaaaaauacaaaaaaaaaauuaggcauggugaugcaugccuguaauccuagcuacuagggaugcugaggugggaggauugcuugaacccgggaggcagagguugcagugagccgagauugcaccacuacacacucuuggguauuguauugccugggcaacagagcaagacugucucaaaaagcauuuggugacauugaggcgggguugcagggagggacaauaguauuugucuuucuguuuauuuauuuauaauuuuuuugagacagggucucacucucacccaggcuguguauucuagagacagggugucacuauguugcccaggcuggucuccaacuccugggcucaagcaguccccuugccucaaccucccaaauagcugagacuacaggugcaugccaccacaccuagcgaauuuauuuauauuuuauaaauagggucuugcuauguugcccaggccugucucaaacucuggccucaagcaauacucccuccuuugccuccuuaguagcuggaaugacaggaucaaaccacagcgcccagccuuaaaauguuauuuuaaauuguaguucuaaaaagucagaauguauaaacgauuauggcauaauuagaaauccugccauccuguauuacuauugacaugcucuacuauugguguguuuuugacguguuauaaccaggacugaacugagauuuuugagguggccauauugaccagcucuguuuucuggacauuaucuuugcuauuauuuugauaauuuuacaccgacucuccaguuuuguuuaaguaaaaaaguuaacaguuuaacaugauuuuuaucuguauuuaaugaauacauaauuauacagcacuuuguaguacuugccauguuccagguacuguucuaggugguuuacaaauaccaauuuguaacgauuauaugcaacuauuaaaauauuuuuauaugaauuguagaaauuuguuaguguuacauuucucuuaacauaagcaucuuuccugaaauuaaucaaauuacauuuaucaaauaugauuaaaguaaaaagaagaauuaaauugcaaaauuuuuaaaucauuuguuuuuuauuucagcuuuaccaacagggacgcuuaugucaacugggcagugaauuuugugaauuggaaguuuuugcuaaaguacugagagcuuuggauaaaagguaaauucuuuuuuaaaaaauuguaaaauauacauaacauaaaauuuaccauuuuaaccgaauugaguggcauuaaguauauucacauugugggcugggugcuguggcuuacgccuguaaucccagcacuuugggaggcugaggugggcagaucacgaggucagaucgagaccuuccuggcuaacgugaugaaacccugucucuacuaaaaauacaaaaaauuagcugggcguggugguaggcgccuuagucccagcuacuugggaggcugaggcaggaaaauggcgugaaccugggaggcggagcuugcagugagccaagaucgcgccacugcacuccagccugggugacagagcaagacuccgucucaaaaaaaaaaaaaaaaaguauauucacauugugcaaccaucaacaccauucauuuccagaacuuuuuaaucacccugaacaaaaacuccuuacccacuaaauaguaacuccccauucucucuuucccuuauccuguguagccaccauuguacuuuagaugaguuugacuucucugauuucccauauaaguggaauccuuauaauguuuauccuuuuguguguauuguauuucauuuagcauaauguuuuuaagguuuaucuauguuguaguacaagucagaauuucauuucuuuuuauggcuagauuauauuccauugugugcauauaccacauuuuguuuaucuauucaucugucaauggauauuuggguucuuucuaccuuuuggcuagugugaauaauacugcugugaacaugagcguagaaauaucucuucaagccccugccuucaguuauuuugguuauauacucagaaguugaauugcuggauuauaugguaauucuacuuuuguuuauuuuuuaagagacuuaguuugacuauguuguacaggcugcccucgaacuccugggcucaagggauccucguuuuucagccucucugcuagcugggacuaaaggcgcuaugccacugcacccaacucuuauuuccaguuuuuuugaggaacugucauacuguuuuccauauuuuuuuuuuuuuugagacacagucuuguucuguugccaggauggaguucaguggcauguucguagcucacugcaaacucaaacucuccuuggcucaaagccauccucccaccucagccuccugaguagcugggacuauaggcgcaugcuaucacacccagcuaauuuuuuuauuuuuaguagagaugaggucucgcuguguugcccaggcuggucucgaacuccugggcucaagugauccucuugucucagucuuccaaagugcugggacauaaauuucauuuuuagguuacuuguuuuuuaaaauuccauuacaccucuuuuuaaugcaugaaguuacguuuauuuuugacuaauuucuuaugugguuuagaaauuauuucauaaauaugauuauaucagaaaauuuagaguggauaaaauaauuuugccucauaaguauaguaccaauauaaaucuauaaaguuguuucauugagaaauugucucaauuaguuuuuccauauaccugguauuauuucacuaugaauuauguuuauuugcaguuguuaccagaaccccugucuugucuuuuuccagucacuacuuccccuccccuaggguaaccacuagauucauuuuauguauuuuagaacauauuaaauacaauuauacaguuugugcccuuuugugucuggcuuuuuuuucccccaguauuguuuuaugagaaucaccuauguuaugugcaauuacaguguguucauucuuguugcuguauauauauaugguguuuuauuaugugaauacaguauuauucauucuauuauugauggacauuugggcuguuuccacuuuuuagcuauuauaacucuugcugcccugaacauucuuguaaauguuuuuuggugaacauauguaugcauaucuauuagauacauaccuagaaguagaauuugaaagcaauuuaagacaacucaagaagucuuugccagcaucauagagaauauaguaaaaauauuguggcaguaauuguacaacccaaacagaagcuuggugacaaagagaagauaauuuguucugccuccuucuauccccuuuggaaaguuaacacuuuggaaguuuagcuuuuugaguucaagaaagggagauugaauucaucuucccguuuuaaguaucaucauguaguaguaguagcuacagaucuggcuuuucauuguacuugcuguucuuuuuuuuuuuuggagccagggucucacuuccaucacccagccuggagugcaguggcaagaucauggcucacuguagccucgacuuccagggcucaggugauacucccaaguagcugggaauacaggcaugccccaccacgccuggguaauuuuuuguauuuuuaguagagaugggguuucgccauguugcccaugcuggucucaaacuccuaagcucaagccauccaccugccuuggccucccaaagugcugggguuacaggugugagccaccgugccuggucugcuugcuguucucuuuaguguucuucccuaaguuuaacugccauuuuauuuccuaacccacauuucuaggaaaauaagaauauaguuucacaaaauacugcugaucucuaauaagaaucuuaccaaguuguuagcauuuauucaacaaauuaaauaaauacuugcugagugccuaauauguuccagguacuguuuuauuuuaaguuuuuggggguacauaguacauacauauuaggugcauauauuuauggguuacauaagauacuuugauacaagcaugcaauguguaauaaucacaucaagauaaaugagguguucaucaccucaagcauuuauucuuuguguuacagacaauccaguuauauucuuucaguuauuaaaauguagaacuaaauuauuuuuuacuauaauccuguuguguuagcaaauacuagauuuuauucauucuuucuauuuuauuguacccauuaaccaucuucauuugccccccucucccaguuacccuucccagccucugguaaccauccuucuccucucuauauccaugaaugcaauuauuuuaauuuuuagcucccacaaauaagugacuacaugcaaaguuguucuuuccuuggcuggcuucuuuuacuuaccauacaguuccauccguguuguugcagaugacaggaucucauucuuuuuuauggccaaauaguacaccauuguguauauauagcacauuuuccagauacuguuuuagaugcuggggccauagcagugaguaggauccacaaggucccuuccucauggaguuuguauuuuagagagagaugauaagauaauaaacaaguaagucggcugggcgugguggcucacaccuguaaucccagcacuuugggaggccaagguggguggaucaccugaggucaggaguugaagaccagccuggccaacaugcugaaaucuugucucuacuaaaaauacaaaaauuagcugggcgugguagcucaugccuguaaucccagcuacucgggaggcugaggcaggagaaucacuugaacccgggaggcggagguugcagugagccaacaucacaccgcugcacuccagccugggugacagagugagacucugucucaaaaaaaauaaaauaaguaaguaaacagcaugauuucaguguucaaggguaacuuugaaauguggccugugugcuaagauuauagagaaacuucuugauuaguugauuaaaguuaggcuguaaaaaaaaaucuaauaaauaagaacuucucauuuugguaaaagaagacuagaaaaacuuuuaaaaacauuccuuacucuaaagaaaggauagcuuuuggggauuugaaucucuguagguaguuuuaaacguggcuguuguaaagauucaguggaauaccucuuuuucaucucuuagguuaucuuucaccaaguccaaauccuuugguaaguguuuuauguauuugugaaacuaaaagcauguaauuugaccuuuuuuuccuuuacccaaagcagugacucuuacaauuuuguuuaaaagguuuuuuuucuauugaaaugugauucacacacuauaaaauucaccaauuuaaauucuaccauucaacuauucacaagauuuuguaaccaucaccacugucuaauucuagaaaauuuggucaccacaaaaagaaaucauuaacagucaacuccauuuccucuuggcugaccauuuccucaguuaacaguaacuuuuuccucaguuucuagcugaccauuaaucuacuuucugucucucuggauuugccuagucuagauauuuuauauaaguugauucuuauauggucuuuugugacugacacuuagcauaauguuuuuaagguucauucauguuguugcuugcaucaguacuacuuuccuuuuuuauggcugaauaauuuuccaucguaaggauaauacugcauuuugcuuauccagucaucuguucaugaacauuugaguuguuuccaccuuuuggcuauuaugaauaaugcugcugugaaugugguuggacaauauuuuguguguauauagucucaauucucuugaguauauaccuaggguguauaauaugguaacccuaugauuaacuuuuugaggaaccacuacacuuuuucacagcagccauaucauuuuauaaucccaccgccaauguaugaggguucccguuuuuucaccucaugacaacacuucaaaaaaaauuauagcagggugcagugacaggcauccauagucccagcuacuguggaggcugaagcaggaggaucuuaauugagaccaguucaaggcuacagugagcuaugaucaugccacuucucuccagccuggaugacagagcaggaccuugucucuaaaacauaaauaaauaaauaaauaaauaaauaaauaaauaaauaaauaauaaauaaauaaaauauuuuuaaaaauucuauuggguguaaagggguaucucaugauuuugguuugcauuucccuaaucauuaaugauguugagccucuuauuucguguuuauuggcauuuauauaucuuuuguggagaaauaucuguucauaucagccaggcgugguggcucacaccuguaaucccagcacuuugggaggccgagguggguagaucacaaggucaagagauugagagcaucccggcuaacauggugagacccugucucuacuaaaaauacaaaaaagauuaguugggcauggugacacguaccuguaguuccagcuacuugggaggcugaggcgggagaaucgcuugaaccagggagguggagauugcaaugagccgagaccacgccacugcacuccagccuggauaacagagugagacuccaucucaaaaaaaaaaaaaaaaaacaaaacaaaacaaaaaaaacucuucuaucuucauugccuuuuaaaaacuggguuauguaccuuuuuauugugaauuauaauuugguuuuuaaaagccaauuuuaaaaguuagcuucauccuuccuugucaucaaguuacacauuguguacuuuuccugaauguuguaggaucacucaguuauccacugagugaagagauuaggcuaaauuuugaauuauggccuuguaauugauaaggcaaaaugcuuuuuaucuuauuccguccuggaaaauaauggugcuauuauuuaaaagagaagcaguuagcacuuucuaaaaggagaaaaauaaauuaacucuauaaaauaaucuuuuucuuuucuuacagacauuugcuucaucauuguuuucaggcuuugauggaucaugguguuaaaguugcuucagucuuggccuacucauucaguaggcggugcucuuauauagcagaaucagaugcugcaguaaaggaaaaagccauucagguuggcuuuguuuuagguaaguaaugguggaacagaaguauuuuguccugugauggacucagaauuaaaucugcuaacaaagaauucuuccagggcuuucccaaagucuacguaagaagguuaugagaagaacaucagaaccacuuaaccccaugccaaagcauuauacuauacauuuaaauaguaucuuucuaaauccucaugacauuccaacgaagugaugguauuaauagcauuuuacaaaugaggaaacagacucagaaaaguugaguaacuggcucaagucacauagcuaguaguagagcuaaguuuagauuccugugucuaugugauuccauaauauguguuuuucuaccaugucaugcugccaccagccucuuugaccugcuuacuguaggcuguggcagagaacuucauccuuucggagccucaguuuucccaucucuaaaaugaggguuauucuguauuuccucauguggauguuaugaggauagugaaaagaaauguaaaagcaacauagugagaccuuaaaaauaugugauagagcugggcauggugacucaugccuguaguuccuagcacuuuggguuacugagguggguggaucacugucaguaguucgagaccagccuggccagcauggcgaaauccugucucuaguaaaaauacaaaaaauuagccgaguguggugacgcaugccaguaaucccagcuacuugggaggaugaggcaugagaauugcuugaacuugggagguggagguugcauugagccuagauugugccacugcacuccagccuggguaacagggagacucugucucagaaaaaaaaaaaaagaaaaaaaaaaggcugggcauggcgguucucaccuguaauucuagcacuuuagaaggcugagguggcaggaucacuugagcccaggaguucgagaccagccugggcaacauagcaaaaccuccucucuaaaacaaaaaaauuaaaaauaaaugauaaauauaaaaguaguuagaaaaauguuuugugugcuauacauguagaaaaauauuguuuaauguauguauacaauuuuauaugguuuucacaaaucuguuuagauguguguuucaggcaauuucuuauuaaaguuuuugcuaccuuuuuuguuuauuuuguuuuauuauuuuauuuugagacaggguuucacugugucacccaggcuagagugcaguggcacaauuguauuaaucuguuuucaugcugccauuaaagacauacccgagacuggguaauuuauaaagcaaaaagagguuuaauggacuuauaguuccacaugacuggggaggcuucacaaucauggcggaagguggaaggcaugucuuauaugguggcagacgagaaugagagccaagagauaggggaaaccccuuauaaaaccaucagcucucaugagacuuauucacuagcaugaaaacaguguuggggaaccggcccuaugauucaguuaucuuucaccaggucccucccacaacacgugggaauuaugggaacuauaauucaaaaugagauuuggguggggacacagccaaaucauaucauuccacccuggccccucgcaaaucucauguccucacauuucaacaccaaucaugccuucgcaacaguccuccaaagucuuaacucauuucagcauuaacucaaaaaguccacaguccaaagucucaucugagacaaggcaagucucuucugccugugagccuguaaaaucaaaagcaaguuaguuauuuccuagauacaguggggguacaugcauuggauaaauacaaccauuccaaauggaagaaauuggccaaaaugaaggagcuaaaggccccaugcaagucuggaauccaguggaguagucaaaucauaaagcuccaaaaugaucuuuucugacuccaugucucacauccaggucaugcuguugcaagagguggguucccauggucuugggcagcuccgccccuguggcuuugaaggguacagccucccucccagcugcuuucacggacuggcgucgagugucugugguuuuuucaggcacacggugcaagcuuucaguggaucugccauucuguggucuggagcacaguggcccucuucucauagcuccacuaggcagugccccaguggggacucuguguaagggcuucaacccaauauuucccuuccacacugcccuagcagagguuuuucaugaggaccucacccugcagcaaacuucugccuggacaugcaggcguucccauacauucugaagucuaggcagagguucccaaaccucaauucuugacuucugggcacccacaggcucaacaccaugugggagcugcuaaggcuugggacuugcccccuuggaagcuauggucuaagcuguacguuggucccuuuuagcuaugaguagagcagcugggacacagggguccaagucccuagucugcacacagcaggggggcccugggcucaacucacaaaaccauuuuuuccuccuaggccucugggccugugauaggaggggcugccacaaaguucucugaaauguccuggagacauuuucuccauugucuuggagauuagcauuuggcugcucguuacucaugcaaauuucugcugccagcuugcaguucuucucacaaaaugaguuuuucuuuucuaucgcauccugaggcugcaaauuuuccaaacuuuuaugcucuguuuuccuuuuaaaacugaaugcugacugggugcaguagcucacaccucuagucccagcacuuugggaggccaagguggguggauuguuuugauaucaggaguuugagaccagccuggccaacauggugaaaccguaucucuacuaaaaauacaaaaacuagccgggccuguuggcgggugccuguaaucucagcuacucgggaggcugaggcaggagaaucacuugaaccuggaaggcagagguugcagugaguugaaaucgccucacuguacugcugagaucaccccacugcacuccagccugggugacaaagcaaaacuucaucucaaaaaaauaaaaauaaaaaaauaaaaauaaaugagacaaugcuuuuaacagcacuccagucaccucuuaaaugcuuuguugcuuggaaauuucuucugccagauacccuaaaucaucucccucaaguuaaagguuccacacaucucugaggcagggacaaaaugucaccagucuuuuggcuaaaauauagcaagagucaccuuuacuccaguuuccaacaaguuccucaucuccaucugagaccaccucagccuggauuucacuguccauaucauuaucagcauuuugaucaaagcuauucaacaagucucuaggaaguuccaaacuuuuccuacauuuuucugucuucuucugagcccuccaaacuguuccaaacuuugccuguuacccaguuccaaaguugcuuccacauuuucagguaucuuuauagcagcuccccacucugcuggcaccaguuuacuuuauuaguucauuuucaugcugcuguuaaagacauaccugagacuggauaauuuauaaaggaaaaugagguuuaauggacucauaguuccacguggcuggggaggccucacaaucaugguggaagguaaaaggcacaucuuacaugguggcaggcaaaacagaaugagccaaaugaaaggggaaaccccuuauaaaaccaucagaucucgugagacuuacuaccacaagaacaguauuggggagacugcccccaugauucaguuaucucccaccaggucccucccauaaugugggaauuaugggagcuacaauucaagaugagauuuguguggggacacagagccaaaccauaucaacaaucauagcucacuguaacuucaaacuugggcucaagcagucuuccugcuucagcuucccgaguagcuaggacaacaggcaugugucaacauacacagcuaauuuuuauuuuuguugagacaaggucuugcuauguugcccaggcuggucuugaacuccugggcucaagcauucuucccaaacuacuggaauuacaggcaugagccacugcacuuggcucuuuuuucucuauuaaacaaacuuuuuuugaagugacuguagauucauaggaaguugcaaaagaguacccagaguucuuugaaccauuccuccagcuucccccaguggucacauauuauauaacuguagggcaauaucaaaaccaagaaauugacacugguguuauaccauuaacuagacuacuggccuuacuuaguuuucaccaguuuuuacgugcacucauuuguuuguaugugugucugugcgguggauuccauguagagucguacaaccaccaucacuaucaagauacaguacuauuugaucaccacaaacuauuuuuguuuggggguuuuuguuuuguuuuguuuuguuuuguuuuguuuucugagauggagucucacucuaucacccaggcuggagugcaguggcaugauuuuugcucacugcaacuuccgccucuuguguucaagcuauucuccuuccucagccucccaaguagccgagauuacaggcgugugccaccacacccaacuaauuuuuguauuuuuaguagagacgggguucaccauguuggccagacuggucucaaacuccugacgucaagugguccacccaccucugccaccaaaagugcugggauuauaggcgugagccacugcacccagcccuacuuuuguuuuuaacuucucucauuacugugugcaugugccauguauguguuuucugucuuaaaguguacacacgugcguauacauccuucccaacaacuuuuaacagucauuuuuaaucuuuuuuuuuuuuuuuuuuuuugagacauggucccacucugucgcccagacuggagugcaguggcacgaucucagcucacugcagccuccgccuccuggguugaagugauucugcugccucagccucacagguagcugggacuacaggcaugcgccaccacacucaucuaauuuuuguguuuuuaguagagaugguguuuuaucauguuggccaggcuggucucaaauugcuaaccucaggugaucuguccaccucagccucccaaagugcugggauuacaggccugaggcaccgugccuggccuguuuaaucuuagaauaauucuuuguaguagccaaagacagguugccgaagggacuucagagcauauuuuuuugaaaaggacccucauuauuucuuuuuuuuuauuugagacagagucuuguacugucgcccaggcuggagugcaauagugugaucucagcucacugcaaccuccuccucccggguucaagccauucuccugccucagccucccgaguagcugggauuauaggcaccugccaccauacccagcuaauuuuuuguauuuuuaguagugaugagguuucacuauguugggcaggcuggucucaaacucaugacuucgugauccacccagcucagucucccaaagugcugggauuacaggcaugagccaccgugccuggccagcauuuauuuuuuaaauagucuuauggaaaugucaguagcgacaaagaauuguccaaagaaagucucucaaaacuugugaucuugacuaauguuaaggaugauaucccuuuaguucuauaugaucauguaaaaaugugugugugagagaaauuuaguaugaaagaagaugaaaggaagacuaguguucauugagguccucuaucaucuccacaucuacuuaugccaaucuggccauuauaaugacccaacuagauaccuuggagagagaaccaaguccuggcaaacucacaguuaucagucuuaauccuaaaauuacccaagaggaaaaagucauaccagaagaguuuugcagacaucaccacaaaaaguuuuagaacauuauuuccuccccaaaaagaaaacaguacccauuagcagucacucccauuucucuccaacaccaggcaaacaucaucuacuuucugucucuauagauuugccuguucuggacauuuuauauaaguguacucuugaaauacauggucuuugugacuggcuuguuuuauuuaccauaauacuuucaaaauccauccauguuauagagacagaauuuaauauaaauaauauuuuuugaccucuggggucagggcauagcugaacaaaaggcagcagaaacuucugcagacuuaaacaucccugucugacagcucugaagagagcagugauucucccagcacggaguuugagcucugagaacagacagacugccuccucaagugggucccugacccccguguagccuaacugugagacaccucccaguaggggcugacugacaccucauacagccaggugccccucugagacgaagcuuccagaggaaggaucaggcagcaauauuugcuguucugcaauauuugcuguucugcagcuuucgcuggugauaccccagcaaguaaggucuggaguggaccuccugcaaacucccaacagacugcagcugagggaccugacuguuacaaggaaaacuaacaaacagaaaggaauagcaucgacauaaacuaaaaggacauccacaccaaaaccccaccuguaggucaccaucaucaaagaccaaaggcagauaaaaccacaaagauggggagaaaccagagcagaaaagcugaaaauucuaaaaaccagagugccuuuucuccuccaagggauugcagcuccucgccagcaauggaacaaagccagauggagaaugacuuugacaaguugacagaaguaggcuucagaagguugguaauaacagacuucuccaagcuaaaggaggauguucgaacccaucgcaaggaagcuaaaaaccuugaaaaaagauuagacaaauggcuaacuagaauaaacaguguagagaagaccuuaaaugaccugauggagcugaaaaccauggcgcgagaacuacaugacacaugcacaugcuucaguagccgauucgaucuaguggaagaaaggguaucagugauugaagaucaaauuaaugaaaugaagugagaagagaaguuuagagaaaagagaguaaaaagaaacaaacaaagccuccaagaaauacaggacuaugugaaaauaccaaaucuacguuugauugguguacccgaaagugacggggagaauggaaccaagcuggaagacacuucaggauauuauccaggagaacuuccccaaccuagcaaggcaggccaacauucaaauucaggaaauacagagaacaccacaaagauaauuccuugagaagagcaaccccaagacacacaauugucagauuccccaagauaaaaaugaaggaaaaaauguuaagagcagccagaaagaaaggucagguuacccacaaagggaaccccaucagccuaaccguggaucucucagcagaaacucuacaagccagaagagagugggggccaauauucaacauucuuaaagaaaagaauuuucaacccagaauuucauauccagccaaacuaagcuucauaagugaaggagaaauaaaauccuuuacagauaagcaaaugcugagagauuuugucaccaccaggccugccuuacaagagcuucugaaggaagcacuaaagauggaaaggaacaaccgguaccagccacugcaaaaacaugcaaaauuguaaagaccaucgaugcucggaagaaacugcaucaacuaauggccaaaauaaccggcuaacaucauagugacaggaucaaauucacacauaacaauacuaaccuuaaauauaaaugggcuaaaugccccaauuaaaagacacagacuggcaaacuggauaaagacgcaaaacccaucagugugcuguauuuaggagacccaucucacaugcagagacacacguaggcucaaaauaaagggauggagaaagaucuaccaagcaaguggaaagcaaaaaaaagcagggguugcaauccuagucucugauaaaacagacuuuaaaccaacaaagaucaaaagagacgaggccaucacauaaugguaaagggaucaauucgacaagaagagcuaacuauccuaaauauauaugcacccaauacaggagcacucagauucauaaggcaaguccuuagagaccuacaaagagacuuagacucccacauaauaauaaugggagacuuuaacaccccacugucaauauuagacagaucaaugagacagaagguuaacaaggauauccaggauuugaacucaguucugcaccaagcagaccuaauagacaucuacagaacucuccaccccaaaucaacagaauauauucuucucagcaccacaucguacuuauuccaaaauugaccacauaguugaaaguaaagcacuccuuggcaaauguaaaagaacagaaaucacaacaaacugucucucagaccucagugcagucaaauuagaacucaggauuaagaaagucgcucaaaaccacacaacuacguggaaacugaacagccugcuccugaaugacuacuggguaaauaacgaaaugaaggcagaaauaaagaugucuuugaaaccaauaagaacaaagacacaacgaaccagaaucucugggacacauuuaaagcuguguguagagguaaauuuauagcacuaauagcccacaagagaaagcaggaaagaucuacaauucacacccuaccaucacaauuaaaagagcuagagaagcaagagcaaacaaguucgaaagcuagcagaaggcaagaaauaacuaagaucagagcagaacugaaggagauagagacacaaaaaacccuucaaaaaaaucagugaauccaggagcuggguuuuugaaaagaucaacaaaauugauagaccacuagcaagacuaauaaagaagaaaagaagaaucaaauagaugcaauaaaaaaugauaaaggggauaucaccacugauccuacagaaauacagacuaccaucagagaauacuauaaauaccucuaagcaaauaaacuagaaaaucuaaaagaaauggauaaaugcccggacacauacacccucccaagacuaaaccagaaagaaguugaaucucugaauagaccaauaacaggcuccggaauugaggcaauaauuaauagccuaccaaccaaaagaagucuaggaccagacugauucacagccaaauucuaccagagcuacaaagaggagcugguaccauuccuucugaaacuuuuccaaucaauagagagggaacucucccuaacucauuuuaugaggccagcaucauccugauaccaaagccuggcagagacacaacaaaaaaagagaauuuuagaccaauaucccugaugaacaucgaugcgaaaauccucaauaaaauaccggcaaacugaauccagcagcacaucaaaaagcuuauccaccaagaucaaguuggcuucaucccugggaugcaaggcugguucaacauaugcaaaucaauaaacguaauccauaacauaaacagaaccaaagacaaaaaccacaugauuaucucaauagaggcaggaaaggccuuugacaaaauucaacucucaauaaauuagguauuuauggaauguaacucaaaauaauagccguuuaagacagacccacagccaguaucauacugaaugggcaaaaacuggaagcauucccuuugaaaacuggcacaagacaguuuucugucuuucucucaucacuccuauucaacauaguguuggaaguucuggccagggcggucaggcaagggaaagaaauaaaggguauucagauaggaagagaggaagucaaauugucccuguuugcagaugacaugauuguauauuuaggaaaccccaucaucucagcccaaaaucuccuuaagcugauaagcaacuuccuuaaagucucaggauacaaaaucaaagugcaaaaaucacaagcauucuuaugcaccaauaacacauaaacagccaaauuaugagugaacucccauucacaguugcuucagagagaauaaaauaccuaggaauccaaccuacaagggaugugaaggaccucuucaaggagaacuacaaacuacugcucaacaaaauaaaagaggacacaaacaaauggaagaacauuccaugcucaugaauaggaagaaucaguaucaugaaaauggcuguacugugcaagguaauuuauagauucaaugccaucuccaucaagcuaccaaugacuuucuucacaggauuggaaaaaacuacucuaaaguucauauggaaccaaaaaagagcccgcauugccaagccaauccuaagccaaaagaacaaagcuggaggcaucacacuaccugacuucaaacuauacuacaaggcugcaguaaccaaaacagcgugguacugguaccaaaacagauauagaccaguggaacagaacacagcccucauaaauaauaccacacaucuacaaccaucugaucuuugacaaaccugacaaaaacaagaaaugaggaaaggauucccuauuuaauaaauggugcugggaaaacuggcuagccguagguagaaagcugaaacuggaucccuuccuuacacguuauacaaaaauuaauucaagauggauuaaagacuuaaauguuagaccuaaaaccauaaaaaccguagaagaaaaccugggcaauaccauucaggacauaggcacgggcaaggacuucaugucuaaaacacgaaaagcaauggcaacaaaagccaaaauugacaaaugggaucuaauuaaacuaaagagcuucugcacagcaaaagaaacuaccaucggcuaggugcgguggcucacgccuguaauccuagcacuuugggaggccgaggcgagcggaucacgaggucgggagaucgagaccauccuggcuaacauggugaaaccccgucucuacuaaaaauacaaaaaaauagccaggugugguggugggcgccuauagucccagcuauuugggaggcucaggcaggagaauggcgugaacccaggaggcagagcuugcagugagccgagauugcgcuacugcacuccagccugggcgacagagcaagucuccaucucaaaaaaaaagaaacugucaucagagugaacaggcgaccuacagaauggagaaaauuuuugcaaucuaccuaucugacaaugggcugauacccagaaucuacaaagaacuuaagcgaauuuacaagaaaaaaucaaacaaccccaucaaaaagugggcaaaggacaugagcagacacuucucaaaagaagacauuuaugcagccaacagacacaugaaaaaauacucaucaucacuggucaucagagaaaugcaaaucaaaaccacagugagauaccaucucacaccaguuagaauggugaucauuaaaaaaucaggaaacaggugcuggagaagaugcggagaaauaggaacacuuuuacacuguuggugggaguguaaacuaguucaacuauuguggaagacaguguggcgauuccucaaggaucuagaacuagaaauacuauuugacccugcaaucccauuacuggguauauacccaaaggauuauaaaucaugcuacuauaaagacauaugcacauguauguuuauuacggcacuucacaauagcaaagacauggaaccaacccaaauguccaucaaugauagacuggauuaagaaaauguggugcauauacaccauggaauacuaugcagccagaaaacaggaugaguucauguccuuuguagggacauggaugaagcuggaaaccaucauucugagcaaacuaucacaaggacagaaaaccaaauaccacauguucucacucaggugggaauugaacaaugagaacacuuggacacagggcagggaaccucacacaccagggccuguugugggguggcggucugggggagggauagcguuaggagaaauaccuaauguaaaugacgaguugaugggugcagcaaaccaacauggcacauguaaccugcacguugugcacauguacccuagaacuuaaaguauaauaauaauaaauuuuuaauccuaaaaaauaaaaaagaauugucuuuuagaaaggacugcauuacuaaguaggacuaucacccuggacauucaagcccuuuucugacaggccacaucuuuauugggaugaggcuauucaaagggaaaauuaaacauuucuuaacaggaauauguuuuuaaaaugguuuggauucauuuauuucuuguuuauaaguauuuaauuugaugcuuauagucaaggaacacauuucuuaaaauuaaguuuuuaaucgaaguaguaacccggccggacgcgguggcucacaccuguaaucccagcacuuugggaggcugaggugggcggaucuccugagguuagaaguuugagaccagccugaccaacauggagaaacccgucucuacuaaaaauacaaaauuagccgggcgugguggcacaugccuguaaucucagcuacucaggaggcugagguaggagaaucacuugaacccaggaggcggagguugcggugagccgagaucacgcuauugcacucuagccugggcaacaagagcaaacucugucucuaaaaaaagaaauaguaaccuauccugugguuacuggauugauacuucuauuaacagcaaauguccacuucauuuucaagcacaaauggucauuguaagaagcuguaacagcugccacaauugugcuguugucuucuuuuccuaacuucuuuugaaaacaaggaucucauuuguuuugaacagagaaaauaaauuugguucuggauuugacuuagcugaagcccagcucuauuguaguauuuuccuugaguuuaggugaauucuagggucaauauuacaaguuuugacuuugucaugcucuagaauaaaccuaaauuuuuagggauugucaaacuaagaaccaaauaaaauuaaguacauuguauaaauuuucuccuucucaacaagauguggaugaaguagauguuauaucugaauaguucauuucacuaggcuauaaaaucaauuaucagcauaaaaaauauuuauuuauuuaggagacagggucucacuguguuacccaggcuggucuugaacucuuggccucaagggauccuuccaccuuggccuccaaaagugcuggaauuacaggcaugagccacuguaccuggccuaauacaaaucguuuuuaaccagauacuagagaacuaaagaggcaaaaagggaacaguaggguauuauggacaaagcagcugugagaauuggcuaccauaccuauggcuuggggaaccaaggaaagagauuggaauuauuaaaaaguaggaguuggagggguuugccccaugaagcugggauacugcuaggcuguuacuggugccucagaggucugaaaagagggcccgugggucuaggaucuagaccucuaggaggagcaaccuggauggcuauugcugauguuugauggagugcugugaaacugguuuugcaagcauuggaaaacugcaacugguauugacuauuauuuaauggaaugaacuaccaccaaagaaaagaagcacacccugggguguuuuugucagcaggaaccucacuaacagauacaggaaggagaguguccauugcucuuccagucaugcagcccauuucuccagugccuccuauucgcugagccaaacggagccagcuagcaaaggagaaaugugguuugcagaguccuugcucagcauccucaaacagacucuaguaguauggguuugaagcugagagacaguauucuaauaaccagcacaauauacaauauguugggaugauaaguagaauauugcuuaguaugaauaugaauaaucucauuauucugcucaacuuggugaggaagcuagaaaguuuuaaagcacaguucucuccaauuaaaaaaaugcuuaauuacauguaguuuuaauuaaauauaaaacaugagucuaagcaaaauauaauauuuugucaacucauacauuaauacuauuaagacaccauauuuuuugugugccaagaaaaagccacuuauuguaauauaccauuacuuuuaugacguacucuaauuucagaguuuuguuguuguuguuguuugagacaaggucuggcuggcucuguugcccaggcuggagggcaguggugugaucuccgcucacugcagccucugccucccaggcucaagccauucucccaccccagccuccugaguagcugggacuacaggcacucgccaccacauccggcuuacuuuuguaucuuuuguagagacaggauuuugccauauugcccaggcuggucucagauaauuucagagauuuuuuaaugugcaaaaaaauguguuuuagaacauaccaugaugguauguuacuuuguguuuucugguuauuguaacuaauccugaauagcacuaagaaauuauuccuuaauaacuguugcaguauagggacuacagacuuagccucugaagucacauugugugcaucugaaucuuuucacuuacuggauuauaagcuuugguuuuucugugacucaaguguuuucaucuguuacguuggggcaguuauuuaagucgaagguguguugugaaaguuaaaugagugaguucguguaguuauguaguuaccacaauacgaaguguuuuacaugguguaguaacaguguauuaaauguuagucauauuuaggaggcagaauccucaaaaagauaauaugcugaggaaauacugcccaggacaguaauuucuuguuuaaaaaaauaauaagauaaucgauuaaggaucacagucuuuuuuuaucuguguauccuccguuaugugcugcuauacuaaguauauucagauuuaucuucuuugggauuguguauugggagaugcuaaaguuauauguacacuccaagaugaaaauaguaaaauaauuuaguuagcucauuagcuggaaaguaacaacucuuaggccauggaguauucuuagaagguucaaacuuuugacuccuuauucaaggucuuagccuuaacccuccuucccguaguucaaaaccuuuauauaaaaaucucacaguucauaccuguguuguaugcuaaacacaagauuuuacuaucaugguuuauuuuuaauuuagguaauauucacugucagcaugucauuuuaucuugcaggcuauuuaucaaguuuucuaaaauugguguuucuuauuuuuuuagguggcuuucuuucagaugcaggcugguacagugaugcugagaaaguuuuucuguccugccuucaguuguguacucuacacgaugagaugcuucauugguuucgugcaguagaauguugugugagguaaguuggaacauauccuguaauuacgugcuauaacaguauuuaguggcuuuuauaguuuuagcucuuauaaguauaugccaacauuugaguaaaucucugagaugauauuuauaugucauaguuucacuagucuggcauccucucaucucuaaaauauaguuaaucugcuguagacagcuuagguuagauuugaguauuaugaaccagaauguguuucuuuuuuuauuuuuauuuugaaacagagucucgcucuuucacccaggcuggagugcaguggcacagucuuggcucacugcaaccuccaccuccuggguucaagugauucuccugucucagccucccaaguagcugggauuacaggcaugcgccaauuauuuguauuuuuaguagagaugggguuuugccauguuggucaggcuggucucgaacuccugacuucaggugauccaccugccuuggccucccaaagugcugggauuacaggcaugagccaccgugccuggcccagaauguguuucuuacauaucuuuuugcuuugucauagagcuuguuuguuuauucauucaacaaauauuuauugaaugcuuguguacuaggaacugugguagacacuggaugcucggaaacuccagaaauguacuuuuucuuugguguuacuuuuguacccccugcuuuguuuacauuuccauaauugugcauaacaagauuagugcuuuacuuaugaauaacuuuucuuugaguauacauuuauuacuuuuuuacagauuuccuuaaagucaagcaaaucuagaaguaacucugcuuuauuguccuuauuuuuuucugcauguuacauuuaccuuuagcuauuuucauacagguuuucucuuugucccccaauuugauuuggcauuucuuaaaaguauuuuuuuauauaaaacuaaaggaaaauuaaaauaaagucaaaaaauuaaacagcagaaauucuuuaucguaagguaacuaaaguccaaucaauuuauugaauuuacagucuucuauuuuuauggaauuaagguucauauuuccuagguauuuuuuagaugaguuaauugaaucugaacccuuucaaaccuagaauauucuccuauaaaaccauuguauuuuuguuuuggguuuuuuuuuaaauauauuuuuuacuuuauuuuuauuagaaaugguguuuugcuguaucgcccagucuggucuccaacuccugggcucaagcaauccucugccugggccucccaaaguucugggauuacaggcaugaaccucuacacccagccagauuauuguugcuuuaagcuaaaauugaguaaaacucuauuuuuuuuuuuuuuuuuuggccaguuggauuucagucuuuugaggcugucauugaccuuuuuuauacaaggcuuaucuaugucagacagacauucaauccugaaguuaauuuuguaauaugcaaacuuaauuauaaauaauauuuuagaaggugauaauuucccacauauacuuuggaaguguaugauaaauuauaggaauauuugugugcagaaacucuaaaaggauuaguauuuagcccuauaauuuauaguacucauaaaaauaaucucucauuuuuuucccccucuucugccuauuuuauauuuuuaggaauaggagacuacauuaucccauaugggauuugggagguuaguuauauauugcuauguacauaaacugguuaauuuggaacagaaaggggauuuuguaugauuuuuaucauagauuauucacuauggcaaucuugaccaaaagauaaaacacuuucuuuuuuguaugugcuuuauuuuuuuauucacauauucagauuuauuucacccaaauaccuguguuucuucugauuuuaagguuccuguauaaauuuggcuuuagccuuaccaaaagguuuaguuuucucacaagacaagucagucuccuucucuccuuccuaguuugucaucuguagcaaguagcucacaucauuauggcugcaaguguuaauaggcaguaagaagaggggaggucaaaaagugcaugccagcugacucuuuuuuaaaucagaaaaaaauugcuuucccagaagucuaacccugucucuuggauuacuugucuuuuaaacuggaaacugggacacauucuacacaacuucuaaucuguguaauaaguauagucugaggagcaaaacauuuuuaauugugcaugaaugaacucaugggucuacauuaaggaagaaaacaugaggaauauuggguagauaacuggcugggugcaguggcucacgacuguaauccuagcacuuugggaggccaagauuugaggauugcuugagcuuaggaauuggagaccagcaagaccucauuucuauaaaaaauuuuaaaauaaauuaaaaacaauagauaauuaacaauucagaacuagcugucuuuuuagcaagcacaugugaaacuagaauauugucuggaccaaggaacaaagccauuuauaaugccagcucacugccuguauaccaagaccuuaugucuuuaugaauuugaaauuucacaauaaaauuugccucuauucaacuaaccuugccaaauucuuggccguuacagguguauuuaauauaauuuauuuauaauaaguaauuuuuuucaucuacuuaguauuauuugaaaagauuauuaaaauuuuaugacuuagccuuuuuuuaaggcagagagaaauuugggguauuaauugaccauguguuuaauugaauuagaaaagaaguguuuugcacaacagauacuaaucaaaugcuuuggccaaucccaggggcuuugagccugaugcaagaauaaaaguauauuuuucaauuuaaugucacaaagccaauuucuaauauggggcuaacaucaaaacauuauacaacaaaggucagagaaccuuccuagccuuucuuaauagaaaguaguuaaaacugguaccauuuuucaguccuuuuguauucuuuggagacucugccuauuuccauuuauucauuuucuauuuaauggcuuuguuuuucuugcuuauacaugucuggccaaacacauccagaaaauacagaaagcuaugaggaagaaaauuguugucuauaacccugcugcucagaaauaacuacaguuacugaacuggcuuguuuuugggggaugacaaacuuaaaaucacacccgcaacccccuuuucaguuuuuucuuuggagcuaaucaguccaugugagcaugguuuguuuaaggucaggaauucucuagaaccuccagauaagggaacagagauugcuuuugggcuugugagaguugggcagaacaaacuuacuuuuuauuuuaaauccuuuucuacuauuuauuauguuuuuaaaccauugacauguauuccuuugguggguuuuuuuaaauaauaaaaagaacuucuugaacuacuggacuguggggugggguuggggagcguguguguguguguguguguguguguguguguguguguguguauaaagaguugaauguggauugaaagagaacccugggcagcugaauuuccugaaauccaaagauaaauagaaauuagaagcuagaagaaaguagcaguaucuuaguuacugagagaaaauacuguaccucaccaguuugaagggcaaaagaaguaauuuucaaauacaugaagacccaguauaucuccauguaccguaucugagggaaauaaucgaggaacuucuguaaccaaauauaaguuccagcaaggcaugguaccucaugccuguaaucccagcacuuugggaggccaaggcaggaggaucguuugagccaaggaguuugagaccugccugggcaauauaaugaaacuaucauguuauguuaugucaugucauguuaugucugagucauguuuuuuguuuuuuguuuuuguuuuuuuugagauggagucucugucgcccaggcuggagugcaguggugugaucgcggcucacugcaagcuccaccucccagguuuaaaugauuuuucugccucagccucccgaguagcugggacuauaggcgcccgccaccaugcccagcuaauuuuuuuguauuuuuaguagagaugggguuucaccauguuagccuggauggugucgaucuccugaccucgugaucugccugcccuggccccccaaagugcugggauuacagacgugagccacugcaccuggccucuauuuuauuuuaaaauaaaaauuuuaaacuuuuauuuaaguucuuaaauuaauaauaacaaaucccaagguaggggaagacaguauaaaaacagugguagguaaugaauauuguaauauaugucucacauguaaauggaguaggaagagaaugaagaacaaauugagaauuuguaauaggccuuaaaugaggauucuuuucaaaccagagaugaaaaggaaauuuuggaaauaacaaaaaacaaaaauuuaccacgucaaaccuauuacagguuuaguguuccuaauccaaaaauuugaaaucugaaacaugauuggucccaaacauuucaaauaaggauacucaaccuguauuuugaacaacaaaguaguauuuaggaaagaaauguuaagcugaaauuucaguuagugcugaugucaggaagcuuuauagagaucaccuagugaaauuuucuuucuaaauaaguuaugaggcugggcgggguggcucaacaccuguaaucccagcacuuugauaggccaggguggguggaucaccuaaggucaggaguucaagaccagccuggccaacauggugaaacccugucucuacuaaaaauacaaaaaaauuaacugggcaugguggugggugccugugaucccagcuacuucgggaggcugagggaggagaaucgcuugaaccugggagguggagguugcagugagucaagauugcaccauugcacuccaaccugggcgacgagcaaaacucugucucaaaaaaaaaaaauaaaaaaaaaaugaaauuuaacagauuuagaauuauucuggaggucaugaccuuauaguuuuaagaguuggauaauuuuauuaacuggcuuuuuaaagauuacuuugaaaagugauggaguaauucaguucuggagauccuggauaucugcuugccauaggagaaauugaaaagcccagcaguccuaaugcuuugcagaugguuacugguagcuuuggauuaaauuucugaugacaucauacagagauucagaaguacugguuuucaaacaagugaaaauguuuuacucuaaaaagcugucauuccaaagaaggauuuauuuaaaagauaaaauaaaaacugucagaugacucaaauaacuauggugaugaugaagcuaaauguuuaagguacaugugaauaauuuggauaaaguuuuguaaauugugaggaggaaaagcgauuuuugaaaauuuaauuuagauuuuaaauauauugguauaaggaaagauuuaaauguuauaaauuuuuauucuuuuuguuuuuaauagaaaagggaccucaguauguugcccaggcuggucucaaacuccugggcucaagugauccuccugccuuggccucccaaaauacugggcuuacaggcaugaccaccacaccuggccuuaaauauaaauuauaaguguuuuaauguuaucacauauaucccuaaaacuugauauauaugaguuggcaaaaauauuuuuagauggaaaauggagguucaucuuacauucagguuguuuuuuaauagacauauagccuauuuuuaaaauaugcauuugggagaauggaugaguaaaaguguuacagaguucucaucuuaguggguagaguaggaaagggcaucauuauuuaguuuaaacauuaucagugcuagagaugggcauuugaugccuuguguaauagaaaagugugauagaacuuccaaacuaggguggugugaauaugggugagaaugauuugaaacuugaccaagcuagauauaagcaaagugaauagaggaacaaacugauuaugauaagugaaaaauaagaugaaaagguuagaccaaauauaauuaucaucacaauacauguaaaugggcucaauucuccuaccuaaagauggcaguuaccaagaggguuaaaaaauuaaaacuagugcuauaucauaaaaaggaaacaccccaaaacaauaauacuaacaauaaggaagaauucaggauaaaagucauuaguuaauacaaaagggauauugauaauagaauguauaauucacaaaaaugucauaaaccuauguguagcaaauaagauaggagccaccuacauaagcaguguaccuuaaaaguacaaaaacuuugauaaaaagauaaucaguacaauguuaagggccuccaggguagguuaauucugaauauauagagguuauuaaggaacuagauucuuucaaucugucugcuaauucuuuguguaccagucauuucuuuggcuagcucuccagugcuuguaagauugcugccaugguuugaggugucaggugcagauuccacguucucuagcagaagaaacacucucacacugauguccucccugacuugaaauuaaaaccauaccagacuaacaaagaaaaagacagaagacucaaauaacuaaaaccagaaaugggacuuggaacauuacuaccaaccuuccacaaaugaaaaggauuuaaggugaauccuaugaacaguugaacaccagugaauuagauaacauaaauaaaauggacaaauuuuuuagaaauggacaauuuaccuaaaugccccaagaagaaauagaaaaucuuacgagaccuauaacaaguaaauaaauuaaauccauaaucaaaaaccuuccaacaaaguccaggacugaagacuucacuagugaauucuaucaaacauuuaaagaauuagcacuaguucuucucaaacuccuccaggaaauugcagaggaaggaacacuuccuaacuuguuuuguuuuguuuuuguuuuuguuuuuguuuccauuuucauuuuauuugcuuuauuuuaugagacagagucuuacucuuuugcccaggcuggagugcaguggcaccaucuuggcucacugcaacuuccgccucccagguucaagcgauucuccugccucagccacccaaguagcugggauuacaggcucccaccaccacaccuggcuaauuuuuguauuuuuaguagagacgagguuuugccauguuggccaggcuggucucgaacuccugaccucaggugaccugcccaccuuggccucccaaaguucuaggauuacaggcaugagccacugcgcccagccccuaacucguuuuaaaagguuaacguuacccugauaccaaagaccaaaaaugacaucacaaaaaaggcaauuucagacgaguaucucuuaugaauauggaugaaaaaauccucaacaaaauacuagcaaaucaaaucuaauagaauauuaaaaggauuuuacacuaugacaaagugagauuuaucccaggaaugcaagggugguucaacguaagaacaucagugugauacaccauguuaauaggaugaagggaaaaaaaaaaaacccaguuaucucaguugacacagaaaagacauuuagcaaaaucuaacaccuuuucaugauuaaaaaaaaaaauucacaaagcuaggaauagaaaggaacuucuucaauaugauaaagaguauuuaugaaaaacucacaauaacaucauacucuauagugaaagacuagaagcuucccccauaggaucaggaacaagacauaguugccugcuuucacuagugguauucaacauuguacuggaagcuuuagcagaagaaauucgacaagaaaaauaaaaaucaucaguauuggaaaggaagaaguaaaacuauagauuuguuggacuuaaucaaaauaaaaacuuuuguaaaucaaaaacaucaagaaaauaaaaagacaaccuauggaaugggagaaaauauuugcaaaucacaugucaauuaaguuucuaguauccagaauauaucaagaacuacaacuacaaacaacagaauuuaaaaaugaggccgggcccuguggcucacaccuguaauccaagcaguuugggaguuugaggcagagagaucaucugaggucaggaguuugagaccagucuggccaacaugauaaaacucugucucuacugaaaaaaaaaauacaaaaauuagccaggcgugguggugcacaccuguaaucccagcuacucaggaggcugaggcaggagaaucgcuugaacccaggaggcagagguugcagugagcugagaucgugccacugcacuccagccugggcaacagagcaagaccccaucucaaaaaaaaaaaaaaauccagucuggccaacauggugaaacccaucucuacuaaaaauaggaaaauuagcuggguaugguggcaggcgccuguaauccaagcuacucuggaggcugaggcaggagaaucacuugaacccaggaggcagagguugcagugagccaagauugugccacugcacuccagccugggcaacaagagcgaaacucuguuaaaaauuuaauuaauuaauuaauaaagagcaggcugggcaugguggcucacaccuguaaucccagcacuuugggaggcugaggcagaaggauuucuugagcucaagaguuugagaccagccugagcaaaauagcaagaccuugucucuauuaaaauaauuuuuuuaaaaaucagccaggugugguggcacuggccugucgucucagcuacguaggaggcugaggugggaggaucacuuaagcccaggagaucauggcuguagugagcuugaucaugcaacugcacuccagccugggugacagagugagacucugucucauaaaauuaaaaauaaaaaauggacaaaggacuugaauagacauuuucccaaggaagauacacaaaagaccgguaagcacaugaaaagauaagcacaugaaaagauagugucauucagcauuagggaaauggaaaucaaacauaaugagcuaccacuuuauuccuaccaagauggguacaguuuaaaaaaaagaaaauaacuguuggcaaggaugagaagaaaucaagugauucugcugagagagcauuugaaaaaaaaaaagaaauuggaaacuuugugcacuguugcugggaauguaaaauggugcagcugcuguggaguacaguuuggcaguuugucaaaaagcuaaacauagaauuacuguaugacucagcaauuucacuccaaguauaugccuaaaagcauugaaagcaaggaaucgagagauauuugugugcuaguguuuauagcagaauuuuucacaagucaaaagauaaaaacaauccaaguauccaucagcagauaaauagauacacaaaauuuggcauuuacauauauacacauacaaugauucagccaguuuugguacaugcuacaacauggaugaaccuugaaaauuuuauccuaagugaaauaaguuagacacaaaaggacaaauauuguaugguuccacuuacaugaaauauguagaauaggcaaauucauagagacagaaaguagauuaaagguuacuagggacuguuuggggugaugaaaaaguuuuggaaguggauaguauugaugguugcaugacauaguuaauauaauuaaugccacugaauuguauacuuaaaaauagcucauauggcaaaguuuuauauauauuucaccauaguaaaaaaaaauuauuaaacccauaccggucuuuauuuucauuaugcagcucuccccuuucaagcuaucauuuauuuccaauuuuuuuuuuuuuuuuuuuugagauggagucuugcucugucgccagucuggagugcaguggugugaucucgacucacugcaaucucugccuccuggguucaagcgauucuucugccucagccucccaaguagcuggaacuacaggcacgcaccaccaugccaagcuaauuuuuuuuuguauuuuuaguagagacggggaucguguuggccaggauggucucgaucuccugacaucgugauccgccuaccucggccucccaaagugcugggauaaacuaguucuaagaaaaagacacuuacaagaaggagagaaauucuuuuccuuuagguucacuuucaguguauuuuacuuucgucaugucuggcugaugaggcucuaacuagucauguucagucuuaugguaaauauauuaguaaacuaaugacuuacacauuuguauauuuuucauuuuaaacaaugaauaguucaaucaaauaguaauuguucuugacaguagguguugaucagguagacauaauuuuauguuaugaaaguaaaauacuguguuuacaugguagugccacauuuugagaaccuccuuuuuccuuaggcagaagguugggauaaaauuagaccauaauaaguuggaccacaaguuccuuggauucaauauacugcuuagugucagcccagauggacacacagaaccuaaagagucuccauauguuuaauuugcccuuuuguuuaaauagacauucagcagggacuggagaaaauaccaagcugugccuuucuggcauacaguguuuauuuugcuacuucaucaugugccaauuacuaaauaauuuccacagauuguuauuucaggagaauacuuacagugaaggucuuuggaaaggaaauucuuagcauuguggaaaugagaaguaagcacuguucuuuuuauucucuaaauuuucaaccuauggguuucucauuuuuuucucuuucaaccauuuggcuaucaaaucuguguuucaaauacuaauccuuuuuuucucaaggacuuuuuuuucuggacuguuacaguaucuucugccuugguugcuuugcuuccccucuuggcuuugcuauagccagaguguagccagagcauucuugauagaguugcauugucccauaugguagccauuaaccauaugugauuauuaaguuuaaauuaauuaaaaguaaaaugugccucagucacacuaggcacauuucuaauacucaguagccacuguggcuaguggcuaccaaauugagcaacacaaguauagaacauuucuaacaucucaggaaauuauauuagauagugcauaagucaaaucaccucccuuacuguugcaaacaaaacuccuuuccacggcccgcaaggugcuauaaaaucuugcuuaucucucccuucucauuucucuuuacauaaucuuuuauucacuguagucuagaugaauuggccuucuuucuguuccuuugacuaugccaggauuuccccccaucccuucucaggggcuauuccuucuguuuugcuguuccuucuguuuuggaacaugcuuccccaccagaucuucacuuggcuggcuacagugucaucauuuagaugucaacuuaaauguuacuaccucaggaggauucuucccugucuacccuaaauaccuccuuucagaaucuuuugaucauauuacccuacuuuuuuaucaucuuuauggcauuuauccuuaaaugaaagucuuacguauuuuaucuuugcccacacuaauacccuucucaccacuagaacauaagcugcuuaugguaauagauuuugcagauaauuguaugguacguguugggaggauacacauuggcauuguauaguagucaucacuuuauugauuaguccugguucuuuggaaguuaaucuguuucugugacuauacagaggaaugauagagauuaaaagauugucugaauuuuucucauuaugaguuacuaaucuguuaauaauugugguauagauagaaaaaauaaauuuuuuguaucuguugauuugaugcuccugaggaauacuuccuaaccuguccauccuuguuuuucuuuuaaauagcuuuuauaccuuuguuccuucucagucugagcauuuucagaaaguuguauuggcuugauacaugaacauaauguucuagcuagcauuuaauaaauaaauaaauaaauaaauauuuguccaguccuaacacuauuugccuaucuuguacagucuauauagauacacagucuguugcuaucuagaccagucugaucuaaagcauuguacuauuuuugcauaucauuaaauagucagcauaguuguacaguuaauuuguuuaaagaacucuguauuucuacuauagaggauaaagauuuuaaaagaaauaguugacacuacugcuauuuucgguaaauuuaucuuauuggaaaaaaugaacauuaugaagcaucaugaaauaagugguaacugaucaaguguuagacuauaccaaaaauaagaaaagaagauauuuuaugucaauuuuauuuucuucauuauuuuccaaguuucuuauacugaagcuauauuacuuguggauuuggaacaaaaagauuaaaugucauuuuuuuagaugcaguacaugcugaguacauaaaauauauaaaauauuuagagaaggaaucaacaauugaugagaugaauuaugggacgcuuucaggaaagagcauguacuucuuuaugggcaugaggucaacuccaauuugggccacacacuuauuuucaaugcugccuuguaauuguauuuaauuaccuuaagucauucaggugauugguaagaggucaucaggucuaccaagcugaaaauaucaaaaauagagcaauguuauugguguuuuauagguugcuucaugugcgaaauggaaacugcaaauaucauuugggugaagaaacauuuaaauuagcucagacauauauggauaaacuaucaaaacauggccagcaagcaaauaaagcugcacucuauggagaacugugugcacuccuauuugcaaaaagucacuaugaugagguaaguguuuuaagguacauuucacugugaccaauaaguaccuauaaaaacagaggguaaaucaaauagucuucucuuauuuuucuuacagaucucuuuuacauauuagguuuauauaaggcaguacacauuuguaauggaaaauuuaaaaucagacaagccgagcacuguggcucaugccuguaaucccagaacuuuaggaggccaagguagaggaucacuugagcccaggaguuuggggccagcaugggcaacaaagugagagagacccugccucuauagaaaauuagccgcauguguagcacacgccugugguggucacaacuacaugggaggcugaggcaggaggaucccuugagcccaguaaguugaggguguagugagccauauuuauaccacuguacuccagccugagugacagagugagacccugucucaaaaaaauaaaaaaucaggcaaaaggaguguuugugaggugaauuugaaauauauacauguguaauuuagagcccuuucuuuuguuguuuuucuuuuaauuuaaccaaauauuugccuaaauuguuugguugggccucguguuguaguuuuugagacaggaucuugcuuugucacccacgcuggacucaaacuccugggcucaggugauccucuaccuuggccuccugaagugcugggauuacaggcaugagccaccaugcccagccugacaguuauuuuccuucuacauuuggauuuagggguuuauacugugccuuauucaugucuuugcagcucucagcacauucgugaggaauguugaagucuuggauaauuuugacaguucaaucuucuagugauaaauaagcuuuucacugauaucuacagaaaaguacacaaaucuuacagacaugguuugaugaauuagcaucauguuuuuguguuaggauaggcuagguuaugcagagguaauaucaaccccagaauagcuuggaacaauaaaaguuucuuucuggcucauaauauaucccugucuucagauggcuauggcuguucuuaacauuauaccuacgcuuugaucaagacacagcgugguuuugggucuaucuggaacguaucuaucuagaacauuaccagccugggcacaggggcagaaacuucauggagaaguacugccggcucuuggacuuuucuuccagaaguggcacauuucacuucucauauuuuaauuguggaaagaaaucacauggccacacuugucuuuguuuguuuguuugucuguuuguuugagacagcgucucacuccaucaccaaggucuggagugcaguggcaugaucacggcucacugcagccuccaccucagcucuaccaaguagcuggaacuacaggugcacaucaccacgcccagcuaauuuuuuugauuuuugauagagacaaagucucacuauguuauaacccaggcugguuucaaacuucugagcuuggcgauccucccaucucagccucccaaagugcugggauuacagguaugcaccacuacacccagccuaagacaauuuauuuugccuuuuuuauuucuuccacuaagcaccaggagaggaaggacauuuuugguuuuguuucccacuucauaccuagauacuagcacauuaccugccacuuaaccucucuacaccuguuuccccuaauaguacguaucuuauagggcuguuuugucagguaaauguguuaaugcacauaaaauacuuuggacaguagcugggacaaaguaaacacucaacuaaacagacaauucagacauaaaauaacaaauguuacaauaggaggauggaauguauaggaaaacacaggaaaccccacaagacagaugaguuuaagggguuggaggaagggggaauguauuuuaaggcagagggaacaguaugugcaaaggcuucugggcaagagagaacauaccucugauuuccagaagauaugucauguauccacaacgucugauucagauaagcuauagauauuaagaguaaaaauaauauaacagauuuauacuuugaagaaaguuuagccucagaaaauucuaacuguaaauauuuuguguguguucuuauuuaagugcuuguagaaaaauuuugcagucaucuuguuaaauauugucaacuugauuuaaccacaguucugucucuucuauaaauaauuuuuuuaggcauacaaauggugcaucgaggcaaugaaagaaauuacagcaggcuuaccagugaaaguugugguggaugucuuaagacaagcuucuaagguaaauauaauguuaaaauuauuaaaugaauuauaggauuuaucaggcuuuaaguuuguuuuaauuaaccuguuauuuaacauuuuaguuauuuguacacuccguaggcauaggucuguuuuauaaguuucugugcucauuuuuagaaaucugguuucuaacuaaaacuauaucacacauagauuuuuagccaauuuuucuuuaccaagaaaaccagugaaauaauucauuuugaucauuguuucagugcacuaaaguacagcucaaaguaguauuugggugcuauucuggcuugaguuuguuuuuguuuuucuuaaauauuuauagcaaccagaauuccuuaugccaaaauccugugaacuuuggucacuuuucugcuaaagauagccugguguuaaaucucuuugucauaguauugcagucucacagcaaggcagcuugcuauacuugaccugcuaggcaguccuuacuugauuuuucucuaguguuuucuuauucuguaaauaaaugcauuaaaucuuuuacauuuuuauuuuauuuuaaauagagacagggucucacuauguugcccuggccggucucaaacaccuggacucaagcgauccucccaccugagccuccaaaaguucuaggcaagccuccaaaaguucuaggauuacagguccaccacgguuggccugcguuaacucuuugaggacauuuaguaguauuuuaaaacuacuccuuuggugcagugaggacuuaaagcauuaauguacuuuucagauacacucuucuacccugaaguuucucagauuugaauauuucauuuugguugauuuuacuuauggaaauucaacuagaaaauagauuccaaaauuauagaucugagagagucuaauauuucucugaaauuuauuaaaucagucauuuuagaguaaguaaacagcauaaauauuuaaguuaucagagcuagaacagggauauucuuacguuuuuaauuaauugaaauaauugaauauuaauauaaagacaacauaauauuuaugcaagauuuauauuucuggguuuuuuuuucuuuuuuuuuuuuuuugagauggagucuugcugucgcccaggcuggagugcaguggcgcgaucucgggucacugcaggcuccgccccccaggguucacaucauucuccugccucagccuccugaauagcugggacuacaggugcccgccaccucacccgacuaauuuuuuguauuuuuaguagagacgggguuucaccguguuagccaggauggucucgaucuccugaccuugugaucugcccgccucggccucccaaagugcugggauuacaggcaugagccacugugcccggccacaagauuuauauuucuauaugcaaauuauauuuagaguuuuuagaaaaugccuagcuauaaucauggaucaaaauaacaacugagagcugugcacaguggcacaucccuguagccaggaguucaaguccagccugggcaacauaaaaccuugucucuuaagaaaagaauuaauaggaaaacuugaaauucuaugcauuuaaaaauuauuaaaugaaaauaacaaaagauuguugucagccacuccaggacugggauauaaggaccuuagaaaaugcugugguaaauucugcccccauuguuuuauuuuaauaauagcggaaaauggggguauaccagcuuuguaagguaacuuuguuuugacagauuuguacuaggacugacugucaaaauuuuaaacuuuauaauuuucccagcuuauauacagaucuguuuauaauagaauuuuuaaguacuuggaaggaaagaaauuacaaauagaaccuuuguauuuauguuuggaggguuuuuuuucuuauuaacucuuauagccagaauauauaaacuacacguauuuuagcacacuaaugaacuguuugagaguuaaccauuuuucacuuuaucuuuaggcuuguguaguaaaacgugaauuuaagaaggcagaacaguuaauuaaacaugcaguguauuuggcacgguaggugauuauuauuaaaaauauccuuuuaaauugucucuauacuuuauauccuaauaauuuugugucuuuuuauagggaucauuuuggauccaaacacccaaaauauucugauacacugcuagauuauggguucuacuuacucaauguagauaauaucugucagucuguugcaauuuaucagguauguuaaugguuacccuuuuuuucuuucaaccuguauugacuugcugaccuguauuuguuugugguguauaaaccacucuaaaaaugacuuuuugacaacuaccccgcccaccaauauagguugcaucauuauuuuauuaaguauuaccuagaagguguaaaaguuaaugcuuugggaauuaaagaaaaucauucaggaaaggaauuauuggguugugagcucauaugugggaguaguuuuccauuuuuuauuuacccauguaauggcuugucuuuguuguugauuuagcaaaugucacuaaaacugccuuuguaguaacaaagauggcugauaauuauuuuaggucuuucuuacucauucucagguaaaugauguauuaugccauugcuguagacaaggcauacuugacuucaagguucacuuuuuuuuuuugagacacaguuuugaucugucgcccaggcuggagugcaauggcgcaaucucagcucacugcaaccucugccucccaaguucaagcaauucucgugccucggccuccugaguaucugggauuacaggcccgugccacaaugcccggcuaauuuuuguauuuuuaguagagaggcgguuucagcauguugcccaggcuagucuugaacuacugaccucaggugauccacccaccuuugccucccagaaguacuaggauuacaggugugagccaccgcgccuggccuaagguucacuuuugaagaaggaaacagagcaaaacauucccaaugucuugauucucaagacauaggaaugauuauuauuauuauuauuauuaagccguggccuuuuaagucaaacucguaucuucagaaauucaggacuucuaggugacuuucauguucuguaauuuaaauacagcaggacuuucugggcuucaaaauuuuaugguguuaggcauauagauauauauuuaaauuacuaggauguuuaauuuaacuaggugguauuuucuacaguauugacaaauauuuuuaugauucuuucaggcagcccuugacauuagacagucaguguuugguggcaaaaauauccacguagcaacagcucaugaagauuuggccuacucuucuuauguccaccaguauagcucugggaaauuugacaaugcacuguaaguuccacauuccuuuucucugaaggaggaaauacuguuuuuguuuuauuuuguuuuuucccauuagggaacuauuauuacauuaauaauaguacuugauauacuuuauggauugaacuugucuuccuggagcuuuaucagaaugccuaaaauguucuugaagucauuuaaaaucauaccaguuuucaggugcagaggcucccgccuguaaucccagcacuuugggaggcugagguggaaagauugcuugagcccaagaguuugagacccugucuacucaaaaaauuuuuaaaacuagauggacguuuuggugcaugccuguggucccagcuucucuggaggcugaggcaggagaaucgcuugagcccaagaggucaaggaugcagcgaagcauauucacaccacugcauuccagccugggcaacagagugagacccuguuuccaaaaauaaauaaagucauacuaauuuauagguuauucauuuagccuuuaugugauuuacuauugagacuuguauauuuucaugcagaauauaacuuauguuuugaguauuuccuucaauaauuuuugaguaauacaguagcaaacuuaauaaccuaaaaacuucuuggugauaacacauagaaauacugaauaacaauugucuuuuuaaauauauaacugagcuugcaagagugagggggaaaucccccaagggccaauaauggacacuaaaauuuaaaggauuaaguauggccugugguauaacugcucuggggugaugggaaaguuuacagauuucuguaaccuugguuuaagaaacagccuauaggaggcugggaguuagaacugaaacccucacaugaagcaaagucaagacugcaacccggccgggcgugguggcucacgccuguaaucucagcacuuuggcgggccaaggcagguggaucaccugaggucaggaguucaagacaagccuggccaagacgaugaaaugccaucucuacuaaaaauacaaaaauuagccgggcaugguggugggcacuuguaaucccagcuauucgggaggcugaggcagacaauugcuugaacccaagagguggagguugcagugagccgagaucacgccacugcucuccagccuaggcaacagagugagacucugucuccaaaaaaaaaaaaaaaaaaaagggacuacaaccccagggaaaggacagguggacaucuaucuaauuaauagaugacagggaaaguuggccaucugagcuuggugucacaguugaacccaaaaagaagccucacaaaacauaauuauuuaccuauaccgcucuugaguuuagggauaaugcaucaggaucugcaaacagaaaaauauuaaaaagcacuuugggggugcugguucuccugggaugccuugugagagaaaaugcaagacuuggaaauaauuaucugucaacccaaacuauacagacauuucauagacgaagcuuuaccuaaaaugaacucaccauuaaaaauuacaaaacauaaggaaauauuuccucugagucagcagacauaaugaacaggauuagaauccugaaaacuuuaguuaacagaacuuuuuuuuggcugggcgcaguggcugauaccuguaaucccagcacuuugggaggccgaagcgggcagaucacgaggucaggagauggagaccauccuggccaacacagugaaaccccgucucuacuaaaaauacaaaaauuagccaggcaugguggcaugcgccuguaaucccagcuacucgggaggcugaggcaggagaaucgcuugaacccgggagucggagguugcagugagccaagaucaccacugcacuccagcguggcgacagaacgagacuccgucucaaaaaaaaaaacaaaaaaaaaaaccagaacuucuuuuugguugaugcuguaaaguauguguucuuuauaugauuaaagauacaaaauagguugacgaacuaggccuauaaguaaaguuuuauguuuuacuggaacauagccaugcucauucauucauguguuuucuauagcuucuuucacacuacagcagccagaguucaguaguugcagcagagaauguguggacaacacaaccuaaaauauuuacuaucuggcccucuacagaaaaacuuuguuaacucuaauauaaaagaaagaaugaagaauauucccauaaagaaaacaggaaguuuuuuuguuuuuguuuuguuuuuuuuuugagacagagucugucacucugucgcccaggcuggagugcaguggcgugaucucggcugacugcacucuccaccucccagguucaagcgauucuccugucucagccaccugaguagcuggaauuacaggcacacgccaccacaccuggcuaauuuuuguauuuuuaguagagacaggguuucaccauguuggccagacuggucucgaucuccugaccucaagugaucugccccccuuggccuccuaaagugcugaggcugcagaugugagccaccaugccuggcuggaaaagggcagauuuuaaaguaacuguuacaugcuacagcauggaugaaccuugaaaacacugugcccagugaaagaagccagucacaaaggaucacauauuguaugauuucauuuauguaauauguccagaauaggcaaauccguagagagaacauaaauugauguuaucuaggcuggggaguuggagggaaauggagacugacugcuaaugggcauagguuucuuuaugggguaaugaaaauguuguaaaauugauuuuggugauuggcauacuacucugugaauacacuaaaaaucauugaauuguacacauuaaaugggugaauugugugguauacuaauuauaucuugagcuguuauaaaaauaaaacaaauggcuagaaauggaaauagucauugacauuaaaacucagcagaugggccaggcgugguggcccacgccuguacucccagcacuuuaggaggccaggguggguggaucacuugagcccaggaguuugagaccagccuggacaacauagcaaaucccugucucuucaaagaaaaugcaaaaaaauuaguugggcauggcaguguacaccuguaacccaccuauccgggaggcugaggugggaggaucacccgagcccaggaguuugaggcugcggugagccaugauugcaucacuguacuccagccuggaugacagagcaggauccuguguaaaaaaaacaaacaaacaaaaacaaaacaaaaaaaaccucagcagacaaguuaaacagaaguuuaguuacaacaaaagagagaauuaguaaauuggaagacagauuugagaaaacuagugguuaccuggagggugggggagagggaggcuuggcauuguuugaaagaaacugacaauaaaacagaaauagcuuaccuucuauuuggugauaugggccauaaacaaauaaccaaacuugucaggcaagaauacauguugugaagaagaguaaaguaggcugaguugagagagugaugguaauuuuuuuuuuuuuuuuugagacagucuuugucacucaugcuggaguacaauggugcaaucuuggcucgcugcaaccuccaccucccagguucaagcgauucugccucagccugcugaguagcugggauuacaggcguucaccaccacaccuggcuaauuuucguauuuuuuuaguagagauggaguuucaccauguuggccaggcuugucucgaacuccugaccucaggugauccacccaccucagccucccaaagugcugggauuacaggcaugagccacugcacccggccagugguaaauuuuuuuagggccuuuuauguggucuguucuggaaagaccugaggagcgagucgugagaauguucaggggaagagcauuauagaaaggguaaagccagggugagaacaugcucugcauguucaggaaacugcuaggccuguguggcuggaggggaaggcggagaggguuggugugagaauggcaggagaugaggucagggaaguagcaggcugaaagaucauguagaaucuuguagucuguaguaaagauuuccucucauucugagggaaaugggagucucuguuggguauuaaaaguucagucuacaacagauuggaaauuuaaaacaaaaagcuggaucuuuaccacagauaguuuuagaaguacuuucuaucaauauuauauuacagauugugauuuuuaaaauuccuaaaucauuuguaacuaaaaagaaaugccagacuguaucuaucuguauuacagauuucaugcagaaagagcuauugguaucauuacccacauccuaccugaagaucaucuucuuuuggcuucuucaaagagggugaaagguauccuuuguaaucuagucucagauauuuuaaaauagaugauauaugguauaaaauagggguauuuguuuauuuucucagaggauuggaggauuuucucacaggauuugacggugucuauguauuacuagauagccauuuuaccacaacucuacuuaagggguuccaguggcucauaaugaaagacuguuugcaucucucauaaaacauuguuaauaggccggaugggguggcuuaugccuguaaucccagcacuuugggaggccgaggcaggcagaucaccugaggucagaaguuugagaccagccuggccaacauggugaaaccccaucuuuacuaaaaauacaaaaauuagccggaugugguggcgugcaccuguaaucccagcuacuugggaggcugaggcaggagaaucguuugaacccaggaggcagagguugcagugagccaagaucgugccacugcacuccagccuaggcaacagaacgagacucugucucaagaaaaaaaaaucaguaagccagaauuucuuucuuuucucucucccuuuugucauucacucaugcaugcauuaauuuuuuugaggauugcauggaagcauaauacaaauguuucuacacaacaugaauagaagauggguuucauaacuucagcuuuguagugcaggauucuuauccugagcuucguaucagguuaccccgaauguugcaaggcucuugcaaaauaccccuaucuuccauuucuuauuuuaacuuuucuucugauuaccaccaaggcuuuuucacguaaugcauuuauuuugcuaacaugauugggucaccuauguguuauuuccgugcauguuggauauguucuaccuuaauucuggaacugaguuuuuucucccucuagguuuguauuuuuuaaguugcacaaguaauacaugauguuagauagaaaagagaaaaauaaauugccuuaaaaucccaccaauccucagucaacauuuuggugaauauuauuuuagacuuuucuuacuucaaauaagauaacuaaaugaaugauuuaauuuuauaaucugauuuuuucacuuaauauauuacauuuuuucaugucucuacauauauccuuuuuucuaauguauuuaaccuuaccuuuauuauuugacucuuauaauuauuuuuaaccuuuucuuuuuaaaaaaugcuacagugaaguaaaucucuuuuucuuaccuuuguguacauagacaguuuuccaauaaaucaaauuaucugguaaaauaauauguauauucuuaagacuuuagauagaauuugaaagucuugaauggagcuuugaaauugaaaugucuugccugauuugguuggucagaugaguaggaggaaaucaguucuuuuagccguguuugguuaaagguuauguuuuauaaaguguguuuucaaaauuuucagaagugcuuagguacuccuugacacaguuucaugacuuuaaaaaacuugccuugugcuuccguuuaauuugaaaaacaaauuucacaucagcaaaguauagcagucuauuaaaauagaagcuaauucugcaaaaucguuuauaccauuguuuuucuuaaauuugaauauauauacugugcaaaauagaaugaccaccaaaaaguguacuuuuuuguuaaaaguggaauucuuucaucuugaccaguuccaaaccauaaucacauauaaauauauucaguaaacauuuauauuauuuaaguuuaaauuagauguucuuacuagcuuugguagaugguuuugaaguacacuaauuuauugccuucuuuuuuagcacuuauuuuagaggagauugcaauugauugucauaauaaggaaacugaacagaggcugcuucaagaagcucaugauuugcaccugucuucacuccaacuagcuaaaaaagcuuuuggggaauuuaauguacagacugcaaaacacuauggaaaccuuggaagacuuuaucagucaaugagaaaauuuaagguagaaacauguuuuuacuauauuuuucucucuuaaguaaugaaauagaaccugaaauaauaaauuuuaaguaagcucaaauaaauuauacacuuauugcacaaaggaauugagaagauagugaguauaaaacaacauaggccaagcacaguggcucauuccuauaauccuggcacucugggaggcugaaaugggaggguccuuugagaccaggaguuucagaccagccuggacaacauagggagacccugucucuacaaaaauuaggcaggugugguggcacaugccugucuuccuaccuacuuggaagacuaaggcaggaggaugaguugagcccaagaaguugaggcugcagugacuaugaucacaucacugcccucuagccugggugacagagugagacccuaucucuaaaacaaacaaacaauagucaaaauauaaauaaaauuuaaaaaucaggaccgugggccaggcacaguggcuuaugccuguaaucccagcacuggaguccagggugggacaaucaccugaggccaggaguugaagauuagccuggucaauauagggaaaucccaucucuacaaaaaagaaaaaguuagccagacaugguggcucacaccuguagucccagcuucuccagaggcugaggcaagaggaugacuugagcccaaaagguugaggcugcagugagcucugaucacaccacugcacuccagccuaggugacagagugagagccugucuucaaaaaaaacaaaaaaaaaaacaggaucaugaaaaauuaggaaacaugucaaacuaaaaagauuaauauaugaggccgggcucaguggcucaugucuguaaucccagcacuuugggaggccaaggugugcagaacacuugagggucaggaguucaagaccagccuggccaacauggugaaaacccaucucuacuaaaaauacaaaaauuagccaggcaugguggcaugcaccuguagucccagcuacucaggaggcugagacaggagaauugcuugaaccugggagauggagauuguagugagccgagaucugcacuccagcuuggauaacagagugagacucaucucaaaaaaaaagauuaauauaugaaaguaguacuugagauaagaaaaaauuuuuuaaauaaaaaagacaaauaugauugcuauauuucaaacaguucuuaguauauaguucuugauauauaauucuuaguauauacuaaguauagcucuuagcagaaugccuggcacauggcaggugugcaagaaaugucagauauugcaacaaguauuaucaguuguagcaauaaauaugacuaacuucaauguauuuuagaauuuugaguuauauauauauuuuuuaauauggguucuuacucuguuguccaggccguaguacaguggugugaucauggcucacuacagccucaaccucccugggcucaggugaucuuuucaccucagcuucccaaguagcugggaauacaggcgcacaccaccacacugccuaauuuuuguauuguuuguagagacagggucuugcccuauugcccagcccuguugcccaggcugaucucgaacuccugggcucaagcaaucugccugccucgaccucccaaacuguugggauuacaggcaugagccacugugcccagccuauaaauucuuaauauuauuaauuuugggaucacaguaaguaaagagugagaggucuucuuuaccugaaaagcaaccuguauaucccucaauuagcuugaguuuaguuuguuggaauaaaaauugucaaaauuccaaaaaaugaaaugaaaguguaugcccauguaaauuaacauauuaugaucuagagcuuguuaagaagguucaacuaaauuuuggacuguguuaacuguguuaaccaaaggaaguaauuuuuguuuuagaauguuuuguuaauuucuucuaacaguuucuuaaaauuuugcaaauuucuuuguugugaauuucuuguaacaauuuuuuauuaccaggauaaguuuucacuuguuacuuuugacauaggauacuauugcugucaucaguuuaucugcaguuuccaaaacucuguaaugcuucccauaggcaauuuuuggaauaacauaguauguucuuugaucugauuaccuuauggcauucauaagaugucuuuggcauuuagaucaguuuugcucauugaguaagaacuguuaagaugagaaaaaguauaaugauugauauggcauaauuguuuuucaggaagcugaagaaaugcacaucaaagcaauucagauuaaagaacaacuucuuggucaagaagauuaugaaguagcccuuucagugggacaucuggcuucuuuauauaauuaugacaugaaucaguaugaaaaugcugagaaacuuuauuugcgaucuauagcaauugguauguuacauuuaaauuuucuuuagucaguugauuacaaaucaacaugucagcaugucuuauauguuguauaaggaaaauguuauuaaagacuuaaauggggcugggugcgguggcucauaccuguaaucccagcacuuugggaggccgagauaggcagaucacuugaggucaggaguucgagaccagccuggccaacauggugaaaccccaucucuacuaaaaaauacaaaaacaaauuagcugggcaugauggugcaugucuguagucccaccuacucaggaggcugaggcaggagaaucacuugaaccuggaaggcagagguugucaugagcugagauugugccacugcucuccagccugggcaacagaacgagacuccaucucaaaaaaauaaauaaaauaaaauaaaauacuaaaauauuuaauaaaauaaaauagauuuaaaugggauaaguugcuaaggauauucaggaaccacccaaaaaucaucuggaacauuuugcuaaaggugcuuuuuuugauacugaagccaguaguaagagguaugacaguagacugucauguguaggcaaaaguaguuauuuuaaacuauuugugcaguuacugcccacucauuccucccccucccuucuccuaccuuuaacaucauagaucaggcuuaccuguuuuugaacuugaugaaguuauacaauguauauuuuuaugugucugguuuauuggugaacaauaauggugaaaucugugauguugcguaucacugccauuuguuggauuaggaugucaucauuuauccauuccacuauuaaugaacauuuggaacauuuggauuuccauuucaggacuauuacaaaaucaaaauaaggaaucuauggccaucaucuuaugaagugccuguuaaaacucuugcccauuuuuauauugauuugucuugucauuuucuuauugacuuauagaaguucuuuauaugauaugaauaugacagaccuucguugguuacaugugucauagauaucaucucuuauucuugcuuguuuccuaauggagccuuuuaaauaacagaaguucuuuuuuucuuuuuucuuuuuucuuucuuuuuuuuuuuuugagacaggaucuuacucugucacccaggcuggagugcacaucagggcucacugcagccucaaucuccugaguucaagugauccuucugccucagcccaccugaguagcugggacuacagaugugcaccagcacacccggcuaauuuuuuuuuuuuuauuguuucaauagggacaaggucucacaaucuuggcccaggcugaucucaaacuccugagcucaaguaauccuccuaccucagccucccaaagugcugggauuauaggcaugagccacugugcccagccaguucuuaauguaaucagaugcaucaguauuuucuuuuuuuuuuuuuuugagagggagucucgcucugucacccaggcuagagugcaguggcgcgaucucggcuuacugcaaccuccgacucccagguucaagcaauucuacugccucagccuccggaguaccugggacuacaggugcccgccaccaugcccagcuaauuuuuuguauuuuuaguagagacgguguuucagcauguuggccaggaugaucucaaucucuuaaccucgugaucugccugccuuggccucccagagugcugggauuacaggccucaugagccaccgcguccagccugcaucaguguuuucuuuugugaauagcacuuuuuguauuguuuaagaaaucuuuucagccaggcacgguggcucacaccuguaaucccagcacuuugggaggccgaggcagguggaucacuugaggucaggaguccaagcccagccuggccaacaugcugaaaccccgucucaacuaaaaagacaaaaauuagccgggcgugguacaguacgccuguaaucccagcuacucgggaggcugaggcaggagaauugcuugaaccuagcgggcagagguugcagugagccgagauugcacugugcacuccagccugugugacggagcaagacuacgucuccaaaaaaaaauauggaaaucuuuuucuacccaaaguaauaaagauauuuuuuucuagaaaauuaucuucaggaaacuuuauuuauauuuagaucuacaauccugaaacugauuuuuuuuuuauggugugaaguagggaucaauuuuuuuccccauauggacacagaguuaagccaagaccauuucuucaaaagacuuuuuuuugguuuuguuuuguuuugagacaagagucucgcugugucguccaggcugguaugcaguggcguggucuuagcucacugcagccuccaccuccuggguucaagcgauucuccugccucaguuucccaaguagcugggacuacagaugcacaccaccacaccuggauaauuuuuuuguauuuuuuuaguagaggcaagguuuugccguguuggccagguuggucucgaacuucugaccucaggcagccugcccgccugggccucccaaagugcugggauuacaggcgugagccaccgcuccuggccaaaagacucuuuuuuucccucugcuauacuguguucuucauaaaucauuuauccauauacauguggguucccuauuaucuauaauauauugacugacuugcucauuccucaagugcauguaguuuaagaguugcuaacccauaccgcugugaaaaacagaccuacuacuuagaguucaauauucguuuacaguuuuccuuuuucucuagcccgaagguaguauauuuucagaauacuauguucaaaaguuacuugggguuauuuacaccccuuuccuuucaaugugguuauguuauucuuuugcacaacaauuagguuuauuuaacauguuaaauuguugccccauccaucuuuguuuauuuuguuaauuuuuuugaguaugcgaaauauuaacguacuguaauuagaacuauacagaaagauauguccagauacauauaauuuucucugauuucuucuacccaguucccacccacucacuauggauaaccagucucauuaguuucugguuuaucauuuuuguguaucuuuuugcacaaugaacagauaaauauuuucuuauuucccuaucauacacaaaagauagcauacuauagauacucuuugguauuuuacuuuuuucaaucuuaacaauauaccaucagucacuccguaaccguuacagagagcccagaaauuuccccaucaguuugcagcuacauaauaugccauugagugaagguaccacaguugauuaaacuauucuacguguuuuuguuuguuucuguuaauuuguaauuacaaauacuguugcagugaauagccuugugcauguguuuugguuuuucauuuguugguugguuuuuuugagacggagucucucucugucacccaagcuggagugcaguggccugaucuuggcucacugcaaccucugccuccuggguucaggcaguucucaugccucagccucucgaguagcugggauuacaagcaugcaccaccacgcccagcuaauuuuuguauuuuuaguagagacggguauucaccauguuggccaggcuuucaccauguuggccaggcuagucccaaacucuugaccucaggugauccacccaccuuggccucccaaagugcugggauuacaggugugagccaccaugacuggccugugcauguguauuuuucuguuguuggagaugcugccauucuucuuugagaucucuuuaaacaguucuuucaaaccaugaauuuuuauaauucuauucuaaugaggccaacuucuuuagacgagaaaauuuuuuuuaagucuuagugauagcucaugguugggacugauuuaggggaugcugauacaagaauuauaucuauuccuuucaggggaauaaaccuaagccacccuguuuaaagaauugaacuuguguucauguuauagaaauugcuuguuaucucauuauuugugcuuuuuuuuuuuuccuuuuucuuuuuuguuacagggaagaaacuuuuuggugagggcuacaguggacuagaauaugauuaucgaggucucauuaaacuuuacaacuccauuggaaauuacgagaaaguguuugaauaucacaauguucugucuaacuggaaccgguugcgagaucggcaauauucagugacagaugcucuugaagaugucagcaccagcccccaguccacugaagaaguggugcaguccuuccugauuucucagaaugucgagggaccgagcugcugagggaggaccucaguuaaccaauuaccuuuucccggauuccagggaauucauacugugaaaucaaaaccauguuguuuuggggggcuggaauuugcauugaaacacugguccaguccauugaagacccuauuuugggugaucccuaucuugcagaaugucuguaggaauaagcauauauucaguuauauucagcauguaccgcauguguaaguagucuggcccacauuuucaaccuaguagaacaaacaacaggaaaucuuuuuuuuguuguuuuuaaaaaauucauuuugcagaaagccugaaagaaaaaaaauaccccuaaauaaaacuauuuaagaguuuaaaagaguugcauucuuauuauguaaggaugauuuuaacaacuuuuuaauauguaauucuuccauguggagguauucaauacuguaguguaaagaaauuuuaugcggaaaaucuuuauaugcaguauagaaaaguuaacacaaguacuaauaaaagagggacaucccgacuuacguuuuucuaccuugcccagauaaguggauacaaccacucuauauuacaaggaaaggacugucagauucaucugaacuggaccaguguugaucuguaauguaauagaaaaucugauagaccagcacuucugacuuuuuuuuuuuugguacaacaaugcaagaugcucugauagcauuugcuaacaggaccaggaggaucuaaaaaggaccagccuaauguagaaggugguuacuuggaccagaggcuuuagauuauuauuuuagauccuacauauacuuuuaucaguagaaugauuucauuuagauguauaaugaaaaaggauaaugcaaaaauuauguaauagauaccaaauuagggaaguuuggcaauuucaauggcauauuuuuagucaagguacacagauggcagugccauaagcaagucuauaaauaucggcugcagccaucccccucauuuuaaauguugcccuaauaaucaaugcaguuaacaaguauauuggcugugugucaugaaauaguucauguucagauggaaauguuagguuacuguaugguuuauggagauuaaugaaaaugaaugcccaaaaauaagucuuagaaaauccuccauuuuuaugguaaauaguaauacaacuaggucauuucauuugaaaucuaggagucaaauggaaagauccccuaauaauacaccuauuucacuaacuugucuuucuguuuauuggguuuugauuugauuuuuuguaagccagucagguuauuuaaugaugagguaauaaucaaauuuaagaauuugugacauguagcaauucaagaaacaaaaagguauuuugcuguuaccucaauucuuacuguaguagcccaucugaugcuucuauaguuaagaaucuggguucccccccuauuuucagggguucaugacuuggcuguuaaagauguugcuccuagcuaaugcuuggaguagucugugggugaauggauguguguugaauuuuaguuuucuuuuaacaugcauguugggugagaggggaaaaaaaucuaagcugucugccacauugaguacagaaaaguuguagauuucaaauuuuauuaauauuuuaagcacuuuuuugaacuucccaaccuuguuugaagcuguuauuugcaguccuauuaguuuugagccauugcauuuaaguucccuaggaggggguugguugggggauguacugaaagagaugaagcaaacccacacccuaagaugguaacugugugauuuagaaaccugaguuuacuccucaaaucgaauuauuuucuuuuuaaauuuuggaaagaguaaauugacguacuugcaguuuaugaagcugccccccaccccucaguuaauugcagucuaaugucaagaggcacuucuuuauuaauuaccaaauagucuuugugaccaaggacuaacauuuuuaaguuacucagcucuauccucaugggccuauauauuuaauaccuccaaagauauuuucaggauaggcuuuguauacuuuuauugguuauuuagaauccagugguauguuugugguauaggaaugucaugguaaauuguuuuucaauaaauauuuugaaacauguuuccauaugaaguuuuuuuuucaaucuguauuuuuugguuuugugcacauacagcauuuccuaggauaaaaauaaacaaaugacuuacagccucauccucccuaacuccauuugaacucaacuuagcucacacucagugauaaaacaacaugguauguagaagccuaggaucacagggugauaaugucaauuggcagccaguuguguuuuuuugaaacaucauuauuggcaguuucuccuuaucaccacugcuuuaauguaguuuuuuuguaaauccauauacuuuaaugcauacacucuagcuuaagaaaacauugccauuuugguuagggauaugacuuaaugugcuauuauuucugguucuaaugaagaauaauacccuaugacuuuaaguguaagauucauccuuuaaguagggauguuuaggauaaguuagaugugugccacuaugauuuauuggguuucuuaaaaaucuugaagaaaauaauaaaauuuaucucacaauaaguuaacuugcgcaaacuuuuuacauauggugaggugcguaaggaagcccuggccaacuuaaagauuuuucuggagguucagcaaaguuauguuaaauuaggggccuuuggucucauccuucucugacucuucuacccagucuuuuccuaaaguucggugcuacuccaguugggugcaucagggagcuccgucagcacucgcaugugucgcucagguggccacucaugccugcauuccauuuaauagagucaauuggaauuuuuagagcauaaucuuuauggauccucaaagcugacuuugccaaagggauugagacccuuacuaccaucaaaucucugucucugcuugguuaaaaauuggcucacuauugcuuuguaguaaccccugcccagguauuuuuucacuugugaaaauaauuugagaaagaccuuuguuccuagccuguugggaaaaguuuauaauuuuaugaaaauuaaguacagaggcugcgaucuuagaaauaaugaaggugccauuuggcugcuccuuaauagugcagacagaaaacugcagugaacacaugccaaaacaugauugaagccuuuggcugaaacuuuauacauagaaauaaugauuugcucauaacagguaucauuaacugccacuuuuuauguuuucccuagaauuuguagccuugcugcuugcuuuucuucuggguggcaaaguuacuacuggaaaaacacuauaaguacaaaguuuuugggguuuuaucuuugcuuuagaaguggauguguacuucaccucuuggcuguggaggaacuuaguugccaggaaauuuuuuuuuuuuuuuucagacggaguuucgcucuuguugcccaggcugggagggcaauggcaccgucuuggcucacugcaaccuccgccucccggguuccagcgauucuccugccucagccuuccgaguagcugggauuacaggcuccugccaccacgccuggcuaggaaauuuuuuguuguuaauaugacauuuggauuaaucuccagcuucaacaguacuucuuuuguccauaaaucucaggaauguuuuaggcagaaaacugguuuuacccuguugauaaucagaaggagugugcuuuaggauuuauugcauaauacuauucuuuaauugcaauccuagguaucuauagcaugaguggccuuagugaguuuguugaagugcacauguuuuucaagaguaaaauuuaagauuaaaaauauauccuauauauagauaucuagaaaacuugguuuguggugcacaguuaaguguuggaucacuaaauaaccauugcagguaccguuuguguaacauuacucauuucuguauauuccuuuuaugggaagauauuuugccaugguaacuaaaacuuuucaguucuacuuuuaugaugugaaugaaugcuacguuuuauuaaauauuaccaggucaguacuauuuuuauacuuuauuaagcaacaggggauuuuaguuuaauaggcucaaaauaaaaaguucuuaauggaacaguuaaaaacaaaacacuaacaaucuuuacgugaaaauccccacuaauagugccacaauaauuucuauagaaauaucuaaggucauuaaauagauuuuugaagacgguucuucauugugucaggaugaccuuucauaucauucucaccaacuuguagugcccaccguuauuuguaacuauuaaaccauacuaaguauguuuguaaccagcauugugauauauucuguacuuguauugcuaaaaaugaauuauugaccuaauaaauauaguguuccugc

SEQ ID NO: 192287 - RNA, 83061 nt, Homo sapiens
gcaggaacacuauauuuauuaggucaauaauucauuuuuagcaauacaaguacagaauauaucacaaugcugguuacaaacauacuuaguaugguuuaauaguuacaaauaacggugggcacuacaaguuggugagaaugauaugaaaggucauccugacacaaugaagaaccgucuucaaaaaucuauuuaaugaccuuagauauuucuauagaaauuauuguggcacuauuaguggggauuuucacguaaagauuguuaguguuuuguuuuuaacuguuccauuaagaacuuuuuauuuugagccuauuaaacuaaaauccccuguugcuuaauaaaguauaaaaauaguacugaccugguaauauuuaauaaaacguagcauucauucacaucauaaaaguagaacugaaaaguuuuaguuaccauggcaaaauaucuucccauaaaaggaauauacagaaaugaguaauguuacacaaacgguaccugcaaugguuauuuagugauccaacacuuaacugugcaccacaaaccaaguuuucuagauaucuauauauaggauauauuuuuaaucuuaaauuuuacucuugaaaaacaugugcacuucaacaaacucacuaaggccacucaugcuauagauaccuaggauugcaauuaaagaauaguauuaugcaauaaauccuaaagcacacuccuucugauuaucaacaggguaaaaccaguuuucugccuaaaacauuccugagauuuauggacaaaagaaguacuguugaagcuggagauuaauccaaaugucauauuaacaacaaaaaauuuccuagccaggcgugguggcaggagccuguaaucccagcuacucggaaggcugaggcaggagaaucgcuggaacccgggaggcggagguugcagugagccaagacggugccauugcccucccagccugggcaacaagagcgaaacuccgucugaaaaaaaaaaaaaaaauuuccuggcaacuaaguuccuccacagccaagaggugaaguacacauccacuucuaaagcaaagauaaaaccccaaaaacuuuguacuuauaguguuuuuccaguaguaacuuugccacccagaagaaaagcaagcagcaaggcuacaaauucuagggaaaacauaaaaaguggcaguuaaugauaccuguuaugagcaaaucauuauuucuauguauaaaguuucagccaaaggcuucaaucauguuuuggcauguguucacugcaguuuucugucugcacuauuaaggagcagccaaauggcaccuucauuauuucuaagaucgcagccucuguacuuaauuuucauaaaauuauaaacuuuucccaacaggcuaggaacaaaggucuuucucaaauuauuuucacaagugaaaaaauaccugggcagggguuacuacaaagcaauagugagccaauuuuuaaccaagcagagacagagauuugaugguaguaagggucucaaucccuuuggcaaagucagcuuugaggauccauaaagauuaugcucuaaaaauuccaauugacucuauuaaauggaaugcaggcaugaguggccaccugagcgacacaugcgagugcugacggagcucccugaugcacccaacuggaguagcaccgaacuuuaggaaaagacuggguagaagagucagagaaggaugagaccaaaggccccuaauuuaacauaacuuugcugaaccuccagaaaaaucuuuaaguuggccagggcuuccuuacgcaccucaccauauguaaaaaguuugcgcaaguuaacuuauugugagauaaauuuuauuauuuucuucaagauuuuuaagaaacccaauaaaucauaguggcacacaucuaacuuauccuaaacaucccuacuuaaaggaugaaucuuacacuuaaagucauaggguauuauucuucauuagaaccagaaauaauagcacauuaagucauaucccuaaccaaaauggcaauguuuucuuaagcuagaguguaugcauuaaaguauauggauuuacaaaaaaacuacauuaaagcaguggugauaaggagaaacugccaauaaugauguuucaaaaaaacacaacuggcugccaauugacauuaucacccugugauccuaggcuucuacauaccauguuguuuuaucacugagugugagcuaaguugaguucaaauggaguuagggaggaugaggcuguaagucauuuguuuauuuuuauccuaggaaaugcuguaugugcacaaaaccaaaaaauacagauugaaaaaaaaacuucauauggaaacauguuucaaaauauuuauugaaaaacaauuuaccaugacauuccuauaccacaaacauaccacuggauucuaaauaaccaauaaaaguauacaaagccuauccugaaaauaucuuuggagguauuaaauauauaggcccaugaggauagagcugaguaacuuaaaaauguuaguccuuggucacaaagacuauuugguaauuaauaaagaagugccucuugacauuagacugcaauuaacugagggguggggggcagcuucauaaacugcaaguacgucaauuuacucuuuccaaaauuuaaaaagaaaauaauucgauuugaggaguaaacucagguuucuaaaucacacaguuaccaucuuaggguguggguuugcuucaucucuuucaguacaucccccaaccaacccccuccuagggaacuuaaaugcaauggcucaaaacuaauaggacugcaaauaacagcuucaaacaagguugggaaguucaaaaaagugcuuaaaauauuaauaaaauuugaaaucuacaacuuuucuguacucaauguggcagacagcuuagauuuuuuuccccucucacccaacaugcauguuaaaagaaaacuaaaauucaacacacauccauucacccacagacuacuccaagcauuagcuaggagcaacaucuuuaacagccaagucaugaaccccugaaaauagggggggaacccagauucuuaacuauagaagcaucagaugggcuacuacaguaagaauugagguaacagcaaaauaccuuuuuguuucuugaauugcuacaugucacaaauucuuaaauuugauuauuaccucaucauuaaauaaccugacuggcuuacaaaaaaucaaaucaaaacccaauaaacagaaagacaaguuagugaaauagguguauuauuaggggaucuuuccauuugacuccuagauuucaaaugaaaugaccuaguuguauuacuauuuaccauaaaaauggaggauuuucuaagacuuauuuuugggcauucauuuucauuaaucuccauaaaccauacaguaaccuaacauuuccaucugaacaugaacuauuucaugacacacagccaauauacuuguuaacugcauugauuauuagggcaacauuuaaaaugagggggauggcugcagccgauauuuauagacuugcuuauggcacugccaucuguguaccuugacuaaaaauaugccauugaaauugccaaacuucccuaauuugguaucuauuacauaauuuuugcauuauccuuuuucauuauacaucuaaaugaaaucauucuacugauaaaaguauauguaggaucuaaaauaauaaucuaaagccucugguccaaguaaccaccuucuacauuaggcugguccuuuuuagauccuccugguccuguuagcaaaugcuaucagagcaucuugcauuguuguaccaaaaaaaaaaaagucagaagugcuggucuaucagauuuucuauuacauuacagaucaacacugguccaguucagaugaaucugacaguccuuuccuuguaauauagagugguuguauccacuuaucugggcaagguagaaaaacguaagucgggaugucccucuuuuauuaguacuuguguuaacuuuucuauacugcauauaaagauuuuccgcauaaaauuucuuuacacuacaguauugaauaccuccacauggaagaauuacauauuaaaaaguuguuaaaaucauccuuacauaauaagaaugcaacucuuuuaaacucuuaaauaguuuuauuuagggguauuuuuuuucuuucaggcuuucugcaaaaugaauuuuuuaaaaacaacaaaaaaaagauuuccuguuguuuguucuacuagguugaaaaugugggccagacuacuuacacaugcgguacaugcugaauauaacugaauauaugcuuauuccuacagacauucugcaagauagggaucacccaaaauagggucuucaauggacuggaccaguguuucaaugcaaauuccagccccccaaaacaacaugguuuugauuucacaguaugaauucccuggaauccgggaaaagguaauugguuaacugagguccucccucagcagcucggucccucgacauucugagaaaucaggaaggacugcaccacuucuucaguggacugggggcuggugcugacaucuucaagagcaucugucacugaauauugccgaucucgcaaccgguuccaguuagacagaacauugugauauucaaacacuuucucguaauuuccaauggaguuguaaaguuuaaugagaccucgauaaucauauucuaguccacuguagcccucaccaaaaaguuucuucccuguaacaaaaaagaaaaaggaaaaaaaaaaaagcacaaauaaugagauaacaagcaauuucuauaacaugaacacaaguucaauucuuuaaacaggguggcuuagguuuauuccccugaaaggaauagauauaauucuuguaucagcauccccuaaaucagucccaaccaugagcuaucacuaagacuuaaaaaaaauuuucucgucuaaagaaguuggccucauuagaauagaauuauaaaaauucaugguuugaaagaacuguuuaaagagaucucaaagaagaauggcagcaucuccaacaacagaaaaauacacaugcacaggccagucaugguggcucacaccuguaaucccagcacuuugggaggccaagguggguggaucaccugaggucaagaguuugggacuagccuggccaacauggugaaagccuggccaacauggugaauacccgucucuacuaaaaauacaaaaauuagcugggcgugguggugcaugcuuguaaucccagcuacucgagaggcugaggcaugagaacugccugaacccaggaggcagagguugcagugagccaagaucaggccacugcacuccagcuugggugacagagagagacuccgucucaaaaaaaccaaccaacaaaugaaaaaccaaaacacaugcacaaggcuauucacugcaacaguauuuguaauuacaaauuaacagaaacaaacaaaaacacguagaauaguuuaaucaacugugguaccuucacucaauggcauauuauguagcugcaaacugauggggaaauuucugggcucucuguaacgguuacggagugacugaugguauauuguuaagauugaaaaaaguaaaauaccaaagaguaucuauaguaugcuaucuuuuguguaugauagggaaauaagaaaauauuuaucuguucauugugcaaaaagauacacaaaaaugauaaaccagaaacuaaugagacugguuauccauagugagugggugggaacuggguagaagaaaucagagaaaauuauauguaucuggacauaucuuucuguauaguucuaauuacaguacguuaauauuucgcauacucaaaaaaauuaacaaaauaaacaaagauggauggggcaacaauuuaacauguuaaauaaaccuaauuguugugcaaaagaauaacauaaccacauugaaaggaaagggguguaaauaaccccaaguaacuuuugaacauaguauucugaaaauauacuaccuucgggcuagagaaaaaggaaaacuguaaacgaauauugaacucuaaguaguaggucuguuuuucacagcgguauggguuagcaacucuuaaacuacaugcacuugaggaaugagcaagucagucaauauauuauagauaauagggaacccacauguauauggauaaaugauuuaugaagaacacaguauagcagagggaaaaaaagagucuuuuggccaggagcgguggcucacgccuguaaucccagcacuuugggaggcccaggcgggcaggcugccugaggucagaaguucgagaccaaccuggccaacacggcaaaaccuugccucuacuaaaaaaauacaaaaaaauuauccaggugugguggugugcaucuguagucccagcuacuugggaaacugaggcaggagaaucgcuugaacccaggagguggaggcugcagugagcuaagaccacgccacugcauaccagccuggacgacacagcgagacucuugucucaaaacaaaacaaaaccaaaaaaaagucuuuugaagaaauggucuuggcuuaacucuguguccauauggggaaaaaaauugaucccuacuucacaccauaaaaaaaaaaucaguuucaggauuguagaucuaaauauaaauaaaguuuccugaagauaauuuucuagaaaaaaauaucuuuauuacuuuggguagaaaaagauuuccauauuuuuuuuuggagacguagucuugcuccgucacacaggcuggagugcacagugcaaucucggcucacugcaaccucugcccgcuagguucaagcaauucuccugccucagccucccgaguagcugggauuacaggcguacuguaccacgcccggcuaauuuuugucuuuuuaguugagacgggguuucagcauguuggccaggcugggcuuggacuccugaccucaagugauccaccugccucggccucccaaagugcugggauuacaggugugagccaccgugccuggcugaaaagauuucuuaaacaauacaaaaagugcuauucacaaaagaaaacacugaugcaggcuggacgcgguggcucaugaggccuguaaucccagcacucugggaggccaaggcaggcagaucacgagguuaagagauugagaucauccuggccaacaugcugaaacaccgucucuacuaaaaauacaaaaaauuagcugggcaugguggcgggcaccuguagucccagguacuccggaggcugaggcaguagaauugcuugaaccugggagucggagguugcaguaagccgagaucgcgccacugcacucuagccugggugacagagcgagacucccucucaaaaaaaaaaaaaaagaaaauacugaugcaucugauuacauuaagaacuggcugggcacaguggcucaugccuauaaucccagcacuuugggaggcugagguaggaggauuacuugagcucaggaguuugagaucagccugggccaagauugugagaccuugucccuauugaaacaauaaaaaaaaaaaaauuagccgggugugcuggugcacaucuguagucccagcuacucaggugggcugaggcagaaggaucacuugaacucaggagauugaggcugcagugagcccugaugugcacuccagccugggugacagaguaagauccugucucaaaaaaaaaaaaagaaagaaaaaagaaaaaagaaaaaaagaacuucuguuauuuaaaaggcuccauuaggaaacaagcaagaauaagagaugauaucuaugacacauguaaccaacgaaggucugucauauucauaucauauaaagaacuucuauaagucaauaagaaaaugacaagacaaaucaauauaaaaaugggcaagaguuuuaacaggcacuucauaagaugauggccauagauuccuuauuuugauuuuguaauaguccugaaauggaaauccaaauguuccaaauguucauuaauaguggaauggauaaaugaugacauccuaauccaacaaauggcagugauacgcaacaucacagauuucaccauuauuguucaccaauaaaccagacacauaaaaauauacauuguauaacuucaucaaguucaaaaacagguaagccugaucuaugauguuaaagguaggagaagggagggggaggaaugagugggcaguaacugcacaaauaguuuaaaauaacuacuuuugccuacacaugacagucuacugucauaccucuuacuacuggcuucaguaucaaaaaaagcaccuuuagcaaaauguuccagaugauuuuugggugguuccugaauauccuuagcaacuuaucccauuuaaaucuauuuuauuuuauuaaauauuuuaguauuuuauuuuauuuuauuuauuuuuuugagauggagucucguucuguugcccaggcuggagagcaguggcacaaucucagcucaugacaaccucugccuuccagguucaagugauucuccugccucagccuccugaguaggugggacuacagacaugcaccaucaugcccagcuaauuuguuuuuguauuuuuuaguagagaugggguuucaccauguuggccaggcuggucucgaacuccugaccucaagugaucugccuaucucggccucccaaagugcugggauuacagguaugagccaccgcacccagccccauuuaagucuuuaauaacauuuuccuuauacaacauauaagacaugcugacauguugauuuguaaucaacugacuaaagaaaauuuaaauguaacauaccaauugcuauagaucgcaaauaaaguuucucagcauuuucauacugauucaugucauaauuauauaaagaagccagaugucccacugaaagggcuacuucauaaucuucuugaccaagaaguuguucuuuaaucugaauugcuuugaugugcauuucuucagcuuccugaaaaacaauuaugccauaucaaucauuauacuuuuucucaucuuaacaguucuuacucaaugagcaaaacugaucuaaaugccaaagacaucuuaugaaugccauaagguaaucagaucaaagaacauacuauguuauuccaaaaauugccuaugggaagcauuacagaguuuuggaaacugcagauaaacugaugacagcaauaguauccuaugucaaaaguaacaagugaaaacuuauccugguaauaaaaaauuguuacaagaaauucacaacaaagaaauuugcaaaauuuuaagaaacuguuagaagaaauuaacaaaacauucuaaaacaaaaauuacuuccuuugguuaacacaguuaacacaguccaaaauuuaguugaaccuucuuaacaagcucuagaucauaauauguuaauuuacaugggcauacacuuucauuucauuuuuuggaauuuugacaauuuuuauuccaacaaacuaaacucaagcuaauugagggauauacagguugcuuuucagguaaagaagaccucucacucuuuacuuacugugaucccaaaauuaauaauauuaagaauuuauaggcugggcacaguggcucaugccuguaaucccaacaguuugggaggucgaggcaggcagauugcuugagcccaggaguucgagaucagccugggcaacagggcugggcaauagggcaagacccugucucuacaaacaauacaaaaauuaggcagugugguggugugcgccuguauucccagcuacuugggaagcugaggugaaaagaucaccugagcccagggagguugaggcuguagugagccaugaucacaccacuguacuacggccuggacaacagaguaagaacccauauuaaaaaauauauauauaacucaaaauucuaaaauacauugaaguuagucauauuuauugcuacaacugauaauacuuguugcaauaucugacauuucuugcacaccugccaugugccaggcauucugcuaagagcuauacuuaguauauacuaagaauuauauaucaagaacuauauacuaagaacuguuugaaauauagcaaucauauuugucuuuuuuauuuaaaaaauuuuuucuuaucucaaguacuacuuucauauauuaaucuuuuuuuuugagaugagucucacucuguuauccaagcuggagugcagaucucggcucacuacaaucuccaucucccagguucaagcaauucuccugucucagccuccugaguagcugggacuacaggugcaugccaccaugccuggcuaauuuuuguauuuuuaguagagauggguuuucaccauguuggccaggcuggucuugaacuccugacccucaaguguucugcacaccuuggccucccaaagugcugggauuacagacaugagccacugagcccggccucauauauuaaucuuuuuaguuugacauguuuccuaauuuuucaugauccuguuuuuuuuuuuguuuuuuuugaagacaggcucucacucugucaccuaggcuggagugcaguggugugaucagagcucacugcagccucaaccuuuugggcucaagucauccucuugccucagccucuggagaagcugggacuacaggugugagccaccaugucuggcuaacuuuuucuuuuuuguagagaugggauuucccuauauugaccaggcuaaucuucaacuccuggccucaggugauugucccacccuggacuccagugcugggauuacaggcauaagccacugugccuggcccacgguccugauuuuuaaauuuuauuuauauuuugacuauuguuuguuuguuuuagagauagggucucacucugucacccaggcuagagggcagugaugugaucauagucacugcagccucaacuucuugggcucaacucauccuccugccuuagucuuccaaguagguaggaagacaggcaugugccaccacaccugccuaauuuuuguagagacagggucucccuauguuguccaggcuggucugaaacuccuggucucaaaggacccucccauuucagccucccagagugccaggauuauaggaaugagccacugugcuuggccuauguuguuuuauacucacuaucuucucaauuccuuugugcaauaaguguauaauuuauuugagcuuacuuaaaauuuauuauuucagguucuauuucauuacuuaagagagaaaaauauaguaaaaacauguuucuaccuuaaauuuucucauugacugauaaagucuuccaagguuuccauaguguuuugcagucuguacauuaaauuccccaaaagcuuuuuuagcuaguuggagugaagacaggugcaaaucaugagcuucuugaagcagccucuguucaguuuccuuauuaugacaaucaauugcaaucuccucuaaaauaagugcuaaaaaagaaggcaauaaauuaguguacuucaaaaccaucuaccaaagcuaguaagaacaucuaauuuaaacuuaaauaauauaaauguuuacugaauauauuuauaugugauuaugguuuggaacuggucaagaugaaagaauuccacuuuuaacaaaaaaguacacuuuuugguggucauucuauuuugcacaguauauauauucaaauuuaagaaaaacaaugguauaaacgauuuugcagaauuagcuucuauuuuaauagacugcuauacuuugcugaugugaaauuuguuuuucaaauuaaacggaagcacaaggcaaguuuuuuaaagucaugaaacugugucaaggaguaccuaagcacuucugaaaauuuugaaaacacacuuuauaaaacauaaccuuuaaccaaacacggcuaaaagaacugauuuccuccuacucaucugaccaaccaaaucaggcaagacauuucaauuucaaagcuccauucaagacuuucaaauucuaucuaaagucuuaagaauauacauauuauuuuaccagauaauuugauuuauuggaaaacugucuauguacacaaagguaagaaaaagagauuuacuucacuguagcauuuuuuaaaaagaaaagguuaaaaauaauuauaagagucaaauaauaaagguaagguuaaauacauuagaaaaaaggauauauguagagacaugaaaaaauguaauauauuaagugaaaaaaucagauuauaaaauuaaaucauucauuuaguuaucuuauuugaaguaagaaaagucuaaaauaauauucaccaaaauguugacugaggauuggugggauuuuaaggcaauuuauuuuucucuuuucuaucuaacaucauguauuacuugugcaacuuaaaaaauacaaaccuagagggagaaaaaacucaguuccagaauuaagguagaacauauccaacaugcacggaaauaacacauaggugacccaaucauguuagcaaaauaaaugcauuacgugaaaaagccuuggugguaaucagaagaaaaguuaaaauaagaaauggaagauagggguauuuugcaagagccuugcaacauucgggguaaccugauacgaagcucaggauaagaauccugcacuacaaagcugaaguuaugaaacccaucuucuauucauguuguguagaaacauuuguauuaugcuuccaugcaauccucaaaaaaauuaaugcaugcaugagugaaugacaaaagggagagagaaaagaaagaaauucuggcuuacugauuuuuuuuucuugagacagagucucguucuguugccuaggcuggagugcaguggcacgaucuuggcucacugcaaccucugccuccuggguucaaacgauucuccugccucagccucccaaguagcugggauuacaggugcacgccaccacauccggcuaauuuuuguauuuuuaguaaagaugggguuucaccauguuggccaggcuggucucaaacuucugaccucaggugaucugccugccucggccucccaaagugcugggauuacaggcauaagccaccccauccggccuauuaacaauguuuuaugagagaugcaaacagucuuucauuaugagccacuggaaccccuuaaguagaguugugguaaaauggcuaucuaguaauacauagacaccgucaaauccugugagaaaauccuccaauccucugagaaaauaaacaaauaccccuauuuuauaccauauaucaucuauuuuaaaauaucugagacuagauuacaaaggauaccuuucacccucuuugaagaagccaaaagaagaugaucuucagguaggauguggguaaugauaccaauagcucuuucugcaugaaaucuguaauacagauagauacagucuggcauuucuuuuuaguuacaaaugauuuaggaauuuuaaaaaucacaaucuguaauauaauauugauagaaaguacuucuaaaacuaucugugguaaagauccagcuuuuuguuuuaaauuuccaaucuguuguagacugaacuuuuaauacccaacagagacucccauuucccucagaaugagaggaaaucuuuacuacagacuacaagauucuacaugaucuuucagccugcuacuucccugaccucaucuccugccauucucacaccaacccucuccgccuuccccuccagccacacaggccuagcaguuuccugaacaugcagagcauguucucacccuggcuuuacccuuucuauaaugcucuuccccugaacauucucacgacucgcuccucaggucuuuccagaacagaccacauaaaaggcccuaaaaaaauuuaccacuggccgggugcaguggcucaugccuguaaucccagcacuuugggaggcugagguggguggaucaccugaggucaggaguucgagacaagccuggccaacauggugaaacuccaucucuacuaaaaaaauacgaaaauuagccaggugugguggugaacgccuguaaucccagcuacucagcaggcugaggcagaaucgcuugaaccugggagguggagguugcagcgagccaagauugcaccauuguacuccagcaugagugacaaagacugucucaaaaaaaaaaaaaaaaauuaccaucacucucucaacucagccuacuuuacucuucuucacaacauguauucuugccugacaaguuugguuauuuguuuauggcccauaucaccaaauagaagguaagcuauuucuguuuuauugucaguuucuuucaaacaaugccaagccucccucucccccacccuccagguaaccacuaguuuucucaaaucugucuuccaauuuacuaauucucucuuuuguuguaacuaaacuucuguuuaacuugucugcugagguuuuuuuuguuuuguuuuuguuuguuuguuuuuuuuacacaggauccugcucugucauccaggcuggaguacagugaugcaaucauggcucaccgcagccucaaacuccugggcucgggugauccucccaccucagccucccggauagguggguuacagguguacacugccaugcccaacuaauuuuuuugcauuuucuuugaagagacagggauuugcuauguuguccaggcuggucucaaacuccugggcucaagugauccacccacccuggccuccuaaagugcugggaguacaggcgugggccaccacgccuggcccaucugcugaguuuuaaugucaaugacuauuuccauuucuagccauuuguuuuauuuuuauaacagcucaagauauaauuaguauaccacacaauucacccauuuaauguguacaauucaaugauuuuuaguguauucacagaguaguaugccaaucaccaaaaucaauuuuacaacauuuucauuaccccauaaagaaaccuaugcccauuagcagucagucuccauuucccuccaacuccccagccuagauaacaucaauuuauguucucucuacggauuugccuauucuggacauauuacauaaaugaaaucauacaauaugugauccuuugugacuggcuucuuucacugggcacaguguuuucaagguucauccaugcuguagcauguaacaguuacuuuaaaaucugcccuuuuccagccaggcaugguggcucacaucugcagccucagcacuuuaggaggccaaggggggcagaucacuugaggucaggagaucgagaccagucuggccaacauggugaaacccugucucuacuaaaaauacaaaaauuagccaggugugguggcgugugccuguaauuccagcuacucagguggcugagacaggagaaucgcuugaaccugggagguggagagugcagucagccgagaucacgccacugcacuccagccugggcgacagagugacagacucugucucaaaaaaaaaacaaaacaaaaacaaaaaaacuuccuguuuucuuuaugggaauauucuucauucuuucuuuuauauuagaguuaacaaaguuuuucuguagagggccagauaguaaauauuuuagguuguguuguccacacauucucugcugcaacuacugaacucuggcugcuguagugugaaagaagcuauagaaaacacaugaaugaaugagcauggcuauguuccaguaaaacauaaaacuuuacuuauaggccuaguucgucaaccuauuuuguaucuuuaaucauauaaagaacacauacuuuacagcaucaaccaaaaagaaguucugguuuuuuuuuuuguuuuuuuuuuugagacggagucucguucugucgccacgcuggagugcaguggugaucuuggcucacugcaaccuccgacucccggguucaagcgauucuccugccucagccucccgaguagcugggauuacaggcgcaugccaccaugccuggcuaauuuuuguauuuuuaguagagacgggguuucacuguguuggccaggauggucuccaucuccugaccucgugaucugcccgcuucggccucccaaagugcugggauuacagguaucagccacugcgcccagccaaaaaaaaguucuguuaacuaaaguuuucaggauucuaauccuguucauuaugucugcugacucagaggaaauauuuccuuauguuuuguaauuuuuaauggugaguucauuuuagguaaagcuucgucuaugaaaugucuguauaguuuggguugacagauaauuauuuccaagucuugcauuuucucucacaaggcaucccaggagaaccagcacccccaaagugcuuuuuaauauuuuucuguuugcagauccugaugcauuaucccuaaacucaagagcgguauagguaaauaauuauguuuugugaggcuucuuuuuggguucaacugugacaccaagcucagauggccaacuuucccugucaucuauuaauuagauagauguccaccuguccuuucccugggguuguagucccuuuuuuuuuuuuuuuuuuuuggagacagagucucacucuguugccuaggcuggagagcaguggcgugaucucggcucacugcaaccuccaccucuuggguucaagcaauugucugccucagccucccgaauagcugggauuacaagugcccaccaccaugcccggcuaauuuuuguauuuuuaguagagauggcauuucaucgucuuggccaggcuugucuugaacuccugaccucaggugauccaccugccuuggcccgccaaagugcugagauuacaggcgugagccaccacgcccggccggguugcagucuugacuuugcuucaugugaggguuucaguucuaacucccagccuccuauaggcuguuucuuaaaccaagguuacagaaaucuguaaacuuucccaucaccccagagcaguuauaccacaggccauacuuaauccuuuaaauuuuaguguccauuauuggcccuugggggauuucccccucacucuugcaagcucaguuauauauuuaaaaagacaauuguuauucaguauuucuauguguuaucaccaagaaguuuuuagguuauuaaguuugcuacuguauuacucaaaaauuauugaaggaaauacucaaaacauaaguuauauucugcaugaaaauauacaagucucaauaguaaaucacauaaaggcuaaaugaauaaccuauaaauuaguaugacuuuauuuauuuuuggaaacagggucucacucuguugcccaggcuggaaugcaguggugugaauaugcuucgcugcauccuugaccucuugggcucaagcgauucuccugccucagccuccagagaagcugggaccacaggcaugcaccaaaacguccaucuaguuuuaaaaauuuuuugaguagacagggucucaaacucuugggcucaagcaaucuuuccaccucagccucccaaagugcugggauuacaggcgggagccucugcaccugaaaacugguaugauuuuaaaugacuucaagaacauuuuaggcauucugauaaagcuccaggaagacaaguucaauccauaaaguauaucaaguacuauuauuaauguaauaauaguucccuaaugggaaaaaacaaaauaaaacaaaaacaguauuuccuccuucagagaaaaggaauguggaacuuacagugcauugucaaauuucccagagcuauacugguggacauaagaagaguaggccaaaucuucaugagcuguugcuacguggauauuuuugccaccaaacacugacugucuaaugucaagggcugccugaaagaaucauaaaaauauuugucaauacuguagaaaauaccaccuaguuaaauuaaacauccuaguaauuuaaauauauaucuauaugccuaacaccauaaaauuuugaagcccagaaaguccugcuguauuuaaauuacagaacaugaaagucaccuagaaguccugaauuucugaagauacgaguuugacuuaaaaggccacggcuuaauaauaauaauaauaauaaucauuccuaugucuugagaaucaagacauugggaauguuuugcucuguuuccuucuucaaaagugaaccuuaggccaggcgcgguggcucacaccuguaauccuaguacuucugggaggcaaagguggguggaucaccugaggucaguaguucaagacuagccugggcaacaugcugaaaccgccucucuacuaaaaauacaaaaauuagccgggcauuguggcacgggccuguaaucccagauacucaggaggccgaggcacgagaauugcuugaacuugggaggcagagguugcagugagcugagauugcgccauugcacuccagccugggcgacagaucaaaacugugucucaaaaaaaaaaagugaaccuugaagucaaguaugccuugucuacagcaauggcauaauacaucauuuaccugagaaugaguaagaaagaccuaaaauaauuaucagccaucuuuguuacuacaaaggcaguuuuagugacauuugcuaaaucaacaacaaagacaagccauuacauggguaaauaaaaaauggaaaacuacucccacauaugagcucacaacccaauaauuccuuuccugaaugauuuucuuuaauucccaaagcauuaacuuuuacaccuucuagguaauacuuaauaaaauaaugaugcaaccuauauuggugggcgggguaguugucaaaaagucauuuuuagagugguuuauacaccacaaacaaauacaggucagcaagucaauacagguugaaagaaaaaaaggguaaccauuaacauaccugauaaauugcaacagacugacagauauuaucuacauugaguaaguagaacccauaaucuagcaguguaucagaauauuuuggguguuuggauccaaaaugaucccuauaaaaagacacaaaauuauuaggauauaaaguauagagacaauuuaaaaggauauuuuuaauaauaaucaccuaccgugccaaauacacugcauguuuaauuaacuguucugccuucuuaaauucacguuuuacuacacaagccuaaagauaaagugaaaaaugguuaacucucaaacaguucauuagugugcuaaaauacguguaguuuauauauucuggcuauaagaguuaauaagaaaaaaaacccuccaaacauaaauacaaagguucuauuuguaauuucuuuccuuccaaguacuuaaaaauucuauuauaaacagaucuguauauaagcugggaaaauuauaaaguuuaaaauuuugacagucaguccuaguacaaaucugucaaaacaaaguuaccuuacaaagcugguauacccccauuuuccgcuauuauuaaaauaaaacaaugggggcagaauuuaccacagcauuuucuaagguccuuauaucccaguccuggaguggcugacaacaaucuuuuguuauuuucauuuaauaauuuuuaaaugcauagaauuucaaguuuuccuauuaauucuuuucuuaagagacaagguuuuauguugcccaggcuggacuugaacuccuggcuacagggaugugccacugugcacagcucucaguuguuauuuugauccaugauuauagcuaggcauuuucuaaaaacucuaaauauaauuugcauauagaaauauaaaucuuguggccgggcacaguggcucaugccuguaaucccagcacuuugggaggccgaggcgggcagaucacaaggucaggagaucgagaccauccuggcuaacacggugaaaccccgucucuacuaaaaauacaaaaaauuagucgggugagguggcgggcaccuguagucccagcuauucaggaggcugaggcaggagaaugaugugaacccuggggggcggagccugcagugacccgagaucgcgccacugcacuccagccugggcgacagcaagacuccaucucaaaaaaaaaaaaaaagaaaaaaaaacccagaaauauaaaucuugcauaaauauuauguugucuuuauauuaauauucaauuauuucaauuaauuaaaaacguaagaauaucccuguucuagcucugauaacuuaaauauuuaugcuguuuacuuacucuaaaaugacugauuuaauaaauuucagagaaauauuagacucucucagaucuauaauuuuggaaucuauuuucuaguugaauuuccauaaguaaaaucaaccaaaaugaaauauucaaaucugagaaacuucaggguagaagaguguaucugaaaaguacauuaaugcuuuaaguccucacugcaccaaaggaguaguuuuaaaauacuacuaaauguccucaaagaguuaacgcaggccaaccgugguggaccuguaauccuagaacuuuuggaggcuugccuagaacuuuuggaggcucaggugggaggaucgcuugaguccagguguuugagaccggccagggcaacauagugagacccugucucuauuuaaaauaaaauaaaaauguaaaagauuuaaugcauuuauuuacagaauaagaaaacacuagagaaaaaucaaguaaggacugccuagcaggucaaguauagcaagcugccuugcugugagacugcaauacuaugacaaagagauuuaacaccaggcuaucuuuagcagaaaagugaccaaaguucacaggauuuuggcauaaggaauucugguugcuauaaauauuuaagaaaaacaaaaacaaacucaagccagaauagcacccaaauacuacuuugagcuguacuuuagugcacugaaacaaugaucaaaaugaauuauuucacugguuuucuugguaaagaaaaauuggcuaaaaaucuaugugugauauaguuuuaguuagaaaccagauuucuaaaaaugagcacagaaacuuauaaaacagaccuaugccuacggaguguacaaauaacuaaaauguuaaauaacagguuaauuaaaacaaacuuaaagccugauaaauccuauaauucauuuaauaauuuuaacauuauauuuaccuuagaagcuugucuuaagacauccaccacaacuuucacugguaagccugcuguaauuucuuucauugccucgaugcaccauuuguaugccuaaaaaaauuauuuauagaagagacagaacugugguuaaaucaaguugacaauauuuaacaagaugacugcaaaauuuuucuacaagcacuuaaauaagaacacacacaaaauauuuacaguuagaauuuucugaggcuaaacuuucuucaaaguauaaaucuguuauauuauuuuuacucuuaauaucuauagcuuaucugaaucagacguuguggauacaugacauaucuucuggaaaucagagguauguucucucuugcccagaagccuuugcacauacuguucccucugccuuaaaauacauucccccuuccuccaaccccuuaaacucaucugucuugugggguuuccuguguuuuccuauacauuccauccuccuauuguaacauuuguuauuuuaugucugaauugucuguuuaguugaguguuuacuuugucccagcuacuguccaaaguauuuuaugugcauuaacacauuuaccugacaaaacagcccuauaagauacguacuauuaggggaaacagguguagagagguuaaguggcagguaaugugcuaguaucuagguaugaagugggaaacaaaaccaaaaauguccuuccucuccuggugcuuaguggaagaaauaaaaaaggcaaaauaaauugucuuaggcuggguguaguggugcauaccuguaaucccagcacuuugggaggcugagaugggaggaucgccaagcucagaaguuugaaaccagccuggguuauaacauagugagacuuugucucuaucaaaaaucaaaaaaauuagcugggcguggugaugugcaccuguaguuccagcuacuugguagagcugagguggaggcugcagugagccgugaucaugccacugcacuccagaccuuggugauggagugagacgcugucucaaacaaacagacaaacaaacaaacaaagacaaguguggccaugugauuucuuuccacaauuaaaauaugagaagugaaaugugccacuucuggaagaaaaguccaagagccggcaguacuucuccaugaaguuucugccccugugcccaggcugguaauguucuagauagauacguuccagauagacccaaaaccacgcugugucuugaucaaagcguagguauaauguuaagaacagccauagccaucugaagacagggauauauuaugagccagaaagaaacuuuuauuguuccaagcuauucugggguugauauuaccucugcauaaccuagccuauccuaacacaaaaacaugaugcuaauucaucaaaccaugucuguaagauuuguguacuuuucuguagauaucagugaaaagcuuauuuaucacuagaagauugaacugucaaaauuauccaagacuucaacauuccucacgaaugugcugagagcugcaaagacaugaauaaggcacaguauaaaccccuaaauccaaauguagaaggaaaauaacugucaggcugggcaugguggcucaugccuguaaucccagcacuucaggaggccaagguagaggaucaccugagcccaggaguuugaguccagcgugggugacaaagcaagauccugucucaaaaacuacaacacgaggcccaaccaaacaauuuaggcaaauauuugguuaaauuaaaagaaaaacaacaaaagaaagggcucuaaauuacacauguauauauuucaaauucaccucacaaacacuccuuuugccugauuuuuuauuuuuuugagacagggucucacucugucacucaggcuggaguacagugguauaaauauggcucacuacacccucaacuuacugggcucaagggauccuccugccucagccucccauguaguugugaccaccacaggcgugugcuacacaugcggcuaauuuucuauagaggcagggucucucucacuuuguugcccaugcuggccccaaacuccugggcucaagugauccucuaccuuggccuccuaaaguucugggauuacaggcaugagccacagugcucggcuugucugauuuuaaauuuuccauuacaaauguguacugccuuauauaaaccuaauauguaaaagagaucuguaagaaaaauaagagaagacuauuugauuuacccucuguuuuuauagguacuuauuggucacagugaaauguaccuuaaaacacuuaccucaucauagugacuuuuugcaaauaggagugcacacaguucuccauagagugcagcuuuauuugcuugcuggccauguuuugauaguuuauccauauaugucugagcuaauuuaaauguuucuucacccaaaugauauuugcaguuuccauuucgcacaugaagcaaccuauaaaacaccaauaacauugcucuauuuuugauauuuucagcuugguagaccugaugaccucuuaccaaucaccugaaugacuuaagguaauuaaauacaauuacaaggcagcauugaaaauaaguguguggcccaaauuggaguugaccucaugcccauaaagaaguacaugcucuuuccugaaagcgucccauaauucaucucaucaauuguugauuccuucucuaaauauuuuauauauuuuauguacucagcauguacugcaucuaaaaaaaugacauuuaaucuuuuuguuccaaauccacaaguaauauagcuucaguauaagaaacuuggaaaauaaugaagaaaauaaaauugacauaaaauaucuucuuuucuuauuuuugguauagucuaacacuugaucaguuaccacuuauuucaugaugcuucauaauguucauuuuuuccaauaagauaaauuuaccgaaaauagcaguagugucaacuauuucuuuuaaaaucuuuauccucuauaguagaaauacagaguucuuuaaacaaauuaacuguacaacuaugcugacuauuuaaugauaugcaaaaauaguacaaugcuuuagaucagacuggucuagauagcaacagacuguguaucuauauagacuguacaagauaggcaaauaguguuaggacuggacaaauauuuauuuauuuauuuauuuauuaaaugcuagcuagaacauuauguucauguaucaagccaauacaacuuucugaaaaugcucagacugagaaggaacaaagguauaaaagcuauuuaaaagaaaaacaaggauggacagguuaggaaguauuccucaggagcaucaaaucaacagauacaaaaaauuuauuuuuucuaucuauaccacaauuauuaacagauuaguaacucauaaugagaaaaauucagacaaucuuuuaaucucuaucauuccucuguauagucacagaaacagauuaacuuccaaagaaccaggacuaaucaauaaagugaugacuacuauacaaugccaauguguauccucccaacacguaccauacaauuaucugcaaaaucuauuaccauaagcagcuuauguucuaguggugagaaggguauuagugugggcaaagauaaaauacguaagacuuucauuuaaggauaaaugccauaaagaugauaaaaaaguaggguaauaugaucaaaagauucugaaaggagguauuuaggguagacagggaagaauccuccugagguaguaacauuuaaguugacaucuaaaugaugacacuguagccagccaagugaagaucugguggggaagcauguuccaaaacagaaggaacagcaaaacagaaggaauagccccugagaagggauggggggaaauccuggcauagucaaaggaacagaaagaaggccaauucaucuagacuacagugaauaaaagauuauguaaagagaaaugagaagggagagauaagcaagauuuuauagcaccuugcgggccguggaaaggaguuuuguuugcaacaguaagggaggugauuugacuuaugcacuaucuaauauaauuuccugagauguuagaaauguucuauacuuguguugcucaauuugguagccacuagccacaguggcuacugaguauuagaaaugugccuagugugacugaggcacauuuuacuuuuaauuaauuuaaacuuaauaaucacauaugguuaauggcuaccauaugggacaaugcaacucuaucaagaaugcucuggcuacacucuggcuauagcaaagccaagaggggaagcaaagcaaccaaggcagaagauacuguaacaguccagaaaaaaaaguccuugagaaaaaaaggauuaguauuugaaacacagauuugauagccaaaugguugaaagagaaaaaaaugagaaacccauagguugaaaauuuagagaauaaaaagaacagugcuuacuucucauuuccacaaugcuaagaauuuccuuuccaaagaccuucacuguaaguauucuccugaaauaacaaucuguggaaauuauuuaguaauuggcacaugaugaaguagcaaaauaaacacuguaugccagaaaggcacagcuugguauuuucuccagucccugcugaaugucuauuuaaacaaaagggcaaauuaaacauauggagacucuuuagguucuguguguccaucugggcugacacuaagcaguauauugaauccaaggaacuugugguccaacuuauuauggucuaauuuuaucccaaccuucugccuaaggaaaaaggagguucucaaaauguggcacuaccauguaaacacaguauuuuacuuucauaacauaaaauuaugucuaccugaucaacaccuacugucaagaacaauuacuauuugauugaacuauucauuguuuaaaaugaaaaauauacaaauguguaagucauuaguuuacuaauauauuuaccauaagacugaacaugacuaguuagagccucaucagccagacaugacgaaaguaaaauacacugaaagugaaccuaaaggaaaagaauuucucuccuucuuguaagugucuuuuucuuagaacuaguuuaucccagcacuuugggaggccgagguaggcggaucacgaugucaggagaucgagaccauccuggccaacacgauccccgucucuacuaaaaauacaaaaaaaaauuagcuuggcaugguggugcgugccuguaguuccagcuacuugggaggcugaggcagaagaaucgcuugaacccaggaggcagagauugcagugagucgagaucacaccacugcacuccagacuggcgacagagcaagacuccaucucaaaaaaaaaaaaaaaaaaaauuggaaauaaaugauagcuugaaaggggagagcugcauaaugaaaauaaagaccgguauggguuuaauaauuuuuuuuuacuauggugaaauauauauaaaacuuugccauaugagcuauuuuuaaguauacaauucaguggcauuaauuauauuaacuaugucaugcaaccaucaauacuauccacuuccaaaacuuuuucaucaccccaaacagucccuaguaaccuuuaaucuacuuucugucucuaugaauuugccuauucuacauauuucauguaaguggaaccauacaauauuuguccuuuugugucuaacuuauuucacuuaggauaaaauuuucaagguucauccauguuguagcauguaccaaaacuggcugaaucauuguauguguauauauguaaaugccaaauuuuguguaucuauuuaucugcugauggauacuuggauuguuuuuaucuuuugacuugugaaaaauucugcuauaaacacuagcacacaaauaucucucgauuccuugcuuucaaugcuuuuaggcauauacuuggagugaaauugcugagucauacaguaauucuauguuuagcuuuuugacaaacugccaaacuguacuccacagcagcugcaccauuuuacauucccagcaacagugcacaaaguuuccaauuucuuuuuuuuuuucaaaugcucucucagcagaaucacuugauuucuucucauccuugccaacaguuauuuucuuuuuuuuaaacuguacccaucuugguaggaauaaagugguagcucauuauguuugauuuccauuucccuaaugcugaaugacacuaucuuuucaugugcuuaucuuuucaugugcuuaccggucuuuuguguaucuuccuugggaaaaugucuauucaaguccuuuguccauuuuuuauuuuuaauuuuaugagacagagucucacucugucacccaggcuggagugcaguugcaugaucaagcucacuacagccaugaucuccugggcuuaagugauccucccaccucagccuccuacguagcugagacgacaggccagugccaccacaccuggcugauuuuuaaaaaaauuauuuuaauagagacaaggucuugcuauuuugcucaggcuggucucaaacucuugagcucaagaaauccuucugccucagccucccaaagugcugggauuacaggugugagccaccaugcccagccugcucuuuauuaauuaauuaauuaaauuuuuaacagaguuucgcucuuguugcccaggcuggagugcaguggcacaaucuuggcucacugcaaccucugccuccuggguucaagugauucuccugccucagccuccagaguagcuuggauuacaggcgccugccaccauacccagcuaauuuuccuauuuuuaguagagauggguuucaccauguuggccagacuggauuuuuuuuuuuuuuugagauggggucuugcucuguugcccaggcuggagugcaguggcacgaucucagcucacugcaaccucugccuccuggguucaagcgauucuccugccucagccuccugaguagcugggauuacaggugugcaccaccacgccuggcuaauuuuuguauuuuuuuuuucaguagagacagaguuuuaucauguuggccagacuggucucaaacuccugaccucagaugaucucucugccucaaacucccaaacugcuuggauuacaggugugagccacagggcccggccucauuuuuaaauucuguuguuuguaguuguaguucuugauauauucuggauacuagaaacuuaauugacaugugauuugcaaauauuuucucccauuccauagguugucuuuuuauuuucuugauguuuuugauuuacaaaaguuuuuauuuugauuaaguccaacaaaucuauaguuuuacuucuuccuuuccaauacugaugauuuuuauuuuucuugucgaauuucuucugcuaaagcuuccaguacaauguugaauaccacuagugaaagcaggcaacuaugucuuguuccugauccuaugggggaagcuucuagucuuucacuauagaguaugauguuauugugaguuuuucauaaauacucuuuaucauauugaagaaguuccuuucuauuccuagcuuugugaauuuuuuuuuuuaaucaugaaaagguguuagauuuugcuaaaugucuuuucugugucaacugagauaacuggguuuuuuuuuuuucccuucauccuauuaacaugguguaucacacugauguucuuacguugaaccacccuugcauuccugggauaaaucucacuuugucauaguguaaaauccuuuuaauauucuauuagauuugauuugcuaguauuuuguugaggauuuuuucauccauauucauaagagauacucgucugaaauugccuuuuuugugaugucauuuuuggucuuugguaucaggguaacguuaaccuuuuaaaacgaguuaggggcugggcgcaguggcucaugccuguaauccuagaacuuugggaggccaaggugggcaggucaccugaggucaggaguucgagaccagccuggccaacauggcaaaaccucgucucuacuaaaaauacaaaaauuagccaggugugguggugggagccuguaaucccagcuacuuggguggcugaggcaggagaaucgcuugaaccugggaggcggaaguugcagugagccaagauggugccacugcacuccagccugggcaaaagaguaagacucugucucauaaaauaaagcaaauaaaaugaaaauggaaacaaaaacaaaaacaaaaacaaaacaaaacaaguuaggaaguguuccuuccucugcaauuuccuggaggaguuugagaagaacuagugcuaauucuuuaaauguuugauagaauucacuagugaagucuucaguccuggacuuuguuggaagguuuuugauuauggauuuaauuuauuuacuuguuauaggucucguaagauuuucuauuucuucuuggggcauuuagguaaauuguccauuucuaaaaaauuuguccauuuuauuuauguuaucuaauucacugguguucaacuguucauaggauucaccuuaaauccuuuucauuuguggaagguugguaguaauguuccaagucccauuucugguuuuaguuauuugagucuucugucuuuuucuuuguuagucugguaugguuuuaauuucaagucagggaggacaucagugugagaguguuucuucugcuagagaacguggaaucugcaccugacaccucaaaccauggcagcaaucuuacaagcacuggagagcuagccaaagaaaugacugguacacaaagaauuagcagacagauugaaagaaucuaguuccuuaauaaccucuauauauucagaauuaaccuacccuggaggcccuuaacauuguacugauuaucuuuuuaucaaaguuuuuguacuuuuaagguacacugcuuauguagguggcuccuaucuuauuugcuacacauagguuuaugacauuuuugugaauuauacauucuauuaucaauaucccuuuuguauuaacuaaugacuuuuauccugaauucuuccuuauuguuaguauuauuguuuugggguguuuccuuuuuaugauauagcacuaguuuuaauuuuuuaacccucuugguaacugccaucuuuagguaggagaauugagcccauuuacauguauugugaugauaauuauauuuggucuaaccuuuucaucuuauuuuucacuuaucauaaucaguuuguuccucuauucacuuugcuuauaucuagcuuggucaaguuucaaaucauucucacccauauucacaccacccuaguuuggaaguucuaucacacuuuucuauuacacaaggcaucaaaugcccaucucuagcacugauaauguuuaaacuaaauaaugaugcccuuuccuacucuacccacuaagaugagaacucuguaacacuuuuacucauccauucucccaaaugcauauuuuaaaaauaggcuauaugucuauuaaaaaacaaccugaauguaagaugaaccuccauuuuccaucuaaaaauauuuuugccaacucauauauaucaaguuuuagggauauaugugauaacauuaaaacacuuauaauuuauauuuaaggccaggugugguggucaugccuguaagcccaguauuuugggaggccaaggcaggaggaucacuugagcccaggaguuugagaccagccugggcaacauacugaggucccuuuucuauuaaaaacaaaaagaauaaaaauuuauaacauuuaaaucuuuccuuauaccaauauauuuaaaaucuaaauuaaauuuucaaaaaucgcuuuuccuccucacaauuuacaaaacuuuauccaaauuauucacauguaccuuaaacauuuagcuucaucaucaccauaguuauuugagucaucugacaguuuuuauuuuaucuuuuaaauaaauccuucuuuggaaugacagcuuuuuagaguaaaacauuuucacuuguuugaaaaccaguacuucugaaucucuguaugaugucaucagaaauuuaauccaaagcuaccaguaaccaucugcaaagcauuaggacugcugggcuuuucaauuucuccuauggcaagcagauauccaggaucuccagaacugaauuacuccaucacuuuucaaaguaaucuuuaaaaagccaguuaauaaaauuauccaacucuuaaaacuauaaggucaugaccuccagaauaauucuaaaucuguuaaauuucauuuuuuuuuuauuuuuuuuuuuugagacagaguuuugcucgucgcccagguuggagugcaauggugcaaucuugacucacugcaaccuccaccucccagguucaagcgauucuccucccucagccucccgaaguagcugggaucacaggcacccaccaccaugcccaguuaauuuuuuuguauuuuuaguagagacaggguuucaccauguuggccaggcuggucuugaacuccugaccuuaggugauccacccacccuggccuaucaaagugcugggauuacagguguugagccaccccgcccagccucauaacuuauuuagaaagaaaauuucacuaggugaucucuauaaagcuuccugacaucagcacuaacugaaauuucagcuuaacauuucuuuccuaaauacuacuuuguuguucaaaauacagguugaguauccuuauuugaaauguuugggaccaaucauguuucagauuucaaauuuuuggauuaggaacacuaaaccuguaauagguuugacgugguaaauuuuuguuuuuuguuauuuccaaaauuuccuuuucaucucugguuugaaaagaauccucauuuaaggccuauuacaaauucucaauuuguucuucauucucuuccuacuccauuuacaugugagacauauauuacaauauucauuaccuaccacuguuuuuauacugucuuccccuaccuugggauuuguuauuauuaauuuaagaacuuaaauaaaaguuuaaaauuuuuauuuuaaaauaaaauagaggccaggugcaguggcucacgucuguaaucccagcacuuuggggggccagggcaggcagaucacgaggucaggagaucgacaccauccaggcuaacauggugaaaccccaucucuacuaaaaauacaaaaaaauuagcugggcaugguggcgggcgccuauagucccagcuacucgggaggcugaggcagaaaaaucauuuaaaccugggagguggagcuugcagugagccgcgaucacaccacugcacuccagccugggcgacagagacuccaucucaaaaaaaacaaaaacaaaaaacaaaaaacaugacucagacauaacaugacaugacauaacauaacaugauaguuucauuauauugcccaggcaggucucaaacuccuuggcucaaacgauccuccugccuuggccucccaaagugcugggauuacaggcaugagguaccaugccuugcuggaacuuauauuugguuacagaaguuccucgauuauuucccucagauacgguacauggagauauacugggucuucauguauuugaaaauuacuucuuuugcccuucaaacuggugagguacaguauuuucucucaguaacuaagauacugcuacuuucuucuagcuucuaauuucuauuuaucuuuggauuucaggaaauucagcugcccaggguucucuuucaauccacauucaacucuuuauacacacacacacacacacacacacacacacacacacacacacgcuccccaaccccaccccacaguccaguaguucaagaaguucuuuuuauuauuuaaaaaaacccaccaaaggaauacaugucaaugguuuaaaaacauaauaaauaguagaaaaggauuuaaaauaaaaaguaaguuuguucugcccaacucucacaagcccaaaagcaaucucuguucccuuaucuggagguucuagagaauuccugaccuuaaacaaaccaugcucacauggacugauuagcuccaaagaaaaaacugaaaaggggguugcgggugugauuuuaaguuugucaucccccaaaaacaagccaguucaguaacuguaguuauuucugagcagcaggguuauagacaacaauuuucuuccucauagcuuucuguauuuucuggauguguuuggccagacauguauaagcaagaaaaacaaagccauuaaauagaaaaugaauaaauggaaauaggcagagucuccaaagaauacaaaaggacugaaaaaugguaccaguuuuaacuacuuucuauuaagaaaggcuaggaagguucucugaccuuuguuguauaauguuuugauguuagccccauauuagaaauuggcuuugugacauuaaauugaaaaauauacuuuuauucuugcaucaggcucaaagccccugggauuggccaaagcauuugauuaguaucuguugugcaaaacacuucuuuucuaauucaauuaaacacauggucaauuaauaccccaaauuucucucugccuuaaaaaaaggcuaagucauaaaauuuuaauaaucuuuucaaauaauacuaaguagaugaaaaaaauuacuuauuauaaauaaauuauauuaaauacaccuguaacggccaagaauuuggcaagguuaguugaauagaggcaaauuuuauugugaaauuucaaauucauaaagacauaaggucuugguauacaggcagugagcuggcauuauaaauggcuuuguuccuugguccagacaauauucuaguuucacaugugcuugcuaaaaagacagcuaguucugaauuguuaauuaucuauuguuuuuaauuuauuuuaaaauuuuuuauagaaaugaggucuugcuggucuccaauuccuaagcucaagcaauccucaaaucuuggccucccaaagugcuaggauuacagucgugagccacugcacccagccaguuaucuacccaauauuccucauguuuucuuccuuaauguagacccaugaguucauucaugcacaauuaaaaauguuuugcuccucagacuauacuuauuacacagauuagaaguuguguagaaugugucccaguuuccaguuuaaaagacaaguaauccaagagacaggguuagacuucugggaaagcaauuuuuuucugauuuaaaaaagagucagcuggcaugcacuuuuugaccuccccucuucuuacugccuauuaacacuugcagccauaaugaugugagcuacuugcuacagaugacaaacuaggaaggagagaaggagacugacuugucuugugagaaaacuaaaccuuuugguaaggcuaaagccaaauuuauacaggaaccuuaaaaucagaagaaacacagguauuugggugaaauaaaucugaauaugugaauaaaaaaauaaagcacauacaaaaaagaaaguguuuuaucuuuuggucaagauugccauagugaauaaucuaugauaaaaaucauacaaaauccccuuucuguuccaaauuaaccaguuuauguacauagcaauauauaacuaaccucccaaaucccauaugggauaauguagucuccuauuccuaaaaauauaaaauaggcagaagagggggaaaaaaaugagagauuauuuuuaugaguacuauaaauuauagggcuaaauacuaauccuuuuagaguuucugcacacaaauauuccuauaauuuaucauacacuuccaaaguauaugugggaaauuaucaccuucuaaaauauuauuuauaauuaaguuugcauauuacaaaauuaacuucaggauugaaugucugucugacauagauaagccuuguauaaaaaaggucaaugacagccucaaaagacugaaauccaacuggccaaaaaaaaaaaaaaaaaauagaguuuuacucaauuuuagcuuaaagcaacaauaaucuggcuggguguagagguucaugccuguaaucccagaacuuugggaggcccaggcagaggauugcuugagcccaggaguuggagaccagacugggcgauacagcaaaacaccauuucuaauaaaaauaaaguaaaaaauauauuuaaaaaaaaacccaaaacaaaaauacaaugguuuuauaggagaauauucuagguuugaaaggguucagauucaauuaacucaucuaaaaaauaccuaggaaauaugaaccuuaauuccauaaaaauagaagacuguaaauucaauaaauugauuggacuuuaguuaccuuacgauaaagaauuucugcuguuuaauuuuuugacuuuauuuuaauuuuccuuuaguuuuauauaaaaaaauacuuuuaagaaaugccaaaucaaauugggggacaaagagaaaaccuguaugaaaauagcuaaagguaaauguaacaugcagaaaaaaauaaggacaauaaagcagaguuacuucuagauuugcuugacuuuaaggaaaucuguaaaaaaguaauaaauguauacucaaagaaaaguuauucauaaguaaagcacuaaucuuguuaugcacaauuauggaaauguaaacaaagcaggggguacaaaaguaacaccaaagaaaaaguacauuucuggaguuuccgagcauccagugucuaccacaguuccuaguacacaagcauucaauaaauauuuguugaaugaauaaacaaacaagcucuaugacaaagcaaaaagauauguaagaaacacauucugggccaggcacgguggcucaugccuguaaucccagcacuuugggaggccaaggcagguggaucaccugaagucaggaguucgagaccagccugaccaacauggcaaaaccccaucucuacuaaaaauacaaauaauuggcgcaugccuguaaucccagcuacuugggaggcugagacaggagaaucacuugaacccaggagguggagguugcagugagccaagacugugccacugcacuccagccugggugaaagagcgagacucuguuucaaaauaaaaauaaaaaaagaaacacauucugguucauaauacucaaaucuaaccuaagcugucuacagcagauuaacuauauuuuagagaugagaggaugccagacuagugaaacuaugacauauaaauaucaucucagagauuuacucaaauguuggcauauacuuauaagagcuaaaacuauaaaagccacuaaauacuguuauagcacguaauuacaggauauguuccaacuuaccucacacaacauucuacugcacgaaaccaaugaagcaucucaucguguagaguacacaacugaaggcaggacagaaaaacuuucucagcaucacuguaccagccugcaucugaaagaaagccaccuaaaaaaauaagaaacaccaauuuuagaaaacuugauaaauagccugcaagauaaaaugacaugcugacagugaauauuaccuaaauuaaaaauaaaccaugauaguaaaaucuuguguuuagcauacaacacagguaugaacugugagauuuuuauauaaagguuuugaacuacgggaaggaggguuaaggcuaagaccuugaauaaggagucaaaaguuugaaccuucuaagaauacuccauggccuaagaguuguuacuuuccagcuaaugagcuaacuaaauuauuuuacuauuuucaucuuggaguguacauauaacuuuagcaucucccaauacacaaucccaaagaagauaaaucugaauauacuuaguauagcagcacauaacggaggauacacagauaaaaaaagacugugauccuuaaucgauuaucuuauuauuuuuuuaaacaagaaauuacuguccugggcaguauuuccucagcauauuaucuuuuugaggauucugccuccuaaauaugacuaacauuuaauacacuguuacuacaccauguaaaacacuucguauugugguaacuacauaacuacacgaacucacucauuuaacuuucacaacacaccuucgacuuaaauaacugccccaacguaacagaugaaaacacuugagucacagaaaaaccaaagcuuauaauccaguaagugaaaagauucagaugcacacaaugugacuucagaggcuaagucuguagucccuauacugcaacaguuauuaaggaauaauuucuuagugcuauucaggauuaguuacaauaaccagaaaacacaaaguaacauaccaucaugguauguucuaaaacacauuuuuuugcacauuaaaaaaucucugaaauuaucugagaccagccugggcaauauggcaaaauccugucucuacaaaagauacaaaaguaagccggaugugguggcgagugccuguagucccagcuacucaggaggcuggggugggagaauggcuugagccugggaggcagaggcugcagugagcggagaucacaccacugcccuccagccugggcaacagagccagccagaccuugucucaaacaacaacaacaacaaaacucugaaauuagaguacgucauaaaaguaaugguauauuacaauaaguggcuuuuucuuggcacacaaaaaauauggugucuuaauaguauuaauguaugaguugacaaaauauuauauuuugcuuagacucauguuuuauauuuaauuaaaacuacauguaauuaagcauuuuuuuaauuggagagaacugugcuuuaaaacuuucuagcuuccucaccaaguugagcagaauaaugagauuauucauauucauacuaagcaauauucuacuuaucaucccaacauauuguauauugugcugguuauuagaauacugucucucagcuucaaacccauacuacuagagucuguuugaggaugcugagcaaggacucugcaaaccacauuucuccuuugcuagcuggcuccguuuggcucagcgaauaggaggcacuggagaaaugggcugcaugacuggaagagcaauggacacucuccuuccuguaucuguuagugagguuccugcugacaaaaacaccccagggugugcuucuuuucuuuggugguaguucauuccauuaaauaauagucaauaccaguugcaguuuuccaaugcuugcaaaaccaguuucacagcacuccaucaaacaucagcaauagccauccagguugcuccuccuagaggucuagauccuagacccacgggcccucuuuucagaccucugaggcaccaguaacagccuagcaguaucccagcuucauggggcaaaccccuccaacuccuacuuuuuaauaauuccaaucucuuuccuugguuccccaagccauagguaugguagccaauucucacagcugcuuuguccauaauacccuacuguucccuuuuugccucuuuaguucucuaguaucugguuaaaaacgauuuguauuaggccagguacaguggcucaugccuguaauuccagcacuuuuggaggccaagguggaaggaucccuugaggccaagaguucaagaccagccuggguaacacagugagacccugucuccuaaauaaauaaauauuuuuuaugcugauaauugauuuuauagccuagugaaaugaacuauucagauauaacaucuacuucauccacaucuuguugagaaggagaaaauuuauacaauguacuuaauuuuauuugguucuuaguuugacaaucccuaaaaauuuagguuuauucuagagcaugacaaagucaaaacuuguaauauugacccuagaauucaccuaaacucaaggaaaauacuacaauagagcugggcuucagcuaagucaaauccagaaccaaauuuauuuucucuguucaaaacaaaugagauccuuguuuucaaaagaaguuaggaaaagaagacaacagcacaauuguggcagcuguuacagcuucuuacaaugaccauuugugcuugaaaaugaaguggacauuugcuguuaauagaaguaucaauccaguaaccacaggauagguuacuauuucuuuuuuuagagacagaguuugcucuuguugcccaggcuagagugcaauagcgugaucucggcucaccgcaaccuccgccuccuggguucaagugauucuccuaccucagccuccugaguagcugagauuacaggcaugugccaccacgcccggcuaauuuuguauuuuuaguagagacggguuucuccauguuggucaggcuggucucaaacuucuaaccucaggagauccgcccaccucagccucccaaagugcugggauuacaggugugagccaccgcguccggccggguuacuacuucgauuaaaaacuuaauuuuaagaaauguguuccuugacuauaagcaucaaauuaaauacuuauaaacaagaaauaaaugaauccaaaccauuuuaaaaacauauuccuguuaagaaauguuuaauuuucccuuugaauagccucaucccaauaaagauguggccugucagaaaagggcuugaauguccagggugauaguccuacuuaguaaugcaguccuuucuaaaagacaauucuuuuuuauuuuuuaggauuaaaaauuuauuauuauuauacuuuaaguucuaggguacaugugcacaacgugcagguuacaugugccauguugguuugcugcacccaucaacucgucauuuacauuagguauuucuccuaacgcuaucccucccccagaccgccaccccacaacaggcccuggugugugagguucccugcccuguguccaaguguucucauuguucaauucccaccugagugagaacaugugguauuugguuuucuguccuugugauaguuugcucagaaugaugguuuccagcuucauccaugucccuacaaaggacaugaacucauccuguuuucuggcugcauaguauuccaugguguauaugcaccacauuuucuuaauccagucuaucauugauggacauuuggguugguuccaugucuuugcuauugugaagugccguaauaaacauacaugugcauaugucuuuauaguagcaugauuuauaauccuuuggguauauacccaguaaugggauugcagggucaaauaguauuucuaguucuagauccuugaggaaucgccacacugucuuccacaauaguugaacuaguuuacacucccaccaacaguguaaaaguguuccuauuucuccgcaucuucuccagcaccuguuuccugauuuuuuaaugaucaccauucuaacuggugugagaugguaucucacugugguuuugauuugcauuucucugaugaccagugaugaugaguauuuuuucaugugucuguuggcugcauaaaugucuucuuuugagaagugucugcucauguccuuugcccacuuuuugaugggguuguuugauuuuuucuuguaaauucgcuuaaguucuuuguagauucuggguaucagcccauugucagauagguagauugcaaaaauuuucuccauucuguaggucgccuguucacucugaugacaguuucuuuuuuuuugagauggagacuugcucugucgcccaggcuggagugcaguagcgcaaucucggcucacugcaagcucugccuccuggguucacgccauucuccugccugagccucccaaauagcugggacuauaggcgcccaccaccacaccuggcuauuuuuuuguauuuuuaguagagacgggguuucaccauguuagccaggauggucucgaucucccgaccucgugauccgcucgccucggccucccaaagugcuaggauuacaggcgugagccaccgcaccuagccgaugguaguuucuuuugcugugcagaagcucuuuaguuuaauuagaucccauuugucaauuuuggcuuuuguugccauugcuuuucguguuuuagacaugaaguccuugcccgugccuauguccugaaugguauugcccagguuuucuucuacgguuuuuaugguuuuaggucuaacauuuaagucuuuaauccaucuugaauuaauuuuuguauaacguguaaggaagggauccaguuucagcuuucuaccuacggcuagccaguuuucccagcaccauuuauuaaauagggaauccuuuccucauuucuuguuuuugucagguuugucaaagaucagaugguuguagaugugugguauuauuuaugagggcuguguucuguuccacuggucuauaucuguuuugguaccaguaccacgcuguuuugguuacugcagccuuguaguauaguuugaagucagguagugugaugccuccagcuuuguucuuuuggcuuaggauuggcuuggcaaugcgggcucuuuuuugguuccauaugaacuuuagaguaguuuuuuccaauccugugaagaaagucauugguagcuugauggagauggcauugaaucuauaaauuaccuugcacaguacagccauuuucaugauacugauucuuccuauucaugagcauggaauguucuuccauuuguuuguguccucuuuuauuuuguugagcaguaguuuguaguucuccuugaagagguccuucacaucccuuguagguuggauuccuagguauuuuauucucucugaagcaacugugaaugggaguucacucauaauuuggcuguuuauguguuauuggugcauaagaaugcuugugauuuuugcacuuugauuuuguauccugagacuuuaaggaaguugcuuaucagcuuaaggagauuuugggcugagaugaugggguuuccuaaauauacaaucaugucaucugcaaacagggacaauuugacuuccucucuuccuaucugaauacccuuuauuucuuucccuugccugaccgcccuggccagaacuuccaacacuauguugaauaggagugaugagagaaagacagaaaacugucuugugccaguuuucaaagggaaugcuuccaguuuuugcccauucaguaugauacuggcugugggucugucuuaaacggcuauuauuuugaguuacauuccauaaauaccuaauuuauugagaguugaauuuugucaaaggccuuuccugccucuauugagauaaucaugugguuuuugucuuugguucuguuuauguuauggauuacguuuauugauuugcauauguugaaccagccuugcaucccagggaugaagccaacuugaucuugguggauaagcuuuuugaugugcugcuggauucaguuugccgguauuuuauugaggauuuucgcaucgauguucaucagggauauuggucuaaaauucucuuuuuuuguugugucucugccaggcuuugguaucaggaugaugcuggccucauaaaaugaguuagggagaguucccucucuauugauuggaaaaguuucagaaggaaugguaccagcuccucuuuguagcucugguagaauuuggcugugaaucagucugguccuagacuucuuuugguugguaggcuauuaauuauugccucaauuccggagccuguuauuggucuauucagagauucaacuucuuucugguuuagucuugggaggguguauguguccgggcauuuauccauuucuuuuagauuuucuaguuuauuugcuuagagguauuuauaguauucucugaugguagucuguauuucuguaggaucaguggugauauccccuuuaucauuuuuuauugcaucuauuugauucuucuuuucuucuuuauuagucuugcuaguggucuaucaauuuuguugaucuuuucaaaaacccagcuccuggauucacugauuuuuuugaaggguuuuuugugucucuaucuccuucaguucugcucugaucuuaguuauuucuugccuucugcuagcuuucgaacuuguuugcucuugcuucucuagcucuuuuaauugugaugguagggugugaauuguagaucuuuccugcuuucucuugugggcuauuagugcuauaaauuuaccucuacacacagcuuuaaaugugucccagagauucugguucguugugucuuuguucuuauugguuucaaagacaucuuuauuucugccuucauuucguuauuuacccaguagucauucaggagcaggcuguucaguuuccacguaguugugugguuuugagcgacuuucuuaauccugaguucuaauuugacugcacugaggucugagagacaguuuguugugauuucuguucuuuuacauuugccaaggagugcuuuacuuucaacuauguggucaauuuuggaauaaguacgauguggugcugagaagaauauauucuguugauuugggguggagaguucuguagaugucuauuaggucugcuuggugcagaacugaguucaaauccuggauauccuuguuaaccuucugucucauugaucugucuaauauugacagugggguguuaaagucucccauuauuauuaugugggagucuaagucucuuuguaggucucuaaggacuugccuuaugaaucugagugcuccuguauugggugcauauauauuuaggauaguuagcucuucuugucgaauugaucccuuuaccauuaugugauggccucgucucuuuugaucuuuguugguuuaaagucuguuuuaucagagacuaggauugcaaccccugcuuuuuuuugcuuuccacuugcuugguagaucuuucuccaucccuuuauuuugagccuacgugugucucugcaugugagaugggucuccuaaauacagcacacugauggguuuugcgucuuuauccaguuugccagucugugucuuuuaauuggggcauuuagcccauuuauauuuaagguuaguauuguuaugugugaauuugauccugucacuaugauguuagccgguuauuuuggccauuaguugaugcaguuucuuccgagcaucgauggucuuuacaauuuugcauguuuuugcaguggcugguaccgguuguuccuuuccaucuuuagugcuuccuucagaagcucuuguaaggcaggccugguggugacaaaaucucucagcauuugcuuaucuguaaaggauuuuauuucuccuucacuuaugaagcuuaguuuggcuggauaugaaauucuggguugaaaauucuuuucuuuaagaauguugaauauuggcccccacucucuucuggcuuguagaguuucugcugagagauccacgguuaggcugaugggguucccuuuguggguaaccugaccuuucuuucuggcugcucuuaacauuuuuuccuucauuuuuaucuuggggaaucugacaauugugugucuugggguugcucuucucaaggaauuaucuuugugguguucucuguauuuccugaauuugaauguuggccugccuugcuagguuggggaaguucuccuggauaauauccugaagugucuuccagcuugguuccauucuccccgucacuuucggguacaccaaucaaacguagauuugguauuuucacauaguccuguauuucuuggaggcuuuguuuguuucuuuuuacucucuuuucucuaaacuucucuucucacuucauuucauuaauuugaucuucaaucacugauacccuuucuuccacuagaucgaaucggcuacugaagcaugugcaugugucauguaguucucgcgccaugguuuucagcuccaucaggucauuuaaggucuucucuacacuguuuauucuaguuagccauuugucuaaucuuuuuucaagguuuuuagcuuccuugcgauggguucgaacauccuccuuuagcuuggagaagucuguuauuaccaaccuucugaagccuacuucugucaacuugucaaagucauucuccaucuggcuuuguuccauugcuggcgaggagcugcaaucccuuggaggagaaaaggcacucugguuuuuagaauuuucagcuuuucugcucugguuucuccccaucuuugugguuuuaucugccuuuggucuuugaugauggugaccuacaggugggguuuugguguggauguccuuuuaguuuaugucgaugcuauuccuuucuguuuguuaguuuuccuuguaacagucaggucccucagcugcagucuguugggaguuugcaggagguccacuccagaccuuacuugcugggguaucaccagcgaaagcugcagaacagcaaauauugcagaacagcaaauauugcugccugauccuuccucuggaagcuucgucucagaggggcaccuggcuguaugaggugucagucagccccuacugggaggugucucacaguuaggcuacacgggggucagggacccacuugaggaggcagucugucuguucucagagcucaaacuccgugcugggagaaucacugcucucuucagagcugucagacagggauguuuaagucugcagaaguuucugcugccuuuuguucagcuaugcccugaccccagaggucaaaaaauauuauuuauauuaaauucugucucuauaacauggauggauuuugaaaguauuaugguaaauaaaacaagccagucacaaagaccauguauuucaagaguacacuuauauaaaauguccagaacaggcaaaucuauagagacagaaaguagaugauguuugccugguguuggagagaaaugggagugacugcuaauggguacuguuuucuuuuuggggaggaaauaauguucuaaaacuuuuuguggugaugucugcaaaacucuucugguaugacuuuuuccucuuggguaauuuuaggauuaagacugauaacugugaguuugccaggacuugguucucucuccaagguaucuaguugggucauuauaauggccagauuggcauaaguagauguggagaugauagaggaccucaaugaacacuagucuuccuuucaucuucuuucauacuaaauuucucucacacacacauuuuuacaugaucauauagaacuaaagggauaucauccuuaacauuagucaagaucacaaguuuugagagacuuucuuuggacaauucuuugucgcuacugacauuuccauaagacuauuuaaaaaauaaaugcuggccaggcacgguggcucaugccuguaaucccagcacuuugggagacugagcuggguggaucacgaagucaugaguuugagaccagccugcccaacauagugaaaccucaucacuacuaaaaauacaaaaaauuagcuggguaugguggcaggugccuauaaucccagcuacucgggaggcugaggcaggagaauggcuugaacccgggaggaggagguugcagugagcugagaucacacuauugcacuccagccugggcgacaguacaagacucugucucaaauaaaaaaaaagaaauaaugaggguccuuuucaaaaaaauaugcucugaagucccuucggcaaccugucuuuggcuacuacaaagaauuauucuaagauuaaacaggccaggcacggugccucaggccuguaaucccagcacuuugggaggcugagguggacagaucaccugagguuagcaauuugagaccagccuggccaacaugauaaaacaccaucucuacuaaaaacacaaaaauuagaugagugugguggcgcaugccuguagucccagcuaccugugaggcugaggcagcagaaucacuucaacccaggaggcggaggcugcagugagcugagaucgugccacugcacuccagucugggcgacagagugggaccaugucucaaaaaaaaaaaaaaaaaaaaagauuaaaaaugacuguuaaaaguuguugggaaggauguauacgcacguguguacacuuuaagacagaaaacacauacauggcacaugcacacaguaaugagagaaguuaaaaacaaaaguagggcugggugcaguggcucacgccuauaaucccagcacuuuugguggcagagguggguggaccacuugacgucaggaguuugagaccagucuggccaacauggugaaccccgucucuacuaaaaauacaaaaauuaguugggugugguggcacacgccuguaaucucggcuacuugggaggcugaggaaggagaauagcuugaacacaagaggcggaaguugcagugagcaaaaaucaugccacugcacuccagccugggugauagagugagacuccaucucagaaaacaaaacaaaacaaaacaaaacaaaacaaaaacccccaaacaaaaauaguuuguggugaucaaauaguacuguaucuugauagugauggugguuguacgacucuacauggaauccaccgcacagacacacauacaaacaaaugagugcacguaaaaacuggugaaaacuaaguaaggccaguagucuaguuaaugguauaacaccagugucaauuucuugguuuugauauugcccuacaguuauauaauaugugaccacugggggaagcuggaggaaugguucaaagaacucuggguacucuuuugcaacuuccuaugaaucuacagucacuucaaaaaaaguuuguuuaauagagaaaaaagagccaagugcaguggcucaugccuguaauuccaguaguuugggaagaaugcuugagcccaggaguucaagaccagccugggcaacauagcaagaccuugucucaacaaaaauaaaaauuagcuguguauguugacacaugccuguuguccuagcuacucgggaagcugaagcaggaagacugcuugagcccaaguuugaaguuacagugagcuaugauuguugauaugguuuggcucuguguccccacacaaaucucaucuugaauuguagcucccauaauucccacauuaugggagggaccuggugggagauaacugaaucaugggggcagucuccccaauacuguucuugugguaguaagucucacgagaucugaugguuuuauaagggguuuccccuuucauuuggcucauucuguuuugccugccaccauguaagaugugccuuuuaccuuccaccaugauugugaggccuccccagccacguggaacuaugaguccauuaaaccucauuuuccuuuauaaauuauccagucucagguaugucuuuaacagcagcaugaaaaugaacuaauaaaguaaacuggugccagcagaguggggagcugcuauaaagauaccugaaaauguggaagcaacuuuggaacuggguaacaggcaaaguuuggaacaguuuggagggcucagaagaagacagaaaaauguaggaaaaguuuggaacuuccuagagacuuguugaauagcuuugaucaaaaugcugauaaugauauggacagugaaauccaggcugagguggucucagauggagaugaggaacuuguuggaaacuggaguaaaggugacucuugcuauauuuuagccaaaagacuggugacauuuugucccugccucagagauguguggaaccuuuaacuugagggagaugauuuaggguaucuggcagaagaaauuuccaagcaacaaagcauuuaagaggugacuggagugcuguuaaaagcauugucucauuuauuuuuauuuuuuuauuuuuauuuuuuugagaugaaguuuugcuuugucacccaggcuggagugcaguggggugaucucagcaguacagugaggcgauuucaacucacugcaaccucugccuuccagguucaagugauucuccugccucagccucccgaguagcugagauuacaggcacccgccaacaggcccggcuaguuuuuguauuuuuaguagagauacgguuucaccauguuggccaggcuggucucaaacuccugauaucaaaacaauccacccaccuuggccucccaaagugcugggacuagaggugugagcuacugcacccagucagcauucaguuuuaaaaggaaaacagagcauaaaaguuuggaaaauuugcagccucaggaugcgauagaaaagaaaaacucauuuugugagaagaacugcaagcuggcagcagaaauuugcaugaguaacgagcagccaaaugcuaaucuccaagacaauggagaaaaugucuccaggacauuucagagaacuuuguggcagccccuccuaucacaggcccagaggccuaggaggaaaaaaugguuuugugaguugagcccagggccccccugcugugugcagacuagggacuuggaccccugugucccagcugcucuacucauagcuaaaagggaccaacguacagcuuagaccauagcuuccaagggggcaagucccaagccuuagcagcucccacaugguguugagccugugggugcccagaagucaagaauugagguuugggaaccucugccuagacuucagaauguaugggaacgccugcauguccaggcagaaguuugcugcagggugagguccucaugaaaaaccucugcuagggcaguguggaagggaaauauuggguugaagcccuuacacagaguccccacuggggcacugccuaguggagcuaugagaagagggccacugugcuccagaccacagaauggcagauccacugaaagcuugcaccgugugccugaaaaaaccacagacacucgacgccaguccgugaaagcagcugggagggaggcuguacccuucaaagccacaggggcggagcugcccaagaccaugggaacccaccucuugcaacagcaugaccuggaugugagacauggagucagaaaagaucauuuuggagcuuuaugauuugacuacuccacuggauuccagacuugcauggggccuuuagcuccuucauuuuggccaauuucuuccauuuggaaugguuguauuuauccaaugcauguacccccacuguaucuaggaaauaacuaacuugcuuuugauuuuacaggcucacaggcagaagagacuugccuugucucagaugagacuuuggacuguggacuuuuugaguuaaugcugaaaugaguuaagacuuuggaggacuguugcgaaggcaugauugguguugaaaugugaggacaugagauuugcgaggggccaggguggaaugauaugauuuggcuguguccccacccaaaucucauuuugaauuauaguucccauaauucccacguguugugggagggaccuggugaaagauaacugaaucauagggccgguuccccaacacuguuuucaugcuagugaauaagucucaugagagcugaugguuuuauaagggguuuccccuaucucuuggcucucauucucgucugccaccauauaagacaugccuuccaccuuccgccaugauugugaagccuccccagucauguggaacuauaaguccauuaaaccucuuuuugcuuuauaaauuacccagucucggguaugucuuuaauggcagcaugaaaacagauuaauacaauugugccacugcacucuagccugggugacacagugaaacccugucucaaaauaaaauaauaaaacaaaauaaacaaaaaagguagcaaaaacuuuaauaagaaauugccugaaacacacaucuaaacagauuugugaaaaccauauaaaauuguauacauacauuaaacaauauuuuucuacauguauagcacacaaaacauuuuucuaacuacuuuuauauuuaucauuuauuuuuaauuuuuuuguuuuagagaggagguuuugcuauguugcccaggcuggucucgaacuccugggcucaagugauccugccaccucagccuucuaaagugcuagaauuacaggugagaaccgccaugcccagccuuuuuuuuuucuuuuuuuuuuuuucugagacagagucucccuguuacccaggcuggagugcaguggcacaaucuaggcucaaugcaaccuccaccucccaaguucaagcaauucucaugccucauccucccaaguagcugggauuacuggcaugcgucaccacacucggcuaauuuuuuguauuuuuacuagagacaggauuucgccaugcuggccaggcuggucucgaacuacugacagugauccacccaccucaguaacccaaagugcuaggaacuacaggcaugagucaccaugcccagcucuaucacauauuuuuaaggucucacuauguugcuuuuacauuucuuuucacuauccucauaacauccacaugaggaaauacagaauaacccucauuuuagagaugggaaaacugaggcuccgaaaggaugaaguucucugccacagccuacaguaagcaggucaaagaggcugguggcagcaugacaugguagaaaaacacauauuauggaaucacauagacacaggaaucuaaacuuagcucuacuacuagcuaugugacuugagccaguuacucaacuuuucugagucuguuuccucauuuguaaaaugcuauuaauaccaucacuucguuggaaugucaugaggauuuagaaagauacuauuuaaauguauaguauaaugcuuuggcaugggguuaagugguucugauguucuucucauaaccuucuuacguagacuuugggaaagcccuggaagaauucuuuguuagcagauuuaauucugaguccaucacaggacaaaauacuucuguuccaccauuacuuaccuaaaacaaagccaaccugaauggcuuuuuccuuuacugcagcaucugauucugcuauauaagagcaccgccuacugaaugaguaggccaagacugaagcaacuuuaacaccaugauccaucaaagccugaaaacaaugaugaagcaaaugucuguaagaaaagaaaaagauuauuuuauagaguuaauuuauuuuucuccuuuuagaaagugcuaacugcuucucuuuuaaauaauagcaccauuauuuuccaggacggaauaagauaaaaagcauuuugccuuaucaauuacaaggccauaauucaaaauuuagccuaaucucuucacucaguggauaacugagugauccuacaacauucaggaaaaguacacaauguguaacuugaugacaaggaaggaugaagcuaacuuuuaaaauuggcuuuuaaaaaccaaauuauaauucacaauaaaaagguacauaacccaguuuuuaaaaggcaaugaagauagaagaguuuuuuuuguuuuguuuuguuuuuuuuuuuuuuuuuugagauggagucucacucuguuauccaggcuggagugcaguggcguggucucggcucauugcaaucuccaccucccugguucaagcgauucucccgccucagccucccaaguagcuggaacuacagguacgugucaccaugcccaacuaaucuuuuuuguauuuuuaguagagacagggucucaccauguuagccgggaugcucucaaucucuugaccuugugaucuacccaccucggccucccaaagugcugggauuacaggugugagccaccacgccuggcugauaugaacagauauuucuccacaaaagauauauaaaugccaauaaacacgaaauaagaggcucaacaucauuaaugauuagggaaaugcaaaccaaaaucaugagauaccccuuuacacccaauagaauuuuuaaaaauauuuuauuuauuuauuauuuauuuauuuauuuauuuauuuauuuauuuauuuauuuauguuuuagagacaagguccugcucugucauccaggcuggagagaaguggcaugaucauagcucacuguagccuugaacuggucucaauuaagauccuccugcuucagccuccacaguagcugggacuauggaugccugucacugcacccugcuauaauuuuuuuugaaguguugucaugaggugaaaaaacgggaacccucauacauuggcggugggauuauaaaaugauauggcugcugugaaaaaguguagugguuccucaaaaaguuaaucauaggguuaccauauuauacacccuagguauauacucaagagaauugagacuauauacacacaaaauauuguccaaccacauucacagcagcauuauucauaauagccaaaagguggaaacaacucaaauguucaugaacagaugacuggauaagcaaaaugcaguauuauccuuacgauggaaaauuauucagccauaaaaaaggaaaguaguacugaugcaagcaacaacaugaaugaaccuuaaaaacauuaugcuaagugucagucacaaaagaccauauaagaaucaacuuauauaaaauaucuagacuaggcaaauccagagagacagaaaguagauuaauggucagcuagaaacugaggaaaaaguuacuguuaacugaggaaauggucagccaagaggaaauggaguugacuguuaaugauuucuuuuuguggugaccaaauuuucuagaauuagacaguggugaugguuacaaaaucuugugaauaguugaaugguagaauuuaaauuggugaauuuuauagugugugaaucacauuucaauagaaaaaaaaccuuuuaaacaaaauuguaagagucacugcuuuggguaaaggaaaaaaaggucaaauuacaugcuuuuaguuucacaaauacauaaaacacuuaccaaaggauuuggacuuggugaaagauaaccuaagagaugaaaaagagguauuccacugaaucuuuacaacagccacguuuaaaacuaccuacagagauucaaauccccaaaagcuauccuuucuuuagaguaaggaauguuuuuaaaaguuuuucuagucuucuuuuaccaaaaugagaaguucuuauuuauuagauuuuuuuuuacagccuaacuuuaaucaacuaaucaagaaguuucucuauaaucuuagcacacaggccacauuucaaaguuacccuugaacacugaaaucaugcuguuuacuuacuuauuuuauuuuuuuugagacagagucucacucugucacccaggcuggagugcagcggugugauguuggcucacugcaaccuccgccucccggguucaagugauucuccugccucagccucccgaguagcugggauuacaggcaugagcuaccacgcccagcuaauuuuuguauuuuuaguagagacaagauuucagcauguuggccaggcuggucuucaacuccugaccucaggugauccacccaccuuggccucccaaagugcugggauuacaggugugagccaccacgcccagccgacuuacuuguuuauuaucuuaucaucucucucuaaaauacaaacuccaugaggaagggaccuuguggauccuacucacugcuauggccccagcaucuaaaacaguaucuggaaaaugugcuauauauacacaaugguguacuauuuggccauaaaaaagaaugagauccugucaucugcaacaacacggauggaacuguaugguaaguaaaagaagccagccaaggaaagaacaacuuugcauguagucacuuauuugugggagcuaaaaauuaaaauaauugcauucauggauauagagaggagaaggaugguuaccagaggcugggaaggguaacugggagaggggggcaaaugaagaugguuaauggguacaauaaaauagaaagaaugaauaaaaucuaguauuugcuaacacaacaggauuauaguaaaaaauaauuuaguucuacauuuuaauaacugaaagaauauaacuggauugucuguaacacaaagaauaaaugcuugaggugaugaacaccucauuuaucuugaugugauuauuacacauugcaugcuuguaucaaaguaucuuauguaacccauaaauauaugcaccuaauauguauguacuauguacccccaaaaacuuaaaauaaaacaguaccuggaacauauuaggcacucagcaaguauuuauuuaauuuguugaauaaaugcuaacaacuugguaagauucuuauuagagaucagcaguauuuugugaaacuauauucuuauuuuccuagaaauguggguuaggaaauaaaauggcaguuaaacuuagggaagaacacuaaagagaacagcaagcagaccaggcacgguggcucacaccuguaaccccagcacuuugggaggccaaggcagguggauggcuugagcuuaggaguuugagaccagcaugggcaacauggcgaaaccccaucucuacuaaaaauacaaaaaauuacccaggcgugguggggcaugccuguauucccagcuacuugggaguaucaccugagcccuggaagucgaggcuacagugagccaugaucuugccacugcacuccaggcugggugauggaagugagacccuggcuccaaaaaaaaaaaagaacagcaaguacaaugaaaagccagaucuguagcuacuacuacuacaugaugauacuuaaaacgggaagaugaauucaaucucccuuucuugaacucaaaaagcuaaacuuccaaaguguuaacuuuccaaaggggauagaaggaggcagaacaaauuaucuucucuuugucaccaagcuucuguuuggguuguacaauuacugccacaauauuuuuacuauauucucuaugaugcuggcaaagacuucuugaguugucuuaaauugcuuucaaauucuacuucuagguauguaucuaauagauaugcauacauauguucaccaaaaaacauuuacaagaauguucagggcagcaagaguuauaauagcuaaaaaguggaaacagcccaaauguccaucaauaauagaaugaauaauacuguauucacauaauaaaacaccauauauauauacagcaacaagaaugaacacacuguaauugcacauaacauaggugauucucauaaaacaauacugggggaaaaaaaagccagacacaaaagggcacaaacuguauaauuguauuuaauauguucuaaaauacauaaaaugaaucuagugguuacccuaggggaggggaaguagugacuggaaaaagacaagacagggguucugguaacaacugcaaauaaacauaauucauagugaaauaauaccagguauauggaaaaacuaauugagacaauuucucaaugaaacaacuuuauagauuuauauugguacuauacuuaugaggcaaaauuauuuuauccacucuaaauuuucugauauaaucauauuuaugaaauaauuucuaaaccacauaagaaauuagucaaaaauaaacguaacuucaugcauuaaaaagagguguaauggaauuuuaaaaaacaaguaaccuaaaaaugaaauuuaugucccagcacuuuggaagacugagacaagaggaucacuugagcccaggaguucgagaccagccugggcaacacagcgagaccucaucucuacuaaaaauaaaaaaauuagcugggugugauagcaugcgccuauagucccagcuacucaggaggcugaggugggaggauggcuuugagccaaggagaguuugaguuugcagugagcuacgaacaugccacugaacuccauccuggcaacagaacaagacugugucucaaaaaaaaaaaaaauauggaaaacaguaugacaguuccucaaaaaaacuggaaauaagaguugggugcaguggcauagcgccuuuagucccagcuagcagagaggcugaaaaacgaggaucccuugagcccaggaguucgagggcagccuguacaacauagucaaacuaagucucuuaaaaaauaaacaaaaguagaauuaccauauaauccagcaauucaacuucugaguauauaaccaaaauaacugaaggcaggggcuugaagagauauuucuacgcucauguucacagcaguauuauucacacuagccaaaagguagaaagaacccaaauauccauugacagaugaauagauaaacaaaaugugguauaugcacacaauggaauauaaucuagccauaaaaagaaaugaaauucugacuuguacuacaacauagauaaaccuuaaaaacauuaugcuaaaugaaauacaauacacacaaaaggauaaacauuauaaggauuccacuuauaugggaaaucagagaagucaaacucaucuaaaguacaaugguggcuacacaggauaagggaaagagagaauggggaguuacuauuuaguggguaaggaguuuuuguucagggugauuaaaaaguucuggaaaugaaugguguugaugguugcacaaugugaauauacuuuuuuuuuuuuuuuuugagacggagucuugcucugucacccaggcuggagugcaguggcgcgaucuuggcucacugcaagcuccgccucccagguucacgccauuuuccugccucagccucccaaguagcugggacuaaggcgccuaccaccacgcccagcuaauuuuuuguauuuuuaguagagacaggguuucaucacguuagccaggaaggucucgaucugaccucgugaucugcccaccucagccucccaaagugcugggauuacaggcguaagccacagcacccagcccacaaugugaauauacuuaaugccacucaauucgguuaaaaugguaaauuuuauguuauguauauuuuacaauuuuuuaaaaaagaauuuaccuuuuauccaaagcucucaguacuuuagcaaaaacuuccaauucacaaaauucacugcccaguugacauaagcgucccuguugguaaagcugaaauaaaaaacaaaugauuuaaaaauuuugcaauuuaauucuucuuuuuacuuuaaucauauuugauaaauguaauuugauuaauuucaggaaagaugcuuauguuaagagaaauguaacacuaacaaauuucuacaauucauauaaaaauauuuuaauaguugcauauaaucguuacaaauugguauuuguaaaccaccuagaacaguaccuggaacauggcaaguacuacaaagugcuguauaauuauguauucauuaaauacagauaaaaaucauguuaaacuguuaacuuuuuuacuuaaacaaaacuggagagucgguguaaaauuaucaaaauaauagcaaagauaauguccagaaaacagagcuggucaauauggccaccucaaaaaucucaguucaguccugguuauaacacgucaaaaacacaccaauaguagagcaugucaauaguaauacaggauggcaggauuucuaauuaugccauaaucguuuauacauucugacuuuuuagaacuacaauuuaaaauaacauuuuaaggcugggcgcugugguuugauccugucauuccagcuacuaaggaggcaaaggagggaguauugcuugaggccagaguuugagacaggccugggcaacauagcaagacccuauuuauaaaauauaaauaaauucgcuaggugugguggcaugcaccuguagucucagcuauuugggagguugaggcaaggggacugcuugagcccaggaguuggagaccagccugggcaacauagugacacccugucucuagaauacacagccugggugagagugagacccugucucaaaaaaauuauaaauaaauaaacagaaagacaaauacuauugucccucccugcaaccccgccucaaugucaccaaaugcuuuuugagacagucuugcucuguugcccaggcaauacaauacccaagaguguguaguggugcaaucucggcucacugcaaccucugccucccggguucaagcaauccucccaccucagcaucccuaguagcuaggauuacaggcaugcaucaccaugccuaauuuuuuuuuuguauuuuuaguagagacgggguuucaccauguuggccaggcuggucuugaacuccugaccucaagaccaaaugcuucuaaauuuacacaugcuauauaaauaauacagugccuuagaaagcaggauuuauuugacuuuauauuacaggcauuuaacagcucaguugaugagaacauggguuucauaaagaaaacaaggucacucuccaaaugggccaguuuacuuggugcauggaaaacauaauaaaaccucagcacacuccugggcauaaaucacuagucacaauggaggucaggucgaauuagguaaauauauuaauccaaauccauaaugacugcuucaaaaaaucuguaacuccuggaggggagaggggacagggaccaccacaugcucacgaaggaaaggcagaaauguuaucuucauguaauaguuagacauuuauguuaacauuaaaaccuucagcaagaaagauuuguuauuuuuauuuauuuauuuauuuauuuuuuaauggucuuacucugucauccaggcugcaguauaguggcacaauuauagcucaaugcagcacugcagucucaaacuccugggcucaagugaucuuccugccucagacucucugagugcugggguuacaggcgugagccacugcguucagccuauauuugcuauccuuauagaggacucuguuuucugcuauagaaaaguaagagcuucugggaaugcaugcuguaaaauucacuacuauuaacugcugucuuauuuacuugacaaccaaaacagaauaacucagggaaaguaaagcugagaacuuacgaccacauucuuauaacaugggcuuaacaaggugauaaauuucugauuugcgacacaacaguuaccaaaauaaauacaaacauacacuccaaaaacacuaagacaacaaucuuagcuucuuaccaaaaugacugacuuuucauuaucaaacuuaaggcuuagaauuucuuuuuaaaaaaagaauaaacaggcugggcaugguggcucacgccuguaaucccagcacuuugggaggccaaggggggguggaucagcugaggucaacaguucaagaccagacuggccaacauggagaaauccugucucuacuaaaaauauaaaaauuaaacaggccaugguggcaggcaccuguaaucccagcuacucgggaggcugggagagaaucgcuugaacucguaagacagguugcaaggagccaagaucgcgccacugcacuccagccugggugauggagcaaaacucugucucaaaaaaaacaaaaaaagaauaaacaaaaacaaguuauacaacuacuuugccuaaaaacaaaauuuuauguuaucuuacaauucacugcauuccuuuaaugacugaaacugguguauccuacuaaaugagagucuauauuugauauuuggcuguuuaaauuuucuuuuuuuuuuuuuuuugggacagagucucucacucugucaccagguuggagugcaguggcaugaucucagcucacugcaaccuccaccuccuggguucaagcgauucuccugccucagccucccgaauagccuggacuaccggcgcgggauaccacgcccagguaauuuuuguauuuuuaguggcgacaagguuucaacauguuagccaggauggucucgauuucuugaccucaugauccgcccgccucagccuuccaaagugcugggauuacaggcaugaguuucucuaguuaaaaugcgcucacauuuaaauugacgggaaaggguaauuuguuucaacucauccuuaccaaguuuaucuaaaaaaugcaaaguaauuuuuuuuuuuuugagacagaguuuugcucuuguugcccaggcuggaguacaguggcgugacugacucacugcaaccuccaccucucagguucaagugauucccuugcuucagccucuggaguagcugggauuacaggcgcccgccaccacgcccagcuaauuuuuguauuuuuaguagagaugggguuucaccauguuggccaggcuggucuugaacuccugaccucaggugauccgccugccuuagccucccaaugugcugggauuauaggugucugccaccgugcccggccugaaauuaagacauuuuaugaauuaaagggguuuuuggauaccaauccagaaaaaaaauaacuucuaaucuuuuaugugucaggcacuguugucagugcuuuucauaaauuauucauuuuauccuuuuacagaugaggaaacugagucauauacaguuaaauaaccuucucaaaaucauauaauuaggaugggcaaagcaggaaucuuacccaggcagucugucccuacauccauguucuuaacaacuuacccuauauugccucuugaagauaauauaaaaggaaauuuuuaaaaguauuaaauggacaauuuaaaauauuuuuauagaaaugauggaagauuuaaagguuaauccccucauagauucaaacaucuuaugaaacagagcuuagaagagaggaaacugauacuuuuuguuccaguaaugauucucauauaagauuuuuaaaacuuauuuuaguuuauauuauguacccguagcauaaugaagcuauuaaagggcuauaucaaccacuuucagcuguuccuaccuuaaacaaaagggaaaacaagcuuauuucuagaaguaggcaaauuaucacccaccagauauaaaaacagauaauaaaauacaauuaaaacaguauuauacaguuaugaagauagaucaaccaacagaacaaaaugcaaaguucaaaaacagaccuuaguguauauaaauaucaacguaugacaaaagaagcauuuuaagaucacugaggaaagaaaaaaauuacuuaauaaagagugcauaaaaauggguaaacaaagaugccuaccugauaaaauguaacaaaaaggaauuccagauuuaucaaaguuuuaaaugguaaaaaauuauaucauagcaguauuaaaagcuaccugcuaacauugcuuuccuaagcaucacaucacauaaaauucaagaucagccuggccaacauggcgaaacccugacuauaccaaaaauauaaaaaucagcccggcauggcugcgugucccagguacuugggaagcugaggcauaagaauugcacaaagucaggaggcggagguugcaauaagcugauauugcgcacugcacuccagccugggugacacugagacucuugucucaaaaacaaccaaccaaccaaaaaacaccuauguucuaagaaaaacugaaggcacauaauugcaugcacacacucacacauaccaaugaaaccugugcaucucauucauguuuggaacuuucucagagagucuuuaaauagccaaaacuucagaaaugaaaagggguuguuaucaaggaaaaauggccauguuauaugaagugaacaaguuccugaaacguguaauaaaauuccacuuuugcuucuaaauuguauaucuacauuauauaugcauccauauaaaaaucugaaauaauacaaugcuuauauauaugguauaggauuaauaucucaaauauuucaccuagauuacuguaaagguuugauagaauuagucccuccauuaccacucuugucucccucaaaauuacgguccacacaguaaccagaauaaucuuguaaaaaaguaacucauaucaugccauucucuuguuuaaaaccuuuauuuaaauggcacccccaauguagaacauaauccaaaaucuuuucuuuuugagacggagucucgcucugucgccuagguuggagugcaguggcacgaucuuggcucacugcaagcuccgccucccgcguucacgccauucuccugccucagccuccagaguagcugggacuacaggcgccugccaccauggccagcucauuuuuuguauuuuuaguagagacggggcuucacgguguuagccaggauaguuucgaucuccugaccuugugauccgcccaccguggccucccaaagugcugggauuagaggugugagccaucgcgccuggcccauaauccaaaaucuuuauuaauguuaccucugagauccuaaaagccaccugaccccugcgguuuuuuuuuuuuuuuuuuuuuuuuuuugagauggaguuucacucuuguugcccaggcuagaguguaguggugccacuugggaucacuaccucugccucccggguucaagcaauucucaugccucagucucuugaguagcugggauuacaggcgcccgccaccaugcccagcuaauuucuguauuuuuagcagagauggggcuucaccauguuggccaggcuguucucgaacuccugaccuaggugauccaccugccucggccucccaaagugcugggauuacaggugugagccaccaugccuggccuuucuuuuuuuuuucucccugggagacagucuggccucugucucacaagcuggagggcaguggcaugaucaugacucacuggagccucaaucuccuuccugggcucaagcaaugcacccaccucagccccagauaguagcugguacuacaggcaugcacaaccaugccuggcuaauuuuuccauuuuuucuguagagauggggucacacuauguugccuagccugguguacaaacucuugggcucaagugauacucccaccuaggccucccaaagugcugggauuaccggccugagccacugccccuggccuugacgccugccuauauuucugaccucaucguuuacuauuguuucucccugucuccuacacuccugccaccuuagcuuucuuuuggcucauaacuuuugcacacauaugcuacuaccucuacaugaagcacugguaacaugauucuuugccugguuaguuuauaacucauccaaauccucucaacuacacuaugucacuuccucacagagcucuuccccugacucagcaaucuaaauucuauguccuguuaaacuuucucaugacacacuguuuuuuuuaccuccacaguagcauuaagacaugcaugcauucacuuaaacagucauuuguuaaauauauuauuccaucacacucuacauucuaugaggugacuacagucaccacuauauucccaauaccuagcacagugccuaguacaagauauacauucaauauuuucuuuuuuaaaaaaaacauuuuccccccgggcgcgguggcucgcgccuguaaugccagcacuuugggaggccgaggcgggcagaucacgaggucaagagaucgagaccauccuggccaacauggugaaaccccguuucuacuaaaaauacaaaaauuagcugggcgugguggcgggugccuguagucccagcuacuugggaagcugaggcaggagaaucucuugaaccugggaggcagagguugcagugagcugaaaucacgccacugcacuccagccuggcgauagagcaagacuccaucucaaaaaaauaaaaauuuuuucuuucuucucuuuucaaaaauuuuagauucagggguacauuugcaggcuuguuacacgguuauauugcauaaugcuggggugugggcuucaagugaacccauacccaaguagcaaaacaguacccaguaaguaguuuuucaauccuugccacauuaaauauuuuucuuuuuucuuuuuuuuuuuuugagacagagucucauuccaucacccaagcuagagugcaguggcaaaaucuugacucacuucaaccucugccuccuggguucaagugguucucgugccucagucucccaaauagcugggauuaaaggcauguaccaccaugcccggcuaauuuuuauacuuuuaguagagaugggauuuugccauguuggccaggcuggucuagaacuccugaccucacgugagcugcccaccucagccucccaaagugcugggauuacaggcaugagccacaaugccuggcccccuuaaauauuuucuaaaugaauaacccaaauugguacuuaauuacuuuggauggaacucagaaccucagaagacacaaaaaaauucaagacacagucucuacucuggaguuuauaauuagggaaucaauuauuuaguauuguuauuauauuacauccuuauuuacugaaauuaucgagauuaacccgguugguaaauuugauacuuugggaaaaaccucacuuucacacaguugacuacugccucuccaaucagacuauaagcaccuuucauuuucauguuuuugaaucagggucucacugucaccuuggcuggaguacaguggcgugaucauagcucacugcagccuccaacuccugggcucaagagauucucccaccucaaccucccaaguagcuacaacuaaagacacacccugcuacacccagccaaguuguuucuuuuuuuuccuucuuuuuuuuuuuuuuggagacagggucucacucugccacccaggcuggagugcaguggugaaaucccagcucacugcagccuccgcuuccugggcucaagcgauucuccagccucagccuccggaguagcugggacuacaggugcgagccaccaaugccuggcuaauuuguguaguuuuugguagaacuguucucugauuucaaaaaauuuagaaucuuucagaacagaaaaauaauguucacagauuauaugaugaagguaggcaaacugcuuuaagaauacagauaaaauauccacuccaagaacuucagaugcagaggaauugcuaguaacacuucuagcaauauggcacauagcacugacaaagaugcuaaccuuucaacccuuuuucggacacagaaaggcuggauauauauuuaaaaaaaaucacaaaauaacuuuuggauaaauagcuaaauugaaaccaagcauagaaacuccacaguugccaaaaauuaagaaaacacaaacuugaaagcagcuaggaaagaaggaaaacagaguaguuuauaccucugaaugguuucaagcuagaguaucaaagaccagaaaggagcugaggcagcauauccuguaagcaaagagaccuggagauuaacuaccugccuaaagaagucuaacuaccugccuaaagaagucuagaacaucuccucuagcuuuagcagucuccuaugaaaaacugaaaccuccaguccaggacacacauggguaccuaguccaaauugauacuaccuagaugauuuacagaccccaaacucagaaucuggcauuaaaaacuagccugaaaccagugaaacccaugaaguccccagacagacaaaugcaaaaacacccagguguuucugaggggagaugaaaaugcuguauauacugaucagcaaaaucuagacuucaggaaacucuuuaaagucuacaggacaaacgaauguguuucuuaacaaguaaauugcaaagaaaauaaaacagaaggaaagguaaacuauagaucaagagagacucaagagguguaucaagaaaaugcuaacauguggaacuuaccugcauccugauccaaacaagcaaacuauaaaaauauacacauuugaguccaggagugguggcucauggcuguaaucccagcacuuugggaggcugaggcagguggaucacaaggucaggaguucaagacaaacuuggccagcauggugaaaccccaucucuaauaaaaauacaaaaauuggccaggcaugguggugugugccuguagucccagcuaccaggaggcuaaggcaggagaauugcuugaaccugggaggcggagguuguagugagccgagauugcgccacugcacuccaaccugggcgacagagcgagacuccgucucaaaaaaaaaaaaaacauguuugaaacaacugaaaauuugaacagugacuguacauuuaagaacauuaaggaauuacuguucauuuuccucagguguuauaauagugugguaguuacuaaaauauuucuagaugaaauuaccuggccaggugugguggcucacgccuguaaucccagcaccuuaggaggccuaggcaggcggaucaccugagguugggaguuugagaccagccugacuaacauagaaaaaccccaucucuacuaaaaauacaaaauuagccgggcgugguggcacaugccuguaaucgcagcuacccggggggcugaggcagaauugcuugaacccaggagguggaggcugcggugagcugagauugcaccauugcacuccagccugggcaacaacagugaaacuccaucucaaaaaacacaaaaaacaacaacaaagaaaucaucugaugucuagauuugcuuccaaauaucacaugaaaggggaaagugaaugggagaacagauucaguaacaagacuggccagaaucgauaauuguuaaagcuaggugauagacauaggaauucauuauucuauucuauuucuguauguauuuaacuuuuuaaaaaaggaagucuuguaaauguauccuuuaccucuaacauaaaagaauauguuucauuuaacaaacaugaguuaucgucacuuacaugauucauuuauuauuaugcucugaucucaaaacucaucugaaggcuggcacaguggcucacaccuguaaucccagcaauuuggcaagccgagacaagaggauugcuugagaccaggaguuugagaccagccggggcaauguagcaagacccccaacuccacaaaaaauaaaaaauuagccagacgugguaguacauaucuguagucugaacuacuuggguggcugagguggaaggaucacuugagcccugaaggucaaggcugcagugagucaugauuauaccacuggacuccagccuggacaacacagcaaaauccugccucaaaacaaauaauuuuaaaaaguaaaaaacucaucugauguugggcguggugggucacaccuguaaucccagcacucugggaggccaaggugggaggacugcuugagcccaggaguuuaaggccagccuggacaacauagggagacccccaucacuacaaaaaaaaaaaaaauuggccaagcaugguggcgugugccccagguacuugggaggcugaggugggagguuugccugagccugggagguugaggccgcagugagccauaauugcuccacuacaccagagccugggagacaaagugagauccuguuucuggggaaaaaaaaaucaucugaaauguacucugaaaaacauuauauuagaauauugauauuccuuuucuuuguacuuuauaccuuacauuuaauguccuuuaucuguugcuucauuaaagugucauuucagauaauauucaaauaaaagggcaacccuuuacuaaaacuuaaauaugcuguccauuuaugaugaugaugucacuaggucaaucauccaugaaacaagaaauuaagaguuuucccccccaaugguuaaaagaaugaacuuauguguauuuacccagaugcuccaacucuauaccucacuuuauaggucaauggcauaauuuucaagauaguaugauuuuguuagugguaggagauguuaccacagcacaaauggaaguucaaaacaaaaaucuaguuagauguaaggccuagucagugauaaccagucauacauaacacaauauauaccagcaaucucuauauuugggauaagucucucagcuucucuucuugaaguuucacuaccaauauguggugaaaaucggaaguguuuccaugagacaaaaggauagggcaguauagcuauaagaaaacacuuucugccgggcgcgguggcucacgccuguaaucccagcacucugggaagccgagguggguggaucaugaggucaggagaucgagaccauccuggccaacauggugaaaccccgucucuacuaaaaauacaaaaauuagcugggcgugguguugugugccuguaauccuagcuacucagcagacugaggcaggagaaacacuugaacucggaaggcagagguugcggugagccgagaucgcaucacuguauuccagccuggcgacagagcaagacuccauugaaaaaaaaaaaaaagaaaaagaaaaaagaaaacacuuccugucucuauaagaaaacucauucuguauucuagauaaccaacuguaaaacacuuguuuccucugauuucagcauuuauguuuuuaaaaacauuagaaaaugcagggaauuucaaaaauaauugcugauuuuuaccauccaucuacagaggaaaaucacugucaacauaauggcacacuucuuuccaguucuccuuuucuuauugauuugcaagaguuuugaauaugcuuaauaaacuuuaauccucuauuauauaaagauauauuuuuucccacuacacauuuuuaaaauuuuuaacgguucuaagaacuguucuggggauucugauuaaguucacacugaauauauagauucugggaaaaguuacaucuuugaaaccccaaaucuuccaaucuaggaacaaaauauuggcucuucuacauuuauugaagacuuuugggugucuuuuuggucucacuccuugagguguuuuuuuauuauuauuauuauuuucuuuuuuugagauggagucucgcucugucacccaggcuggaguacaguggcccaaucucggcucacugcaagcucugcuucccggguucaagccauucuccugccucagccucccgaguagcugggacuacaagugcccaccaccacgcccagcuaauuuuuuguauuuuuuaguagagacgggguuucaccguguuagccaggauggugucgcucuccugaccucgugauccgcccgccucggccucccaaagagguguuuuauuauuuugagucagauauaauccuuccuauauugcauauagaaaaauugaauuuuuaauuauaaacguguaaucagccccuuuacugaauuaucuuacugcuauaguuuuucaguugacuuugcuggcuuuuuacuuauuuuaacaguacugguuagcaccucaagaauguugaauagggcugggugcgguggcucacaccuguaaucccaacacuuugggaggcugaggcgggaggaucacgaggucagaaguucaagaccagacuggccaacauagugaaaccccgucucuacuaaaaauacaaaaaauagucgggugugauggcacgcaccuguagucccagcuacucaggaggcugaggcaggaaaauaauuugaacucaggaggcggagguugcagugagccgagacugcccauuacacuccagccuaggcaacagagugagacuccaucuaaaaaaaaaaaaaaaaaaaaaaggaaaggaaaagaaacgacaaaaaaaaagaaugcugaauaucuaguauacaguuucagaaauaagucugaaagucuucacuuaaaaaaaaaauuuuucuuuuccuuuuuuuuuuuuuuuuugacccugggagccuauucaaaagggaacgcuacauggucgcaucuuggcgugagacagcgcuauuccgugggugcuauaacagguuccagcaguacuuggguguugaugucccaccccugaugcugugcagcgccugaaacccagcgagcucggaagguguccagaagaauuucaguauuugcuacaguaaccucaucagccugccaagacagcagugcaagcggccaagagggcgagcauucgacuuccaccugaaguaaaucagauauuguauauaagaaauuugccauacacaaucacagcucaaucaauguauauuugggaaauauggaccuauucaucaaaucagaguggaaaacacaccugaaacuagaggaacagcuuauguggucuaugaagacaucuuuguugccaagaaugcuugugaucaccuaucgggauucaauuuuugugacagauaacuugugguuuuguacuauaaugccaacagggcauuucagaagauggacacgaagaaggaggaacagcugaagcuucucacggagaaauaugguugucaagauagauccaccaaaaucaauguuuucuacauuuuuauuuugagggcgggcacgguggcucacaucuguaaucccagcacuuugagaggccaaagcgggaggaucaccugaggucaggaguucgagaccagccuggcuaacauggugaaaccccauuucuacuaaaaauacaaaaaauuagccgggcgugguggcgggugccuguaaucccagcuacucgggaggcugaggcaggagaaucacuugaaccugggaagcagagguugcagaugccacugcaauccagcuucggcaagaagagugaaacuccaucucagaaaaaaaaaaagaaaauagagcauauauguacaaaguaaaaagcaauugcgauccuaccccuggaguaaacaccauuaaaauuuuguuguguuccccuauauucuucuuucaaugcaaacacauauacauauuuuccccacauuaaaaaaaaaaaaaaaaaaaaaacacagccaggcaugguggcucacaccauuauaaucccaacauuuugaaaggcuguggcaggaagaucacuugaacccaggaguucaacaccagccugaacaaugcggcaaaaucucaucucuacaaaaaauacaaaaauuagcugagcaugcaguacacaccuguaagucccagcuacuaggcaggaucacuugagccuaggagguggagguuguaguaaguggugauugcaccacugcauuccagccuggguaacagagcaagacccugucucaaaacaaacaaacaaaaaacccacaauggaggcuaggcaagguggcucauaccuauaauaccagcacuuuaggaagccaaggcaggaagaccgccuaaugccaggaauucaagaccagccuggacaacagagccagaccccguuucuaucaaaaaaacaaaaacaaaacacacacauaagaugauucuauucacacuacuuuguaacaaacuuuuuauucucccuacuugcucuauguucuggcaucucuaguauacauagaauacucauucuuuauaaaugcacuaugauauuccauuccugauuagcauaugguuguuuucaauuuuugccaucauaaacaaugcugcuuaugaacaaacacugaauauccucuaacaggauuuuccacacauucaacaaguauuccuggaagaaaaauucuuuaaauuguauuguugguuaaaggguaugagugauuugaauuuuuaaagcaugacaaucugacaggugaaggcugauguuauuuuaaaacuuuucuuuuuuuuugaggcagggucucacucugucgcccaggcuggggugcagcagugcaaucucagcucauugcaacugccaccucccagguucaagugauucuucugccuuagccucccaaguagcugggauuacagguauccgccaccaugcccagcuaauuucuguauguuuaguagagacgggguuucacuauguuguccaggcugguguugaauuccugaccucaaguaauccacccaccucggccucccaaagugcugggauuacaggcaucaaccacugcgccuggccuauuuuaaauuuuuuuuuuuuuuuuuuuuugagacagagucucacccugucacccaggauggagugcaguggcacgaucucagcucacugcaaccuccaccuccuggguucaagcagaucuccugccucagccuuucaaguagcugggauuauaggcaccagccaccaugccuggcuaauuuuuguacuuuuaguagagacgggguuucaccauguuggcaaggcuggucucaaacuccugaacucaggcgauccacccacccuggccuuccaaagugcugggauuacaggcaugagccaccacgcccagccuauuuuaacauuuuuaaaucaaaguauaacaugcauacagaagagcgcacaacucauauuuuaaaugugaagcuugauaaauuuuucacuuguaaccagcauccagauaauaacaaaguauaaccacaaucucagaaggcuccccucauaucugucccugcaucgucacuacuguccaagaauagcgucuccuaacuuucaacaacuaaauuuugccuguuuugaacuucauauaaaugagaucauauauuauacauccaguuuccaaacugugcaccaaggugcccugaggcccugcuagauauucuuaauuugagagaaacaacauucagcaucugcaaugcgcuauaccaacuacuagacugguauacuacacugcuuucaaugagaucuuuaugaagcuguguuuucagugguugcugugauaaaaagaguaauauaaaaagucaauaaggaacaucagaugaagcugggugcgguggcucacgccuguaaucccaacacucugggaggccgagacaggcagaucacuugaggucaggaguuggagaccagcuuggccaacauggugaaaacccgucucuaccaaaaauauaaaaaauuagccaggugugguggcacgcaccuguaaucccagcuacuggggaagcugaggcagaacugcuugaacccagaaggcagagguugcagugagcagagaucaugccacugcacuccugccucggaggaagagugagacucccucucaaaaaacaaaaacaaaaaaaaaacaaacaaaaaaaaccagaugagaguggugguauccaaucugauuccaagguuugagacgcuguacagugcccaauaaacaaacaucccauuaguuaaugugguugucuaagaaugaaaguuuuuucguucaauuuuugugcauuuuaagaaacagaucuuaaguuguuaggacauaaauaauaugaaguuuuuuggaucuaacuacuuaauaaacagaacugucagguauuucuuuuggccugggguugccaugaaccaaggguuauaaagggagaaaguuuaggaaccucugguauauauuccugugacugguuuauuucacucauuaucauuugcaagauucauucauauuauuucaaguaguuguuguucauucauuuucauuguguaauauucuacuacgugacuaucccacuauuuauuaauauucuucuauugauggguauuuggacaguuuccaccuuugggcuauuaugaauagcagugcuaugaacauucauaaguguauauaucuugaaguagcauuacuggguuacaggguauguuuauguucaguuuuaguagauaaugcugcuuuuccaaaauggcauaucaacuuauauucccauuaacaauguaugagaguuuuuuauuucuccauauccuugcuaacauuuucauugagucacugugauggguguacaguaaaacaguacuucucugaagacaaaauaagguugaguuucuuucuaaauguuuggccuuuugaauauucucuuuugggaugccuauucaaauucucuucaaaaaacaaacaaacaaaaaacugaguauuuuucucgcugugucgcccagccuggagugcaaugucaugaucucagcucgcugcagccuccgucuccuggguucaagcaauucuccugccucagacucccaaguagcugggauuacaagugccugucaccaugccuggcuaauuuuuuuuauuuuuaguggagaugggguuucaccauguuggccaggcuggucuugaacuccugaccucaggugauccccugccuuggccucucaaagugcugggauuacaggcgugagccaccauguugggccuuuucucugcuauuaauguacaguucuuucuuuagguguacaaugaguccuuugucagauacaggugcugcaaauaucuucucccacucuguggcuugacucuucacuugcuuaaugauaucuuuugaugagauguucuugaucuuaauauagcaccaauuuaucacacuuccuuuauauuuaaccacuuugagauccaaauuaaucuuugcugacauaaaauuuuuuucuaaaaaacuuuuuucauauuuagaucagcaauuuaucuggaaaugacuuuuguguguggugugagguaaagucaagauacuuucuucccugauacagaaauuaauuaaccaauaccauuaauuugacuuuccuuucccuaucauagugcugucucacuuuuaucauaauacaggugauaguauaugugucagucuguuucuggacugucgauuuugauccauuggucuauuugucaauccaugugccaauaccauauuaccuuaauuguuauagccagguaacaaguugaauuccuccagauuuucuuucuucaucgucaugauuaccuugcaucuggcuuuaucuuguauuugaauuuguauuucaguugaguaucuuuuaauguucauuggccauucauauuuccucuucuguaaacugguuuuugggacaugaauuaguugccuuagcugccuuuuucaaacugauuaguauuagaucuuucuguauuagaaaacaugcccuucaucugucaaaugcugucaucugcauaguguuuuuuuaaaguguucuuacaauuuccuuuuuuuuuuuuuuuuugagacagucucauccugucugcagugcaguagcaugaucuuggcucacugcaaccuccgcauccugggcucaagcaauucugccaaguaacuggcacuacagguguaugucgccaugccuagcuuauuuuuuauuguuuuugguugagacaccauuuugccauguuacccaggcuagucuugaacucuuaggcuuaagcaaucugccugccucggccucucaaagugcugggauuacaggcaugagcuaccaugcccagccgugugugcgugcguguguguguguguguguguguguguguguguguguguguguaagagagagagacagcuagucuugaacucuuaggcuuaaacaaucugccugccucggccucucaaagugcugggauuacaggcaugagcuaccaugcccagccgugugugugugugugugugugugugaaagagagagagacagggucucacucuggaggcugagagugcagugucaugauaaccacucacugcagccuugaaucucccaggcccaagcgauccuccugaguagcugggaccguaggcaugugccaccaugucuggcuaauuuuuaauuuuuuuguagagacagggucucccuauguugcccaggcaggucuagaacucuuaggcucaagccauccucccaccuuggccucccaaaguucucagauuacaagaguaagccacugcucccugcucuacuuuuuaaugcauuccaacacaucaauuucuuuuuuuuccuucugggcuuugguuucauucuuagaaaugccuucuucaugccaagauggcauuacaguguuggcaagguaagacaagagguaaagauagauuuuaaaauuauuuuuacauuaccuuuuucccccccuuugagacaaguucucacuguguugcccaggcuagugugcagcggcacaaucacagcucacugagcggccucgacuugccaagcuucaaaugauccuuccaccucagccucccaagcaacugggaccacaggcaugcaccaccacaccugaauaaauuuuuuuuuuucugguaaagacagugucucccuauguugcccaggcuggucucaaacucuugggcucaagcaauccuccugccuuggucucccaaagugcugggauuacaggcaugagccacugcuccuggccacuuauuuuuauaguguuugacauuuucaugauuuguacauuaccuuaaaaauaauuuuuuaggcuaggcacagugacucacaccuguaaucccagcacauuacggggcugaggugggaagacugcuugaggcuaagguucaagaccagcuugggcaacaaagugagauacggucggucucuacaaaaaaaaaauuuuuaagguuuuuuuuguuguuaucuccuacagaaaggagaaaauuuuuuuuuuaauuaaccaggugugguggcaagcaucuguaguccuagcuacucgggacgaugaggcaggaggaucacuuggggccaagaguccaagguugcagugagauaugauuaugccacugcacuacagccugggagacagaaggaggacuugucucuuaaaaaagaaagaaaaacaauuucuuuaaagaagaaauuuuggucauuucccacugcaaaauauugacccaauaauuuauucugauacuuuuauaauuuuaguagccaaauuuaauuuuuuuuuuuuuuuuuuuuuuugagacaaggucucacccugucacccaggcuggaguacggugaugcaaugacagcucacugcaaccucagccuccugggcucaagcaauccuccugccucagccuccugaguagcugagacuacaggcaugcaacaccacacauggcuaauuuuuuucuuuguucuagagaugggaucucacuauguugcccaggcuggucucgaacuccuggacucaagcaaaauccucccaccauggccccaaagugcugagauuacagacauaagccaccaugcccggccaucaguguauuuuuuuaaauucucagaaaacugaauguuaguucaggcuguauguagcuauacaacugaaauauacagagaaaaagaaaaaauuaacuccgauccuaaaucagaaccuaauuaguaugguuuucagcaugguauuuauuuuuauuuuguuuuuucuuuucagcauaauacuuuaauuuuuaaaaaaaucauuaaggaggccgggcgcaguggcucacuccuguaaucccagcacuucgggaggccgaggcaggcagaucaccugagguaaggaguucaagaccagccuggccaacaugguaaaaccccaucucuacuaaaaauacaaaaaucagcuggaugugguggcaggugcuuguaaucccagcuacuugggaggcugaggcgggagaaucacuugaacccaggaggcagagguugcagugagccgacauugugccuaugcacucgagcccaggcaacagaacaagacucuguuaaaaaaaaaaaaaaaaaaaaauuaagauugugaaaacaauacauagaacacacugcugaaacacuucacccagacaaaguuuaacucuacggcacacuuuguauuuggaaaaaacacaaaauagaccuucaguaguuaaaauaaaaagaucauaaacuucauucauuuuuuuaaagagauggagucucacuacauugccccagccagucuugaacuccuggacucaagagauccucccggcucagccucccgaacuguugggauuacaggugugagcuaccacaccuggccauaaacuucauucuuuagaauaagaacacagccccgucucuauuuccuuucacucuguauagaguucuagaauuuucuuuuaagagauaauuguguugcccaggcuggagugcaguauucacaggcacgaccgcagcuagcacccuauaaccuccaacuucugggcucaaaccaucuuccugccucagauuccugaguagcuaggaugggacuacaggcauauaucacuccaucugccucacaauucuuucacuucaucuuaccugcuuuuauaccaaaaugguugcacgcccuuggagagaaaacuuucagaauccaagcauuaugaucacaugccacauaaaguuucagucaacaaccgacugcauauaaaaagguggccccauaagauuauaauagagccaaaaaguuccuauugccuagagacauuguaguugaauuacuuuauuuuuaacauuaauuuauagucgucuaaguauacacuguuuauaacaucuacaguaguguacagugaugucuuaggccuucacauucacucaccacucacucacugacuuaccagagcaacuuccaguccuaaaagcuccauucacgguaagugcccuauacagguguaccauuucuuaucuuuuauacuguaccuuuuccauguuuagaugaagcuugcccaaugcacagccagcgggccacacguggcccaggucagcuuucaguuacacuuuuuuuuuucuuuuugugaagaauggggucucgcuuuauugcccaggcaggucucgaacuccugaguucaagcuauccucccaccucugucucccuaagagcugggauuacaggcaugagccacugcaccuagcccccaggacagcuuugaaugagacccaacagaaauucguuaacuuucuuaaaacauuaugagauuuuuuuuuuccucagcuuaucagcuaucguuauuguauuuuauguguggcccaagacaauuuaucuucuuccaauguggcucagggaagccaaaacauuggacaccccugguuuagauacacaagcacuuaauacuguguuacaacugccuacgguacucaguaaaguaacaugcuauaugaguuuguagccuaagaacaauaggcuaucccacauaaccuagguguguaguagacuauaccaucuaggcuuguguaaauacacucucugauguucccacaagcaugaaaucgccuaacaaugcauuucucagaacauauccccgucauuaagcaacacaugacuguauuguguaggguucugauuuuuauuaacuauucuuuuacacauuuuuagucaccuucccuucucauacaccucaguagacauucccaacuucuguuuagacuuccuguauaaaagcuaccacuccuaucacuuacccgcagcaaaugaacucaccuccuaauucaugacaaucauucuuacaaacuuaccuauauuaacgacuuguuuuguuuugagauaggaucucccucuguugcccaggcuggagugcaguggcacaaugacagcucacugcaggcucugaccuccuggucucaagcaauccucucaccucagccucccgaguagcugggaugacaggcaugcaccaccaugccuggauaacuuuuucuacuuuuuguagagaaggggucuauguugccuaggcuggucucgaacuccugugcucaagcgauccuucugcuucagcuucccaaaguguuggaauuaugagugugagcccugcgccuuuacaucuuuaauucuuuuguucugaucuuagaagaagaguucuuuccccaacuccaauauaaggauaauaccuuaauuuaugcacggugaaggaggaaagaccaaaaacaggcaagacucaucaacucauguuccugcucagggacuuugcuccguaacuuauuucccaccacacuuggauacucaaccucauucucuugguuucugccacucagccaacaaauauauucuagugucuuccauucuuuuuuuuuuuuaaaaaaaagaaaaaacauuucauauuuuacccuuucuaugcucucccuucccugcuuauacagcagucaacauuccugcuucuuuaccuuccauucauuccauaaccccaucuccuaaugcuuuacgauugugccuuuaucugaagcuauuacaaaaauuaacacagucauacuguaguacaccaaacaagcagaauggggaaauuugauuccacaaauacuccaauuuugucuaugacuaugccuacugauggaaauuuggacugcaagagagauguaauuaugaguuucuccuuggcuuuaaagugcagaaaauuggaaauuggaaacaguaagccuccuaaaauuuucacaaguugggcagggggugaguaucuuauauuuaugugugcaguuauauugcuuuaaaaaguuuuuccagccugggcaauauaucaagaccucaucuauacuaaaaauuaaaaaaaaaaaaauuagcuaggcauggguggcauacaccuguaguuccagcuacucaggaggcugagauggaaagacugcuuaagcccagggguucaagguugcggugagcuaugaucacaacugcacuccagccugggcaacagagcaagauccugucuccacaaaaaaaguuucuuauauguauaugcuaauaguguuuaaaaggaagaaaagucaggugcgguggcauaugccuguagucucagcuacucaguaggcugaggcaggaggauagcuugagcccaggaguucaagaccagcuugggcaaaacagcgagaccccaucucuauuuuuuuuaaauuuuaauaaaaagaauaauuucuucuuacaucuccauuaaagauuagaauagaguccugggacugacuuucacuccacuuccauagaagcuaauaaaaaaauuaguguuauaauaucuuucauuaaaauaaucuacuaucuuaagauagauaucuaaguaaaagagcaaggaacucaggaacuaaauaucagguuugagaccuuaauuaaauuacuuaacuuucucaccaauaaagcaagguuauacuguacucuacuucacaguuuaauucugaagauuaaacaaaauaacacauaaaagcacaacauaguuacaggcacauguuuaacacuucccucaucuuagcacagugccauacucccaauaagcauacaacuauuaagaaguaaaaguguaccaaaaaggagcaauauuaaaacugugugaacuaugugaaacagaaauucuaacaaaagcaccaucuauucauacuaauaaucuucaaaugaaaagcuucaauuagaagugaaaguuacuaaaagauauucaaguauuuugaacgaauucaacuaguaaauacacuuggauuacauucccaaugauuuccucugagagauuacauaugagguacaagauuacacaugauuuaauaaaauggacagagagcacacacaaagcugcaguuucccaggcugagaaagacaaaucuaauuuguccuuccuggggaggaauguaucuuaaaugaacaaaauuuccuuagaauacacaaaaguaaaucaauguaucaaagggauuaggaaaaaagggagcuuuuucucgaaauccaaaauaauaauacgcaugaccuaaaugaaucuucuccaaauauuuaggggggaaaccccacuuuaauuguuagaauuggugcaaagcagcuggauuuaguagaacgcagcccaucaacugcuaauucugaaaaaaaaaaaaaaaaaaaaaaaaaaaucuagggguggagaaagcaggcaaucuucccaauaaaacaacugccacaaaacacuguacauacguaagaacauaaacaucuguuaaaauaucaguuuacacuguuccagccaacuuacagaucaagaggaaguauuuaaggucuaaaaaauaaauuacauucuacuuuuagucacauuuugcauggguggcuacuggacacuaggaguuaucgacgcggauucaagacaaggaagacugaauaauaaauccaguguucacauucaaaugugggggagagaaaagggcaggcucugaguccauaaaguucuccacacucugaaaacacugcaaaaauaguccacaucuaaggacacuuacccuugaaacuccuuggagaguggcuugggagacuugcuguucagauuuuugagggggagugauuuaagaaugcugcaagauugcaacuuucaaacacaggaacauaaucuaaaguguuuuuuucuuucaguaaagaucucucccuguccucuucaaacaguugaucagcacucccauuuucacaaaaucccuaauucaaguauagagccccuccucucccacaaaaaaaucaaagcuuuaaagaauaugcaaauaaaacacacagauuauuuccaauaaucccuaacuccuucccaauugggaaaagaaaggagaaacgaaggaacacgaagcaaaaacaccaaaacacucggggaaggaaggcggcgagaugagaaaguaggaauggguggggggaggagcacggaaaaaaguccagcugaugcugacacuuaauuggaaggagaggauggaaaauauccugaagauacgggcuagaaggaaaggacuaggugggacaggggcgcgauagaguaaguccacgcaaaaggccuacccaagagggccacuguguagaagggaacaccaacagggagcaagacuccccaagauuacuucaaggccccaaagcuuaagagacagggcauagggagauggggugcuucuccacuggcaaugcagacaccgcaccagacguuucgggaggcaagucugccggaaggggugagggguuaacugcggggguucgcagacguggaagggggugcggcccccgggguugcuggaggagagcagagaggaggcccacggcgcauaccuuguaguaaacaucaaacuggauguucucgggcaaggagcggaugucucggcgggagcggauguaguuguccacgacagcggagauggcgguguuauagagagucucugggauccacucuaguuccacggccgccaucuuccuucccuccuccuccgccuccuccgccuccuccucccgaaggcccccaccucccuccguagcgaaccccucugcggccccggaggauucggaggggcgguggcagccacgcgggcgcacggcagaaggcacggccgcccugccuccuccgggggcaaacugagggacggcggcagcggacgcaggcccgaguaaaaagugggacagaaaacagcggccagccaggccaaaagcgucacaaucccgguucgagaggaacccggguuccgucccagcgcugaucuc

SEQ ID NO: 192288 - RNA, 62650 nt, Homo sapiens
cucugccuuuccucucgcagccacccuuccucucagaccaguacgguggccgacgggagucagacgcuggggaugaaugaaggugcugggugcagguugaaaaagucucccgcuuuuccguuccuacagucccgguucugccuuuguguggugcccccauccuucccacuuuguaucgacaacccgguuggucccggcgucugaguucuugguguccgagucgacucgaggcacaacuaggguuugggguuccggauaucgccuaggcccaacaucggaccgcgcucucgauuucugccgcgucccgccucuaggacgcggaguccgugugcgguuccgugaggcuggaggguagaucuuaagguaugaagcguccgcuucucuggccucagcgcguuccuagguccgugucggagccuggccagacuuugcucagccugagggacuuauugguucuaguugcgcccggggcgagacggaggagcacgcaggucuuggcuccucugcuccagucagcccgccccucuguuaaaagagcagccccucccugaaagcaaagcaguuuuuacccacgacuuuuacccacgcugcugcuagucggucggccuugagaggggacugcuuuggcugccagcucacugccuuuuuguuuacuuuuugugccuuggaugauuccuggagacagagaagugcgcuaaugagacgcgucuuucucacauagcacccacacaucugcuuuuuacccgguaacacaggggacauaggauaguguuguggccuccagagccuugaaucuggcauugguucugcccagugauuugcuaguuuuuccaccgacucauggagggugagaaagagaagcccaauaguucuugauguauaucgggguaggcaugugaaacuaucgggguaugaaagaaagcacuuaacuaugaccauucacuuuuguuuacauuuuguggagcucaugugacugauauaguggagaaagucuuggacugggauuuuaguagaugaggauucagccuuggauugugccucuaacuaguaauacuauuuugggcguguuacuucaucucucugggcuucauauuccuucuuuguaaaauaugaguauuagagcagaagauuccugaggcuggaagagacauuaauauacucuguuuucuuucccauuucccaggugacaguauaaaccuagggagacagagaagccuugucuugauugugccaggaacauugccaacauagggaccuauuaaagauacaccacauuuuucaggguuuuuagaaaguuggguguucauacaugugaaaguuaaacuccuacuuucauuuguauuuuuaccauuaggaucaacaaacaguaauaaugacugaauguacaagucuucaguuugucagcccuuuugcuuuugaggcaaugcagaagguggauguuguuugccuggcaucuuuaagugauccagaauuaagacuucuucugcccuguuugguacggauggcacuuugugcaccugcugaccagagccaaagcugggcucaggauaagaaacucauccuucgccuucuuucuggaguggaagcugucaacuccauuguugcauuguuguccguggacuuucaugcuuuagaacaagaugccagcaaagaacagcagcuuagguaauguuauguuauauuauauguggauuuggauuugacaaagaacagggaaucagauauuuuuuagagcucuccagaaaagagagaaugagaaucuaaauucuggagagcauuuuacuuaggucuuuucuguauauaguuacaguuccagaaucuuuugacuuccauguuauaaaauguuaucuagagaaauauggcaaugugcuguuguaugugggcuaaacucauuaggccaauuacuuucagugggaaguagguaggguaacuuccccuagauuagagggauuuauuggaaucacuugggaggcuuuuuuuuuucuuuuuugagacagaguuucgcucuuguugcccaggcuggagugcaauggcgugaucuuggcucacugcaaccucagccucccagguucaagcgauccuccugccucagccucccgaguagcugggauuacaggcaccugccaccaugcccggcuaauuuuuuguauuuuuaguagagaugggguuucaucauguuggccaggcuggucuccaacuccuggccucaggugauccaccugccuuggccucccaaagugcugggauuacaagugugagccacugggcccagccucuugggaggcuuuuaaagcuuagauauucccaaagauucugggcaggugcuauguccuucccugcccauugugaaucuaguagcaagccaccaucaguggaagugaguguuaauugucaguugugguagaguauuuauuuauuuauuuuuauuuuuauuuuuuuuuagaccgagucuugcccuguugcccaggcuggagugcgguggcgugaucucggcucacugcaaccuccaccuccuggguucaagugauucuucugccucagucucccgaguagaugggacuacaggcacgcgccaccaugcccggcuuuuuuguauuauuaguagagacgagguuucaccauauuggccaggcuggucucgaacucccaaccuugugauccaccugccucagccucccaaaguacugggauuaccggcgugagccacugugccuggccuaugugguggaguauuuauuauacguaggaugugaaucccugaaauacacaggcaaacuaaauagcauuucagaaguaacagaacauuuuagaacacuuuauacauccuuuuauagcuuauuucaauaaaagauaauuuuuaugcaauuauuuccauaucaguguuuucauaauuguuacauguuuuguacuucauuaggcauaaacuuggaggaggcaguggagagagcauccugguaucacagcuucagcauggacugacguuagaguuugaacacagugauucaccucgucgauugcgucuugugcuuagugaacuguuggcaauuaugaacaaggugcauuucuuuuaaccacagcucaaaguaugcaugauuugaugucuauguauagggagguagacagaaaaagagacaagaagucaggcagguugaauucuccucuacucuuauuuuguucuuuuuuuuuggagacggaguuucauucuuauugcccaagcuggaaugcaguggugugaucucagcucacuguaaucucugucucccagauucaaacgguucuccugccucagcuucaugaguagcugggauuacaggugcccgccaccacgcccagcuaauuuuuuguauuuuuaguagaaaugggguuucaccauguugaccaggcuggccaggcuggucucgaacuccugaacucaggugauccacccgccucagccucccaaaguguugggauuacaggcaugggucaccgugcccggccuucucuacuuuuauuucuauauauuuguuuuccuuucaaagccugaaaggauauuauaagucugccuuaaaguccuucucuuaauuaucauuuucucucauuuauacuuguucugcauuuucuaugagagggauuuuuuuccguauggaauccauacacaguggcuucuugacauuuagaaagggauuuaucucaaggcuuguacagauuaucaaauuuauuagcagauaauaccuuuaugggauacaauuucucccauaaaguguaaugaaguaacauuuucaauaacugaaugugaauaacugaaaaauguaugugauucauuuagacacuggaugagcaguaacagccucauauaugacagcagaggggaguaucaaugcugaauugaauguaggaugauuggcuagucucaaucacuaaaugaccaaagugcuucuuuacacuaaugaaagcuauucaaguuaucuucuuuguaaaauuauagauuacuuaggucauagaccuuuggguaauauaguuaauugaaacucugaauuuaaaauuuuugaaugucaaaguucuaucauauaaauaacuaaauuagcugggcgugguggugcacgccuguaaucccagcacuuugggaggccgaggugggcggaucaccugagguugggaguucaagaccagccugaccaacauggagaaaccccguuucuacuaaaaaauacaaaauuagccaggagugguggugcaugccuguaaaagaauugcuugaaccugggagguggagguuguggugagccgagauugugccauugcacuccagccuaggcaacaagaguaaaacugccucaaaaacaacaaccaccaccaccacaaaaacccacuaaauuagaucuuuauguuuauuuacuguuauaauuuuggggagucaguuaauuuauaguaaauaaaguuuaguuuuauaaauuguggacaaaaagagaaaggacuaaauucuguuuucauagaaaauacugguagagaggauuuuggugaguuuuagauaguuuuuuuuuuuuuuuuuuuuuuuuuggagacagagucucacucugucgcccaggcuggagugcaguggcacaaucucggcucacugcaagcuccgccucccggguucacaccauucuccugucucagccucccgaguagcugggacuacaggugcccgccaccaugccuggcuaaucuuuuguauuuuuaguagagacgggguuucaccguguuagccaggauggucucgaucuccugaucucgugauccgcccuccuuggccucccaaagugcugggauuacaggcacgagccacugcgcccggccgaguuuuagacaguuuuuaagguauguuaaaaaauuuuucuaaaauuuccaucaccaauuauaauuuccuucucuuuuuuacuauuuugauacuuuuauuuauuuuuguuuguuuuuuugagacagaguuucgcucuuguugcccagguuggagugcaauggugugaucuugcucacugcaaccuuugccuccuggguuaaagcgauucuccugccucagccuccugaguagcuagaauuacaggcacccgccaccaugccugcuaauuuuuguauuuuuaguagagacgggguuucaccauguuagccaggcuggucucgaacuccugaccucaggugauccucccaccucggccucccaaaguucugagauuacaggcaugagccaccaugcccagccuauuuugauacuuuuaaauuucagccaagaguuuuccuucaucuuuuccguaauaccucacuuggugacucuaauaaauaagugaccuuucuccucugggagauuuccaauuuuuuaguuuggcacucuucauuauauaggaaauaugguuaugaaacuauugugcagaauuuccaaaaagcuuaguagauuuuguuaucuaaacuuuaauucuuuguuuuuccaacaguuuauucagaauugaacacguauauauauauauauauauauauauauauauauauguuuguuuguuuucuuuuuucuuuuucuuuuuuuuuuuuuuuuugagacggagucucauucugucucccaguguggagugcaguggugcuaucucggcucacugcagccuccaccucccggguucaagcgauucuccugccucagccuccugaguagcuaagauuacagauggccaccaugcuuggcuaauuuuuauauuuuuaguagagacaggguuucaccauguuggccaggcuggucucgaacuccugaccucaguugauccacccaucuuggccuuccaaagugcugggauuacaggcgucagccacugcaccuggccaugaauuuauauuuguuaaacugcuuuagguugacuguucuuggcuuuuuuaaagcaguuuauguaggcugcauuuguaguucauuucuuuggcuugccuuauccuuuaauuccaguugucuccaaauauuuagauagaaaucaguucuugagauugauacugcuauaucugaauaauaauuaacaugacugcugugugugguuaaauugguugaaauugauugaauacugcauauucugcugugguauauuagugauacauuaagagacauaaucugugagcucaagaaauaauuauaaaaauagggauuuaauuaucugaaauuaauagaguuuauaucuuuuuuuuuucuuuuuuaaggugucugaguccaacggagaauuuuuuuucaagucuucugaacuuuuugagaguccaguauauuuggaggaagcugcagauguacuuuguauuuuacaagcagguacuguacugagugcuaagauggauuucauauauaguuucuuguuaaaugauacuguguaacuucuuagccugguaugcuguguuauuuuagggaucauauaacaaacauguuaugugauuuuaagucaaaagugacuaauaguuggacaaugauuaaguaaauuauauuauuuucauagugugacauauuaugcagacauuaacaugguaucuuugauuuaaugacuuuaaugcucguuaaugauuuuggaaaauguuuacaauauguuaagugaaaaaagcaaagggcaaaguguuaaguagacuauaaucccaguuuuguuaaaaguucaagaacaauacccuugaugaauuaaaauaaaauacuuauuuuuuuuuagagacagagucuugcucuguugcucaggcuggaguacaguggcaggaucauagcccacuggcuugaauuccuggacucaagggauccucccacuucagccuucugaguagcugggacuacaggccugugaaaacauuuuuuauuaacuuugaauucugggauuagggcagauuuuaauuuucuucuucguaccuuuuuguauuuuccagauuguauauaauaggugugaaugauagaaauaaaagaggacagaaaaauguaaagaaggcugucgcucaugccuguaaucccagcacuuugggaggccgaggcaggaggaucacuugagcucaagaguucaagaccagucugggcaacauagugagaccuugucucuaccaaaaugaaaaaaauuagccuaguguggugguguauaccuguagucccagcugcaugggaagcugaggcaggaggauggcuugagccugggagauugaggcuguagugagccaugauugugccauugcacucuguccagagugagaccuugucuuuuuuuuuugagauggagucucacucugucacccaggcuggagugcaguggugugaucucggcucacugcaaccuccgccuccgggguucaagugauucuccuuccuuagccuccugaguagcugggauuacaggcaugcggcaccaugcccagcuaauuuuguauuuuuaguggcgacgagguuucaccauguuggccaggcuggucucgaauucuuaaccuugugaucugccugccucagcuucccaaaaugcugggauuauaggcauaagccacugugccuggcugcagaccuuuucuuaaaaaaaaaaaaaaaaaaaaaaaguauaggccaggcacgguggcucacgccuguaaucccagcauuuugggaggccgagguggguggaucaccugaggucaggaguuggagaccagccaggucaacauggugaaacccugucucuacuaaaaauacaaaaauuagccuggugugguggcaggcuucuguaaucccagguauucgggcggcugaggcaggagaaucgcuugaacucuggaggcggagguugcggugagcugagauugcgccauugcauuccagccugggggacaaaagcgagacuucgucgcaaaaaaaaaaaaaaaaaagcaaauaagauuuucgugaaaauaacucuuuagaccaguucuauaaaauaaaauuuccuguacuguucuaugcuaugcuguccaguguucuuuguggcuguggauuacuugaaauguggcuagugugauugaggaacugaacuguuuuuaauauaaguauccuuauguugcuaguggguauccuacuggacagcuugguucuagacuaugaaaagaaaguacuuuauuuuagaugacauuugugaaaugucaaaagauauuuaauaauacaaugaaaugucauuuuugguugggcaugguggcucaugccuguaauucuaggaguuuaggaggcugaggcaggaggauugcuugagcccaggagguugaggcugcagugagcuauaaucacaccacugcacuguagccugggcaacaaagcaagacccugucuuaaagaagaaaaaaagaaauaucacucuuuaacacuggguccaggcaugguggcuuaugccuguaaucuuagcacuuugggaggcugaggcuggaggaucacuugaggccaaaguuugagacccaccugggcaacacagugagauucagucuccacagaaaauaaaaaaaauuagcugggugugguggagugcaccuguuaacaaagacuaacacugacuuuguuuucuuguagagcucccuuccuugcucccuauaguugauguagcugaagcuuugcuacauguuagaaauggugccugguucuugugucucuugguggccaauguuccugauaguuuuaaugaagguaaauaugauucuaauaugguauauugaaaagacuugcuuggacauguacaggaccuaucuuuuugaccuaagaagaaacauuaaugggauuuuauuugagauuuuaucuuuugaaaguuuguuaguauguauaaagaaauauugaguucacaaauuguauugaguuuaaagaucaggcugggcgcaguggcucacaccuguaaucccagcacuuugggaggccgaggcgggcagaucacaaggucagaaguuugagaccagccuggccacuauggugaaaccccaucucuacuaaaaauacaaaaauuagcuggaugugguggugggugccuguagucccagcuacuggggaggcugaggcagaagaaucgcuugaaccugggagguggagguugcagugagucgagaucgcaccacugcacuccggccugggcgacagggcgagacuccgucucaaaaaaaaaaaaaaaaaaaccccaaggaacuagaagauguaauaucuauaaucagggaucaaagaagauacauguaucagugaaauaucaagagagcaauacgggauauguauaaugagaaaugcuaggaaucagaccuuuguuuuuuagcccuacugcugucaguuuacagagaaguauaaaguagaaauugagaaaaaucgacuacauuuuuucaccucuauuuaaaacuuacagugauugaagguuguuguuuggguaugagugauauaaaaauaaaaacauuuuguugagcaagguaguuugugaauuaggagccugggaggaaaaaguacuggaguuauaauuccugauuuugucauucacuuauugugugagcucuaucaaaauacuucucaucuggcugggcacgguggcucaugccuguaaucccagcacuuggggaggccgaggugggugcaucauuucaggccaggaguuugagaccagccuggccaacauagugaaaccccgucucuacuaaaaauacaaaaauuagcugggcuuggugguggaugccuguaaucucagcuacucaggaggcugagacaggagaauugcuucaaucugugagguggagguugcagcgagccgauaugugccacugcacuccagccugggcaacagagugagacucugucuuaaacaaacaaacaaaccaaaauacuucucaucuguaaaauggagauauugauaguguaauaguucccugacuuuuuuaagagauuuauugaauaucagaugauauguaaaaacucuuuguaaacuguguccuugccgauuuuuugucaacuuguucugucaauuacugagagaggaguuuugaugucuccagacauaauuguggauuugccuauuucuucuuuuuguucugucaguuuuugcuucauguauuucaaagcucuuuuguuggguuuauaugcauuuaggaugauuauaucuuuaugaugaauugagccuuuuuuucauuauaaaauauacuuuuuuccccaagucaaauuugauuucuuuauucuuaguuuucacauuuauaguuauaucccccuuucuaaacauuauuuacauauuauucaauuuguugucaccuuuguuuuaauuuuucuuuuuaaaaaaauucgaaguuuuauuuuagauucagggggguacaugugcagguuuguuacauggguauauuguaugacacugagguuuggaguuugaaugaucccgucacccagguuaugagcauaguacccaauagguaguuucucagcccuuguccccuuucuuccuccccacugguagucccaguguccauuguucccaucuuuauguccauguguacccaauguuuaacucccacuuauagugagaacaugugguauuugguuuucuguuucuguguuaauuugccuaggaugggauggcuuccagcuuuauccuuguugcggcaaaggacaugauuucauucuuuuuaauggcugcauaguauuucaugguauauauguacauuuuauuuaauccacuguugaugggcaccaagguugauuccaugucuuugcuauugugaauaguauugggaugaacauacaagcgcaugugucuuugguagaacaauuuguuguccuuugaguauauauccagcagugagacugcugggucgaaugguaguucuguuuuaaguucuuugagaaaucuccaaacugcuuuccacaguggcugaacuaauuuacauucccaccaacaauguguaaguguucucuuuucuccacagccucgcuagcaccuauuauuuuuugacuuuuuaauagccauucucacuggugugagauggcauuucaugauuguuuugauuuguguuucucugaugauuagugauauggagcauuuuuuuucauguuuuuugguugcuuauaugucuucuuuugagaaguaucuguucguguucuuuccucacuuuuaauggggugguuuuuugcuuguugaauuguuuauguccuuauagauucugcacauuaggccuuugucagauacauuuuugucaauauuuucucccauucuguagauuguuugcucuguugauaguuucuuuugugugcagaauaucuuuaauuuaaauaggucacacuugucaauuuuuguuuucauugcaauugcuuuugaggacuuggcuauaaauucuuugccaaggccaguguccagaauaguauuuccuaguguuucuucuaggauuuuuauaguuugagguuuuacaucuaaaucuuuaaucuaacuugaguuaauuuuuguauaugauaaaagauagggucuaguuucauucuucugcauauggcuagccagcuaucccaacaccauuuguuaaauagggaguccuuucccugucauuuauuuuugucaacuuuguugaagaucagaugauuguagguguguggcuuuauuucuggguuuucuauucuguugcauugguccgugugucuguuuauuuuuauuuauuaauuuuuuguuacucuguuacccagacuggaguccaggggugcgaccuuggcucacugcagcucugccugcuggguucacgccauucuccugccucagccuccugaguagcugggacuacaggcacccacuaccaugccuggcuaauuuuuuguauuuuuaguagagaugggguuucacuguguuagccaggauggucucgaucuccugaccucguggucugcccgccucagccuaccaaagugcugggauuacaggugugagccaccgugccuggccugugugucuguuuuuauaccagugccauguuauuuugguuacuguagccauguaguauaguuugaaguuagauaaugugaugcuucuggcuuuguucuuuuuguuaggauugcuuuggcuauucaggcucuuuuuugcugugugaacuuuaguauccuaaaguuucuaauuuuguggaaaaucauguugguaguuugauaugaagaguguugaaucuguagauugcuuugggcaauauggccauuuuaaagauaaugauucuuccaauccaugagcuuggaauguuuuuccauuuguuugugucuuauaugauuuuuuuuuuuuuuuuuuuuuuuuagacagagucuugcucugucgcccaguggcacaaucucggcucacugcaagcucugccuccuggguucagccauucuccugccucagccucccgaguagcugggacuacaggcacccgccaccacgcccggcuaauuuuuuguauuuuuuuuuuuuuuuuuaauuagagacaggguuucaccguguuagccaggauggucuugaucuccugaccuaguuauccacccuucucggccucccaaagugcugggauugcaggcgugagccaccgcgcccggacuuuuuuuuuuugaaacagaguuucacucuguuucacaggcuggagugcaguggcgcaaucucggcgcacugcaaccucuaccuccuggguuuaagcgauucuccugcaucagccucccaaguucaugggauuacaggcaugggccaccacaccuggcuuauuuauuuauuuauuuauuuauuuauuuauuuauuuuuuugagacggagucuugcucugucacccaggcuggagugcaguggagugaucucggcucacugcaaccucugccuccccaguucaagcgauucuccugucucagccucccgaguagcugggacuacaggcgccugccaccaugcccggcuaauuuuuuguguuuuuaguagagacgggguuucacuguguuaaccaggauggucuugaucuccugaccuugugaaucgccugccuuggccucccaaagugcugggauuauaggcgugagccaccgcgcccggcuaauuuuuguauuuuuaguagagacggaguuucaccauguuggccaggcuggucuugaacuccugaccucaagugaucuguccuccucggccuuccaaagugcugggauuacagacaugagccacuguccuuggccucuuuguagagauuuuuaaccuccaaaauacgcuuuuuuuuuuuuuuugagauagugucucgcucugucacgcaugcuggagugcagugguguggucaugauucacugcagcauugaucucccaggcucgagugauccuucugccucagccucuugagugagugaggcuaccagccgauaccacugggcccagauaauuuuuuuuuuuuuuuuuuuuuugagacggagucucacucugucgcccaggcuggaaugcaguggcgcaaucucggcucacugcaagcuccgccuccuguguucacgccauucucccgccucagccucccgaguagcugggacuacaggcgcccgccaccaccacgcccggcuaauuuuuuuguauuuuuaguaguaacacgguuucaccguguuagccaggauggucuggaucuccugaccucgugaugcgcccucuguggccucccaaagugcugggauuauaggcgugagccacugcaccuggcgcgcccagcuaauuuuuuguauuuuuguggauaugggguuucaccauguuacccgugcugucucagacuccugggcuaaagugguccgcuugccucaaucucccaaagugcugggauuuacaggcgugacaaaauagacuucuuuauugcugauaauauuccuucuuuucaagucuacuuugucugaauaauacagccaugucaucuuucuuauaauuaguuuuuccaugguguauauauuucuucaucucuuuaaucuguccauaucuuaaggucgauuucuuguggacagguauaguucggucuucauuuuuuuuaaucuaguggcagucucugucuuuuaauuggaguguuuagacuguauacauagaccauuuaaaugugauuauuauagugguuagguuugaaucuucuuguuauuuguuuucuauuuauuuucuuuuuccucuuguacuuugugccauuguugucauggauuuuacuuuuacaugaauuauaaaccuuagagcaaauuguuauuacuuuuguuuuaaacaguuaauuauauuuuaaagacuaaaaauauagaggaaaauacuauuuauccacacauuuaccauuuuuggugcucuuaauuccuuucuguaguuccauauuuccaucuggcauaauuuccccuuaacuugaagaauuuuccuuauuuuuuguaggguggguuuguuggcaacaaauuuuacuggcuuuuuuggucuggaaaaauauauuuucaaaggguauaaaauuuuagguugacgucaucuuuuagcuauuuaaagaugucauucuggcuggguauguggcucacaccuguaaucccagcacuuugggaggccaaaacgggaggauuguuugaagccaggaguuugagacuaguaugguggcaaagcaagaaagcaagaucccaucucuaggaaaaaagaaaacaaagaacaaagaugucauucucuuuucugcaguaaauuuuaucuuuguuccucuguaaaguuucuuuuucccucuggcuacuuuuuuuuuuuuucuuuaauuucuucuggcuccuuuuuuuuuguuuuuuuuuugggagacggagucuugcucugucacccaggcuggagugcaguggcaugagcucggcucacggcaaccuccgccuccccugggguuaaagcaguucuccugccucagccucccggguagcugggacuauagucaugugcccccaugccuggcuaauuuuuguauuuuuaauagagaugggguuucacuauguuggcuaggcugaucuugaacuccuggccucaggugaugcgccuauccucugcucuaguuacuuuuucucuuuuuuggagauggagucuugcugugucacccaggcugaagugcaguggugugaucucggcucacugcaacuuccaccucccggguucaagugauucugcugccucagccuccugagcagcugggacuauaggugcgcauuaccacacccagcuaauuuuuguauuuuuaguagagacaggguuucaccauauuggccaggcuggucucgagcucuuaaccuagugauccacucaccucggccucccaaagugcugggauugcaggugugagccacugcacccggcccugguuacuuuuaagauuuucuuuuuauuacugguuucagaaaguugacguaugauguuucuugguaugauuuucuuugcauuuguuccacuuagggcucauugaacuggguuuagaguuuucauucaacuugggaaaauuucuucaaauuaauuaauuaauuaauuuauuugagaaggaguuucgcuuuugucgccccaggcuggaguguaaugaugcgaucuuggcucacugcaaccuccaccucccaguucaagcgauucuccugccucagcguccugaguagcucggauuacaggugccugccaccacgcccagcuaauuuuuguauuuuuaguagagaugggguuucaccauguuggccaggcuagucucgaacuccugaccucaggugauccaugccccgcaccccccccccccccgcccccaccuuggccucccagaguucugggauuacaggugugagccacuguccguggcccucaaauguauuuuugucucguacuuucuuugucucucugggaccguaauugcaaguguguuugaauguguaauauugucccagaguuuacuauucuuuuuuaagucucuuuucauuuuuugcuucauuuuggccaauuucuguuguugugcuuucaaauacccugauccuuuucuucugucaugugaaaucuucaugaacaauuaauucugaaggcugaagaagaugguuucuaucauguuaguuuguaggggccugauaaaaaauggagaacgacaagaugaagaaagucuuggaggaaggcgcaggacagaugccuuacgcuucuuguguaaaaugaauccuucucaggcccucaagguccgaggcauggugguaagugauccuguguuuuauuagacaaaggccuuuauauuagguccaagaacucuucucaagaugguuuuagaguccuguagagguggggaauuuuauuuauauacuggauauguuaccuuccucucuggguuuuuauguuuuguaggaguucuuccucuaaacuuuagauacuuuagauuuggaagcaucacuggccuuuuugcuuaugauacugaauucaguuuguuuucuuuucugugcuagguggaagaaugucacuugccaggccuugguguggcuuugacauuggaucauacuaaaaaugaagcuugugaggauggagugagugacuugguuuguuuuguaagugguuugcuucuuggaacaaaugcgaaaguccggacuugguuuggaacuuuuauccgaaauggacagcaggugaggguuaaauaucuguauaggcuaaggaucagaauacuuuagcagcugcuaaaagagaaagaaacauuuuuugaaugaugucauuagacaagugguucucacacuuucuaguuucagggaccuccuuauauuuuaaaaaaucacuaaggauaccaaagagcuuuuguuuauguggcuuuuuuucuguugauauuuaccauauuagaaauuaacacuuaaauauuugaaauauuuauuuaguucuuuuaaaaauaggaacagcugguguguugguaugugccuauaguccuagcuacuuaggaggcugaagcaggaagauugcuuaagccaggggguucuaggguauagugugugauaauugugccugugaauagcgacuguacuuuagccugggcaacauagcgagaccucaucucuuaaaaaaaaaccaaaaccaaacaacaauaacccuauuaaaugugaacauaacauauuuuaaaugaaaacuaacuguguuuucccaaacaaaauuuaaugagaagaaugauaguuuuauuuuauuguauuuuuuucaaauaucuucaaugucuggcuugguagaagccuuuggaaacugcaccguacccuugugagugaaugagaaagaaaaagacagauaaugucuugaguauuauuaacaccuuuccagacccccugaaagcauauaucuccaggguucugggccagacucaugagaacuggugcauuagaucacugaaauaaguuauuauauuuuuaaauuuuaauacauauguguauauauguuuuuauuaugguaaaauauacauaacauaaaauuuugccauuuaaucauuuuuaaguauauaauucaguggcauuaaguauauuuacagugugcaaccauuaucacucuucguuuccagaacuauuuuuuuuuuuuuuuuuugagacggcgucucacucugucacccaggcuggaguacaauggcgcaaucucggcucacugcaagcucuaccuccuggguucgaggauucuccugccucagccuccugaguaguugggauuacaggugcccaccaccacacuuggcuacuuuuauuuugaguagaggcuggguuucgccauguuggucaggcuggucuagaacucuugacaucaggugauccacccaccugggccucccagaguacugggauuacaggcgugagccaccacugggccuggcccauuuccagaacuuuuucaucaucccaaacagaaacucuguauccauuaaauaacuccccauucccccuaucaucccauccucugguaaccucuauucaacuuucugucuguaugaauuuacccuuucuggcuaccugaaguaaauggaauuauacaauauuucuccuuuuguauguugcuuauuucacuuagcauaauguuuucaagguucaucuauguuguaacaugugucaggauuuccuuuuuaaaggcugaauaauauuccauugugaacuuagaguagaacugccauucuguccagcaauccuacugcuggguagagaaaucauuauauaaaaaauguaccuacacuuguauguuuauuucagcacuauucacaguagcaauguuauggaaucaaccuaagcaucuaucaacggaugguugcuuaaagaaaaugugauauaugcacacacacacacacacacacacacacacacacacacauacacacauguacacacacacguauauauguauacacacacacaaacacacacaccauggaauacaacucaaccauaaaaaagaauaaaaucaugucugacaguaacauggauggaacuggaggccauuauauuaagugaaauaacgcauaaacaaagucaaauauugcauauucucaauuaugagugggugcuaaucauguguacacauggacauaagcgagugggauaauacacaucauagacuccaaauguugggagggugggaagggggugaggguugagaaguuaccuauauuggguacaggguauacuaucagggugaugacuacaccaacagcccagacuucuaugcaauagauucauguaacaaaacugcacuuguacccccuaaaucuauaaaaauaagaaguaagggcugggugggguggcuuacgccuguaaucccagcacuuugggaggcugaggcgggcggaucacaaggucaagagagggagaccauccuggccaacauggugaaacccugucucuacuaaaaauacaaaaauuagcugagcgugaugugcgugccuguagucccagcuacucgggaggcugaggcaggagaaucgcuugaacaugggaggcagagguugcagugagccgagaucacgccacugcacuccagccuggugacagagcaggacucggucucaaaaaaaaagaaaaauaauauuccauuguguguauauaccacauuuuauuuuauacguucaccugcuuaugcauauguauuuugcaacaguuuuuaacuugcaaaauguuuuaauuuuucaaaaacuaauuuauauuaacuaugugaauagaguuccuaugaaggagcuaaugcagauugcgauuuaacucguugaggucacuuagcuagacaacauguauacugcuuagauccuguagucuauuuuuaagcuacugaaucauaguuuuuuaaaauauucaaguucuauuuuauagcccauuugaaaacugauuuuaagcucugcuuuuuaaaacaaaguuaacauuuauuuauuggaugcuucauauaugucagguacugccuuaagcacuuggcaugcucaucuuguuuguaguugucuuuuguauucaauaaaccuuuauucuuugaacuuacuguuauuauuaaagcaggucuaucauauuuuacuuagagacacucaaaagauaauaauuaacauuugucuagcccuguauaguuuagaacugcuuucauacauguauuaucucuguucauucaucuacuuaacagacuuugagugcuugcuguauguuaggcacaauguucgacugugcagagugagagaagacuaaggcauugucccugccugaagaacuguagugguuauagaauuguaaacucuuuuguuuuuuuugagacgagaguaucacucuguugcccaggcuggagugcaguggcgccaucuugacucauuguaaccuccgccuccuggguucaagcgauucuugugcuucagccucccaaguagcugggauuacaggcaugcaccaccacacccagcuaauuuuuauauuuuuaguagagaugggguuucaccauguuggccaggcuggucucgaacuccugaccucaagugauccguccgccuuggccucccaaagugcugggauuacaggcgugaaccacugcaucaggccaagaauuguaaacucuuaauuauaggaguucuauaagguaaauauuguugauaaaauauuuccuugucauuaaggaaauugggguucagagaggcuaaccaaugugccuaaagguauauaaucgucuaauaguagagcuggcauuuaaaccccaagaacuuacgucuucaaaaucugagcauuuucuccuauaccacauaucacuuuguuagucuuuauguauuugaaaguaccauugaaauaauauuccacaauucaaauugucacuaauuuagucuuuccucugcaaccaauccaaauuauggugaauauucauucuucagacaaacuaguggauuuugaguuugcuugauugguuaaaaugagauucuguagucacgacaaucucuucaaauaggccaauuugaaaguguuuaaguggggugcuauguuuuagcucccuuuuaguuuaguaaaugcuucaugcuuucuuccuuuugugauccauauuucuuucagagaaaaagagagaccagcaguucuguccuuuggcagaugagaaggcagcuucuucuggaguugaugggcauucuucccacaguaagaagcacccgaauuguggaagaagcugauguggauauggagcccaaugugucuguguauucggggcugaaagaagagcauguugugaaagccagugcacucuuacgucuguacugugcuuugauggggaucgcuggacucaaguauucaauaguuugauauuuuaccuuuuugucauuuuaccuucuuguuucuauucucaagaaagugagccaaaggccuuuuauucagaggauuaaaguuuucuguuggacucagguagugggcuggccuguaagaagaaugaaauccuaaggccaagaauuucuagcagagauguauucaucuauuuuguucugauuguaaacagaacuauauaaauaugggaggagccagagcaguuuaucaauuuccaaucacaguuuaaagaaaccugugauuucaacacagcuugacaaaacuauagugaaugaucugugagugaucuuuuaccauugacuaguugaaguaaaucucuccuuuguuuccuuuuacagcugauaucauaauuguuuaaaauuaauaugaugugauuaauaaguacaauguuuuuuuuuuuuuuuuuuuuugagauggaaucuccgucugucgcccaggcuggagugcaguggugugaucucggcucacuguaaccucugccucccggauucaagcgauucuccugccucaccacacccggcuaauuuuuuuuuuuuuuuuuuuguauuuuuaguagagacgggguuucaccauguuggccaggcuugucuugaacuccuuaccucagguguucugccugccucagccucccaaagugcugggauuacaggcaugagccacugugccuggccaguacaauguuucuuagucaccauacaaaauccuuuugaauaguguucuuaauaauuguacauacaguccucauuugcaugucuccaauaugcaugaguuucaguuacgccaguuuauuuaaauaaugcuggucucucaacacaguugccauuucaguugccaugauacauuaaccaguuaauuguauagaguuugugagcuccucaggacacagaucacuaaguaaauaacagauguacaucaugguuagugaccaauggccucacuucuuucaaagucugucgguagcugguuacugcacaccuguuauuugauucauguacauauagcagaggagguaguuguaaagguugaauaucccuuaucugaaaugcuugagaccagaagcguuugggauuuuagaacuuuucggauuuuggaauguuuauauuuaccgauuuagcaucccuaacagaaauucaaaauccuuaaugcuccaaugagcauuuccuuugagcucauuaccucauauuggcacucagaauguuuuggaguuugggggcauuucagauuuuagguuuuuuggauugggguuacucaaccuguauugcuuccuuucucuccauaaugaacucauguuccaaaacauggaaacaguuuuuggaacauuauauuccaaaaacagauaauuggaagagacaguuggccaauaaagaugaaagcauaggccaggcgcgguggcucacgccuguaaucccagcacuuuggggggccaagguggacagaucaccugagguugggaguucgagaccagccugaccaacauggagaaacccugucucuacuaaaaauacaaaauuagcugggugugguggcacaugccuguaaucccagcuacuugggaggcugaggcaggagaaucacuggaacccaggagguggagguugcggugagcuaagauugcaccauugcaguccggccugggcaauaagagugaaacuccaucucuacaaaaacaaaaaacauaaaaaaaaggaggcaaaggcuguuuaaacuacucuugauaaagucuuuacgaagaaauaaaaaaacuuuaagaccgggcacaguggcucacgcccauaauccgagcgcucugggaggccaaggcuuguggaucagugaggucaggaguucgaggacaaccuauucaagauggugaaacccucucucuacuaaaaauacaaaaauuagcugggaaugauggcgugugccuguagucccagcuacucaggagucugaggcaggagaauugcuugaacuuaggagguagaguuugcagugagccgagauugugccacugcgcucccgccugggcgacagggugagacucugucucaaaaaaaagaaacaaagaaaacaguuuaauucccaauguuucuaauauuuucaauuagaguacuauaaaaauauuaguuuuaccauuuaaaaaaaaaaauuccuggcuggguacagugacuuacaccuguaaucccagcauuuuaggagaccaagggagguggauuuuuugagcccaggagucugagaccagccuggggaacguggcaaaacccugucucuacuaaaaaaaauaagcugggcaugguggcgcauaccugugguccuagcuacaugaggacugacgugggaggauuaccugagccuggaaggucaaagcugaagugagcucugauccugccacuacacuccagccugggcgauggagcaagaccuugucucaaaaaaaaaaaaaaaaaauuaugcauuauaaucaacagaguuuuuaauguuuugacaaaaauuuuaaaggcuacaguacaaccauacuuuucaccauugauuauuaagauuguguugcaugauuucagcuugcauggucauuuuuauggucucacacuacagggcaaagggaggaccugccuguauuuguguccacaguaaaacacuguaguuguaauuucucaacaguuuugcauuuggcaacuugagauguuaaagauuuuauaaauagcaagauaccauuauaaaguuuaaaauuuguaacuaaaagguuaaaaauucacuuuuucuucuucaucccaacuaaaaauguaaagccuaaugauguauuccuuuuuagaccaacugaagaagaagcugagcaauuacugcaguugaugacgagccguccuccugcuacgccagcugggguucgcuuuguuucacuuuccuuuuguaugcuacuggccuuuucuacacuugucagguaccuaacuauauaaguugcuccauuuucucaagguuuacuuuuauuuacucaauaaaauuguauagcauuagauaagaguuuucuacaaaagcuggucuagguauggacagucguaguuuuguuuuguuuuuuccaauuuuuaagagaaggggucuagcuuuguugcccaggcuggaguacaguggcuguucauggguaugaucauagcacagugcagccuugaacuccuggccucaaauaauccuccugacucagccucccaaguagcugggacugcagguguaugccacuggcccagcuuauuuguauuuuuuuaaaauaaggauaucaguagcaucugauucauuuuauuuaucuuauauauguacauuguuuaaauaagucgaaauaguucuucaggauuuguuaaggcaaauagcaguccuuccuucucuccuuccuauuuuaucuuucuuagaagcagugucuuucaauucuuuuagcuguuuauuuuguguuuuacugcuacaucuguaauaauauguuuguauuugauaccucuugauuuuugcuuuuagguauuuuuuauugaguucccaguaugaaagaugagaaauuaguucucugucuuuuuucucccuguccuaaacacauccauacauguccuuccuauccucucauucuccuaguaugguuauaauuuagauuagaucaauauauaguuguuaugauuauguaagcacuacugagaacucaaccaugcaguauaugauuauuuuuuacuuccuuguaaaacuuguuuuuuuuuuuuuggauuaauauuuauccuguguuuuuguuuuuugcuuuuaacuuucuugguguuauauguaccauucauguaaccucaaacucucugccagccuaaaucuucucuccagauguuuugacucauuagacagucugugaguuucaucuucuugaggagauuucuucaggagcauuuuggucuggaaugguuaccagguauaccugguaguauaaagcucucauccugggauugaccuucaccaucauuuuggagacuugcuucaucucuccuuuguuggaucuucuguuucuuauaucucauaucaucauauuacccaggcgugguggcucacaccuguagucccagcuacucaggaggcugaggcgggaggguugcuugaggcuaugaguucgaggccagcuggggcaacauagugcgacuccugucuuuguuuaaaaaaaaaaaaauuaaaaagaaaaccuauccuuucuuucuuuuuuuuuuuuuuuuuuuccuuuuuugagacggagucuagcuuugucgcccaggcuggagugcaguggugcgauaucuuggcucacugcaagcuccaccucccagguucacgccauucuccugccucagccucccgaguagcugggacuacaggagccugccaccacgcccggcuaauuuuuguauuuuuaguagagacgggguuucaccauguuagccacgauggucucgaucuccugaccucgcgauccacccgccucggccucccaaagugcugggauuacaggcgugagccaccgugcccagccucuguuuuuuuuuuuuuuuuuuuuuuaagcucuuucacccaggcuguagugcuauggcacaaucauagcucacuguaaucuugaacuccuggguugaagugauccuucuccuugaaccucccaaauagcugggacuaaggcacguuccacuaccccuggagaauuuuuuuuuuuuaagagacaguguuucgcuguguugcccaggcuagucugaaacucauggccugaaacaguccucccaccucagucucucaaaccacuggguuuacaggggugagccacuguaccuggucuuagaaugagcaaguuauuuuuagagugcugaacagguucuaaaauucuguuguguuggugguugcauaacucuguauauacacuaaaaaccacucaauuguacacuuuggguaaaucuuaugguauguauauuacaucucaauaaagcuguuuucuaaaaaguagaacaagauugaggggaaggaaaagaggaaaggauaagaaaauacgacaaucauuucaaaaaguccaauuccaaauaaaaggagguuuuagacagaacacccaagaagaaaacauuaccaacaaauuuauucaggaaaauuuccuagaacugagagacaugaguuuccagguucaaagggcuuacugaaugccuaggacaauagucaaaaagagacucaggcuaaggcauaucauccagaaauuucaaaacccuagggauaaaaaacuaauccuacgaguuucuauauuaaaaacaaauaggccacacaaaggaccaggaaucagaaugucagacuuccugacaacacuggaaguuagaagacaaugaagcaacaccuucaaaguccugaaaggaaauuauuuccaacuuagaauuccauaccccaucaaacuaucaaucagaugucaaaguaggacaaagauauuuucagaaauacccagucucaaaaagaauuuacuucacacauacccauucugaaggagcaaaauggccaggcacacuggcucacgccuguaaucccagcacuuugggaggcugaggcagguggaucaccugaggucaggagaucgagaccauccuggcuaacacggugaaaccccgucucuacuaaaaaaaauacaaaaaaauauuagccggucaugguggcgggcgccugcaguccuguaggcugaggcaggagaauggcgugaaccugggaggcagagcuugcagugagccgagauugcgccacugcacuccagccugggcuacagagcgggacugcaucucagaaaaaaaaaaaaaaaaaaaaaaaaaaaaaaaaaaaaaagaaaucauucugccuuuuaggauuugucuuuaacuuuaucuucaauuccuauucagucuuuaauuucuaagagugcuuuuuuggcucucugaauguuucuucuuuguagugucuauugguucauuauagcauaauuucuuugauauuagucauacugauuuugaagagauuuuauuauuuguauugcuucuuuucucuaagcugcuuuuuuucccugccuuuuuugggucucuauuuuuaaaguuagaagcuuuucucagauacuuaauauuuauuauuauuuuuaaauuucuauuuauuuauuuauuuagagaugggggcucucucuguugcucggggcaaacucagugguacagucauaacucauugcagcuuugaacuucuggggucaacagauccuuccaccucagccucccaaguggccagugugggccaccacaccuggcuuauuuuuaaaaguuuuuuguagggauggggucucacuuuuguugcccaggcugauuuugaacuccuggccuaaggugauccuccugccuuugccucccagagugcuguaacuacaggugugagccaccacacccagccaauauuaauuguucauauacauauauaaauauaauuuuugagacagaguuuugcucuuguugcccauggugcaauggugugaucucggcucaccgcaaccucugccucccggguucaagugauuguccuguguuagccucccgaguagcugggauuauaggcaugugccaccacccucagcuaaguuuuguauuuuuaguggagaugggguuucuccauguuggucaggcuggucucgaacuccugaccucaggugaucugccugccuuggccucccaaagugcugggauuacaggugugagccaccacgucuggccgauuguucauauuuaagacuaggaaaugaaaaagcauauuagaaccucuaaugcauaagugggucuuugggaaacucuugggcugaucagaguucuaaagauuauugucuggccuggagagggaagaccuauacagaaacccauaaacaaaguuaaagagugaggguuaagggcugguagauaucagccugcaguauaaucguuuacuuaauucuccuacuuucagaauggugcuccagauauaccugguugucccuuaauucagaugcaugauuuuaccaccuccagacaauaaaucuccagucuucucucugcugagggaaggguauucuucuaguugugcagaaugcaggaggugauuuggaggucuacuacuuauauagaaugucaaccucuuaauuuuagucugucuucacucucaguccuggaacugccuggaguagccugagcccuuugggaauuccgugguauaaaauggauggguuuucucuucuaccaguuuagcauuuugcuuccucaggucugcugaguccguuuccauuuaucuauauauucucuagcuuccaguauuuugugguguugucccuccucaauaucuuaugcguuuaugccuuuuaagaaaaucccuuuaauguagcuuuaauggaguuucaggaugguguaaaauuagguacaugaauucuuucuuuucuuuuuacuugaaguacuuucuaaacauuaucucaaauccucauuacucuuauaagguauuuuuuuuuuuuuuuuagauaggaucuugcuuuguuucgcaggcuggaguccaguggcacgaucagggcucgcugcagccuuggccucuugggcucaagagauccucccaucuuagccucccguguagcugggacuacaaacaugcgccaccaugccugucuaauuuuuaaauuuuuuuguagagaugggaucucacuuuguugcucaggcuggucuugaacugcugggcucaagcuauccuccugucuuguccucccaaauugcugggauuacaggcaagagccacugugcccagccuuauaagguauuuuugucuauaucuuauagauagaaaaacuaauguuuagaaagauacuuaaaaguccuuaagauaggccaggcacaguggcucaugccuguaaucccagcacuuugggaggccaagguggguggaucaccuaaaggucaggaguucgagaccagccuggccaacauggugaaaccccgucucuacuaaaaauauaaaaaauuagcuggguguguuggugggcaccuguaaucccagcugcucgggaggcugaggcaggagaaucucuugaauccgggagguggagguugcagugagccaagauugugucauugcacuccagccugggcaacaagagcgaaacuucucaaaaacaaaaaaaaaguucuuaacauuugagagcuacagugaaaaaggaaaagaaagauuauuuguguuucuucuucaagaucacacuaccaguaauuagcagagaugggauucucacucagaugugguaggcuguaaaggcuguaaucuuucuacuacauaacacuuuauuauuuguuauaugguuuagguauaguugagaaugaccuuuuuuauuuucuuagcuuuugguaauagaagaauuauacuuuucauuugcuuuuuguugcaucuauuuuuacugcacugaaguggaaagagauuggugaaaaaauuuucacaagucaacgucagcuuguacuuuucaauuaaaauuuagaccgggugugguggcucaggccuguauucccagcacuuugggaggcugaggcgggucagucaccugaaaucaggaguucaagaccaaccuggccaacagggugaaaccccaucucuacuaaaaauagaaaaauuagccaggugugguggcagacaccuguaaucccagcuauucgggaggcugagguaggagaaucgcuugaacccgggaggcggagguugcagugagcugagauugcgcugcugcacuccagccugagcaacgagagugaaacuccaucucagaauuuaggaauucccuuuaaaaagucauuguuaggcuaggcaugguggcucaccucuguaauuccagcacuuugggaggcuuaggcaggcguaucacuugagcucgagaguucaagaccagacugggcaacauagugagaccuccccucuacuaaaaauaaaaaauauuagcuggaugcaguagcgcaugccuguagucccaacuacuugggaggcugaggugggaggaucacuugagcuuggguggucgaggcuauagugagcuaugauugcgccacugcacuccagccugggcgacagagcaagacauugucucaaagaaaagucguauuuuuauagccauuuuucauaucugguaagccugugacugccuuuuuucccaugauuagugaucauuuauuucucuguaacuuugagaucuacucauaagguuucuauaaauuaaauuucauuuuuccagaagauggacugcucauuacuguuuggcacucaguuugugauauuuugaugcuuaaguguuaacacuagauuuuuuucuauaugaaauaaauaucagcuguuguguaguuguuuuaacaaguuaaucccaaggggccuuuguuuucuaaggaaugugaagaaucuuacucuuuccaaccugugaaggcaguaacuaagacuuugagaggggauccaugaaaaaaagcaaagguccucauucuugagcucuagaauuacuucauaccucaaugacaauuaauggcccaauucagcaagccuuuaauuugacuugauacuugaaaauagggcaggaaaaauaauuucuaccaaaaauaacuucagaaugcuuuuuauucauaugcuaguauaucuaauuuaaaccagugacauucugguauauuuuauauaguacaccugaacaggagcagcugauggugguguggcuaaguuggaugauaaaagaagaagcguauuuugagagguaagauaauuugauuuaguuaguugagaaagcuuuucuucuucucucuuuggaaaauucauauuuccuauuuuguuuugacaguacuucaggcgucucugcuucuuuuggggagauguuauuauugguggcuauguacuuucacagcaaccagcuuagugcuaucauugacuuggucuguuccacuuuggggaugaagguaauuuucuuuuaacuucuuucuaaaaaaaaaaagguguuucuaagcuggacauuuuguuguaguguaaauagauuguuuucauuuaaguaauuuuaauuguuuaauagaaguuuuaucaagagcgcuuagaaaaaugcauuuugaaaccuguauuuacuaaaauaauagauacucaugcaaaaaccuuggaaagcacagaaaagggaaagauaucuuauaauuccaugauucagagauaccuaguauacuacuauuaauauucugaugucuguucuuucuuuaaagugacguacauauuugaugauuuaaaaaaauuaauauaugaugagcauuuacucauaucaauaaauauuauaauacaguauaauuuuuaaugacugcauugucuuauaguccauuguuugaucuucuuaauaggucccuuauuauuucccauguagauuuucuaguuucuguauaaugcuuagaggaauguccuuguuuauguaaauacacacauaggcacccacauguaucucuucauacaccuguuggauuauuuucuuaggauaaauuucuagaagguaauugcuaaggaaaaguguaugacuauguuaagguguuucaugaguacugucagauuaucuuuucgaaagauuguaucaguuuaacucuuaccguuaguaagaacuacuguuuuucuaaacuuucaacaugacugagcauuacuauuuuuuuuuaaucuuugcaaauuugguugaugaacagugguaucacuuaguuugaauuucuuugauuacuagugaaacuuaguauuuaaaauuuauguguuuuggcuuguuuauuucuuuugugaaaagcugaucaguauccuaauuuuccuguagggacuuugauuuauuuuuuucuuucacugauucaaaaggaaagauaugucauuaugccuuauacaucuuacuucauauauuucaagacguauauuuuacccaguauugaaauugggauucauuuuacaguugacauguaauaugaaagugguaguguuccaacuccuacuuuuuucuugaaaagcuacuguaauauuaaaucagugacauaucuuauaguaucuuuaaaaguggagaguucaauauguuauaauugacuuuuuccaguauuuuuugccauuuaacuucgccauguggaaauuauuaucauuauuauuuuuauguaguauauuaaauguuuuuuuuuuguuuuuuuuuuuugagauggagucuugcucugucgcccaggcuagagugcaguggugcgaucucggcucacugcaagcuccgucucccagguucaugccauucuccugccucagccuccccagcagcugggacuacaggcacauaccgccacgcccggcuaauuuuuguauuuuuaguagagaugggguuucacuguguuagccaggauggugucgaucuccugaccuugugaucugcccuccucggccucccaaagugcugggauuacaggcgugaaccacugcaccuggcuguaaauguucuuuuuguguuuucuauuuugcucuuaugcuuagaaauguuuuccuuucuuggguuuauauaaguggucacuuauauuuucuucuaguuuuuuuuggugguuucauguuuuacauuugaacauuuuaaucuacuuggaguuucuuuugguguauggugugauaugugcaaaaaguguaugugugucuaucuguacauauacauauauacauauauuuguguguguauaugugcguauauacagacacagacacacacauacacacacacacauauuucucuuggccucacagaggggcagcuauccuagcuccauguaguaaauaaucuguuucccccaaccgacugaaaaugccaauaauaguauuuauuaagugcuuuuuauauugguucuguuuuugaguauuaacacuuuaauguuggguuugggaaagcacuucuaaaacagaguagaguacuugaacauuugaacauuuauguguaucauagccauuuuagauaaguucccuagaauaaauuguguuucauauauuuuuacaugcuguuggaauucuuuugguaauuuuagauuguaauuaagccaagcuccuugagcaggaugaagacaaucuucacacaggaaauuuuuacugagcagguauuucuuuuuauucuuagguacuuauuuaacuuucuuuuacaauauucuuugggagaaaacuugugugucuuaccuuaagaaaauaauauggucuuuuuucuuuuuaaacucaugaugauuuauuucaucuuugaaacuuucuuaaagaauaauccauuuaaaauacacuuuuaaaacuagucauaacauaccaaggcaucuuuugaauuuauguauuuuuggagacuuugaguagauacuuaggagaauacucuuagauguugcugguagggcaucucaagggguaauuguuuuaaugugucuggagaaagauaaaaugaaguccuauuuaaaccuuuaggcuguaaaauucauuucuaacuagauuacaggcuagagucuaaauuucuuauacuuaacauguucuucuuuagccuuagcacuuuuguccauggauaagcauaaggauuuuuuucauuucuuuuuuuuuuuuaucucacuuugucacccaggcuaguauacagugguauggucauagcuuacugcaaccucugccuccuggguuggagcaauucuccugccucagccucccaaguagcuaggauuagaggugcacaccaccacgccuaauuuuuguauuuuuaguagagaugggguuuuaccacguugaccaggcuggucuugaacuccugaccucaggugauccacccaccucagccucccagagugcugggguuacaggcaugagccacugcacccggccaguuguugcuuuuuuguggcuauuaauaucuuuauuucuauauuuuacuaucccucccacccucaacacgcauaugcacauauacuccugaauuacaaguagucacacagcaugugggagaaucauaaguuauuuuuugucuuuaaauuugaaccaauuggaagacaacuuugaagagggucuuuaaaagacgauuagagccuaugcaugacauauugagaauaaauauuucuguuuauauuuauguggugcuuuauaguucauaugauguuuuuccaaaaagaauauuuuccccccauaacaaugcuuugaggcagguauggcaguguccuguuuuguagaugugaaaaagauucagaagauaaaugacuucuucaaagucauugagcccagauuguaugcuucaaaauuuuauuuuauuuuuuuaccuuaucacaccacuguguauguaucuauguuuauaaacaaaaaauuagggaauuauauaaaucccuaaauguacauuuccucagcauucaaagacaauuaaaacauguaauaauuuauuuucaucauucauuucuagggaccacacuuguauuagguguugacagucuacuuacuaaucucucuuucaaaauaauuuuauauuuaguucuauuauauuacuaaugcuauuuuucccuuuuagguugucacagcucaugcaguucgggucccugucaccagcaaccugagugccaacauuacuggauuuuugccuauucauuguauuuaccagcuucucaggagccguuccuuuaccaagcacaaagugucaauaaaaguaugccccuacaaauaaaacaaaauaaaagcaugccccuacauuuuuauauauauauuuuuuuucuuuugagauggagucuugcucagucacccagguuggagugcaguggugcagucuuggcucacuguaaccucugccuccuggguuaaagugauucuccugccucaaccucccagguagcugggacuacaggugugugccaccaugcccggcuaauuuuuguauuuuuaguagagacaggguuucaccguguuggcuggcuggugucgaacuccugaccucaagugauaugccugucucaaccgaccaaagugcugggauuacaggcgugagccacugugccuggccuacauuuauauuucaaagaacaaccuaaauuaaugcuuucuccccaguuguauuucaguuuguaggcauuuauuguggguuuuguguaggaaaugugugguauuaagcuaaguuacuagucauuuauauaaguauaguaauuagggauaguaauuauaauuauauaauuauacaguaauuucagauuuuuaaaacaauguaagauuuucaaaaugcauaauacuccauuuaaauucucaauaguggcacauggcuauuuuauuaaaacuuagaaacugccauuuucuaauuuuuuuuuuuaauuuuaaagacagggucucacucugucgcccaggcugucauagcucacuguaaccucaaacuccugggcucaagcaguccuccugccacagccuccuaaguagcuggaacuacaggugcgagccaccacuccuggcuuuuuuuuuuuuuuuuuuuuuuugagauggagucucacuuuguugcccaagcuggagugcaguggugcuaucucagcucacugcaaccuccgccuccuggguucaagugauuccccugcuuccgccuccugaguagcugguauuacaggcuccugccaccaugccuggcuaauuuuuuuuuuuuuuuaauuuuuaguagagacaggguuucaccauguuggccaggcuggucucaaacuccugaccucacgugauccacccaccucggccucccaaagugcugggauuacaggcaugaaccaccgugccuggccucauaccuggcuuuaaaaaguguuuuuuuguagagacagggucucgcuauuuugcccaggcuggucuggucuugaacuccuggucucaagcaauucuccuacuucggccucccgaaguguugggauuacaggcaugagccacugcagugggccugguuuuguuuuacaaauuggggaagcugccaugacuaguauuuguugauuugucauaaggacaccucacaccuaacuuagaauuuugacauguuuugauuugucuuaguuggcuauaucuaacaaguuaaaaggcccucuaaagagaagguauuaagacccaggagguaaaguagacugaaacuuuuucagauauuuacaaagaacagugaauaauauaugcaugauauaucacuuuuuaauuguugcuuguuuuuugugauuuagugagauuauuuuccagccagauugcaucaucugcuuuauauuuuuagcaaguaaaauagcuaagaauuaagaguucacaugcacccccaacauuuuacauguccuccauccaaugauaguuaagugauaagucuccuguaagugcuuuucagagacauuuucuuagucuaucugaggguuugcugugaaggaccuaucucucucucuccaaauuccuaucuaacgugagcucucccaugacgacacacauggugcucuaaauacagauaugguagggacuuaaaauguuuuucccacuacuuaaaaacuaauagauuaaaccgaaaggcaagcuucuaguggagggugcaccuaagaugauacagauauaaugguaguucauauuuuaaaaucaaaggcaguuaugauacuagauaauauauuuggaacugccaaaaguuaauagugaguuuuacugauucauaauucauguaaaacuguauguacuuuuauaauuuugcuugguuuuucuuuuugccacaauuaauucagugucuauaacauucuuucuuaggauuggauuuauagacagcugugugaaaccucuacuccacuucauccucaauuacuuccuuugauugauguguacauaaauucuauacuuacuccugcgucgaaaucuaauccagaagccacaaaucagccagucacagaacaggagauacucaauauuuuccaaggagucauugggguaaaauagugguucuuuuauaucuauuaacuuauuuuucuuuuaguucuucuuacuuaacccauauuuuuauuuuccuaucagaggacuucuagguaguucugaauuuaaaauuagauuaaauuuccuuagaucaccucuaaaaauuaaaagaaugguauuaguuccaaguaguuugcuaaacaggcacuuuuuuuuuugagauggaguuuuacucuuguugccuaggcuggagugcaguggcgcgaucucagcucacugcaaccuccuccucccugcaaccucugucugccggguucaagugauucuccugccucagucucucgaguagcuaggauugcaggcgccugccacaacgccuggcuaauguuuuguauuuuuaguagagacaggguuucaccauguuggccaggcugaucucgaacuccugaccucaggugaucuaccugccucagccucccaaagugcugggauuacaggugugagucacugugccuggccuuuuuuuuuuuuuuuuuuuuuuuuuuuugagacuggagucuugcugugacacccaggcuggagugcaaugggcagucucggcucacuacaaccuccgcuuccuggguucaagcgauucuccugcuucagccuccugaguaggcuggucucaaacuccugaccucaagugauccuccugccuuggccucccaaagugcugggauuacaggugugagccacugcgccuggccaguaauuuuuuuuuuuuuaagcuucacuuuaaagucuaauggguucccuggagauuguguauuugaucaaguacugugugggauaucaagauauucagcauagguuuguuuagcauccugggaaucuaagauacaccuacauucauuuagggggauuuuuuuuuuuuuuuuugagacagagucucacucuguugccccgaccggagugcagugacacgaucucagcuuacugcaaacucugccuccuggguucaagugauucucaugccucagccucucgaguagcagggauuacaggcaccugccaccacgccuggcuaauuuuuauauuuuuaguagagacaggguuuuacuauguuggccagcuggucuccaacucgugaccucaggugaucugccugccucagccucccaaagugcugggauuacagguaugagccacugcuccuggcucauucagggaaaauuugaugaaaguauuuuuuccccaguuuguuagaagggaaaaacaguugcauuuuucacaaauauauuuaaguauacaaugucuuauuuaggaguuacuuuuuucaugguaauuucauauaauacuugggacuccugucuuucagaagcagccugauggguuugcuauugaguaguagcugaagucuuuucuuugucuuaucuuaaagaccacuuaagcauguugccuuucaucucucaugccaucucagauuucauguuguuuuuuugaguuuaauacacacacagcaacauuucuccuguuuuaccugaguuaggagcagcaaugcugaauagucuauuuugauucuuuuacuaucaagaaaaaaaaaagcacucgugaaauucagaguauuucagaguauuuguaauauuaccuccagggugacaacauccgccuuaaucagcguuucaguaucacagcacagcuuuuggugcucuacuauauacugucuuaugaagaggcucuucuagcaaacacgaagacuuuagguaaguuguacguagaggagugguucuagugguaguuuauuuuauuagcuuguauuuuguuacuuuccaaacuguucuuugauaagggcaauauuuuaauaaacucuaguaucauuuuauaaucuuugcaaugugggcauuguauacuugauacauaaaucauguauguugggguauguaaccacgauuuauggcccaguccuccuuaucagaggcuaaauuaauagauaacagaauugccuguauuuuaacaauuguauaggucuuguucacuaaauauaaauuuaacaccugauggagcuguaacugaauuuuuuucucuugauuugaguugagucuuugaccggucuuccuuccauuaguguaaagaguaacaaccuaaucaaaaacaauagaaaaggccagucgagguggcuuacgccuguaauccuagcacuucgggaggccgaggugggcggaucaccugaggucaggaguucgagaccagccuggucaacauggcgaaaccccgucucuacuaaaaauacaaaaauuagccaggugugguggcucaugccuguaaucccagcuacucaggagguugaggcaggagaaucccuugaacccagaggcggaaguugcagugagcugagauugcgccacugcacuccagccugguggacagagugagacugugucucaaaaaaaaaaaaaaguagaagaguuucuuuuuuuuuguuuuguuuugguuuguuuuuuguuuuuuguuuuuuguuuuuuguuuuugacagucuugcucuguugcccagccuagagugcaguggcaugaucuuggcucacugcaagcuccacuuccugaguucaugccauucuccugccucagccuccggcguagcugggacuacaggcgccugcuacgacgcccggcuaauuuuuuuguauuuuuaguaaagaugggguuucaccauguuagccaggauggucuucaucuccuaaccucgugauccgccugccucggccucccaaagugcugggauuacaggcgugagccacugcgccuggccgaagaguuucguuuugccguuaacauugggcuggguaugguagcucauucccuguaaucucaguacuuugguacuuugggaggcugagaugggauggucacuugugcucagaguuugacaccagccuggaaaacagcaagaugcccaucuccacacacacacacacacacacacacacgcacgcacacacacgcacacagagaaugucacugaaaugggcuuugaaacuuaguuacuucacauaauaucagaaggucagauuuagcaugcaugauaucauuauaaagugguaucuuuuccuguauuugaaaaagaagguuuaccuguguuuauacuuccuacauguguauaguucauuucaucuauuuauuuuuugagacagggucucacucugucacccaggcuggagugcaguggcaugaacauggcucaguguagccuugaucucuugggcucaagggaucccugccucagccuccaguguagcugggaccacagguggacaccaccaugccuggcugauuuuuuuuauuuuuuguagagaugggauuugccauguugccaggcugaucucaaacuccugggcucgagcaguccuccuggcuuggccucccaaagugcugggauuacaggugugagugauccuccugaccuuuguguguaguuuuuaauuuguuuuucuuuuuuuuuugagacaaaaucucacucugucacccaggcuggaaugcaguggugcgaucuuggcucacugcaaccuccgccucucagguucaaacgauucuucugcuucagccuccugaauagcugggauuacaggugcguaccacauuccuggcuaauuuuuguauuuguaguagagauggaguuucaucauacuggccaggcuggucucgaacuccugaccucaagugauccacacaccucagccucucaaagugcugggauuacaggugugagccaucacacccggccuggauuuucuuuuuuauguuuugacauuuucugugucuuugauacaguucuuguuuggaauuucuguauauucucacauauuuaaucuuuuccaugaacuuuauaauaauuuuguuaaauuucacaaaugaaaauuauguugggauuuugauaagaauuauguuaaacuuauagauuaauuuggagagaauuuacgucuuugcaguacuaagucuuccuaucuaggaaccugaaauaauuuuuugcuuuuuaaucgugcacauauagucuuuuuuuuuuuuuuuuuuugagacagagucuuguuguguugcccaggcuagagugcaguggcacgaucucagcucacugcaaccuccaccucccggguuccagugauucuccugccucggacuccugaguagcugggauuacaggugcccacuaacacgccccacugaauuuuguauuuuuaguagagaauggguuuuaccauguuggugaggcuggucucgaccuucugaccucaagucauccacccaccuuggccucccaaagugcugggauuacaggugugagccacuuugccuggccuuacuuuagucuuauaguuaacucauguaaacccucauaacaauucugagauaggugugguuacguuuauuuuacaggggagaacacugaggcacaaggaaguuaaguaacuucccuaaguuaguauuaaguauuguaauaaguauuggaaccaggauuuaucucuuucuggaaccuauaacuauuguuuuaacugccuucugauuuuuucuuaauucauaaaagauugguauggaaaacuaugcuaauuuauuaacuuaaaagggagauuauaucuaaaugagaguauaugguauauauguggucuauauagacagugauucucaaccuuuauucuaacacuugcacuuacauacuucuuguccuuaauaaaagaaaaaugguugagcuuuacuguuuguaguuuguaagagaauaaacacauuguacauccuuugugaaauuacaaacacccugauugagauucucauauauuccugugguguaaaggaaaguaccuuggaaugagcuuugggugccaggcauauagaaugcaguagagaugagacagagaaagauacuauugacuggcaaggaccuuuacucugugugaucugaggauucacugaagguggccaaaucucuauuuaaauaagaugacuauggccgcagguugaaggauggauuaaauuggaggcagggaaagugggccauagaagauauuuaaacaaaaggugaguaggcacugaauuaggauagcagcaaaaguacagaaauuaaaauggacuuagaagaaaaaaagguuggacauggcugguugaggguaggaguugugagagaaggaagucaaauucguauugccugacuuaauuuaaaaagaggccagauaugauggcucacgccuguacuuuggaaugcuggggcugguggaucaccugaggucaggaguuugagaccagccuggccaauauggcgaaaccccgucucuacuaaaaaugcaaacauuagcuaggcgugguggcgggcaccuguagucucagcuacuugggaggcugaggcacaagaauuguuugaauccaggaggcagagguugcagugagccaagauugaaccacugcauaccagccugggugacagagugacucaucucagggaaaaaaaaagauuuagucaccacuauuguauauaauaugauaaaauucacuguggcucaugccuguaaucccagcaguuugggaggccaaggcggguggaucaugaggucaggagaucgagaccauccuggcuaacacagugaaaccccaucuuuacuaauaauacaaaaaauuagaugggcgugguggugggcgcuuguaaucccagcuacucaggaggcugaggcaggagaaucacuugaaccugggaggcagaguuugcagugagccaagaucgcgccacugcacuccagccuggugacagagcgagacucugucucaaaaaaaaaaaaaaaaaaaaaaaauuggccgggcccagugacucacgccuguaaucccagcaauuugggaggccgaggcaggcuagaucccccugaguucaggaauuagagaccagccuggccaacauugcaaaaugcugucucuacuaaaaauacaaaaauuagccaggcauggugguggaugccuguuaucccagccaaucuacuugagaggcugaggcgggagaaucgcuugaacccgggaagcggagguugcagugagcugagaucgugccacugcacucuagccugggcaaaaagagugagacuccgucucaaaaaaaaaaaaaaaaagauaaaauuacaguuucuuuuuauaagaugcauuggaaucaugaagcucuaggccauauguucaugaucacauuugaucuugucauuagguuuuggaaaaucuugacucacuuguugguucuuuuaguguagggcacuuuugcacauggcuucucucaaccuguuaugaauuuucuucugucuaguuuuaaauuucaggacauuuuccagaucuugcuccagguauguucuuguucuuccuguguagccacuuguuuucguaaugauucuucaucuuuuauaugcuauauucgcagguuaauugcauuaaaaguaauuugacuuuguuuuuguuuccauuuggguugaagguuaagauuucuguuguuucuggacauuuuauuuauuuuacacuuuuuaucuuugauagcugccaugcaaagaaagcccaaaucauauucuucuucuuuaauggaucagauuccuaucaaauuccuuauucgacaggcucaagggcugcagcaggaguugggagguauguuuuauuuugcuuuuuacugcuaaaguuuauuguuaaaaaaccuuucuguuuauaauguuaugaaguguaauaggugcuuaauguuaaaaauucaaacaguucaagagugaaauuccucuuugccucccucacuaaaucuauuauuucaguuauugcaaaccagccugcccccuaaaacgcaacccuagcuauuuucaguugauauguauuuucaggcuuuuuucuccuguagguugaacuguaugaaauugcagauauucagcuaauuuagagcuacagaaacagcagguucuugugguugaaccuaacagacacuuaacagagguaaaaaaaaaaaaauuuuuuuaacucugaauaguauuguacacuaccucuuuuguuuguuuguuuguuuuuguuuuugagacaguggcucacucugucauccaggcuggagugcaguggcaugaucuuggcucacuguaacccccaccuccuggguucaagugauucucaugccucagccacucaaauagcugggauuacaggcaugugcgccaccaugccugucuaauuuauguauuuuuaguagagacaggguuucacuauguugcccaggcuggucuugaacuccuggucucaagugaucugcccaccucggccucccaaagugcuggaauuacaggagugagccaccaugcccggccuccccugccucaucuaaggcuuguuuuuuuucuuggagucuugaacaucuuuacauaucaguacagguagaucugccuuacuguuucugauuguuuuaugauccauaguauggauauauuguaauauuuuuacuauaaauccuguuaaguagaaauauuguaguguuuuuugaaauuagauauuuuucuuucuuucuuuuuuuuuuucuuuagggaaagggucucacuacguuauccaagcuggagugcaguggguaacugcagccucaaacuccugggcucaaacauccuccuaccucagucucucuaguagcggggacuacaggccuaugccaccacgcccagcuaauuuucuagagauuuuuucuuaauuaaauaccucuuuaauguuugaguguggguguuuuucuuucuguuaaguuggaauuuucuuuuucuuuucuuuuuuuuuuuuuugagacggaguuucgcucuugucucacaggcuggaguacuguggugcgaucuuggcucacuucaacuuucuucucccagauucaagugauucuccugccucagccucccgaguagcugggacuacaggcuccugcuaccaugcccagcuaaauuuuuguauuuuuaguggagaccucauuucgccauguuggccaggcuggucuugaacugaccucaggugauccacccacgucagccucccaaagugcuaggauuacaggcgugagccacugugccuggccggaauuuuuucuuuauuaugguugguuucaaggagaaacaugagccuucauugcucaucguuaaccggaugucugcagcauguauuuacuuaugucuuuguauaaucuuuuuuuuuuuuuaaguagagaugugguuucaucauguugguuaggcuagucucgaacuccugaccucaagugaagagcccuacucagccucccaaaguguuaguauuacaggcgugagccaccgugccuggcuucuuuguauaaucuguuuccagaaaauaauguuauuuuuaacagcauuuggcaauugauauacuuuauugaaaagaguaugaaauguugauuaguuuacacuuuuguaagcagucuuuuuugugaugguuggguauaguuuuaacuguauauauacuccuguaugcauuuagaaguuuaaauguuaaaguaaugccauuuuugauuguuacgaugucuuuucaaacacagaaacaucaauuuuaagcuguuucuaugagaacggaauugcguauuguuucuacugggauaaagcagugguaucauuugauuugcauaauaaaaggauaauuagaucuaaaguacuuugauuccuacuacuacugcguagucuuacuguuaugaugauaauaguaugguagcaacaauauuuauuagguacuuaugugugaagcacuuagcauaguaguacuucguuaauucauuaacuaaauaggcauuuuuauggugucauaauuuuuuuugagacagcaucuugcucugucacccaggcuggagugcaauggcaugaucuuggcucacugcaaccuccacgucccagguucaagcaauucuugugccucagccucccaaguagccaggauuacaggcgugugccaccacgccuggcuaauuuuuguauuuuuaguagagacaggauuuccccauguuggccaggcuggucuccaacuccuggccucaagugauccaucucccucagucucccaaggugcugggauuacaggcaugagccaccgcacacagccucucauuauuaacauuauacauaauagucaugaauagucaaacugugguauagguaaaauguuauaaauaaggcuuugauuugguaacaaguuuucccauuucuuuuggucuucuuuaauacuucuugaaccaagaaaaaaugccccccauuguggguaucaucaguacugcuucucuuggcugacauaugugacugugugacuuuaggguuguuaauguuaauaaaugucuuucagcauuguuuguuccuuacaguagaauggaggcauugcuuacuuuguaugaauguuagggagagaugagaaaacguacauaaaguaccugagaccuuucagguauucaaagugggcaacuuuaauuuuaccauaucuauagugaugauucucaacaggguuggaggaaagggcauguucucuacagaagccuaucaguauuucugaauaggaccuuuuccaaaccauauaugauaguccccaaauggacauucuuuucuccuccuuuucuuuccucuacccugaacucuugaaccauugcuaugucaaacaacuuuaggagacuguuauguugggugggguggaagaaaguugaaagcuuucuuuauaaguaguaguucccaccucacuguuuaucacauuacuucaggaucuucauuuaagcaguuucccuugaucaaaugacugucaggaaguucuuaaacuguaguuugcaugcacaagaagugcacauuccuaggccuccauucuagagcuucugaucuaguaccugggaugguauucauuauucugcacaugaaacaagcuucccaagcuuauggugcugguggugcucuaaucauucuuuuuuuauuuuugaacgggaguuuugcucguugccugagcuggagugcaauguugcgauccuggcucacugcaacuucuaccucccagguucaagugauucuccugccuuagccuccugaguagcugggauuacaggcacccaacaacacgcccggcuaauauuuguauuuuuaguagauacgggguuuugccauguuggccaggcuggucuugaacuccugaccucaggugauccacccgccucggcuucccaaagugcugggauuacaggcaugagccaccgcgcccggccaucuaaucauuuuuugagaaacacugacuuagagcauaacccucuuuccuugugggcugauggcuugauaaaaaugagagggguggggaagcuucugguguuugagcaugaagaauccaauugauuuucuguaaauuuucaaggguugcauucagcuuuacuacgucuccuugcuacuaacuacccacauuuauguauuguggaugacuggauuugugaagaagaaaucacagggacugaugcccugcuacggcgaaugcuccugacuaauaaugcuaaaaaucauucucccaaacaacuccaagaagguauaguaaauuauugauacuccuuuaaccccuuuuguaguacaaggagaugcuaggcuaauugaaaucuuauaaucauacagaauuuucccauggauauaacaauguuuuggugaauguauuuuaaguauauaaaauacucuuugcguuuaaggaauuuuaugcucccuuccccuccccccuuuccuccuuucccccuuuccccuuuuacuccuuucccccuuucccccuuuucccuuuccuuuccuuuuguguuugugugucuuucucucugucacccaggcuggagugcaguggcgugaucucagcucacugcagccuccaccugcugggcucaagcaguccuccuaccugagucccacaaguagcugggacuacaggugugagccaccaggccuggcugauuuuuuuaguuuuuguagagaugggguuucaccauguugcccaggcuggucucgaacuuguaaguuugagugauccuccugccucagccucccagagugcuaggauuaaggugugagccacugugccuggccaggaauuuuuaccauuucuuucugaugugcuuguaucuuuucucucauagguccuauauuauaucacuaaaaagguggugugguuuuagaaagguucuaaacugguuagaaauaagugcaguguaggccgggcgugguggcucacgccuguaaucccagcacuuuggaaggccgaggcaggcggaucaugaggucaggagauugagaccauccugccuaacacagugaaaccccgucucuacuaaaaauacaaaaaaaaauuagccgggcguggucgugggcgccuguagucccagcugcucgggaggcugaggcaggagaauggugugaacccgggaggccuagguugcagugagccaagguugcaccacugcacuccagccugggugacaaagcgagacuccaugucaaaaaaagaaauaugugcaguggaauaggacuauguaauggagaauguucuucuagaucagcacuguuaaauagaaauauaaugugagcuauaacaccuauauauaaugugagcuguaacaccuauaaacuuuccaggaaaaagaaacaggcaacacuaauuuaaauaaucauuuuauuugaccaaauauggccaauauuuuuucuuuucuuuauuuuuuuugagacagagccuuguucuguugccuacucuggacugcaguggugcaaucuuggcucauugccucucaugcucuagcaauccuccugccucagcuuccccaguaccugagacuacagguacaugccaccacacccagcuacuuuuuguauuuuuuguagagaaaggguugccauguugcccaggcuggucucaaacucgugggcucaagcagucugccugccuuggccucccaaagugcuggaauuacaagcaugaaccaccgugccuggccugccaauauuauuucaccauguaaucaauauuaaaauuuuaaugagauauuuuaccccccacuaagacuccugcacuuagucuuugcaaucuguuguguauuuuacacuuauaacacaccucaauuuggacuaguuauuucagaugcucaauagccagaugugguuaguuguuauuggagagcauaguucuagauauuuuuuaguaacagcaaucuucugggugcuuacauccuauaaggggaccaccuggaggaaaguuucaaguuugagccuuucaaauaaauguuagcuaucaaaagcaauacuucagcauauuuuccucuuucaguccuguuuuuaaaaucagucugggcuggacagugacucacgccuguuaucucagcaccuuggaaggccaaagcaggaggaucacuugaggccgggaauucaaaaccauccugggcucuugauugguaaaggcaagagggaaaaaaaaaaaaaaaaaaaaaaaaaaaaagaccagccugggcaacauagcaagacucccaucucuaaaaugaaaaaaaauaaauuaaaaaauaagaucagucugaaucaccaagaaaauaagauuagucuucgggucaguaaaguguuuuuuuuuuuuuuuuuuuuuuuggagacagggucuguugcccagucucaagguuggagugcaguggcaggaacacagcucacugcaaacucugucuccugggcauaagggaucuuccucucgaguaccugguauuacagguacaccaccacauccagcuaauuauuuuacuuuuuguagagauguggucuugccauguugcccagacuggucuugaacuucuggacucaugcaauccuccuaccucagccucccaaagugcugagauuacaggugugagccaccaugccuaucccauuaaugugauuuuuaaaaaauauuuuuguucuuuaugaaagaacaacuacacuugcaugaauuuuucuuagggcccuuauuuuuuuauuuuuuugagauggagucuugcugugucacccaggcuggagugcgcuggugcaaucucagcucccugcaaucuccgccuuccggguucaagugauucuccugucucagucuccuaaguagcugggauuacaggugccugccaccacgccuggcucauuuuuguauuuuuaguagagagagggguuucaccauguuggccaggcugaucucgaacuccugaccucaagugauccacccgccuuggccucccaaagugcugggauuacaggugugagccaccgcauccaucuggcccuuauuuuaauaaguuuaguugaaauuguaccuagguuucuguaggaaacaauagcaaguaacuauaguuacuuuuuagccacauuguuuucuugauuuguuuggucuauagucugagagaacacuacuacuuccugcuugauaaacuguacagaauuuagguuaugauugcuaaauuuucuuuuuagcauuuucagcugucccaguaaauaacacacaagugaugcagauuauagaacacuugacucuacucucugccagugaacuuauaccauaugcggaaguguuaacauccaauaugagccagcuauugaauucagggguuccacggagaauucugcaaacagucaauaaacuauggaugguucuuaauacugugaugccuagaagguaaauucaguguauuguuacauguaauagauaauuauauagcagggauaauauacaauaaccuaaauuuaauuguuuaaaaaauuuuucaccacucauagcaguauuuguugacuauaugacaauauaucuccuuucuuaagacuacuaaauaguuguuauaucuuuaaguaaagcaaacuuuauugaaauagaaaccuuacaguauuucuaacuuuaggaaguucuugaaaauuggguuaucauguauaguuauuuguggcuaauuaugauuuagaucacuguuauaucuuggaucuuugcaguuguuccaaguuuugcugcacauuaaaaucaccuggagaguuuuuaccacuacugauccccagguuggaacccaugccaauuaaaucagacuguuugugggugggagucaggcgucaguacuuuuuaaaagauuccccaggugauuucagugugcagcaaaguuugucuuuagucauugggucucugcugguucauagauuggauccuuaacaccuggacaggucuagaaaacagaauacugggcuauaaauaguauacaaguuaaguaguauauaaggucugccucacaccuuuguauuuuagacuuuagcuccccagagacuacuauuuucaucucuuuuaucuuuuuauucugguauuuauauccuccccauauaucucuuauaaugacuguaauuuccugauuuuccaauuuagaaauuaucuguugacuuucuacucuacaaggugaagguuaguuagcucucuuacuugcuuccacuccugugagucccacuucuucuaauacacauugccccuuuuccuguuucucacaacacagguauauuaaaauuuuuguuaaagcaauauuucaaaugcauauuauuaugacuacagaagugguuucauaauugagcuaugugauaauccuuuaauuacaauuucauucuuaugcaagugcccucccccuuacucaacauauauguuggguuaguuaauaccuuuuuucuauuugcucaguuuuuuaaauugguaucaauaaccaauaacuaauucauccccaagcuucauuauugaggggaaauuuacuucacacuuaaucauaacacaucagauaauguaucauuaacauuuuuuuggcugggugcacuggcccacaccuguaaucuuagcacuuugggaggccgagguggacggaucaccugagcucaggaguucaagaccagcuugggcaacauggugaaaccccgucucuacaaaaaauacaaaaauuagcagggcaugguggugcaugcaugccuguauucccagcuacuuggugggcugaggcaggacgaucgcuugagcccaggagauggaggcuucagugaggugagaucgugccacugaaacccugucucaaaaaaaaacaaaagaaacacuauuuuuuuuuucuuggagacauuccuuucagagcuuucugucuucauguucccaucugggacaaauugcuauugucacucuucuuuguuggauuccauauuuuucucuuucuugguuuauauccucguuuuagugaauggaacacacacucaucucgcuuccugagaaagagagugugguaaacuuaacuuuuuugagaugcugaauuauucucauaugugacugauauuuagccuaaguguggaauucuaguucauuuuuuaaaaaauuauuuuuuauuuuuacuuuuuagauacagggucuugcuuugucacccaggcuggacugcaguggcacaaucauaguucacuguaaccucaacucaugggcucaaacgauccuucugccucagccucccaaauagcuggacuacaggugcauacccccgugccugccuaauuuuuuuuaguuuuuguagagauggugucucacuaugcugcccaggcuagucuugaacuccugggcucaagcgaaccuucugccucagccucccaaagugcugggauuucacaggugugagccacugugucaggcccuguucuucuuaauucuaagagcucuuuguuaucugaauauucuuaaaugccucuuguucuuguuucauguauaaaauacuuuauucuuuuaggauauuaauaguucgaaaauuuuuuuucuccuuaucccuacauuuucuguuuggaguuccuuuuuuucuguuuguauauuuuaaucuuuuucaaaguaaaagcuuucuuuaagugucugaugauccuuguuuauacagucauauuuaagagggggaaguucucugguggauuccugggcuucacuguaagaucaaguaccuucuguauuugcauaacccuuaguaauuaugaugugcagucauuuuaguaaccacuuauaaucuauuaaugucuaaucucaaaguggcaucucacuuggagacuuuaugaugauaaauccagaauagugacuuauauuuauggaacuagauacagaauguuuuggcaagucuuauuucauuuacagguauuaugucauuucuauuuuacagacgaggaaacaguuuagagagccucagugacuuacacagagucauauagcaaguaugguauaacuaagguuuuaacucagguuuuaauuuuauaugccaugauuauuccauuacaacugugaacguuucugaaacuacuuuguguuuacuguuuuaucucuguguuuuuuaaagagauauuuuaauagguuagaugucuguagcuuaaauuuuuucaaaguucauucauauguauuuucuaauuauuuacugaauauaacuuucuaagauagaaaggacuggauggcuacagauuuuaauauauaaaaaacuguuuugaacaugugauuauuuucuuaucaggcuauggguaaugacgguuaaugcacuucagccuucaauaaaguuuguacgacaacaaaaguauacucagaaugaccugaugauagauccucucauuguccuaaggugugaucagaggguucacagguacaugucauuugaguuucauuuuuauuauagagcuguacuuuggagagucaaaagaaauugaugaaauucaguuuaaacuuauauuuuaauuuuucuugcagauaaguaggcagugugaccugugcgguuuuuugucuuauuuuuuuaguuguguuuauucaugaaauguauauucauuuuaauauuuaguaugugauuaauaaaaccuagcuuuagagaaaugccauucuugguuuuggugccacaaauagugguuuuucucucucacaauuuagaccaguaaagaauaacuauuucuguucucacauuaaaaagguuuuuaaaaaacugguuucuugugaaccguuaccugcguuaaaacugugaucuuuuuggcaugcacaauagugauguuagcuucauugauuccacauuuggcucuaaauccuuaccaauugcuaaacuucagcauugcuuucaaguggcuucaucucaaaagguagaauuuaguuaauuccuaucauuaaucuuugagucacacuuguuaugauaaguacuaucaaaaacauauaaguugaggggcuuuccuuuaaagugauuaucauuugcaugggacauaagauagauacaugauaaguuacguaauaugcucauguagaugaauggugugguaaaugaauguucuuaaaaguucaggaaagaugcagaggagaugggacauggguaauguuucaaagaguggaguuagggcugguucgagugcagugguauuuacaacugauugaucauaaucagguacagauuucuuuguucccucuucacucccacugcuuuauuuaaacuuaaaaaaagaagaguggacauaggguuuaggugaauauuuguucaucuaauaguauaaagaugggggucagggagucaaggaagguacuuugagaaaaagaguaguaugagcagaaguuuagaagcaagaaugaggaagccgugaagaggguuauuuuugaaaagagaacauuuuacaguuggaaaguuaaauuggggucaggcuaucgagggccuugaauauuaggcuaaugugguugggguuauaacuuaggaaaagaugcuuugugcuagguggauuagaggagagagaaacuaguaaggaagacuaaauaggacacacuugauauuuaaacuugucugucaucaaccaagggaugacauucucgaagugacaaaaucuacaaaauuagcuaaauaugguuugguaagauuaagaucucauaggaaauaggaaucagaacaaacuguguauguaaaugauguuaaguaucuaauaaaaggaaaccacaauaaauaacacuucuagaaaagagcuguuucuugaaaaaaugauuuaucauuguuaaaaauccacugaaauaggugagcuuacaccugaaucaccuuaggugauucaguuuuuaaggaaguuguuaaauucuguuaucaaauuguaucuaauguuuuuguagcucggauuuuucacuuaacaacuugugaaccuuuuuucauguuaauguucuuauuucaaauuuauuuuuauuuuuugaguugggggucuugcuauguuguccaggcuggucuugaacuccugggcuuaagcaauccucuugccucagccuccugaguagcugggauuacaguugugugcugcugugccuaguuuauauucuuaucuuaauuggcuauaugguauuccauuuuauagagcuaugcuuaacccaauccccuaggauauuuuauuucuacuuuuugcuuuuaucaauagugcuuuggugauuaugugcauuuccccaugcugaguauuucauuagaacaugggaaaauggaauuauuggggcaaaagugucgugcucauuuucaagacuuuuaauucagauuuucauucuacuauguagaaaggcugaacugguuuacauuccauagcaguguuugauaguauauacuuuccugcacuauuugauauaauguuuuccaauuugauaggugaaaauagauucccauuuuaauuuauauucuuauuagacuggacauuuaacaguauuuacuggccauuuauuucaucuuuauauuuuagccuauauuuuuuauugacuuaaagagcucuuuaucuauaaaggauaucagcuuuuuguacguguauuacaguuuuucuucaugcaauauuguuuugcccgcacccggucaucuuuucuuuagaauuuacauuauacauauuugacuuuagcugauaagaugaaacaaguaauacuauuuauauaagggcuugaaauacagagaauaagaaacauauauuaaacuuuugagaaugaauauuuuagugggaaaaguuaguauguacuacucagguuuuucucagcauuuaaacuaaauugaucauguucuggcuaauuuauaaauuuauauucuuucugauauauuuuucuuuucugcuuuccuuguuuagaugccccccacugauggauauuacccuacacauguugaauggauaucuucuugcaucuaaagccuaccuuagugcucaucugaaggaaacagagcaagauaggccuucccagaauaauacaauugguuuaguuggacaaacugaugcuccggaaguuaccagggaagaauugaaaaaugcauuacuggccgcucagguaaauuuugcuaaaguaaaauuuagucaaaaagagcaagggcuucucuacuaguauaaucaguucaauagauggcacauugugcgcuccauguacauuggugacauauugugcauuucuuuuauuauagaaucuauuacaaugauguuaccuuugcuucugaguaucagauauguuguauuucugaaaucaggaauaaucuucaugauaugaaugaaauagccauuuaaauaagauuuauauuuuaauaaaauuuaaguguuuaccuauucugaguuuagaguuacauguuuauucauucggcacauuuuuuuuguuuuuuuuguuuuuugagacagaguuucgcccugucacccaggcuggagugcagagguguaaucuuggcucauggcaacauccgccucccggguucaagcaguucuccugccucagccuccugaguagcugggacuacaggcacaugccaccacaccuggcuaauuuuuguauuuuuaguagagacaggguuuugcuguguuugccaggcuuguguugaacuccuaacuugaggugauccacccaccucagcuucccaaagugcugggauuacaggcaugagccacggcacccggccucauucaaccaauauuuacugggacaccuacugugugccaaguauuguuccaggaacuggggauagaguggugaagaagacaaaauccuuaguuauuuguuucuuaagaucaaaugucaaauuauggagacagacaacagaaaaacaacugcauguauaauaaaaugucaggcagugauaaauaccaugacaauauaagcaguucaacuuuauauuuagaaaaguuuuuuggccaggcaugguugcucaugccuauaaucccagcacuuuggguggcugagguggguggaucaccugaguucaggaguuuugagaccagccuggccaacauggugaaaccccaucucuacuaaaaauacaaaaauuagccgggcgugguggcccaaaccuguagucccagcuacuugggaggcugaggcaggagaauggcuugaacccgggaggcggagguugcagugagcugagaucgugccucugcacuacagccugggcgacagagcgagacuccaucucaacaacaacaacaaaaaucaauaaaauaaaucaauaaaauaaaucuguuccuaggaguuucagauaagggauugaagaucauaaaagcuaacaucuguguagugcuuaccauaugguaggugcuagccuaaguucuuuaaauauauuagcucauuuaauuuuuauaaccuaccuaugagguauagaguauuaucuccauuuuuacagaguaggaaaaugugacccagagaaguuaagugacuugcucaugguuacacauuuaguaaaugucagaaccaggauucacuccuaggcacucuggcuccugagucaacaacaacaaaagaaaacaaaacaauaacaauaacaauaaccaaaaacuccuuuccccaagaaccaugauuauaaaguagucuaaccucacuuuauaauaaguucuuaaucacuuagcucaaguaauuguuuucucuaccuuaggcaguagcugucuaucagagguggaugucauguauucauuuuuauuuuuuacuucuuucugcuagaugagagugauuuuagcucuccuuuauauauaggggccucaaauauauugccauuaccccucaagcuacugcucugugcaaugaugcucaagccuguagacugagcaaugaguugugcagguggaauggaugguaagguagacucuuuccuugugaaaccagagccuuaaacagguugaaaaaaagggaaaucaggauagcauacugggaaaaguaggagauuaagaggaaggaaaggacauucugguagaagucauuuuugccuagggccuguuuuggauguaacugaauucaugauacucuucuaguagauauucuuaaacuggaguccauggaucuauuuuagagauaugugauaucauuauguaaugauguuuguuuauguauguuaauuuuuaucgggagaggguacauaguuuucuuuagauucuuaagggguucauaauccuaaaaaggugagaaccacugcucuacagauugcucaguucugcucuuagaaguaccucuuuguguauguguguuuaagaaauuaguuauuuuaucauaucuguucaugugaaaauaaaaucugauuuguuuuuuaacuucuuagaaacuucuuacuuuuucuauguuuuguuugcuuauaggauagugcagcuguccagauucucuuagagauuugccuaccuacugaagaggagaaagcaaauggugucaauccagauagcuuguuaagaaauguucaaaguguuauuaccaccagcgcuccaaauaagggaauggaggaaggagaagacaauuugcucuguaaccuucgagaaguucagugccuuaucuguugucucuugcaccaaauguacauugcagaucccaacauugcuaagcuuguucacuuucaggucuguuuccaaagaaugaugcuuuguguuugaacuuuauuuuucuugggggcuuugaauacuauauuaacagggaucauuuagaaaccagagaaaacacaaaugauccaugggcuuuugcaauauggagaaaaauccagauuuuuaguuguuuuuuuuuuuaaccuaaugaaauguucgauaguuuaaucucuauucuagugcaucagaaaagugaaaugccagguuacauauggggcacuauagccuucugagcaauuuuuacagaaaggaaaugaaaucuuucauuuguauuuuuaucuguacuuuuauaguuauuuuauuucugacuuuuuucccguuucuuguugagauaggguuauccaugugaacuuuugccucugacggucgcagguauuccaucuaugcacaucugucuagauuucauaccugagcuuauugcacagccagaacuugagaaacagguaaugagcauuuuggagcuuuaggacaauugaucucucucuccagucuuacuaguuauacaaaacauuuuauaauuuuuaauaccuaaagauauucuugagaaacauguaauaacuggauuuuguauugcagauauuugcuauccaguugcuuucucacuuguguauacaauaugcauuaccaaagucacuuaguguggcucguuuagcugucaaugucaugggaacuuuguuaacagguauguagccaaucaacaucaacaaacaucugacauaaauuauuauaguuccuauauuuucugcauuuagugaugcaauauguuuuuucugucacucugagacaguaugauacaauauguguuaaauacuaguuuaacuuaugccgucuuuugaauucuucuuuuggaaacuucuguuuacaaaugugauuuauaguguagugggaaugaauagguaggcaaauuguauuuuucauuuugugaaugaguauauauagauuuguaaauauaagcuuucuguauuuuauaaauggaaaacaaauacacuuucagaauguaauuguaucaguagauaacaaauguucauuuauuacaaaugcucagaguuccagaaaaauaucaucauauguauaaaugaaagauaaauguauuagaugucuucauaaguucuaaaacauauucugauauuuuaaccaccuucugguuuguagaauaaaauggucugaaaauaaacuacuuuaaaauauaugaacuauaaugcaacccuuaauguaauggcauaguuaacuuaguauucuuucucauuauaauauuuccauaauacccuguuguuuuucuuuucaucguauuuauauccuguuauaauuauuuguagugauuaagaguuuacacugccugaauucaaucucagccccaccacuaacuggcuugugaucuuuaacaaguuucuuaaccucucuaaccuuuuuuuaagaguuuucucauauauaaaaugagugucauaauaguacuuuggucauucauaagauuguaggaauucaaugaaauaaugcauguaauguacuuauugcaaaacuugugcauaauaauuuguaucuuggauaaagacugagacuacuagauugugagcuuucugaagacggguuggcuguguuuagagaacuucauaucuccagcacagagcauaguuccccuuaguauguuguguaagcuguguugaauuuauauuuguaaacuaaaauauuguuucauuuuuuuccaacaguuuuaacacaggcuaagcgguaugcuuuuuuuaugccaacucugccaaguuuggucucuuuuugucgagcauuuccuccauuguaugaggauauuaugucuuugcugauccaaauagggcaaguuugugccucugauguugccacucagacaagagacauugauccaauuauuacacguaagugguaacuuauuuucaaggguuaucuuaauaucucaaacaaaaaggccaaauuccuuuccaaauuucuuggccuuaauguuuuuuuucccuuauguuguaggucuucaacaaauaaaggagaaaccaaguggauggucucaaaucuguaaagauucaucuuauaaaaauggauccagggacacuggaagcauggauccugauguacagcucugucacuguauugaaagaacaguaauugaaauaauaaauaugaguguuaguggaauuuaaaacaaaauuuaaaacaacaaaaaguuguuugcugcauauacccaacaugaaucugcauauuaguaacaacucuaaacugaaugggaacaguaaaguauugucuuggaaucacuaaaacaauucaauucaacaugaguauaguuuagaacuuuaugagaauuaugcuugcuuguuucugauuggcacaucuuuggaucuacuuugcugauauguuucuauuguagcagcugagcuuuuuuuuuuuccacugggaacacauguaagaaacucauuauuggaaagggaauuuggccuuguauuuagcuuuugaagugaagacugccaugccuuuaauuucuuauaaaaaugagucuguggguagcccuaguguuuauuuuaacugugagcuuguaacagaaugugacaaagaugcaaagaugggagaggaaaaaaggguaaagggaaaggagaauuaaggaaauaauaggaguuaaaaacacaaguagaaaucucaaagauuugcagugcaaguaauaguaaugcaaguuggaauucuaguucucaagaaagaguauugagaagacuuuuaaaaaggcaaguagcuuuuguaaaugauuucuguggaaauacagaugaggauuuaaagauuucacauauuugcuucaauuuuuauuaauauaugaagccauauguuuaaagagauacuugaauaauuuggaauuuuaagauacugguguaaaaguguuuacagaaacaucuuuguucaaagaagaaccugagagaucucauuuaguuuuauguuuuaaauuuauuuuuauaaugcuuuauuaacuuaccuaaugcucagaggggggaaauauguaucaaauuaaaugaagguagagcaauaaaacccacuggauuaaagagcucuugguuugucaucaggauuauaauucauaucuuacuuugagaagaucuuugaguaagaaaaugcaguguuugaaccugaggaaaaguuaaaguguagaaaauauugucuugccgaaggauuuugcaguccucugucaguaacuuccauugauuaggcagacauauucagguaaacccuaaucauuaaaaaaaaauuaucaauguagaaaguaauucccuuuuuucucucugagauauaccucaaucacacacuuccccacccccacuugaaacagaccucuucacuuguguuuuuuuuuuuuuuuuccugagguggagucuuccccuguugcccaggcuggagugcagugggaugaucuuggcucacugcaacuucugccaccuggguucaagggauucucgugccucaaccuccugaguagcugggacugcaggcacgcgccaccuguauuuuuguauuuuuaguaaagacggggguuugccauguugcccagacugguuuugaacuccuggccucaggugaucugcccaccuuggccucccaaagugcugggauuacaggugugagccaccgcaccuggccagaccgcuucacuuguaaaagaaauuaggcuaauaagaagguguaguuuuugagaaaugaaauuuaacuuuagccuuuucacuaguaaauagucacaucucauuuucuuccuuuguaaaaugggguuacuacuggcccuaccucauauucuaugagaaugaguuuguagcuguuucaaaucaugaagugcauaguaucacaugugauagaauauuuauaacuuuuuauuagaugcuuaauguucaauuaaguaauuuugaugugaaaaauaaaaguaauaaaaguaucuuaaaaauagcauaagaauuuucauauuuuuaaacaaggcaguuuuguagucccuuaagauuaaauacaacugcuccuuuuuuuuuuaaacugaggccuugcgauauuuugugugaauagauaugcccuaggaguucagaaaaaguuaaaaguauguuuucuaauuaaaugcagugcacauuccuggaucaauauucaaagacuggucauaaccugcuguguuaaaauaaucacauaugcucuuuuucaucagauuuguugaugauguaaauaaaauguguaaauauauuaguaaauguuaauauucauguauuuuaaguuaagguuauaaaauuugucacaauguguuuuuuuauucaagugaaaacagaugugugcagcuauuuugaauauugguuuauaaacauucauauucuuuaucaaacgaa

SEQ ID NO: 192289 - RNA, 133090 nt, Homo sapiens
uuggaaugauuaaagaugucuuuauaaaguuuuuuucaagacuucauucuaaauacacagaauaaaaaauggugucagcucacuuguaagacaccaaccagauuuuccuuauacugucucaaaauuuaaagaucaauuuccccagagggugugcaaugcaucauaaaauggcccuuuuuugaggaugggagaggaaggguugggcaggauggaauauuaaauuguaacaugauaaacaugcaagacuguuauccaaucuagauaauuuauauacauuuugaugacuuaggaaaacaaagcaaucauuugugacaagccuaaaaagcuugacauauuuaacauacuuaggaacuuuuuuugugcggugggaauucucuaauuguaucaugugggccuuuugaaaguaacaaacagaaggccagucuguugcaaguuugcugcugaacaucacauuccacccuaagaaaacacaagguggauugcaucgaggguggauaccuuaccuuagcacagaaggaaaaaguaugucagugcaaaguauggacuaaacugcuuucaggaaaaaaguuguaaaaauugauacagguuggaaaagggaauuuuccuucccggcuuggaguccucccaauuuaaggcagaacccauccacuccaauuucugcaguuuaaaacuuucucuacuuauuuaguuuucuccucugaguucaaccgcugcuggauucguuuggcauaacuuugugccauggaguuaaugauagauaggaugaaguaacacaccaugacaacgaccaacuuuucaaacauccaggacaaccaguuuucucccuguagaaauaaaugcagaacaaugcaaugaaaaaggcuucauuaguucaguaguaaaaagaggaucaucuauaaugcuugaaguguguaacuuacaaaaccuaaagaauuaaaaaugaaaaguaagcaaccccaacuacucugaaaucuccauuacucuccuuuuuacacccaacuaucaagauuucacuuuguuggauguaaaaucaguguugaaucacauaguuuagaaugggaugagugugagguuagcucuucuacuaggaccuaagaauaaacucuuugauuaaacucaacucugaagucgccaugcagauacucaugaguauugucaagacaguuaaauauuuuuguuccaguauuaggagcuguuuuuaaaacacacaaauguaucuguuucugaugucauguuuggucaacugagggcagcaaagguccauaagaagagugcaaggccauuaaaaaaaacagugcucuggccgggcgcgguggcucacaucuguaaucccagcacuuugggaggccaaggcgggcggaucaucugaggucaguuugagaccagccuggcuaacacggugaaacccuguuucuauuaaaauacaaaaaauuagcuggugugguggcacgugccuggaaucacagcuacuugggaggcugaggcaggagaaucgcuugaacccgggaggcggagguugcagugagccaagaucgcgccauugcacuccaacuugggcaacgagagcgaaauucugucucaaaaaaaccccaaagaacaaaaaacgaaccaaacaaaacaaaacaaaaaaaaccugugcuucccucgaguuucccauuucagguuauuguuuacucauccucuucuagucauuucccuuugccucagaaucguuuacagaaaagacagucuaaguuuuaaaguucagcuaugguaagagccuugguuuauuaaaaaauuaucauuuucccaugggugaaaagaaaaauagagugaaaaucaaaaggagauauucaagucaccucaguaagucuaauacuuuguuaugcuguaaguuuuaacuuuuuaauccacuugggaaguauaucuaccaauacaucauuuaagaucaaggcaacaacucauucuauguaacagaaccauuacuuuccauuggcucuacccuuguuuuuaggagaagauguacagaaguuacacuuucuagucuaagacaaagacaaauuucccaguagagcauacacagacgcucaacuucugucaaggaacacuggcaaaccaacuucacuuauuugccuaaaaaugugagugagagcugugaauguaauuucagcccgaaacuucccagaggggagaagaaaccggauuaaagucuuaccuguggugugcccauuucgcuuuuguggugaagcuucugccguugagccuccagguacuccugaaauggcuucugcagagauggaccuaugccggggacagcacuggaagcaggguacaguagcccaaagaaaaagacacauuugggaagaaaagcaggaaaaacguuaaagaaaauguacuuaccaccuggacucaaaaggcagggauuggauaggaagaggaauaaaauauaaaaaucagagaacugcugaaauucugugaccccuuuuuaguuaaaaaaaaaaaaaaaaaaaaagaaaauuuacuccaucuaacaaccccuuaaaaaccaaaaucucucccaccaacaugucugggagaaaccaagagcuguaaaucagaaaccgcuuccagcaaaagaguuaguccucagaguaaggucagcucagcugauacuguacucugguauggcacaaagaauaaaaugaaugacuucucagaagucccacauuuaucaccacuaguuccuguaagaacugguuugaaccaauuaauaaggaaaugacuuaugcuugugucaucccuaguuaaaaaagaaacugcccgcccucucucugacuuguccccucuucucagagggggcggucuuucucaaucuaaguccuuauuaggacaaucugugcgucauccuuauccaaaaagaaugcauuagcaaacuugggaggcaccucccacuagucagaagucagugauuaacaaaggaacaaagaaggaacuaugaacuuugaauccuuucaugguuuaugguagacaguuugcacagaaacuccaguacauuaguaacagcuuguucugagaugauugggauagugaucuuugauaaauuuauguacucggagcuccuucuuacccagaauacauggaggcagugcuguuaaaccgguuuggcaacuguagcuaacaggcuccuguuuuagacaugcuugcaggcguuuuuaaaaacgguagcuuggggcaacuuagaaaaaucaaacaucucuauuuucuguaccuuuuaguuucuuaccuguuacauagggcuaaggagguaaauaaguucaaacucuuucuuagagccagccaaagagauuccgauauguacuugcaacacugccuaaugcuuguccuauuaaguacacugacucaaauucacuucacuucacuuuuuuuuuuuugagacagagucucacucugucccccaggcuggagugcaauggccugaucucggcucacugcaaccucuaccuccaggguucaagugauucuccugccucagccucccaaguagcugggauuacaggcgcuugucaccaugccuggcuauuuuuuuuuguauuuuuaguagagaugggguuucaccaucuuugccaggcuggucuugaacuccugaccucgugaucccccuuccucggccucccaaagugcugggauuacaggugugagccaccgcgacuggccuucacuucuuuucuagaacaauuccuugcugcuuuuuauaacaaaaagcaggaauagaagaguuuuugcuauuauauuuuaucagaugcuaacauaucccuaacuucuggcugauucuuuucuuuaauccuuuuuaucuaucagucaccaaauacuuaauugauuccuuuugcugggaaaaaagccaaaaaaaaaaaaaaccaaacugcccacaaggaacuuaaaaucauuuauggggauuuggauucaaaacauaggcagaugcgcacacaugugugcgcacacacacacacgaacugaucugugaacaaaauaauuuacaauucaauauuaaaguuuuugguacagaagauauauaccgaaggaauuggagggagaaaagagagaucagugaggggugaaguuguuaaaaagguccucuaggccaugugugguggcucacgcuuguaaucccagcacuuugggaggccaagaugggaggauggcuugagcccaggaguucaauaccauccugggaaacauggugaaacccugucucuacaaaaaauacaaaaaugagcugagaaugguggcaugugccuguagucccugcuacucaggaggcuacagugagagcccaggaagcucagggcugcacuguacuccagccucggugacagagacccugccucaaaaaaauaaauaaauaaauaaaaauaaaaauaaaaaaauaaaaaaaagauucuuuaaugaauacugaaggagguacaaaaggccugaacagacauauauaauaaaugugaauacugcacugaucagacuagaagaccugugacagacauaaaagaugcugugaacaaucgagaaaacucauuaccuucagacuagccucucacugagccaccgcuccuggcccugacuuuuaagcagacuuauauuagggaggcagacuaguaaucuuuccuuauauauuacaggugggaaugcaaauagcucauccauuuagacuagaaauaaaugacaugaauauaacaaauauauaaaauauuuuaaauauuuaauauauuaaauauauauaauuaaauauauguauuuuuguguauauaaauauaugcacaaaaagguugacuuugaaaacugcaaauuuauguggccgggagcaguggcucaugccuguaaucccagcacuuugggaggccgaggcgggcggaucaccugaggucgggaguucgagaccagccugaccaauauggagaaaacccgucucuacuaaaaauacaaaauuagccaggcgugguggcacaugcacagaauccccacuacuagugaggcugaggcaggagaaucgcuugaaccugggaggcagagguugcagugagccgagaucaugccauugcacuccagccugggcaacgagagugaaacucugucucaaaaaaaaaaaaaacaaaaaacugcauauuuauaagaacuuuccuucucauaaaucaauguuuucacuuuaacaguacucuggccaggugcaguggcucacaccugugaucccagcaccaggggaggcugaggugggcagaucacgaggucaggaguucgagaccagccuggccaacacagugaaacccugucucuacuaaaaauacaaaaauuagcugggugugguggcacacgccuguaaucccagcuacucgggaggcugaggccgaagaaucgcuugaacccaggaaguggagguugcagugagcugagaccacgccauugcacuccagccugggcgacagagugagacuccgucucaaaaaaaaaaacaaacaaaaaagcaaaaaaacaaaacagccuggccaacauggugaaacccugucucuaccaaaaagacaaaaauuaggccagccauggugguucacgccuguaauccuagcacuuugggaggccgaggcagguggaucaccugaggucaggaguucaagaccagccuggccaacauggcgaaacccugucucuaccaaaaagacaaaaauuagaccagccucggugguucacaccuguaauccuagcacuuugggaggccgaggcagguggaucaccugaggucaggaguucaagaccagccuggccaacauggugaaacuccaucucuacuaaaauacaaaaauuagccgggcaugauggagagugccugcaaucccagcuacucaagaggcugagaugggagaaucacuugaacccaggagauggugguugcagugagcccagaucgcaccacuccacuccagccugggcagcucagcaagacuccgucucaaaaaaaaaaaaaaaauuagcugggcaugguggcaggugucuguaaucucagcuacuugggaggcugagaugggacaaucgcuugaacccgggagauggugguugcagugagccuagaucgcaccacuccacuccagccugggcagcuaagcuagacuccgucucaaaauaaaaaaaccaaaaaaacaaaaaacccccccaaaaaacaaaaguagccaggcacgguggcacaugccuguaaucucagcuacuagugggggcugaggcaggaggauccgcuugaaccugggaggcggagguugcagugagcugagaucaugccauugcacucuacccugggcaacagagugagacuccaucucaaacaaaaacaaaaacaaaaacaaggcugggugcggugguucaugccuguaaucccagcauuuugggaggcuaaggcaggcggaucacuugaggucaggaguucgagaccagccuggccaacauggugaaaccccgucucuacuaaaaauacaaaaaauaagccagguuugguggcgggcgccuguaaucccagcuacucggggggcugaggcaggagaaucgcuugaaccugggagguggagguugcagugcgccauuguccuccagccuggggaaaaagagggaaacuccgucucaaaacaaaacaaaaacaaaaauaaaaaacaguacuguaaauugucauuuaaaucuaccagggauagccauagucaagccauuauuuaagagaaaauuaagaaccaagacccaaauguuacaaagaguauguuuuuguuguuuagggaaaugaggaagggacuggaaauaauaauucuagauucccuucaaaauaauuugaaaagguaaauaauuuaccauuguaaguccauuaagagauacacuuuauguacccauaauaauuuuaaaaagagauacacuuuagcugauagauacauuuuagcugauagaguacaucauaugauguguauucacaugauguauaacuuaucuugaggauaaugcugagauuaauauaccaauuuguuaugugucucuauggagguuuccaugaaagacuaggaaaacaguugaaaacagacaagagguuaaaaguuuuauuuauuauuauuauuauguuucuuuuuauauuuuguagagauggagucucacuauguugcccaggugggucucaaauuccuggccucaaaagauccucccaccuugguuucccaaacugucaucaaaauuuuaguuacuucuguuuuucauuucucuaccucuacaaugacuuaggcuacugaugccucagcuucaacaaaguacucuuauacuauaguuugcuuaauuaucacuaaagcuauuuuaguaacggacuagauaaaaauagaaauuacagcucucacucuuaacaugcauuuaaggcaaacaauaaugccagcucuaaaucucaugugucaaguuauucucaagcagcagaccagaagcaagaguccauucugacacuuaagauuaauuuaaagugcacacacggugggaguaauaauuugcaacacaguucaaaggcuuucuauaguugguuuaggaaauacccuaaaugccauucucccuaagccauuacauucuugcaacccugugcaccuugcuaaagaugcuaaucucaucccauaguuaaguuggggaaguccuccaauuugcccuuaagcucugauuaaauucaaagaauuaccauuucggccgggcauggugguucaugccuguaaucacagcacuuugggaggccgaggugggcagaucaccugaggucaggaguucgagaccagccuagccaacauggugaaacccugucucuacuaaaaauacaaaaaaaaaaaaaaaaaaaaauauugccaggcacgguggugggcgcccauaaucccagcuacucgggaggcugaggaaggagaaucgcuugaacccgggaggcgaagggugcagugagccgagauugugccacugcacuccagccugggcgacagagcgagacucugucucaaaacaaaacaaaacaaaacaaaacaaaacaaaacaaauaacuacaauuuugugacauagaagaacauaaaguagaaggagaacaaauggacauagaacuauuuuuucagucaacugcaggacuaaaauauaccuaaacuagcuauguaaguagguacuugcucuaggugagaaagccuuagaaaaacaaaaaaagaaguagguugggcaccauggcucaggaguucgagaccagccugggcaacauggcgaaauccugucucuacuaaaaauauaaaaaaauuagccaggugugauggcacgugccuguagucccagcuacucgggaggcugaggcaugagaauugcuugaaccuggguaguggaggcugcaaugagcugagauugcacuccagucuaggugacaaaaaaaaaaaaaaaaaaaaaaaaguugaucucauuugcuuuuccuugcugugaaccuugaacacaguggguagaaaaaucuuaguggguaguaguaucuucauauuuuuauuccuggcacaaacauaacagcaaauguaagauuaaaaaaaauuuuuccaccaggcaugguggcgcaugccuguagucccagcuaaucuggaggcugagcaggaggcucucuugagcccaggaguugggauggaggcuuagugagcuauaaucacgccugugaauagccacugcauuccagccuggguaaaauagugagauccugucuccgaaacaaacaaacacauuuccaacaaaugaugcuaguggcaauuuuuacacuuuuguuauuguuaacuucuguuaaaaaaaaaacucaggaaugcaaauaaaauuuuuuuuuuuauuuaaagaaaaaaacacagacuugaaaccuacucagagcucaaaauugguuucaugggaacaauauuuucccaugcuuacauaccuagaaucuguuaaacagaccuaagacaaacuucuuggcaagcuuaaauauuguaaaaaaaaaaaaaaaaaaaauccauucaaaauaacauuugggcaaaauucugccaagagcccuugccaaauugcaaacaaaaucuauuauuuuucuaugguuuuuaauauauauguuacucugcuucuggaaaucacuuaugugacaagaaaucuguauuuuaggcugggugugaugggucaugcuuguaaucccagcacuuugggagacugaggcaggaggacuugaggccaagaguuugagaucagccugggcaacauagugagaacccugucucuacaaaaguuuaaaaaaguagcugggugugauggcaagugccuguaguccuagcuauucaagaggcugagaugggaggauccugugagccuaggaguucaagguuaaaguaagcuaggauugaaccacugcacuccacccuuggugaaagagcaagacccugucucucucucaauaaaucaauagauuagauagauagauaauaaauaaguaagaucugaaaucuggccaggcaggauaggguggcucaugccaguaauccgagcacuuugggaggcugaggugggaggacugcuugagucuaagaguucaagaucagcuugggcaacacaguaagacuccugucucuacacccacacagaaaauuaaccagguguggugcacaccuguaguccuaguuacucaagaggcugaguggggaggacugcuugagcccuccuaggagguugaggcuguagugaucuaaaaucacaccacuacacuccagccugggcuacagagggagaaccuguuucuuaaaacaccaacaaaaaagauugauucaccuuguuuagcccuauuuacagaguguauacuuaaagucuaagcaguugaagucucuaagccuaagaauauuuuaccagcauuaauaaaguaaauuuuuuauuuaauauaggcucugcuccuuucucaaauacuuuuuugaggaucucagcauuaaugugagcauauagguuauauuuacccuccugaaaaacauucugacauaaauucuaguaaggaggcgauagccucuuuacaaagaguaauaagccuuuugucuuagaaaaaagucugggcacaacaguuuuuuaccuuuauuucauuguuugugcuggguuaguauucccucugaugauuaaucacaaagucuaaagaaucucagggugucauaagucagaucccugaaagcuuauaaaugaaaaaaaaaauuuuucaggagaagauucaggucaggguacuuauaaaaagaaaagagugcucagcuugguggcucacuguaaucccagcacuuugggaggccaaggugggaggaucacuugagccuaugaguucaagaccagccugggcaauauagugagaccuccucucuacaaaaaauuuaaaaauuggcugagcaugcuggcaugcgacaggaggugggaggaucacuugggccugggaggcagauguugcuccagccugggcaacagagcuagccccuguccccgcccccaccaaaucuggauagcccaacuucaggagacugaaaaccugugcccagaguuauaaaauuuaauuauguucuaaaugaauaucaggaucuuuagaauuuucuugauugaaugaggaccacuguauguaaaucaauacaucaaauuuauccucugaccccagagaguucuaucaauugagauuuggcccaggagcacaggaguagacuccuauauagaaaaugauccuguucuaacugaagccaacaaccgccucuucugcugaagagacugaauuuuacauuuaaggcaauaguaggauacacuuucaggaaugaaauuaaagcccuucccuauccuacucccauuacaagcugaucuguuauauguacaaaagaggaaaagagggugugggagaagaucagcaacaagacagccuagcaauucccuuucucgguaacagucuuguaaauaauucuccaucuucagaaaugugcacauuuuagucaaacauuauagaguuaaauuuuccuuccuacccccuaggcagugaucuaaacaggcuuaacggcuaguauuuuaaugaguugucauuuccugucugauaaagauucucacaguauuuaaccaccaguuucccuggggaccaaccaauacuagagcucuauucauagugacucagaauggaccucagacucuugcccuuauucaaaaaugacagauugcccuccacaugaaacugccuuuccuaguaagguagacugcucggaaaagggugggggaguuuaucaugcaaucuuucugaagaagccaaaggccaucaugcugacucauuaauaucuacagccuuucagcccuuuauuaauccagaauaaguaaaugaacaggugcuaacugaaaauaaacacauauuuaaccuaguaaaaaaggaucuaguuauccugugugacuggaaugaaaguguuauuaucuuuaccauuuaacugaauagaacacaugaaucuuuuuguuuuguuuuguuuuguuuuuggagacggagucuggcucuaucacccacgauggagugcaguggcgcaaucucggcucacugcaaccuucaccucccggcuucaagcgauucuccugccucaacccccugaguagcugggauuacagguaggcaccacuacacccugcuaguuuuuguauuuuuaguagagacaggguuucaccauguuggucaggcuggucucaaacuccugaccuuaagugauccgccugccuugaccucccaaaaugcugggauuacaggcauaagccucugugccuggcucaguauaugaaucuuugaagcugauacuauaagaaaaaacugguaacugauguauucuacuugcuuuggaucugaaaugugguagcccccuaaucauguuucuuuacauccaggaucuuggaauggcaccccaacauaaaauaaauucaggaugaaaaucacacacuauacuagaaaaucuagggcuuucucauauauacaaguuuggacugacagucccuggcaccuucuaaaauucguugugauuugaccccaggaucugggauuaaaacaucuugaauuucauucacaucugugcccuuucaaaugauuaaaacuucuuuuguacuuaaguuaguccauuguacgcagagugguauuaugaacacaugacaccauggguuucuuucuggcuguguagaaggaagaccaugcuuucuccagguguauuuuaucagguacauuguuucuacugccuuacagcauauuuuaucacaaaauaaucugcaauugcccuagcuuuuggagauuuagcauuauuuucuguaagaaucagauuggagguuagacuuccuuaucauuagcagcuacucuuugaaauaagcuaacauuaaagagaagcucuagagaacaaaaccucauuucagaaggcagacuugagcagcaggagaaaagcaggcauuugugcugaugaauguggccagagcuaaaggaguggucuauaaggacuagguaaaacugauugguugccaaaacaaaacucuguuaaaaaucaacugauugcauuuauagaaaaugacagacugguggcagcuuuuuuuuuuuuuuuuaaagagguugugucucuugccucagccucccaaguagcuggaacuacaggcgaguggcacugcaccuggccccaguggcagcuuuuuuuugggaacaggaucuugcucuguugcccacucaagagugcaauggcacaaacacgacucacugcagccuugaccucccgggcucaagcaaucuuccugccucaaccuuccgaguagcuggggccacaguagcuaauuuuuaaauuuuuuucaagagauggggucucaccauguuguccaggcuggucucaaacuucugggcucaagcaaucccgccucagccucccaaaguucuaagauuacaggugugagugggccugguggcagcuuuuuauagugacagaucugcacugguuugaagacucacugaguucuaaaacuuaaaaaucaggccagcacagcggcucaugccuguaaucccagcacuuugggaggccgaggccuccugaggucaggaguuugagaccagccuggccaauauggugaaaccccgacucuaguaaaaauacaaaaauuagcugggggugguggugcaugccuguagucuuagcugcuugggaggcugaggcagaagaauugcuugaacccaggaggcagagguugcagugagcugagaucacgccacugcacuccaggcugggcgacagagcaagacuuggucucaaaaaacaaacagacaaacaaaaaaaccaaaaaagugauaguauuggcaggacacaguggcucaugccuguaaucccagcauuuggggaggcugaggcaggaggaucacuugagcacaggaguucaagaucagccugggcaacacagcgagacccugucucaaaaaagaaaaaaaaagugacaguauugauugaaauucaaucucacuuaaaaaaaaguuaugaucucuguccucaaggaacucuaucuagaaggaugcugggagaggggaaaaaaugcacuuaaauguacacuacagaaaccaguagguuuuucauugaaaguaaccacaguaguaacuagcuacagcugcacacagguggaugcacgugugcacaggagaauagacagaauucaugcugcaucccuaccaaauucacacagcagcuguuugaaacuggugcucuagucuaaauuuccaacuuccagcaaaugacuucacuggcuuccagagugcucccucaggagugucccccuucucugccucaaaacaucuuggagucuucacuccaguuuucaagaaagaacugguucaugaggauaaucaauccacuccagaauugauccuaucucaaucaucucuuaucauuuauaugaauuuaacuucucuguaauaguaccuaacagguuuuguuauggauaugaaaugaauauuuauguaaagcaucuggcacagugggugcuuacugaauguuaauuuccuucccacauccuucccuuucuucauuuauauuuucuaucucuagcauuuuacuagaguuuuucccucagccuaaaauacacacuggucccuccuauuuaaugaaugaauuaauucaucuggucaacaaauauuuacaaaacaauuaaaaugugucagacaugacuuucgcuugaccuuuccucuagcccacaauuccauguaauccaauauauuuggguuuuaauuuucaucaugcuacuaaaaugcuccauuaaauggucaacgguaacuuccaaauacaauguacccauuucucaucuaacagucuaacuccagaacuccuguuuuaaccuuuauguggucucccaauauccauaacaaacauauagaaagguuaacugucaaaagagaaggauauauaaacuaccacggacaagaagagaaagggguuuucccaagcugcagaaagagguuauguuagacuguauaacugagucucggcagcugggguuuaaacccuguguuaagccuuaaauucuauccuuucaucagauaauacaaaugcugggguuccacacuuccauaacuuuuucugauuauuuucaaugaucaaagucaaagagaaucaaauacauggaccauuuuauccucuaaaaugaaaggacagauuuucuuucuguagaagaaaaaguccaggcccacguagcucauucugaccacuuuccauagagugagggauaagaaacaacauucggauucaagcacuuuauuacucacugguuaaaaugaucucucuugccacaggcaagccugacucugaggucaagcaucaaguuagcucagaaauaggagacagcaaagaagagcauggaacauucuguaucugguaaaaagucccuguuccagccaacaccaucccccagcccucaaguucaaugauugaguuauggaaacuuuucuugugugguaaaacuggggacuuugucuuccaauaagacccuggcaacaugacaaugagccaauguucugcauaugguuugcugcgagucauaugcuuaauguuauuuucugggaauucacauccccuauuuggugagaauaugggaacaugucauuuuaaucauaacuuuaaaaguuagauuugguuaugcucuuuaagaaauaugcacaggucucucccacuggagaaagucuaaaauuaaauaaaaauuaguauuaaaucguaauuaaaaaaacaaaaagggcugggcacgguggcuuaugccuguaaucccagcacuuugggaugccaaggcggguggaucaugaggucaggaguuugagaccagccuagccaacaucgugaaauccugucucuacuaaagacacaaaaauuagccaggcaugguggcaggugccuguaaucccagcuacucgggagaaucgcuugaacacaggaggcagagguugcagugggucgagauugcaccacagcgcuccagccugggcaauagaacaaaacucugucucaaaaaaaaaaaaaaaaaaaaaaaaaaaucacaacuaacauaaugccuuuugagcuagaaguucccuaguucuuugguucuaucaccugacuuugggucucgccauguucgagaccaggcuggacucaaauuccugagaauucaaccaauccaucugccucggccucccaaagugcugggauuacaggcgugagccaccaugccuagccaauuuuuuuuuuuuuuuuuuuuuugagacggagucuugcucugucacccaggcuggagugcaguggcgcaaucucggcucacuacaauuuccaccuccuggguucaagagauucucccaccucagccucuugaguagcugggacuacaggcacccaucaccacgcuuggcuaauuuuuguauuuuuaguagagaugggguuucaccauguuggccaggcuggucuugaacuccugaccucaggugauccgcccaccucggccucccaaagugcugggauuacaggcgugggccacugcgccugguccuuuuuuuuuuuuuuuuuuagaaggagucucccucugucacugaggcuggagugcacuggcacgaucuuggcucacugcauucuccaccucccggguucaagugauucuccugucucagccucccgaguagcugggauuauagacgcccacccccacgcccggcuaauuuuuuguauuuuuaguagagaugagguuucaucaggucgcccaggcuggucuugaacuccugaccucaggugauacaccugccuuggccucccaaagugcugggguuauagaugugagccaucaugcccggccccagccaaaagauuuuugauacccuuuuuuuuuuuuuuggagacagagucucgcugugucgcccaggcuggagugcaguggugugaucucagcucacugcaagcucugccuccuggguucaagugauucuccugccucagccuccugaguagcugggacgacaggugccugccaccaugcccggcuaauuuuuguauguuuaguggagacaagguuucaccauguuggccagcauggucucgaauuccugaccucaggugaucugcccaaagugccgggauuacaggcgugagccucugcgcccggcccgggauucauuuuucauucuuccuugccuuauuaucucauaauuuuauuuuaaauuucaacugcugcuggcuuuuuucuugcuugucuuuugauuuuguucucuaccaugacaaguuaucucuccuuuauuugugacugcaagguuuuaaauauccuucaaaagacugcauucugaaguuuacuaauuuaguuugaugauuugcuauaccauucagcgauuuuuuuuuuuugaggcagagucucgcucugucacccagguuggagugcaguggcgugaucucagcucacugcaugauccgccucccggguucacgucauucuccugccuuagccucccaaguagcugagauacaggugccguccaccacacccggcuaauuuuuuuuuguauuuuuaguagagacuggguuucaccauguuagccaggauggucuugaucuccugaccuugugauccgcccaccucagccucccaaagugcugggauuacagguaugagccacugcccccggcccgauuuuuuuuuuuuuuuuugagacauaucucacugucauccaggcuggagugcaguggugugaucucggcucacugcaaccuccgccucccagguucgagaaauucuccuaccucagccucccaaauagcugagauuacaggcaugcggcaccaugcccagcuaauuuuuguauuuuuaguagagaugggggucuuaccauguuggccagccuggucucaaacuccugaccucaaaugaucuacccgccuuggccucccaaagugcugggauugcaggcgucagccaccaugccuggcccauucaggguuuuaacagugugaaggagagaacuaacaauuaaaggagaauguuuauuuucuuucuuccuuucuuuuuuucaagaaucagggucucacucugucgccuaggauggagugcaguaguaugaucaugguucacugcagccucaaccuccugccucaaacaauuuuuccaucucagccucuuggguagcagggacuacaggcggguaccaccaugcccaacuaauuuguuagugcguuuuuuuguagagacagacagagucuuacuauguuuccaggcuaguccugaauuccuagcuucaaaugaucuaaaggagaauguuucuacagcagguuagagacaguguaucuagugaggaaauccagcuguucaccuccucuuuucugaaauaaaguacuacucuauuaauuaugauaugaaaucauauauuugggucuacuaaaaauuuguucucuuuauugaacuuaaucuccauuuuagguuuggugaggcuacuuauuaauuuucaauugaacacuuguauuuaaaagcauuucuggcugggcaugguggcucacaccuguaaucccagcacuuuggugggccgaggcagguggaucacuugaggucaggaguucaagaccagcgugacauggugaaaccccaucucuacuaaaaauacaaaaauuagccaggugugguggugcacaccuguaaucccagcuacucagaaggcugaagcaggagaauugcuugaacccgggaggcggagauuggaguaagcugagaucacaccacugcacuccagccugggcgacacagcaagacucugucucagaaaaaaaaaaaaaaaaaaguauuuccuacuucaaaacauaaaaaaaccaaucaugucaugcucaauuggagaaucugauuaaaagauaauguuauuaaugacaaagacuaaaaggauacccuuugggaucugauaauaaagcuuuacuagcaucugcugagucuaauuauuuauacuguuuaauauauuaucuagaaaagaauggccgggcacaguggcucacucuuguaaucgcagcacuuuggaaggcugaggugggcggaccaccugaggucaggagcuugagaucagccuggccaaaugguggaagcccaucucuacuaaaaauauaaaaauuagccaggcaugguggugcacgccuguaaucccaguuacuugggaggcugaggcaggaaaaucacuugaauccaggaggcggagguugcagugagccaagauugugccacuguaccccagccugggcgacaaagcaaaacuccaucucaaaaaaaaaaaggccaggugcaguggcucacgccuguaaucccagcacuuugggagucccaggcagguggaucaccugaggucaggaguucaggugaccugaccaacauggagaaacccugucccuacuaaaaauaaaaaauuagccgggcaugauggcacaugccuauaaucccagcugcucgggaggcugagucaggagaauugcuugaacccaggaggcggagguuucggugagucgagaucugagaucgcaccauugcacuccagccugggcaacgagagugaaacuccgccucaaaaaaaaaaaaaaaaaaaaaaagaaaaguagcugagguaaucccuguagacagugcuaggaaaaugauaaggacaucaggacauuccaacaucugucuccuaaaaauaauuuuucaaauacgacacaacucauuuaauucaauacaaaucugaauccaguaggucuugaauauuuuagcauaacuauauucaaaaccaucuuaucuuuaagaguaaaggaucacuggaauuuuuugaggggccaugccagugggguuuaaaauaaauuacugacuuugaaagacguaagauaggucaggugcaguggcucacaccuguaaucccagcacuuugggaggcuuaggcaggcggaucaugaggucaggagaucgagaccauccuggcuaacaccgugaaacccugucucuauuaacaauacaaaaaauuagccaggcauggaggcgggcgccuguagucccagcuacucggggggcugaggcaggagaauggcauggacccaggaggcggagcuuccagugagccaagaucgcgccacugcacuccagccugggcgacacagugagacuccgucacaaaaaaaaaaaaaacaaaaaaaagaaagaaagacauaagauauucugacuuaaccacauuggccuaagcuuaaaggcauuucuauuuaccauagauaaauaauauaauuucauaaaaacucuaaagccugcggaaauagaagaaucugggcuauaccaaugauuuucuaauuuguacuggucauguguucacuuauucagcagauuuaccaagugucugcuauaugucagucaagacgccaggaccaguggacauaacaguaaacaaaaauagacacaaucuuugccuuugagaagcuuacagguuaacaguaaaaagacaguaaaucacacacuccuacaaacauaaguguaacaauauaacuauaagugcauguaguauacguugcugugaagaaaggccccugguaaagaugguauuagaucaagucagggaaugcuuucugagaaugcaauggcuaaaaucuaaaggacacuguuuaggccagugauucucaaugagggugguggucuguuccccaugugacauuuggcaaugucugagacauuugugauugucaugauugggagguacuaguagcaugcagugaguagaggaggaagaugaugcuacaucucuuauaaugcacaggacaguuccccauaacaaguaauuaucuggucuuuaaaaagucaauagugccaaggcugagaaaucuugaacuaggcaaagagaaaagcacaagcaaagaccaguggugggagacucaaauauggacaaaguaguuugagcagaggaaacuagaggggacagauaacacagagagggcuuauaaacccugguaaggaguuuuggcuuuaucuaaagaaugaagggaaaaacaaguaagugaaggguuucaagaagaggaggagaaagggagugaagacaguggugaugauaugcucagauuaaaauuucaaaaagguuacugacugcaauauggugaacagauuggaagagagugaaacuggauauaucgguagaugaaacaaguagcuaaguaauguaacuuccuagaaacuccaaaggcuggggaaacagaagguacucauggugaggaugcaggaguagcugaaaaacuucuuucuauaaauguucaguauaagaaaagaacaaauaaugcaugguguuauaugcacugcgcucugcagucucaagguagaguaguagucucuaagaauaaaugaaauguuuuccuuacauuuaaaaaauaagggguugggagcggaggcucaugccuguaaucccagcacuuuggaagcccgagaugggcggaucaccaggucaggaguuugagaccagccugaccaauguggugaaacccuaacucuacuaaaaauacaaaaauuagcugggugugguggcguacaccuguaaucccagcuacucaggaggcugaugcagaagaauugcuuuaaccugggaggcggagguuguagugagcugagauugcaccacugcacuccagccuggagcgagacucugucucaaaaacaacaacaaaaaaaaccaaaaacauaagggaagccaggcaugguggcucaugccaguaauuccaacacuuuggaaggcugaggugggaggacuacuugaaaccaggaguuugacaccagccugggcagcaaagcgagaccccgucucuacaaaaaugaauaaauaaauaaauaaaaaauaagggacaagaauauuuuuugucuuuaugugauauauggucacauauaaaauacuuuauuuguaaggauucaggcagcaaaaaacuagaguaaauuuaauuuuaauuuuaaauguaaauuuuaguguacaaguuauaauccacacugauaagcucaggaauuaaugaaacuaaugacuggcuccacugaguacaaucucaagaauauauuuuuuccuuauuaaagcugaacuagcaaauauuaaaaacuauuuuauuacaauacauagaaaagaaugaacauauauaugaccaaaaaaaucaauagucacaaacucagcaucaaguggcauucuuuuuuuaaauagcaaaaauuuccauaaauguuugcucuguaaguggcuuuuaagauaaagauuuacauuaaaacuaaacaaagggcacuuaaacuugacacauuucccccguggggcagcuguacuacugaaugaaaagaaaaccucuccccuauaauaaugauuuaaaaaccuaacaacuuuugguuuuauugcaauuuauuuuaauuaauuuuuuuuuuugggauggaguuucgcucuucuugcccaggcuggagugcaaugacgcgcucucagcucaccgcaaccuccgccucccucguagcugggauuacaggcaugugccaccacgcccggcuaauuuuguauuuuuaguagagaugggauuucuccauguuggugaggcuggucuugaacucccaaccucaggcgauccgccugcccuggccucccaaagugcugggauuacaggcaucagccaccgugccuggccaguuuagccuuuuaaaauaaccuaauuuuucucuagugaaguaauagagaccugacaaauuuuguuaauauuaugccaucuaacaugacuuacuuaauuaaauacuaaauuuucuuuuuuuugagauagagucuugcucugucacccaggcuggagugcaauggcaugaucuuggcucacugcaaccucugccucccagguucaagcgauucuccugccucagccuccugagcagcugggacuauaggugcccgccaccacggccggcuagguuuuauauaaaauacuaaaauuuuauguaagauuuacauuuacauuaaaugcagcuguguaucuggcaucuaguuuggccaaaaaucacagcauuguacuaaagcaccauuaaacugcaaugauauacacauaucuuuuauauaaagacaauuucuuauuucuuugguggggcuacagauucaaaccccaaagcuucuuuuaaacccagaauuauaugacuugauagauguuugguuuacaauuaaacagggauaauguaagcuuuaucuuucccuacuauagaacaagaaaguauucuucauuuacuaauaacagcaaguuauuuuugcuccucaaaaaauaaagaacuaugucaaaaauucuauuucaauucagucuuguacacauuuacucccauuuaaagaguaauuauauuaauauuaguccuugaagaauuacuuacccaaugaaagccaccauuugcuccacuaugugcuugcugaauguuauuauaacaaaaauuuucuguaaagaaaacaccaguuaaaauaaauuauuuagucaucaaaaaaccaacauaaauucacaauucugguaauagucuaaagagguaagauugugccccuaauugcaauuuuuaaauuucuuuaaaaauaaaauauaacauuuccauccuguccaacauggugaaaccccgucucuacuaaaaauacaaaaauuagcuggggguggugacaugugccuguagucccagcuacuugggaggcugaggcaggagaauugcuugaacccaggaggcggagguggcagugagccaagauugcaccacugcacuccagccugaugacagagugaggagacuccauaucaaaaauaaaauaaaauaaaauaaaagauaacauuuaauucaaauguuaucaacuuuguauuccuuuuuuuuuuuuuuuuuuuuuugagacagaguuucacucuuauugcccaguugcccaggcuggagugccauggcgugaucucaacucaccgcaaccuccgccucccggguucaagcgauucuccugccucagccucccaaaguaccugggauuacagggaugcgcuaccaugcccagcuaauuuuuuuuuguauuuuuaguagagaugguguuucuccauguuggucaggcuggucuugaacuccugaucucaagugauccaucugccucagccucccaaagugcugggauuacaggcaugagccauugcgcccggcccuuuuuuuuuuucuuucuuucuuuuuucuuuuuuuuuuuuugagacggagucuccuucuguugcccaggcuggagugcaguggcgccaucuuggcucacuacaaccuccgccucccagggucaagccauucuccuaccucagccucucaaguagcugggauuacaggcgcacgacaccacgccuagcaaauuuuuguguuuuuuguauagaugggguuucaccaugcuggccaggaggccaggauggucucgaacuccugaccuggugauccaccugccucagccucccaaagugcugggacuacaggcgcccgccaccaugcccggcuaauuuuuuguauuuuuaguagagaugggguuucacuguguuagccaggauggucucgaucuccugaccucgugaucugcccaccucagccucccaaagugcgggauuacaggcgucagccacugugcccagccaacaguagucuucuuuuuauccacucacuaugaaucucaggaaccuggacagguuagacuaacguacauuauuucuggcaagaagacuaauaaggcaaagguauacaauugguaugugaauauuaugaagcuagcaaggcuauuauuacagauaauuugugaagaaaagcagggggucuauaccaaaaaccaguuauuuagagcuauaaaucuuuuauuaaucaacagagcuaguaguucuugccuuccagugauuucaucaccaugaacuuucccuacuaucauuucuuaacaaucaaaauaagccaaugccuaaauaauugcacaauuucaaugcaaaacagcaaaacaagauuuucuuuuuguauguagcagcuugaaaagucacuguucuggguuagacaaaaaaugugucacacauuuaagaacauaugucuuagucuuucaggcaggaggucugagugggaauucuacaaaauaaauaaaaggcacagaccacggaagagcccucuuaaccacaugcauagaagaaacaaaggaaaggguagaggaggaggaaaaaagacaugggagggagaaacuaauugugcuagaaugaacaaagauggaaccaucuguaaaagaaguccuucauuggaaagaagaaucuuuuuuuuuuuuuuuuuuuuugagacggagucucgcucuguugcccaggcuggaaugcaguggcucaaucugggcucacugcaaccuccgccuccugguucacgucauucuccugccucagccuccugaguagcugggacuacaggcgcccgccaccaugcccagcuaauuuuuuuguauuuuuuuuaguagagacgggguuucaccguguuagccaggauggucucgaucuccugaccuugugauccaccugccucggccucccaaagugcugggauuacaggcgugagccaccgcacccggccagaaagaagaaucuuaagacagauucaguuauuaaauauugagugccuacuaucuccuggaugcuauucuaggcauuauaauacaucagugaaccaacagacaaaaaucucugcccuccugggaguuuauaauacugugugugugcuggugagugugaagguagagagauaaagaacagugauguauuuuaaggguacaauaaguaaguuaaaugguacaugaaauaacaugaaugaguauguugcuuuucuuaauuauuugggacaaagguaaugucucuaaggauacuacuucuuaaaaaauuuuuucuaaaaagauacucuucucaugccuuuuccuaucuaaggauacuucuacagacagaguacuugacucugugcaguggaaggggaaaucugaucuaacauuauagguagauugauuugaaucuuuuaggggaagguuaagaggaagacaucaauaaaaauagcaauauuuauuaaagaagguugucuaauuuuaagcugaggaaaaagggaagaaagaaaagcagacaaggagacagguuuacuauuaggguagaaaaaaaucgguguguguguggcuuucccacuauuauuucagaaugguuaaaauguuuauauuacuaauauuguuuacccacagaaugagaaauguuuguuacccuaagcuacaucuggauguacaucaagugacaugccuuuacaaagcaugucacuaugauacgauggaacacagcaaacauaucccacggucuuaguuuagugaaggaacucagauucuuuccuuucagaaacauaaauggauuuuagcuuucuuuuucuuuuuugcuuccacauagauacagggaaagagcuuuaucuuuacagagcuugguuggauucuagggccuuaggcaaguauuuuaccuucucuaacacaguucccucaucuaugaaaugugguuaauaacaaccucucaagauugucugccaugagauaacuacugcaaauuaccuugcacagguccugaucaauagcaggcauuaaacaauucaguuuccuuaaucauaucaauacauuaaaguuaagaaggcaaugcaaaagaauggaaagaacacugaacuugaagucaaaagacuuggguucaaauuccagcuguuacuuacucucuuaagcaacuauuacuuauuaaccucccuaccucugagaauuacaaaauggguauaguaauuccucuaucccaggauuauaagaauuaaaucauauagauaagugcuuuaaagugugaaguuccauaaaaaaaucacucaucggccaggcgcaguggaucaugccuguaaucccagcacuuugggaggccaaggcgggcagaucaugaggucaggaguucgagaccagccuggccaauauggugaacccuaucucuacuaaaaauacagaauuagcugggugugguggcaugcgccuguagucccacuuacucuggaggcugaaacaaaagaaucguuugaaccugggaggcggagguugcagugagcugaaaucacgccaccacacucuagccugggugacagagagagacuccaucucaaaaaucaaucaaucaaucaaucaucauaaauugaaaaaaucugaguauguuuaaauauauacuaguuuuaaaucuuucugaaaugaaaggucugauaaguugcauaucuuaccacuacagauaggguacuuauggcauaauacguuuuacuauaauuuauagaaaggcacugcauucaagagguauaaagcaggacacauaaaacuuauggauuacuagagaaguucuuguuaugaaauaaaauaaucuguuauuuuuccuuagguauuaaggacugcaagaagcuaaaugacagcucucuucuagaaacaacucuaaagauuaaagaaaaaccuauuuucagauacauugaaaauaauuuauuauucaccauauuuuauuauuugaaaaaauccuguaugguauuaaaucuuuuuuuuuuuuuuugagacaaacucuuguugcccaggcuggagugcaauggcacgaucucggcucaccgcaaccuccaccucucagguucaagugauucuccugccucaggcuccugaguagcugggauuacaggcaugcgccaccacgcucggcuaauuuuguauuuuuaguagagacaggguuucuccauguuggucaggcuggucuggaacuuccgaccucaggugauccacccgccucggccucccaaagugcugggauuacaggugugagccaccgcaucuggccaguauuaaaucuuaaccauaguaacuagcacuguaauauuaaaaaaccuguguucguugauugaacaaaauacuuaauuuaaaugggaggaaauauauucuuugaaguaggaaaaacaucaugaaauucugagugauuauggcaggaaaauagaggacagacgcaauaaacuugacccaaaugccaaaaucuaagauuauaaacuggauaaguagaagcagccgaaguuuuccuguuucauucuucccuucuaagaacuggaaguagagagguauuaacauagaaacuuuggggauagacacacuuguaauuaucauggaaucauacaagggcagagaacuucacuguucuuuccuuucuuuuuuugagacagagucuugcucuguugccaggcuggagugcaguggcgugaucuuggcucacugcaaccuccaccucccagguucaagagacucuccugcgucagccucccaaguagcugggauuacaagcgugcgccaccacgcccagcuaauuuuugcguuuucaguagagacaggguuucaccauguuggccaggauggucucgaucuccugaccucaugaucugcccacuucagccucccaaagugcugggauuacaggcgugagccaccacgcuugguuguucuuuccuuucuuuugguuaauaacguucuuuguuacaaaccauacugauauaaaacaaauucuuuccagguuaauuuuuauuuuauucuauugagaucugcccuuagaaggaaguaauucauaucacaguucuagaagcacauauccauuuucccuucguuuaaauuguuaaccuuuucucuccucucuauucauauaugugugcacacacacauacacaugcacacacccuccauccuaaagauuuuguuaagaguggcuuugaggacuagcagauucucacuucucugaccacaacccacaucuccucgccucuucagagacccucuucuuccccauucuccucccacacuaacaucuggcuguuuuucgguaaaggauauugguaacaugggaggaacugcuuuacacacucuauauauauagaguaugugaaagaaaguaagaauuagugaauggcaauauucucucagcuugugguugguaaaacaaaacaaaacaaacaaaaaacuacauuuuuugggcuguguauauaaaaaugaugugcaucuuucugcacacaaacacuauuuuuguuuggugaaaguccuggauaaauaguuaaacaggacaaaaaauaaagaaagaaagagagaaaggaaggaaagaaggaagaaagggaaggagggaggaagaaagaagaaaagaaagaaaacaaggagaucacuaauuccaaaugacauucuaugugguauuaccuaaguaagcuaccaaccaaaaaagcagaaagaauaacuaaauaauucacuuaggaaugagcauguuucauugucuuguaauggguucaucaucauuaggcagugaaucaggggguauaauuaccuggauaugcauuuuuauuauugcuuuuccaauuaggguugcaccaaagaagguccaaaaagguaccagaaaguguccacacguuauuccagccagaucaaauaaaggauuuggaaucuauagagagaaaaagaaggacuuccauauuauaauccaaagaacaauuuaauuuuaucacccauugauaugugguauucugcuuucagccugcuuacacugcaaagcaauauauggguuccuugaucacuacuggauuguucaaaaggagguuaggcaaacauccuaaugugucuagaagcugggucucauauucaccuuagguguucaaucugcucacagcaaaccaagguguccuuuugcuuauauuacucauggcuaaggcacuguguguguguuugugugugugcccaucacaugagaacuggauaaaguaaguggaccugcaggaauuuaaucccguucaguugauuccuggauauuugguggcuguuuucuaaggugagguaugagugaagaaagagccuuaagauuguuucagcaguuaggguucuaaaaucuuuagcuugaaaugugaauauuaucuggaaagcacucauaucauuagcaaauauuuuaauaaauucucaaauacauuuauggguggaugugcuguuauucucaacauaaaauauuaauaauuuguauuuuauuuuacgagagaccaagucugagggcuaugugacacaauuuauaaagaagaucaaguguggaaauaugagaucacacagauucagauguuuugaauacucagucccagacaaagaaguaauucacaacaaauaccuuucccaaacauucccacauuuuaagaaugcuaaaagacauuucauguaaaaaugcaaagaagccacaagcuguuuuugagcacuucaucccuucuucuccuaugaaaguacucugaccuuguggcuguuggcugaaccauuaauaagccaauuaauuuauauaauuucauuuuugaacuuugaaagaaaagccuaguuauuuaaaaaauacuugucacauaugaucuuuaaaaaagacaugacuaaauuagaauucaaguauuccuuuguuaguaacacuuggauucaaugacucauuuuuguuuuucucauccaaauucaaaugcuuuaggauuauuucaucucuuacaaccauauaauaauaucauuuacacagcaucacaccugcuauuuguuauauuugcucaugugacucucauaauucuaugaguuauaacuuuuuuuuccuuuaucauaagguuccaacucauguugaaaugaaaaugaauuuaaaguauuuaagauauguaggcugggcgcagugucuuaugccuauaaucccagcacuuugggaggccgagguggguagaucacuugaggucaggaguucgagaccagccuggccaacauggugaaaccuugucucuacuaaaaauacaaaaauuagcuggguguaguggugcaugauuguaaucccagcuacuggguagccugaggcaggagaaucgcuugaaccugggagguggagguugccgugagccaagaucucgccacugcacuccagccugggugacagagggagacucugucucaaaaaaagaaaaacaaacacaaaaaaaggauuuaagauacguaaaucagaguagcccugagcuaacaucgcuuuaaacagguuuuauauaaauucuuccuuguaacuaauacuugaaacuuuggaaaaagacuucuuaucuauaaauuugaggaaagaaugaagucauccuuauuugguuaaauguaguuuaauuugguuaaauguaguauauucuucauuggaagaauggauuuugucucuuuuauucuuacugauuuaagccauuuaggucugaagucaucacuacaugaugaaauacuuaaaagccaauaaacaagaugugaaccuauucaacagaaaacagcucauuuaauaaguugaauugggcugggugcaguagcucacaccuguaaucccaguacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuaccgccugggcgacagagcgagacuccgucucaaaaaaaaaaaaaaaaaaaaaaaaaaaaaaaaaaaaaaaauuagcugggugugguggcagucgccugaaaucccagcuacuuugggaggcugaggcaggagaaucguuugaacccgggagguggagguugcagugagccgagauugugccauugcacuccagccugggccacaaaagugaaacucuugucucaaaaaaaaaaaaaaaaaaaaaaaaaaaaguugaaugggccagguguaguggcucaugccuguaaucccagcacuuugggaggccgaggcagguggaucacuugggcccaggaguuugagacuagccugggcaacaugagauccugccucuacuaaaaauauaaaaauuagccaggcgugggggugcaugccuguagucccagcuacuagggaggcugagacaggagaauugcuugagcccaggagauggagguugcagugagccgagaucaugccacugcacuccagccugggugacaagagggagacuccgucuuaaaaaaaaaaaaaggugaaugauucacaaaauuacauacccaauaaaagugauagcacuuuuguuaauucaggaguauauauggaucaaaauauaacacuaccacuuaguaaaaguucuguuuuaauacaauucacuuacugaagcacaggccaaaauuccaaaaaauccaacuuucuguacuaguuuuugaacugccaguuuggcccgggaggcaaaguccuguaaaaaggcaaauuuagaaacauuaaugagaaguaggaaaagaaggaaagaugguucuuucuagaguuuauuaaagaucucccaaucugaugacacugauuaauaagaugaaugaugaaaaaaauuacaguagguuguucacugaaacacaaguaaaauaaugauagacuauuacauccuuaaaguuaagcucuuaccacauuuuaagaauaaaccaaaacacuguaaauuuaaauuuaguauucucucuggauauucuagggauuaacaaaauacuguaaacuaaccaugaaccaauuuauuauuuuggaaacacuggccuacaacaucuaccuuuuccuuucuucuauaauuugccagacuucaugaauacaucucugccgaucacuagccagaagauggaaaaaacaguuauguggcaauaaguaagcauucauuaucccagaagcaaaagaacauccuacauuugcacagcuugugcuaguuuuguaaaacauucucaccaugauuuuauuugagccuucgauucugguauguagguauaguggauauuauuauaaccaaucuauagaccacaaaacugcagcccagaaaggguaagugaucaagaucauaaugucaguuagggacaaagauaggacaugauucaauauucagacugugaaaucagugcuuuuuacuucacucuguuaccuccucccaugcugaaacaugcauucggcuggcuaguucuuucggcauguugaugcuacaaauauuugacuuuaauuauuuucugguuuugaaauggcauauauucaaauccaaauuccaaugaaaauaguucauaagacaaaaaaugagcuaauguguaaaugcuuuauuuuuugaauguguguaaaugcuuuauuaauaagucuucauaucauagaaccucuuccacucucuuuaguccaacuuucuuuuuuuuuuuuuuuuuuugagacggaguuucacucuuguugcccaggcuggagugcaauggcgcgaucuuggcucacuggaaccuccgccuccuggguucaagugauucucucgccucagccuucccaguagcugggaucauaggcaccugccaccacgcccagcuaauuuuguauuuuuaguagagacgagguuucaccauguuggucaagcuggucuugaacuccugaccucaggugaucagcucgccucggccucccaaagugccaagauuacaggcaugagccacuacacccggccuuuaguucaacuuucuaaaagacaauaaagagaauauagaagguggacagauccggccgggcgcgguggcucaggccuguaaucccagcacuuugggaggcugaggcaggcggaucacaaggucaggagaucgagaccauucugacuaacacggugaaaccuuguaucuacuaaaaauacaaaaaauuagccgggcgugcuggcaggcgccuguagucccagcuacucgggaggcugaggcaggagaauggugcaaacccgggaggcagaguuugcagugagcugaaaucgcaccacugcacuccagccugggcaacaagagcgagacuccgucucaaaaaaaaaaaaaaacaaaaaaacaaaaaagaagcuggacagaucuaucauagagaggagaaacaaaguuuaaagccagaaaagcaaacuaguugaaaaauauaguucucuaauuggcacagaaucuguguauccccacuuacaaaaacauuuugacaaauaauauuguguagaauagaccuaccaaauuaccacaguaguuaauacugaaauuaaagcaaagaaacaaaaaaccuaacucuacuuguugaagaugaugagaaagucaaagaaaccaaaccaauaaacuauauuaaaaaaaaauaugaucagucaauauaaacacuuucaaguccaaauacauaggcucucaaaguuaaucauuagcuaaacucuacaacaaaauuuagcaauuuuauaauuuauuuccaaagagauaauuauuaauuuuucuuuuugggauuagacuuacuuuuucacuaaaucaguuauaucagauuuaauuuuuuuuuuuuuuuuugagacaaacuuucacucuuguugccuagguuggagugcaaugguaugaucuuggcucacugcaaacucugccucccggguucaagcgauucucuugucucagccuccugagcagcugggauuacaggcgcccgccaucaugccuggcuaauuuuuguauuuuuaauagagaggggguuucaucauauugucaggcuggucucgaacuccugaccucccaccucggccucccaaagugcuaggauuacaggcauugagccaccaccccaggccucagauuuaauauuuuuaaacaacugaacuacugcagcaaaggguauuuucuauuuuuauuuagauuucuagcugaagguuaauuuuuuucuuagcaucuauugcauuaaaugugaaauacugaguuuuauugauuuaaaaccauauaagaauauauaaucaaucaguuuuccuauauagcuuauuuuaaaaacaaauuacauuucuauuucuauuacauuuuauuauuuacugcuccuuuucacuaauccuauccuucugcaaaauccauuuauuuuuaacaauuuauacaauuaguccccaaauuacuaaguuuauaauccauuugaagcacuaaauaaaaacugguaaaaaauguuuuaauugucuaaaguaucaacagauacuauuaaauuaaaaacuaguuaugaaauuuuaauuacuauagcacaagaauuaaauauauaaaaucaggaaaaugccuuccuuuacagcccuuaaaauuuucauagcaaauccacuuuuaagagagggaagauuguauucaauugccaagaaaagguaaaguaaacaacaaaaaaagcauacaaauuuuauuuuaaagacagcacaauuuuuauaaguuuuccaagucagauauaugugggaauauuuuucuaucagcauuaaugucaccuuuaauagacacaauuauagaaaauuaguuuuucuacauuaaaugguauagacaagaucaacaaguauuguauuuagaaggucugguguccugcuuucuuuuauauuaauuuccuuuuuuuuuuuuugcuuuuauuuugaguuugccaaagagcauuaucuuaauuuuaaggcuuuagaauuuucuauuuauuuaaaccaagugacuaagauugugccaucauuucaaacugauggcauuuuucuacucuauagaaucacauauacacauacaaacuuaaauaggaaaagagguauaauuauaccaacugguuuauauaaagaaaaaaaugauuaaacauuaugcagaucaccuaacaauaucaaacauacuuaagacuacagaagaaccagaaaacaugguuuaaaaaacauccugaaaagaggucaaaacacagugaucauuacuaacaaagaggaauaacacguaaggagccauuuuucccuuuuagggaagaguaucuuugcuuaacggcaauuaggcaagaacgaaaaacagacuucucguucuuucagaugccugggugcuccucauuaguuauccuuaagggagcuucaacaaucuuuuuuuugagcacaaagaguuaaucuauccgaacacgugaagcugaaaccuccuuuuaccuuuuuuaauuuuuaaauuugaagcuggcauguauuauaaggaaaacaaguaaagugccuuuuuaauggagagcuuuacuuuuuaaaaagagugaaagucaucuacugaaaaaggauuucacaaauuuuauuauguauuuaacauacacagugaccaugcuacuuucaguucccauaauuuuuuccaggucuuucacaauauucucagaauuuaaauuacauuauauaucaaauaaucuacaaacauuuacugaaauuauauuaauaugaagucugcacaguuguuuuuauuucaagaaaauaaacauuagcauaauaugcaguuugauggacaguauuuucuugauuuuuuuccuugccaguguaaugaaaacaaaaccaggaaagcacugcauugguauuuuaaaauaguaaaauaacuaaaguuuaauguuuagauuugauaaacacgaacauauuuuauuguuucuuauuuuaaauuuauuucacuuuuuuuuuuuuuuuuuuuuuuagcuggagucucacugucgcccaggcugcagugagugaaguggugcgaucuuggcucacugcaacaucugccucccggguucaagugauucuccugccucagccuccugaguagcugggacuacaggcacacaccgcaacgcccggaugauuuuuuguauuuuuaguagagauagaguuucaccguguugcccaggcuggugucaaacuccugagcuuaggcgauccacccgccucagccucccaaagugcugggauuacuggcuugagccggugcgccaggcccaaauuuauuuuacuuucaaagccacauguauaaaacuuaguuauauaguuuuaacagcuuuauguaauaauuuuauugaaaacauuauucuuuuauuguucaaaauguucuauauguuacgugcaauuuugcuuuccuuguugcucuguaguuuuaaaaguucuuuguuuuucuaaaaacaacuucaguauauuuuuuaauuauuuguauaauuuggcggcucuuauugugauuuuagaauaauauuguuuaugaacuaaaauauauauauucucauuugccuuuauaaugagaauuuuauucuacguauauuguuaauaaacuugacucuauuacucacacaccuaacaccaccaaaaagcuaaaccaaaacaaaaaaaaucccuuuuauaaaauuaaaaaaaauuuuaaacaaauuuugcuguucuuuuuaguccaaguaaaauaaaaaagcugaguacaaauacacaccaauaauaaacaauauuuuuaagaaaaacuaaauaaaagauuacaaacaaauuguauguuagguauucaauguucccauuaaaaguuaaaaaaauuaauauuucauuugaauaguuuuggaguauuguggggaacaauguagcaugaccaauuugauuacuuccucacaugucauuuuucacuuuuucaaaaauccauaaacuaaaaacaaacaccuuuuauuaguuccauuucucuguauuuacauuucacaacuuuuaccuauuucacaacuuaagugccugagaugauaguuucauucucuaagucuacuuaaauaugaagcaugcauuuacaauuagcaauuacaaaucauuuucuacuuuucuuuuuucacaaaaauaaaaccaauuauagguaaauaaauuaccuuuccuaccacaacccauagugauuauauauguaaaccaaucacgcuucugaaacaggagacgcaagaaacauuuucccaagcacuacaagacuaauaaaaaaaagucacagcaauuccuuaucacugaauuucaagauuaaauacagaaagacaaagccuuaaacuaugaauaugccuguaccauuguugcuucacauuucuuuuucuuaagaaagauauuuaugauugagagagaagagaaacuacaaggcuaauaacagucugcaaaauauugaucuuugaaucuaaugaugucaacaugaauguaaauauacgaaguaacuuuuaucuucaaacaguaacaguaaacauuuucauuuucacgaggaagccauaugaaaagaucucuuuaaaagcaacagaaggccauaugcgguggcucaugccuguaaucccagcacuuuggaggccaaggcggguggaucaccagaggucaggaguuccagaccaggcugaccaacaugaagaaacgucaucucuacuaaaaauacaaaauuagccgggcaugguggcgcaugccuguaaucccagcuacuugggaggcugaggugggagaauugcuugaacacggcaggcagagguuguggugagccgagaucgugccauugcacuccagccugggcaacaagagcuaaacucuuucucaaaaccaaacaaacaaagcaaacccagaaaauuagcuaggcgugguggcuggcgccuguaauccuagcuacucaggaggccuaggcaagagaaucgcuugaacccgggaggcggagguugcagugagcagagaucgugccacugcacuacagccugggcgacauaaaaaaaugaaauaaaagcaacagaaaaucccuaaacauguaaaaccaaugcaauguuaccgaagauaaauguauacuugguuaauauguuauggaaguuuaaauuaccugccuuuauaacccauuccagucauguguggcuuaacaacuggcauauauucugagaaaugaguuguuaggcgauuucauugucgugugaacaucaugcaguguauuuauacaaaccuagauguuauauagccuacuacacacuuaggcuaucuaguauagcuaccacuccuaggcuacaaaccuacacaaccuguuacuguacuaaaugcuguaggcaauuguaacacaauguaaguauauguguaucuaaacauguuuuuauuuuauuuuguuuuauuuauuuuauuuugagacagggucucgcucugucgcccaggcuggagugcaguggcgugacuuggcucaaugcaaccuccaccuccuggguucaagcgauucucacaccucaaacuccagaguaccuaggacuacaggugcgugccaccaugcccagcuaauuuuuguauuuuuaguagagaugggguuucgcgauguuggccagacuggucucgaacuccugaccucaagugaucugcccaccuuggccucccaaagugcugggauuacaggcgugagucacuacaccuggccuaaauauguuuuuuguuuuguuuuguuuuguuuuugagauggaguuuagcuccuguuacccaggcuagagugcaaagacgcaaucuuggcucacugcaaccucugccuccuagguucaagcaauucuccugccugaacugggauuacaggcaccugccaccacaucuggcuaauuuuuguauuuguaguagagaugggguuucaccacauuagccaggcuggucuugaacuccuaaccucaggugauccggcugccucggccuccuaaagugcugggauuauaggcaugagccaccucauccggccuaaauauguuuuuaaauauaaaaaagguacaaauacaauaugguauauaagauauuuugggccaggcacaguggcucaugccuauaaucccaacaauuugggaagccgagaugggaggaucacucgagccuaggacuuccagagcagccuggguaacauaaggagaccaagucucuauaacuaauuaaaaaaaaaaacaauuagcuggguguggugaugcaagucuguguucccaguuacucgggauacugaggcaggaggauugccagagcccaggaaguugaggcuacagugggcggugaucacaccccugcacuccagccugggcaacagagcaagaugaucucccccuucaacauacacacacacaaaagauaaaacuauaguauaguaaauauauaaaccaaugacacauuucauuuacuaucaaguauuauguacuauauauaacuguaugugccauacacacacacacacacacacacacacacacacacacauauauauauauauauauauauuuuuuuuuuuucgagauggagucuugcucugucgcccaggauggggugcaauggcacgaucuuggcucacuguaaccucugccuccuggauucaagcaauucuccugccucacccuccugaguagcugggauuacaggcacgcgcuaccaggcccagauaauuuuuguauuuuuaguuaagaugggguuucaccaugcuggccaggcuggucucgaacuccugaccucgugaucugcccaccucaggcuccuaacgugcugggacuacaggcaugagccacugcgcacagccuguaugugcuauaguuuuauaugacuggcagcguaauagguuuguuuacaccagcaucgccacaaacaugugaguaauguguugugcuacauuaccaugucacuaggugaugggaauuuuucagccccauuaugaacugucagacaugcaguucaucacuggcugaaaggcuguuauguggcauaugacuguauauauuaaaacuacugagcuaauaaugcuuucuuuuggauuuggagcugaagugauuucacagccaauauuaaaagccucagagcaacuguuucaauacugauuccucauguguaauggaaauuuauguuaaaauauagucuauuugugaagcucuugugccaccuaaaaauuacuugcugguuucugcgugcuagucaaauaugcacgccaagcaaugaaaacucuauuaagcagaaauggaaugacuugucaugaugacuuaauaauuuaaguuuuuucagcauaguagacaaugagucugaaacaauaacuuguuauuaagacccuaauaacguaucauuaaauauuuucuaaaaugaaauacauuauacaauuaacuauuaucuuuauagaaacugcaauguaaaacuuucuguaaugcaguuauaacuucaaaucuuucuugaacacaaaguaaaaagugccuuaauaacuauuuucuacccauuaucagggcucuuugaguuauuuuaaaaauauagagcauuaauugaauucaaagugaacaaaauauucuuacuguugacuuccucaacaauaucacuaaaguaauugcuuauauuuuaauuuugcauauuugaguagguccucuuuaaauaagccuuuuuuuuuuuuuuuuugagaggaagucucacucuuaucccccaggaucucagcucacuguaaccuccgccucccggguucaagugauucuccugccucagccucccgaguagcugggacuacaggggccugccaccacaccuggcuaauuuuuguaucuuuaguagagaugggguuuuaccauguuggccaggcuggucucaaacuccugaccucaggugauccucccgccuuggccucccaaaaugcugggauuucaggcgugagccacugcgcccggccaagugaagcauauuuuuaagucacacauuauuuauuguuauugaauuauaacauaauaaggucacgggauaaagacugugguuaggaaauaaauucuagaauuaccaaaaaaguagggauauuguugaaauaaagugauuguaaaacaaagaaaauaguuaauaaauuuuaaauuacuagcuauaagauguuggauaacaaaaugcaaacccauuuaagaacaaaaagugaugagaacugaguuguguaacuauuccugaaaaugaaacguuuuaacauccagcugauggcuuacacgguuagauaaagccaacuguaaaaucagagauggucacugguauuucuauauauauuagaaauuaggguaaaacucuauaauacugcaagcagaauacaucacaugaacacauuucauaaaagcaaggauauuuuauucugaaaguaacuuagagauuuagaaguuuuaagaagagauuauauguaaaacaugcaauauaaacauaaguucucauaucuaucaaaaucaaugcaggcauaacuaaaaacuaccagaagcaaagaaggaucugacuauucucugaaacaguaagaaacauuuauuuuggcaacuagcuaaauuuauuaaguacucaaaaacuagauguaacuagaaaucugaaaacaaaauucaguuuggguuucuguuuauacucauauuuauauuaucuagggcaguuucauuaaauuaaaaugcggugugaaaauuuaguugguaacaaauuacaucuugcuuuuucuuuuuauuuuuuucuuuugagacggaguuucgcucuuguugcucaggcuggaguguaauggcacaaucucggcucacugcaaccucugccuccuggguucaagcaauucuccugccucagccucccgaguagcugggauuacaggcaugcgccaccacaccuggcuaauuuuguauuuuuaguggagacgggguuucuccauguuggucaggcuggucuggaacucccgaccucaggugauccgccugccuuggccucccagagugcugggauuacaggcgugagccaccgugcccggccuuacaucuuguguuuuaaugaacagaauaaaauggugagaccucacaagcaauggaaguaaauacuauuucacgaaacauuuauucuaguuacacacaaauuggcucuggguugcuaaguacaauguauuuuguauuguuggcuacaguuuaaaaaaagaaguaaaaaagucauugaucuagaggcagcugugacuguaguaggucucaugaugcuuuauccaaauuacacuuuucaaaaguuacgugagaacugaucaacacaaauuuuuuucauguauacacacaggaaauacauaauccacugugaacaccacacauuucagaguguugugccaaaaauagggagcuaucaacuauuucugggucaagaucaggauuaaguggauuucucgauguauagauguauuuccguuaccaaauuuacaugggcagguugcaggagaaaacaguaugaguaguuuuuuaaacuaaggcauaacguauacaguaaagcauacaaaucuaaaauauaccucuuaauggaaauuuacaacacacccauguaaccacuacugagauccagauacagaacauuaccggaacuccagaaacccugcugguggcacuccuaguaauuacucccugcaaaauaaccacuaacauuggcuuccauuaccacagauuuagcuuuuccuauuuuugaacuucguuuuaaaaauuuauuuuaucauaguuuauuuuacuuuuuugagaugguguuuugcucuuguugcccaggcugcaauggugcgaucuuagcucacugcaaccuccuacucccggguucaagugauucuccugccucagccuccugaauagcugggacuacaggcccaugccaccacacccagcuaauuuuuguauguuuuuaguaacgacaggguuucaccacauuggucaggcuggucucaaacuccugaccucaggugaucugccugccuuggccucucaaagugcugggauuacaggcgugagccacugugccuggccugaacuuuauauaaauggaauuauacaguauguccucuuuuaugucuggcuucuuuggcuuaacauuauauuauguccaggugauucauccaugcuguugcauguagcaguaaucaauuuguugcagaugcuacauauuauuccauuguauagguauaucacaauuuauucuauuguugguggacauuaggguugcuuccgcuuuugaacuauuauuuaaaaagucuuuuucuuuuucuuuuuuuuuuuuuuuugagacagagucuugcuaugucgccaggcuggagugcaguggcauggcgugaucucggcucacugcaaccucugcucccggguucaaucaauucuccugccucagccuccccaguagcucggacuacaggcgugugccacaaugccuggcuaauuuuuguauuuuuaguagagacgggggggggguuucaccaugcuggccaggcuggucuggaacuccugaccuugugacccgccugccuugcucucccaaagugguaggauuacaggcuugagcaacagugccaggccuuauuuuuccuuuuuaagcuaucuccuacaggaaggaaauuuugaguuacuauaaauaaugcugcuaugaacauucuuguacaugucuucuggcauauccuucuggugaguauagauuuacaaauggaauugcuggaucauacaguauguguauguuuaacuguaguagacagugccaguuuccaaaagugacugucaaucaaauuauucuuaauauugcuuccauuuugccaacugauaauaacugucaauugaaaaaaaucuaaaugauuuuccuuuuguacagaugguucuaaagaauguguuugucagaauuagcaugaggauugaguaaguuaaagcaagaaaacgaggaaugaauagcuuuaaauauuuuaaaugcuaaguuuuagaaaaacaacuuauaacauuuugaaaguuacuuccaauuuccuuaggaaaacagagauaauugcuuagaaaaaaauguacuuuuugugcacacucaauuugggaagacaaaauugaaaccuuuuucagaaaucagaauucuuauuuaaaagcaauuacauuuaacugaauaaaccugauaacuacuaugugcaagguaauaaagaauccaaagaugagaacauagugauucguucauacauucauuccguauauguuuaaaaaguguuuacuacaugccaaauauuguagaaguugagaacacaacgcuaaaucacacugauaacaaucuggaaccucauggaguuuauauucuagugggaggagaugaaaacuaaauaggacagucaggaaaggcuucagagaaaaggugauccaaaacaucaaaauucucaaggaggugagagaguaggucaugcugacaaucuaugagaagagaguucuggcgaguuuuuucccuugggagauaccuaauuuaggguauguguauggaagcagagggugcaguaaguaaaagggaagaugaaagaaggauggaugaaaccuacaaagcaagagagagcaaaaacaagaaagauaaaaagugcuauagagagaaacaauacaaacaccagcaauucuaugguuuuuaaugauauuaaaaugacacagcauugauaacacuaaaucuuuuagguucucugaaucgcaguuuguucaucuuuucuguaaaaugaugauaauaaugucuaccaccauaaacaaaacugaguaugagacaaaauuguuuaaauugaaguuauacugcuuaguaaaugucaagagacaaaaaacaccugauacccaaugaaguaaaauaucuugccugauuuauuuuaucuacucaaucagaccuuaugauaagcacaauuacuacugcaaucuuacaacgaaaauaagagauuuuuguuuuguuuuaaauuuuauuauuauuuuuuauuuuuauaauuuuuaaaugguagagagaggauuucaccauguugcccaggcuggucuugaacuccugagcucagcugauccuuugggaggccucccaaagugcuaggauuacaggcaugagccaccaugcccgaccauuguuuuuaauuuuaaaaaacaaaagaaacauguucauaucaaagauguaagggggcuguaaaauggaagggagagaaagaaggaaaauauaucaaaaaucaaaaaauuaucggccaggcacagugguucacgccuguaaucccagcacuuugggaggcugaggcggauggaucacuugaagucaggaguucgagaccagccugaccaacacggugaaaccccauaccccaucucuacuaaaaauacaaaacucagccgagcaugguggcacaugccuguaaucccagcacuuugggaggcugaggugggcagaucaccugaggucgggaguuccagaccagccggaccaacauggagaaaccccgucucuacuaaaaauacgaaauuagcugggcgugguggcgcaugccuguaaucgcagcuacuugggagacugaggcaggagaagguuguggugagccaagaucacgccauuacauuccagcuugagcgacaagggcgaaacuccgucucaaaaaaaaaaaaaaaaaaagaucaaaucugccuuuuagugccaacgauuaguuuaccaaauccuucaacacaagaagguagaaaugggugcuauuacuucuccugaaugcuuguucuuuaggaggaaauuguucaguuauuuacaccuguaaugauuauuucacuaugauuacuaaucuuaaaacucacaaacaaccuacuagacauaaaacauuucuuguauagucuaggaagaaagaugagauggaagaaauacgguuucaggaggcuuucucgggggcugacuccaguauuuauuaccauguucagauauaaaguaaguaaauuauucuuagaaguucacacaaacauacagugcucucucgcccuccuuuucuuauuccagcccaguuaccagcauuaagauuggccaguaucugcagcuuccuuucccucugucucucucccuacuuagauuuucguuaaaaaaaaaaaaaaaaaaaaaaaaaaaaaaaaaaugcagggcgcgggggcucacaccuguaaucccagcacuuugggaggccgaggcgggcagaucaugagguuaggaguucaagaccagccugaccaacauggugaaaccccgucucuacuaaaaauacaaaaauuagccaggcgugguggcgugcgcuuguaaucccagcuacucacgaggcuaaggcagaacugcuugaacccgggaggcagagguugcagugagcugagaucuugccacugcacuaaagccugggcaacagagugagacucugucucaaaaaaaaaaaaaaaaaaaaaggccgggugcggugacucacaccuguaaucccagcacuuugggaggcugaggcaggcagaucacaaggucaggagauugagaccauccuggcuaacacggugaaacccugucucuacuaaaaauacaaaaaauuagccaggcgugguggcaggugcuuguagucccagcuacucgggaggcuggggcaggagaauggcaugaaccugggaggcggagcuugcagugaaccgagauugugccacugcacuccagccugggcaacagagcaagacucugucuugaaaaacaaaaaaagggcaaaugcgguggcucacgccuguaaucccagcacuuugagaggccgaggcaggcggaucacgaggucaggaguuugagaccagccugacuaacaaggugaaacccugucucuacuaaaaacacaaaaauuaaacgggcaugguggugcucgccuguaauuucagcuacucaggaggcugaggcaggagaauugcuugaacucgggagguggaggccgcagugagacaauaucacgccacugcacuucagccugggcgacagagcaagacuccaucucaaaaaaaauaaauaaauaaacacacacacacaugcgcacgcgugcacacacgcacaaacaugguaauucuuaggcagcuggcauccacucaaacucaggugggugccugccuaacuccuacuagaaauaagaacggacucuguagcccaagaaggacaagugcucuagacacucagggaaaauaucugaguaugcaagauuuauuacugcauagaaauaaguaaacggauauauuacacaaguaauuuccuuuuucuuuuuccugucugaagccaguaacuccucauaugacaauuuuugaaaauucuuuuuaaaaaaauuaauagaggcugggcaugguggcucacgccuacaaucccagcacuuugggaggcugaggcagguagaucaacugaggucgggaguucaagaccagccuggccaacauggagaaaccccaucucuacuaaaaaaaaaauuagaaaauuagcugggugugguggcacaugccuguaauccuagcacguuggaaggccgaggcaggagaauugcuugaacucgggaggcagagguugugguaagccaagauugugccauugcacuccagucugggcaacaagagcaaaacucgccucaaaaaaaaaagagauggagguguuacuauuuggcccagacuggucuugaacuccugggcuccaagugauccuuccaccucagccucccaaagugcuggaauuacaggcauaagccaccaugcccagccacucaucugauaauaauaauaauaauuauuauuauuauuauuauuauuuuuugagauggcguuuuugcucauguugcccaggcuggagugcaauggcgugaucucggcucacugcaaccuccgccuccuggguucaagcgauucuccugccucagccuccugaguagcugggauuacaggcaugugcccggcuaauuuuguauuuuuaguacagaccuccauguuggucaggcuggucucgaacucuugaccucaggugauccgcccgccucggccucccaaagugcuaggauuacaggcaugagccaccgugcccagccucaucugauaauuauuuagaucaaacugaaauaaaaaaaaucaguagaugacaaucugcuauguauaaaacauaacaauaauacuagucugugaagaaaaaaagaaaaaagucaaaauagugagguaacuugacuuaagcaagcaaagcuaugaaaacuaagucuguauggaauucacaaaacugucagagacaggaaacuuaagagacugaaaacaaaggaaaaagauaaaugggaacuucucuauuaugggaaaugucaacagugacauucuuuucugagguagaaccaaucuuuuuuugauuuugagacagacuuuugcucugccgucuagcuggagugcaguggugccaucauaguucauuacaaucaugaccucucgggcucaagcaauccuccugccucagccuuccaaguaacugggacuacaguugcaugccaccauguaugauuaauuuuuuaacuuuuuuguuuuuagagaugggguuucacuauguuuccuagguuggccuugaacuccuuggcucaagugauccuccuaccucaguaucccaaaaugcugggauuacaagcaugagccauggcacccggccaauagaaccaaucuuaacaaauuuauaaauggcccuggaaaaagaaaugcagaguuuaaguuccaaaucuacaguugaaauuauaucuaaacuaggagaugcuaaauucaugacaguaaacugaaagauuuugcacacuucagcaagcaaguggcaggucaucuucaauacagacaacggcaagauaaaauguuuggggaaaauuuauuuaaauauaaaacaauggggccaggcaugguggcucaugccuguaaucccagcauuuugggaggccaaggugggcagaucauuugaggucgggaguucaagaccagccuggccaacauggugaaacccugucucuacuaaaaauacaaaauuagccgggcgugguggccuguaaucccaguuacuagggaggcugaggcaggagaaucacuugaaccagggaggcagaggagugagcacuccagcuugggugacagagugagacucugucucaaaaaaaaaaaaaaaaaagagccgggcacgguggcucacgccuauaaucccagcacuuugggaggcugagguggguggaucgccugaggucaggaguucaagaccagccuggccaacauacuaaaaccccgucucuacuaaaaauauaaaaaaauuagcugagcgcgguggcaggcaccuguaaucccagcuacucuggaggcugaggcaggagaaucguuugaaccugggagguggagcuugcagucagccgagauugugccauugcacuccagccugggcaacaagagcgggacuccaucuuaaaaaaaaaaaaaaaaaaaaagggaacugggagcagucuuaaauuguuuauuaaaaaugucagcaaaaugcauugcuaaacaggcccaugauuuuagaaauaugaaaaaugaguacaguuauguggcaauugccucuggaaaaucaugugcaguugugacuuucaucaugcgaaguuaugauuucaugcuaggagagauauaaaaggauuagauaaagauccauggaaaaaacaauugagauuugggggcuguuggauauaaaaagugaauaauuacauucucuagaaaggcuugaagaggaagcuaagugaaaucuauaaagcuaugaaaaauaugagaggaaaugagaaguauuugacaaauuuuacaauaucagaauaauuugaguguaaacuuuaaaacuuucuuuuuuuucgagauggagcuugcccugucacccagacuggagugcaguggcgugaucauggcucacugcagccucugcccccuggguucaagugauucuccugccucagccuccccgguagcugggauuacaggcacaugccacuacugcccggcuaauuuuuguauuuuuaguagagauggaguuucaccauguuggccaggcuagucucaaacuccugaccucaagugauccaccugccucggccucccaaagugcuggaauuacaggcaugagccaccacgccuggccaaacuuuauaccuucagagagguaaauuuaaaacaaaauggaagcacugcuuuauaugaugggcuauaaacuuacugagucuuuacuacaaguaguaaaaauacaaaguuuuagaaauuuggauaaguuaauugaugcagacccaugucagggaauggggcaaaaaaaucuaaaauauaucccuacuuuugaggggagcacugaaugaauuaucaugcccauuucuuuagaucucuucauagggccuuaguuuaaaagcaugauagucauauuuugaaguuguaagaccugagauagcaaaaaugggaaggagacucuauugagagaaaucuccuuaaauaauaagcaagaaagaacugcagauuggagccaaacacgguggcucaugucuguaaucccugcacuuugggaggcugaggugggcggaucaccugaggucaaguguuccggaccagccuggccaauauggugaagcccugucucuacuagaaauacaaaaaaacagccgggcaugguggcgugugcuuguagucccagcuacuugggaggcuggggcaggagaaucgcuugaacccgggagguggagguugcagugagcugagaucacaccacugcacuccagucugggugacagagggagacuccgucucaaaaaaaaaaaaaaaaaaaaaagggaaagaaagaaaggaaggaaggaagaaagaaagaaaagaaagagaaagaacugcagauugaucaugacaaacaaaauaucuuggcuaauuagaaauaaaggcaccuuugcaauaggaaaugaacauaauagcuauucugcuguccaggucuuccauuaaacucugauguaccccucaaagcacucagcacuuauaacaaaggguggguuuguauuuagcauguuacugauuuacagacucauaagcaaaaacgaagcguaaguagucuguugguccaaguuucaauacagggccuuuuuuuuuuugagacuugcuuugucacccacgcuggagugcaguggagcgauuuuggcucacugcaaccuccgccuuccggguucaagcgauucuccugccucagucucccgaguaauugggacuacaggugcgagccaccacgccgggcuaauuuuuguauuuuuaguagagaugggguuucaccauauuggccagacugguuccgcccgccucggccucccaaagugcugggauuauaggcguaaaccacugcgcccagccaaaaggggccuuuuuuucuuuuaucuuuuuuuuuuuucucucacugcaaucucugcuucccagguucaagggauucuccugccucagccuccagaguagcugggacuacaggugcgugccaccacgccaggcuaauuuuuuguauuuuuaguagagacgggauuucaccguguuagccaggauggucuugaucuccugaccucgugauccacccuccucggccucccagagcgcuaggauuacaggcaugagccauggcgcccggcccaaaaggggccuuucuaaaggcauuuuauaaaagguguuugaaacacaaaccugaaaaaaaaaaaaagacuuuaguuuaacaaagguaaccuaaugcuuacccagugcuuuuuccaccgccauaucugcaaacagguguggaagugaaaagaacaagcagacauaacacaaaauuauuuucuuucuuucuuuuuuuuuuuuuuuagauggagucuagcucuguugcccaggcuggagugcaguggugugaucucagcucacugcaacuucugccucuggguucaagcaguucuccuaccucagccucccaagcagcugggacuagaagcacccgccagcacacccagcuaauuuuuuuguaguuuuaguagagacgggguuucgccauuauuggccaggcuggucuggaacuuccgaccucaggugauccgcucaccucggccucccaaagugcugggauuacaggcgugagccaccaugcccagccacaaaacuauuuucuuuuuucuucuuuuuuuuuuggagacugagucucucuccaucacccaggcuggagugcaguggugggaucucggcucacuaaaauguacgccucccggguucaagcgauucuccugccucagccuccugaguagcugggacuaccggagcucuccaacaugccugaguaauuuuuguauuuuuaguagagacgguguuucaccaucuuggccaggcuggucuagagcuccugacuuugugauccgucccccucagccucccaaagugcugggauuacaggccugagccaacgcgccaagcccaaaacuauuuucuacuccaaugugcaaagcaaccuaacaagaaaaaccuuaaauauuuauucuuuuuuucccugcuaaugacuggacugcauuaaccucguauuuucauuugaaaaucaucuuguuucaaugauaauugcuuugucaucaaaacaaauaauuuuuuuaaauuuaguuugaugacugacagcauggcuaaaacauaaacaauuucaaacuucauuauuguauauuuuuuccugugaggaauaacuagcuuccacauuuuuuagaauguuuuucuuauuuuguuacaaaaguguaagccgaauaaaagaaauuuuuaggaggucgaguuuaaaaguuuucacuaaauuaauuaauuaacuaauuaauuaauuauuuuugagacaaaguucacucugucacccaggcuggaguguaguggcacgaucucggcucacugcauccucugccucccugguucaagcaauucucuugccucagccuccugaguagcaggauuacaggcaccugccaccaugccccacuaauuuuuguauuuuuaguagagaugggguuucaccauguuggccaagcuggucucaaacuccugaccucaggugauccacccgccucagccucccaaaaugcugggauuacagucgugagccauugugcccagccuaaauuuauuuuuuagauaaguaagucuagcuaaaggugacaaggcuaaauacagaaaugcgcauguaaaaagaaaugcacuugggaauguauguugagaagacaaguuucccacuggccauucauuuaacagcuugcaucacauugcaacuaucuuuccuuguugauaauaugggaaugaguuaaagaaauagaagaaauuaaaagggagaaagauuaaagucugcgagugagguggcaaaagaguucaaaauaaaguaaaugcuucuagagaaagcaaguaaaagggggcacgaagaauuccacuauaaaucaugcuaagugugcuuagacaucacaacuccagaauuacucuaagugcuaccuuuucuugaugaacaaagugcaaguaagugaccuuugguaccgacaccuaacugugcgaauagucaaaauauccuguaacagaauccaucaagaccacuuaaaauugcuuaauuuugaugguacuuugugauaaaaucaugagccaacugugaaagacuaucuaccaggcccgccuuuucaaaaacuaaacauuauugggugugguugguugauuaugaaaagagaaacuacacuaauucuugguaguuuugacaacgccuuuaaugauaaagaaguguguuuaacaugugucucucauguucacuaugguaaaguugaucaguuuaacucuuugcaaacaagcaagagauccugcaagcaggaagcuuuucuguggaacuccugacgcaacacaaaccauaacaguuacugcaaagcuuaaugcaaacccucuagaguccacgcugacaaauucuuuaacaagcccugugguuacagggaagcugguuucacugugacucacuccugcucaaacaguuuacuggaaaugaaggggagggggaauuuucagagaagucaugugauggccagacaaaccacaaccaguaaagguucaucagagucaaaaacaggucccagcaacaacugacacccagagucuucaaaugguacuaaaguguaugaaaauguguccuguuuaguuucagaucaucuacaccauaaacucuuucaugaaucuguguauguaaaggaaaaacuucacagcaggaaaaaccagcaggcauugacaugguguaggcaacugcaaccgcacacacuucauaggaaaaugugcuuaaaagagaauagcauuaguggaaugccaaagcacuuucgugaguauuuaaauaaucuuaucaauuccuuucccauagucuuuaaacucaaaugaucaaacacauauucuaucauuaucaaaagaauccuucacuuugacccuauaguuugaaaagggauguucgcuagauaaaugucuauuuuguuuuacugcauuaaaaaaaaggcauuggccauaagaaugagaacuaccauuacaacuaauaaacuguuuuuugguuuuauauuuucacuaguaaaauaauguaaauaacucaaaacuucugaauaggacaaagauccuauuaagcuaaaaaauaagauuuuuuucagccuuaaauuuaauagaaauuaguaagguaaaagauacuaguauuaaaacuuaauuuggggauuuagcuucaacauacagaguagguagcaauuauugauuauuaauuacauuaauuacuauaguccuaaauagaaccuaaaaauguucccuuaaaaaaagauuaaauucagaaacuauaaaauagccuuugaggaaauauucaaccuaaaauggucggcagacucaugaacgauacucaacagaaagacaagcuaauugauaugaaaauagaggaaaaaaacugauauucuuuuuuaucuuuuuuuuuuuuuuuuuugagauggaaucucacucugucaccuaggcuggagugcaguggugugaucucagcucacugcaaccucugccucucggguucaagcgauucucguuccucagccucccaaguagcugggauuacacaugccugccaucaugcccagcuaauuuuuguauuuuuaguacaaaaaauuuuguauuuuuacaagguuucaccauguuggucaggcuggucuuuagccccugaccucaaaugauccaccugccuuggccucccaaagugcugggauuacaggcaugagucaucaugccaggccccgauauucuuugaaaaggugaaguuuuaagacuuuuacauuucugauuuaauuuuaaauuuccuauucugauagcaauaauaagaaguaggaaauuucacauagucagcaaccuaacacugugagaaagaauccaaguagcaggucauuaaaacagaugacauuuaggaaaguaaacuuauucaaaacauauucuuguaaguaaauauguaccacaacguuucuacucuauuguguaagcuuuaaauacaaaaauaccacaaccacucccggacuccuccauuauuucaguaauacuggcugcccuaauuuuucaggauacaucaugcaaauaaguucuuuuauuuuucaaauuauuuuauuccuaaaguaucuuuaauuuuucuuuuugguuauacagcuuauagaauaaacaagucacaagaaucuucauuuguuucuaaaguauauaauuuuacaaaaguuguuuuacucaaugugaauuaaaauuugcaagucuaaaaaaauaaaaaaauuuuaaaaaguaaaaaaauuugcaagucauuuaacuuggugucuuuuauauuaucuucagaugacaauugcucucagaugacuauuaaacucaaagaugcaauacaguuaaaucuuccuuucuuuguaaaauuacuguuguucaauuacauuuuacagcaaaauaagacugaauauuaauggacauguuucauguaaugcuacacuuuuucuuacuguuauuucaucaucuauucaaaguauccacugcaugaguaguauguguaacaguaggcaggcauuguugaaaauacaaacauuuuuaagcccccuucuuaaggaguuuagacuccuggagagauaagaaaagucuauaaauaguuuuaaaagaagguagaaugugauaagugacacaagaaagacauagcugggcugagauaggaauucagagacaauuugagaggagugaagggggugagguagggguaggaagggaaucauaaaauaguucacaaagaagccagcagcacauaaauugaaagguaagaaaacugaaaaaguagacaugcagaugggaagaaaugacacacuaggcaaaguuacgaaaaagaacaauaccgcauagugguggaggaaaaaguuaaauuauuccaaaugaucaggcuaguaauuuuuaaacuuaaaaacuucagaguucuuuaauuaaaagaaaucucucucccucucccuuccucccuccaaucucucucucucucucacacacacacacacacacacacacacacacacacacacacacucuuuuugauggguauucuggcaguuuuuuaaaguucaacuugaaaaccaucaauacagaggauaaaaaacuguuaaagggaaaucagaaguagucguagguuggggccaaguaaugaagaaaacuggguuaaauaguuuagauuucacucuauacacagugggaggcaucacagauuuuugagcagcaauguuucauaaguagagauauuuuucagaaaauuauuuuuguuacuuugugugggaaaagauugggauaaaaaacuaguaaagaguagaccuacuagcaagcugcuggcaauauuuagguaaggguugauaaaggccugaaacaguagcgggaagggagaagagagggcauguaagauacuauggagauagaaucaacaggccuuaaagaauuaauuacuggggaugggaggaaaggagggagucagaugacucagauuuugacccaaagcgauuguuaggauggugauagcauuaacagaacacaggaacaaagaaggaaaagaagaucauaaagagaauaauuaaaccuugcauaaaacaguccacaaagcacauaaacagcuaucuagaccuaacuuuuauuaaugaugcuaaaauugcucaaggucagaggaagcuacauucauucauguguaccucucacagacaucuaguggaaacacgauagaaagccaagagcaaaaggaagucagcuuaguggaaaaauacugccuaaucucaacauuguacucacaaaaauacagcagguaucauaauaaaucagaauacaaauaaaugcuuuaaucaucuuuuuucccccuuaaaacaucuauaguacgacauccaaccauuagucaagaauggaauuuaaguaaauaaaauuguuucauaacaacaauuucuuuuuguuuuuuugagacagagucucgcucugucgcccaggcuggauugcaguggcgcgaucuugacucacugcuagcuccaccucccagguucaugccauucuccugccucagccuccggaguagcugggacuagaggcgcccgccaccacgcccggcuaacuuuuuguauuuuuuaguggagacgggguuucaccaugucagccaggauggucucgauguccugaccucgugauccgccugccuugggcguguugggauuacaggugugagccaucgcgcccggccacaacaauuucuuaguaaaaucacauacaccauuuaaccuaguuggaaagcacauggcaaagcaaugaaagccaagugguuuuuuuuguuuguuuguuuuuacuuuuuuggcugauaaacuuacucuacuacagggcuuuaccuucaaaaauaaaaacccauauuuucuaacucauucucaugcaaucuuaaaauuuaaauuuccacucauaguuacggauugauuuuacuuaauuugccguuuuagcuacaguugauucaacuuuuccguauuuuauugcuucuaucaaauuggagguuuuaccaaauacauguuaucuacgagcagaucccagcaacaaagucagauaaacuuugaaucuuugcuaaacugauuacuauaagaauuuguaaaucauaaccaauaagaugugacuagaaagaugucaguaaaguuauagcuuagcaaauaagaacccaguaucuuuuuaauauaccauuucuaacauuuauaaaaauauaauaggaaaaaagaugcaaauuagaacaacaaaauauaagacaaaacuaacauauuaaaaucacuuggaaaauaguguuggaacaauauacaauuaguuaauuaccuaagaaagaaaaaaguuagauuccuacaucauaucauauguaaaaauauuuucauagauuaaagacuuaaaagaauaaaaccauaaaaguacuaaaagaaaauacaggccaggugcgguggcucaugccuguaauuccagaacuuugggaggccaaggcuggcagaucacuugaggucgggagcucgagacuagccuggccaacauggugaaaccccaucucuacuaaaaauacaaaaauuagcugggcguggugacaugugccuguaauccuagcuacuugggaggcugaguuaggagaaccacuugaacccgggaggcagagguugcagugagccaagaucacaccacugcacuccagcauaggcgacagagcgagacucugucuaaaaaaaguaacauguaacaaaacauacccaguaaaugacauggaaaaacuacugggaauaaggaauaauacuggcagcauaugacaaagagcaucuucuuaaauauguaaaccaguaagaaaaugaaaaauauaucauaaaaaagauauaugcaccuguuagaugaacauucuauuucuucuuuauuuguauuuucagcauuucauuauaauaaacuuacuuuguaguaagaaaaaaacccguuauagcaaagaugugaaaauauuugauggcguggaaaaauguucacguuuuuagauucaaaucaagucacaaaacaacaaacaauaugauuucacucuuagguauauaaauauuuauagagaaaagacuaaagggcacucaccaauuuucuacaaugagauguaucacuucguaauaaaaaauaauuuuauaauaacauugguaucacaugucuaugauacugugaaaaaggaacuugugacuaaaauuuaugguaugauucuaauuuuuauaaaaaguuauguaugcaaagaaagcagucuggaauacagugauuauuacccuacacuggggagaaggugugugagcuuucacuuuuuacuuuauaauacuuuuggaauguaagaaucuuauuacuaaaauuacuuguauaauuaaaaaauaugcagaucuguaaaacauaaaauaagcaaagggccuaaaacaaauucaugauugaaagcauuaaaaaucuucucuuugccaagccauagcaagaaacucuccuuugaacaagaauuaaaacauuaguacucucucagauaauuuauaacauggaaaaccggcaacagucucuuuccacuuguucucccucaccccuucaacugcaaaacaacuauaaacaaauaaaaauuaaaaaucuuauacaccuuaucugaaacugggaaaaaguauguaaggaaaauuauauccacauccacugaaaucuaucauaagccacaaaauugauggaaacuggugaaaaaaucaugaaaaggaaugaagaaaagaaaaaucaggcugggcacaggggcucacaccuguaaucccagcacucugggaggcccaggcggguggaucaccugaggucaguaguucgagaccagccuggccaacauggugaaaucccaucucuacugaaaauacaaaaaauuagccaggcguggugguggacgccuauaaucccagcuacuugugaggcugaggcaagagaguugcuuuaacccaggaggcagagguugcagucagcugagauggcgccacuacauuccagccugggcaacaagagugaaacucugucucaaaaaaaacaaaaaacaaaaaacaaaaacaaaaacaaacaacacgaaaaauccaauauaggaggaaaaaacuaguucuucacuuuuuauugcauuaaccuggaugaaaauauugcuacaguaugauaugguaagcaccguacuacuaccaugcccagcuaauuuucuguauuuuugguagagaugcgguuucaccacauuggccaggcuggucucgaacuccugaccucaagugauccgcccaccuuggucucccaaagugcuggaauuacaggcgugagccacugcagcaggcaacaguauaugauuucuaacaaagaacaugaaacaguauguguguacauuuugcucacuugauuuuucaauauaaauaagcaaauaugaaauuagguacugagaaauguacaguuuaucuuaaaauagugauuuuaauuauuggcuuuacaggaugaaaauagccaaaccucauaaccaacagaaguauugugugcauucugguuuccacgacucaaagaaaaagugguaucagagaagauccccucaaaaaguaacuaaucagggacauaagagaugaaagaaaaagauuauuaccccaacaguagauagauaaagacugagaaaagaaauggucaaagucuucaagagcucaaauuacauggauaaaauaaagaauucuucaucaaauucuagaagaucuuaguuuuaggaacugagcuuuuagauggcaauaagcuuaugaaauucauucuuuaaaauuccaaaaucaaaacccugcaaagaaugaaauaagucuucuacucugauauucuagccaauguagggugugcuauggaugggauccuugagagauaucacacagaaacaaggcacucacugcacucugugagcaauacgaaugacuuuucuuaguuuaaaccacuaaauguuggggugauuuguuacucaguaauacacaacuggaauacucuuuguucuaaaaauaaccccaaaacauagaaaacagaaaugagaacucaaucuuugaugaaguuagcauuaauaaaugaggacaggacaaacagaagaaaagauuauaccugagagcguacaggugagggauauguaagagaagcaaaauacuuugccccacaaaacuccaaaagagcucuucagcagaacugccagaagaggcuggcauaggucugaaaacaaggagaaugcaaaagacucccaggucccaucccuacucagcacagccaggcaagucucucucccauaucagugggagacauagucucuagacaaaagugaauguucugggcucaggacauacuugugcuuguguuuguguagguauucacagauagaacagaaagugaguugagcaacaguccacauacuaaauggagaucucuaaccacucuuccccagucuagcuuuagugugucagcagcaaggcugauacagauguuccuugacuuacaacgggugacgugucuuaaccccuucguacugaauauaucguaaaucaaaaaugcauugaauacaucuaaccuaccaaacaucauagcuuagccuagccucccuuagacaugcucagaagacuuacauuagcccauaguugggcaaaauuacaguacacugcagaguauggacguuuacccucaugaucaccuggcugacugggagcuguggcucacugcugcuacuuggcauugugugagaguaugguaccacauaucgcuggcuggggaaaagaucaaaauccaaaauucgaccuaugguuuguacugaauguguaucaauuucauaccauuguaaaggugaacaaucauaagucaaaccacuguaaguuagggacugucugcauugccuaggcaagaaauugaaggauccaucauggagaaacugaacuauccccaagaaaagaucaauagacacugauacauggagguucucaguaaauauuaagccuggaugccacuugacuguacaauagggaagccucaccaucacuacaccuggccuguacgcacauagcuuccacuuagcuuuuaagugccuuauucuuuuuuuuuuuuuuuugagacagagucucgcucucacccaggcuggagugcaguggugcgaucucggcucacugcaagcuccaccucccagguucacaccauucuccugccucagccucccaaguagcugggacuacaggcgcccgcuaccaugcccagcuaauuuuuuuuuguauuuuuaguagagaugggguuucacuguguuagccaggauggucucaaucuccugaccucaugauccgccugccucugccucccaaagugcugggauuacaggcugagccacugcgcccggccuuaagugccuuauucuuauauaaacauacaaauaaggauuaucaggcuuugaggaaagccucgaacuccaaauugaacaaacagaaaagacgaugccugaaaaauacauacaaauugcuuuuugaaaauaaauauguuaacagcagaaaaacauuucgauauaagacuuagaagauaaacuugggaaaucucauagauaguaaaaugagauaaauauuagaagcaaaaagguuuaaaaaauuaaaaggaugggcauaggaggccuaacauugaagcaacuagaauuccaggaagcaagaacagagacuaaagagggaaaacucacauaaaaaauacaagaacauuuccccaaacuaaggaacaaguuuucugagcaccuaucagaguacacuuuauuuguuuuuuuguuuuguuuuguuuuguuuuguuuuguuuuguuuuguuuugagacggagucuugcugugucgcccaggcuggagugcaguggcaugaucuuggcucaccgcaaccucugccuccaggguucacgcgauucuccugucucagccucccaagcagcugggacuacaggcgcauacgaccacacccagcuaauuuguuuauauuuuuaguagagaugggguuucaccauguuggccaggcuggucuugaacuccugaccguaggugauccacccaccucggccucccaaagugcugggauuacaggcgugagccacugugccaagcucagaauacauuuuaaaaagacuguaccucagauaaugaaccuaaaagcuucuagagaggaaaaaaaaaaaaaguagacugcuuauaaagaggacucagaagggcaucgguccucuggauaccaauuacagaaacuugaagacaauugaacaaugccuuccaaauucuaaguauaaaaagugauuuucaacccacaauccuauauucaguuaauuaauugugaaugaagaacaugcuaguuuagaauguaugguaucacauuuuccauuuacucacccuuucacagaaagcuacagcagaauauguucaagcaaaacgaagguguaaauuaagaaagaggaagacaagaaaucuaaaccaagacagaagcaacugugcagaagggcaacugaacagcaaguccagaauggagugggagcauggagggcuccagagagaugacuucaugaaaaaaaauggaauugauauaaucuuauuuguguuaccgaguggaaagugguaucaugagauguuuuuacagggcuguuggaggggagagaaggcaagccagagauguaaagacuaugcaaauuugaaaauguuaauucuaagaaaaaaagguuuaaaaacaaaaggagaaauaaucauaguacauuaguugacuuaugagagaacaacucucauacccauuuggaauccaagucauagcaaaaaaauguauagcugcaagccaccuuauauuuauuccacuucaacuugcugauuucauauagauaaaaaaagaauuuuagagauguuaaaugacauacauuaguuagugccauaacucaaagaacuaucaguugucacaagucucacccaucugcuucuguggacagacugguuucaguaaucggaauauaccaguaaugcuggcauucugaguuuuuguucuaccuauaaguaugugaaauuugggaaguaacaacuaaaucuacuguuuucuauaaaguuagaagaaugguaccuuuccaaacucccucagaguuaacacaagggucauauuaaauacuggauuuuuaaaauguuaaaaauaauuuuaaaaguuuauauuuguaauaauuauuagcauuaauauaagcauuaugaugucaugagaggcauaauauuugguuggcagauaaggcaaagcagauaccagggcaauuugcucuuuccacaaagagcagauauucauggcucuuuauuucauuugguuuauauuuggcuauucuaaauucauauuugaaaguuuuguauuuaauuaaaaacuauaaccauacuugguugaauuuuauuucauaaugcuucuuguuuuuuuuuagguggggucuugcucuguugcccaggguagaguacaguagugcaaaugcagcucacugcagccuccaccuucugggcucaagcaaugcuccuguuuuagccucccaaguagcagggacuacaggaaugcaccacccuauacagcuaauuuuucauuuuuuguagagaugagaucuugccauguugcccaggccggucuugaauuucuggccucaagcaauccuccuguuucagccucccaaaguucucgguaauaaugcauuuuuaaaaagccuaucugacuugaagauggagauucaaucuuucaacaagguuuuuaggaauuuuccugaaaacaaaacacucuguugagauaacugagauagaggcugauacacagauugugauuaggucaaaaagccucaaccaauuauguuacugcuugccuaggccuagcauuuaauauuuuucuguuuugaaaguuuaccuugcucaucuugaggacacugucuagaauacuccagggcauucauuaaucugacugaggcaaaggcaagucugaacugcugaauaguuugaacuguuaaauauuauucaaaaagaaaguucaggccaggugugguggcucacgccuauaaucccagcauuuugggaggccagggugggaggaucacuugagcccaggaguuugaggccagccugggcaacauagugggacccugucucuacaacaaauaaaaauuagcuggccauagugguauauaccuguagucccagcuacuugagagauugaggcuggggaauaacuuuguguuuuuugagauacucccauucugucacccaggcuggagugcaguggcacaaucagggcucacugcaaucuuugccucccaggcucaagugauccucccaacucagccucccaaguagcuaggacuacaagcauacgccacuaggcccagcuaagcuuuuuaaaaaauuuuuuguaggccgggcgugguggcucacgccuguaaucccagcacuuugggaggccaaggcggguggauugcgaggucaggagaucaagaccauccuggcuaacauggugaaaccccgucucuacuaaacaaaauacaaaauguuagccaggcgugguggcaggcgccuguagucccagcuacucgggaggcugaggcaggacaauggcgugaacccagaagguggagcuuguagugagccgagaucaggccacugcacgccagccuuggcgacagagcgagacuccaucucaaaaaaaaaaaaaaaaaauuuuuuuuguagagacaaggucucacuauugcccaggcugaucucaaacuccuagguucaagugaucugcccaccucagccucucaaagugcugggauuacaggcaugagcuaccacccccggcuggagccuaagaguuugaagcugcaguaagcuauguuuauauaagaguuugaagcugcaguaagcuauguuucuaucacugcacuccagccugagugacagagugagacccuaaaucaaaaacaaacuaacaaaacaaaacaaagaaaaggaagaaagaagcaaagaaagaaaaaguucuacuauuacuauugucauauauacuacuacauauugcuuacuaguuuaaaguuuuaguaacuacuuaagaauuugauauaauucauguauuucccuagcaaacauuucagcagcucugcacacuauguggaauacagaaugaagcugcuuucaagggaggaaagggccacuauagauauagccauaaaauaagauuucuuucuuucuuucuuucuuuuuuuuuuuuagagagagggccuguugcuuaggccagaguacagugggaugaucauagcucacuugcagccucaaacuccugcgcuuaugcaauccuccugccucggguucucaaagugcugggauuacaggagugagccaccacaucuguccuuugauguuauguuuaacaauuaauucagaaguucuauuauuuuggacucagagcagcagucugcuugguaauaccucuaaacaaauaauggagaaaguaaguuucagcuccuuaacaucauuggcaacauuaauuuacccugguuucugacaagguguuuuaguguauuaagaguugucuuauugcauuuuucuauucuaagaucaagauuaucuuuuauauuuugaccuuucuaaauauucuaucucaagcaauauuuuucuuucuuuuuuuuuuuuuuacuuuagcaguuuucuucuucagaguaacuacuaacaauuuuaccuuaauagccucuuuaggaagaaguaaaguguucuauuuucuauccccacuguucuuacuugugcagacucugcauguuccagcaucucuucaaauuccugauacucuucaucaucugguucagcaccugagaggcgagcugcucuggccaugaaauauggaggcagcucuccgauugcuguaccgauacccuaggugaaaaaccaaaauacuuacaaugagguucuguuaucaacagugacacuuaauagaucaaacccauacucuucuauaucaccagaagcauuuugagaugcaauauauugggggaaagcauaugcuacauaaucaaaauaauaaaaguuugaauccuggcucuaauucugaccuaucugaugcuuggcaagcaucacauaaaacccuuaagacaagccaggcacagugggcacgcaccuguagccauagcuacucaggaugcugaggcaggaagaucaccugagcccaggaguuugaggccagccugggcaacauucugagauuccugucuaugaaaaaaaaaaaaaucuugagacaacaccuggcucauuguagacacuaaguaaauuuuaguucucuagaaucucuacuuagacucuguuauuuuuaucauuugcccccccccaccgcuucugauaucuaaaugaucugguaauaagaauucaccaguggcugggcaugguggcucacgccuguaaucccagcacuuugggagggcgaggcgggcggaucccgaggucaagagaucgagaccauccuggccaauagggugaaaccccaucucuacuaaaaauacaaaaauuagcugagugugguggcacgcacuugcagucccagauacucuggaggcugaggcaggaaaauugcuugaaccugggaggcggagguugcagggagcugagaucgcaccacuacacuccagccuggcaacagagcaagacucugucucaaaaaaaaaaaaaaaaaaaaaaaaaaaaaagaauucaccaguauauguguuagauaaaaauucucuaggaaauccucuggaacuucagaaguugcuuuaauuuaaauacaacuuuucuucuguugaguuaaaacuuuuaacaaauuguagucagaaagcccuuugaaaacuaaacauuaggaugaauaaguuuucuuuuucuuuuuuuuuuugagaugaagucucacucugucacgaaggcuggagugcaauggcacgaucucggcucaccacaaccucugccucccaaguucaagcaauucuccugccucagccucccuacuagcugggacuacaggugugugccaccacgucuggcuaauuuuuguauuuuuaguagagucagaguuucacuauguuggccaggcuggucucgaacuccugacuuuaggugauucacccgccucggccucccaaagugcugggauuacaggugugagccaccacgcccagccaagcucugcuaguucuuaaaaagcaauguuaagcauuucaguuugcucugucuuaugguucugccuccaaaugcucugaaaagaauucccaagggaccaaaucaaauucaaauauuuuguauucacaauggguggaaccaacaauuuccacguguaacuacauuauccauacuugaaacaagaauuuugaaaaagaguccaggcacaguggcucacgccuggaaucccagcacuuugggaggccgaggugggugaacugccugagcucaggaguuugagaccagccucggcaacauggcgaaaccccaacucuacuaaaauacaaaaaauuagcugggcaugguggugcgugacuguagucccagcuaccugggaggcugaggcaugagaacugcuugaaccugggagguagagguugcagcaagcuuaugggugacaaagcgagacucuaucuccaaaaaaaaagaaaaaagagaaaaagaauacuuaacugccaaaagauuaagccuacauuuagucaaaaaacagacagagaaggcaggagagacauauauacauggauauaggcaaaaaccaaaucauauauauugcuaaauaagaaaaguuggucagacgucauggcucgcaccuaucaucccagaacuuugggaggcugaggcagguguauugcuuauguacaugagcucaagaacagccugggcaacauaaugaggcugucucuacaaaaaauuaugcacuuguggucccaguuacuugggaggcugagguaggaggaucaccugggcccaggaggucaaggcugccaugagcugugaucaugcuacuacacuccagcuugggugacaggugagacucugucucaaaaaaaaaaaaaaaaaaaccaaaaaaaccaaaaaacacuguaauguuggccaacuuuggaggaugcuagagaaccaacuuauuauuuuaaaaacugguauaauaaagaucaaguauuuaucuuuuucugauauaaacuauaucucgggguaacuaaauuagugacaaggaaaaguuuuccuucaucaaaguauuauuucagacccaguacaguggcucaugccuguaaucccagcaguuuaaaaccggccugggcaacacagcaaaacccugccucuacaaaaaauuagcuuggcaugguagcuugugccuuuagucccagcuauucaggaggcugaggugggaggauuguuuaagccugggaggucaaggcugcagugagcugugauugugccacugcacuccagccuggugacagagugagacccugucuccaguuaauaauucaaaaaaaaaaaagguguaauguaacugggauacuaauauuuuauaaccucuaauaaaauaauggacauauauaauaaaaaaucauccauggugcuaauaucacaaaaaggaaggacaaacagacauuguaucucgugauagaaauacacaaggcuauggaguguauuccuauuuacaaaaaaaaaaaacacaauuuaucaacucaaaggaaacacaaggaacagagcaacaugcuuaaauuauacuaauuagaauuuagucaguaaaauucagaccaugggaaauuauuuaacaguuucuucagcauaaaugugaaaagaaauaaaaucccagcacuuugggagacugaggcaggaggaucacuagguaaggaguuugagaccagucugaccaacauugugaaaccccaugucuacuaaaaauacaaaaaauuagccggguaugguggugugcgccuauaaucccagcuacucgggaggcugaggcaggagaauugugggaauacgagaggagguugcagugaaaugagauugugccauugcacuccagccugggugacagugcaagaucccaccucagaaaaaaaaaaaaagaaauaaacguaaucagaaaaauuugaacacuaauuggauaaugaauuuuaagagacuacuacaguuucuuuuaggugugauaaugcauuuuaggccccaaggcugauauauuuacagaugauguguauuaugauaucugggaucagcuucaagauaauugagaagagaaugagaaaggguauagauacaacaauauaaacuauuaguuaauacuagcugaacuugagugagaguauauuaaauucauuuuauaauucucugcaccuuuggaaaaucuuccauagaaaaaaguaggacagaaaguguaacaucuuacucaaaacaugaacuucuccuaaguucaaauguuaagucaaauguucaacaguucuuaaagcaaucaugugauugaagcucaugacaaauuuccuaaaaguuaagaaggaaguaacauaauggacugaaaugaaaucaagggcuguauacugucuuauacguaguugacuauauuuacuguuauauuuuaguuuaauucuccuaguguuuucccauauuagcaagaaacaaugggaaucaugagucaguacucucuuauuaugcaaauaaauaacaagggaauuuagucauccaggcaggugucccaaaacacauuauacccuagacacagacauuuauuuaucucaaauuagauacugaagucucaucauuucauaauccuuacaauuuuaugauucucuauaaaauucaaauauauauuuguauaagauacaaaauucuuuacauuuguuuauauucaaaacaaaacauaaauuguggaacacugaaaacugucagccuaaguuuaauuaaggagagagaaugacuggcuuccuuacugcaaaauaagugguauguacagucaagcaauaauucagaaagcucuccuccaaaccaucuacuacauacaaauuuauuacccuuaaauccuucuuaaacuagagaagaguuuaauaugcacaaaauaugcaaaccaacugauaacacagcaucuucuuggagugcuaauuuuauucaaagauucauucaaagauuuauucaaagacaaaaauucugaauuuguacuuuuaaaaaguuuugucaggugagguagggaaaaaacauuuugucaagugaacucacaagcaaaucugcagcaaggugcuuuuauauuaagaaauguaaguuuaaugauaaaaaucuggagagcaggaauuaaaaaaaucuaucuuuuucaccaagaaacccugucucuacuaaaaauacaaaaaaauuagcugggcaugguggcgcaugccuguaauccuagcuacucaggaggcugagucagaaucacuugaaccugggaggcggagguugcagugagugagauugugccauugcacuccacccugggcaacaagagcgaaacucugucuuuaaaaaaaaaaaaaaaaaguuuucauuuuauuuauuuauuuauauuuuuuuggagacagagucucacccuguugcccaggcugaagugcaguggcacaaucuuggcucacugcaaccucugccucccggguucaagcaauucucccaccucagcguccugaguagcugggauuacagaccugcgccacuacacccggauaauuuuuguauuuuugguagagaugaacuuucaccacguuggccaggcuggucuugaacaccugaccucaagugagccgccugccucaggcucccaaguagcugggacuacaggggccugucaucaugcccagcuaauuuuuuuuuuguauuuuuaguacagacagcauuucacuaucuuggccaggcuggucuugaacuucugaccucaugcucugccugccuuggccucccaaagugcugagauuacaggcgugagccaccgcgcccggugaauuaauucuuauauaugguguaagguaaggguccaacuucauucuuuugcauguggauauucaguuuuuacagcaucccccuuguuuuuuuuucuuugagauggagaguugcucugucgcccaggcuggagugcaauggugugaucucagcucacugcaaccuccaccuccuggguucaagcgauucuccugccucagcaucccgaguagcagugacuacaggcacccaccaccaugcccagcuaaguuuuauauuuucaguagagaugggguuucaccauguugguccggcuggucucgaacuccugaccucaggugauccaccugccuuggccucccaaagugcugggauuacaggugugagccacuacacccaguccccagcaccauuuguugaagacuguccuuguaaauguugagaacaauauuaacaaauuuaaacauaacuuagugugugcuguauuuuuaauauaacgagacaguuacaaagaaggaaagaagagcaaacauuugaccuauuaaucaguauuuauugacauuccuauacuacauggaaaacuuuuucaaaaaaauuaauuaauuuuuuuuuugagauggagucucgcuguguugcacaggcugaagugcagaggugcaaucuuggcucacugcaaccucugccucccggguugaagugauucuccuaccucagccucccaagucacugagaauacaggugugagccaccaugcccagcuaauuuuuuguauuuuuaguagagaugggguuucaccauguuggccaggcuggucucaaauccaccuaccucggccucccauagugcuaggauuauaggagugagccaccaugcccagcccuaugugcaaaacuuaaugcugauuacuaugaugcuaauacuuuuaagguauauuuaauauuuuuuaggauccuaaauauuauuuggggaagaaagccaccauaccagccaaauuaacuaauuuaaagcauguguaaagccaggccuaauaagcacuacagacaauauauacuacagaaauuuggaggaggcaguuaucacagccagccgagauagugguuuucauuuguuggccuuaagguuaauccagcaauguaaauaauuuuugaagaacaaaaguauaauauuaagaaaaaaagacaaauuuacauacaaagucccuuuucuagcauguuccaaguaucuucuguuauucuaacauuuuuuucaucaaaagacuaaugucaucaaauuuauaaagcauaugcaacuaguauaauaaauuuguuuccaguguuuauaaaagagcaacaggaaacaugacaauuuuuccugucuuucauauucaacaaauucaacaugaugguauuuccuuuauaauucuuuuaaagcagaacacaauugcuaacacuuaacuguguuucaaaacucugcuucuccugaggguaugguauucaugcucauuuuaaugaguuaagauuuguaagugaucuguuccauaaucuuuaauuuccuaagaaauuguuagugggaaaaaauuacaggaacauaacaaaucccaaugaguuaaaaaaaaaaaaaccucaaaugguaaaagaaaucuuuaacccaugaauuauuccuacggaugccugaauaaauuuaggcauacagggcugggugagguggcucacgccugguggaucaccugaagucaggaguucgagaccagccugcccaacauggagaaaucccgucucuacuaaaaauacaaaaaaaucagccgagcgugguggcgggugccuguaaucccagcuacuggggaggcugaggcaggagaauugcuugaaccugggagacagagguugcagugagccgagauugcgcuaccacacuuuagcccgggcgacagagcaagacugucucaaaaaaaaagcaaaaaaaaaaauuuaggcacacaaaaaaaauuguguggauuagaauccaucugccacuuaacaugcuguccaaagaauuuuguaaaauaaacuuaagcaaaccacaaaaagaauaacuggaacaacugaaaguaaaauugccauauacgaucauacagccugauacguucacuauaauaaggcuugguuuauauuaagaaaugucugaccuuacuuuaguuagcauuauaauaacucagaaaaugaaaugaguucucuaagaacauaauauuuucuuguuguuguugagauguagucucgcucuguagcccaggcuggagagcgguggcgggucucgguucacugcaaccccuacuuccuggguucaagcaauucucaugccucagcauccccaguagcugagaugacagguaugcgccaccacgcccggcuaaucuguguauuuuuaguagaggcaggguuucaccauguugaccaggcugaucucgaacuccuggccucaagugaucugccugccuuggccgcccaaagugcugagauuacagggauggccaccaggcccagccagagcacaguauuuuaaucuaaaaguaagacauacgggaggaucacuugagcccaggagguugaagcugcaaugagccgagauggcgccauugcacuccagccugggcaacagagcaaggcccugucucaguaaauaaauauauaaauaaauaaaugcauacauacauauacacacacacaauuuuuauuugccaaauaaauaaaaguaaaauuuuaaauuaaaaaaaguaagacauaugacauuuaccaaucuaauauuuauauauaacuauauauuaccaaucuaauauuuauauauauuuuauauaacucuuagauaaauucuaaaaguuuaucagguauagaaauacuagaacaaauuuuauaauguaguauacaguugacccuugaacaacauggauuugaacugugccaguacaagugauaaugggugugccucucauggcuccccaucuaccuccuccaccuccuuugccugugccaccccuaagacagcaagaccaaccccuucuuucccuccgccuccuccucagccucagccucuucaacaugaaaauggaguggaaaugaugauccguuuccacuuaauuaauaauaaauauauuuccuuucccuuauaauuuucuuuguaauaugguauacaauacuguauuaacacauacaaaauauguguuaaucuacuauuuaucauuaaggcuuccguucaacaguaggcuauuagcaguuaaguuuuuggggagucaaaaguuauauguggauuuccuacugcacaggggguuggcaccccuaacccacacaugguucaaggcucaacugugguuccaucaucuguacucccuugcccugcuggagucuacuuggccucaguugcuuugugauacauaugguucaugccuuucuucucaaugccauucaugaauaggagaugcucuaaaagguuucuuuugccuuggaaguagguagcugguuacugacugaaucauuuacugacaaggaauauguuuagauuccauuucaauaagguacacacacuaucaagauggugagguuaguuuuaaacaaauaugaaaaugcauaucuuacccacaugcaggcuucaauccuaacuuuugagaugauacuccacaaagaaaugguuccuucagugcccucuucaucuggacaaauaaucugaucaggauagggugguucgggaaaauuaacugaauugcauucauaagcagcuaauguaacugaggcuauauguggacccuauaaaacaaauacaagaaacuucugauaagaacuauuaaaaaauuaucaauacacauuauuuuaaaaauauauuaauuacuguguaagaaaaaucuuagcuuucaaagaacaaaaauaauucuaaauaauuucaagaugcaguuaguaauaugaagaaaauaauccuucccagaaucucuuccugguugacuuaaaaaaaaaucagauuuauugagguaaaauuuacacauaaugagucacuuauuugaggucuacauuucaauuagcuuugacgaacauauucagccauauaaccacaccaaucaagauacagaacauuuccauuacugcaaaaaugaucccuuggccaggcacagcagcucaugccuguauucccaccacuuugggcggcugagccaggaugacugcuugaagccaggaguucaagaccagccugggcuacaaagcaagaccucaucucuacaaaaauuuaaaaaauuagccaugcauuguggcaugugccuguagucccagcuacucaggagguaggaggcauugcuugagcccagguguuggaggcuguagugggcuaugauugugccacugcacuccagucuggacaacggaacaaggccccaucccuuauaaaaaaaaaucccuuguguuccucuguggccaauucccucccucaaguccuaguccccggcaaccacugaucuaauuccuugcuugacuuuuauuuuauuuaucuauauuucucauuuguuagauaauuccuuuuauuaaaaaaaacuuccugagccacuguucuuuuaggcacaauuugagaauaucacuuuacguccuuacuuaaaaacagcuggugaucuaccaccucauguaaccuuucccagugagaucauaaagcaaaaauguaacugugaaaccaguaucaaugaguuuuacacaaugguuccuaaaagcacaagaugaggugucugcauacuagggaguugguuaaaauauaaauuccugggucccuuaagcauagguugauagauguccucuagcauacaguaacuagcagccaucagcuauuaugaagauaaauacuuuauuuguagaauaaaauuauuuacauauauauacacgagauuuuauuacuaauuauauugugcaaguauuucugaaucugaagguuucuauuaaagauuucuccaaugauuuuucauaaaugagacagucccacagaaaaguaagugggcucuguguauaagaaaguauuuuaagaucacuugaugaaagaaucugugguucaaaguacauaaaaucuagugauaaaaauaaaacuaagacauucuacuaucaagauaauaaaauuuuguuugauguuaauauacaaaguuguucacacauaugugauauuuaucucuaaauagaaucggcauuuucuguuaaaauaauaccuaaaaaaugaaauccuuggaacugaaucaguuaauuauuaguuuuuucuggaucaaaaaaaucgaugugaaguuuuagccuuuguuccucuuuuuggggacuuuuaauucuuggaaaugcagaaauauuaaaguauuaaaauaauuauauaagauuuugaaaauacuuugacuacuuagguuuuugaaaacuuaugauuaaccaugaaaucuacaaucauuucuuuaaaugccaggugcacacaagagauuucacacuugggggaaaaaagaauuauuuugugauacuacaaaaaaaccccaaaguuugugauauucagaauaacugcauaguuugugaaacauuucuccucauacaauuauagcuaucagacauaauuaaaaaaaaaagaagaaaucagcuguaacuuccaccuuuacuauuagaaaacacaaaagagacauaugaaugccaauaagugaaaaagaagaaaauuuaagaguuuguccaugcuguccccauguuacuguccucuuuggcuacagguagucuacagcuaaaguuagaaaugaauuucaagugaacaaaaauaaauugcucugggagcuaaaauaaugagauuucugggauagauaggaaagaaaaagcuauauuugcauuccagaaauauaaaaaauguauccuaacagauuaaacacauuauccaauaaaauaaaaguucuuuauaguuuucauuuuuaguuauucugaaaagggaaauuuucaacaaucugauuugagaauguuuuuucaagucucugauuugagaauucuuucuucuaaagaagucuguucauucacucaacuaaacugacauauauuuuccauaaccacacuaguaagucaugauuacucagccuuugaggcagauguggugguucccagacaaaaugaacauuaacaacucaguuucuuguccuuuguucauaguuuaaacuauauuaagugauaggaaaccucacaaguucuauucaacauuuuagcuuaaugguuuuuaaauauaaccgauuugaaugaaaaaauauguuuauaugaaaaauucaaauaaaaaaauuuuugauuaaaaguuuuaaaaguuacacauaauucaaacuacuuuuaaaguauauuuucuaaaaacuacaagucucacuacaauguagcaaauaugagucacauuuuuaaccauacuaaacaaagaaacaagaggguaaagacccaaacagcuauaguauuaauugaaaagccuaacuggauaaaaccugccacaggauauaaaauuuauauauuuacugagcagcagguuccaacucuugugggagcauggguuagggauccuggucuauggcugaagguuuucugucucacggcggaugaaguaacggauacuagacuuucauuucuauagcaaacaauuagaaaacuggacaaaauauaugggacaauucuuuuuagacauuguacuacaggcaguacagggcuuugauuacuaagagaagggauaaaaaugaagaaaccauacauugacucuggcuucuugucuguagacacauuccaugccugccaaaaauuccauggucaaaagagcaagagcccaaacaaagcauguugcuccugccgaguugagaaugagauugggguucacgaguucaggauucaagaaggcugaggcagucagaauuuaugaggcaguauaccagaaaagagaaagcuacacagagaaggaacucuagaaaucugcacagggguccccuucagacucuggcacacaaagcugcauugcaugcuaaggugagaccacaaguccaggcaaagaacuacaagaacuacugggaaaagaauaauuacuggggauuuguaaacugaccaauucccagaguucacacaggccugggaaacauuugugaucaaccagcuagaguagagagacucagcauucaacccagaaaggucaugccuggguagguacgaccuuuccuucugguccuaaggugaaagcuacucuagucugacccuaacaggguuuaaaacaagucuuaaaaagaucaagcugauccacagguaacuuaauuguccccuucacccuccccccacaucaauguucuauaguggaagacaaaauccauacaaucaacaauuuaauacuacauaucuagcauucaauuaaaaauuacuagcacucaauauaauauuacuagauaugcgaagcagcaaauuauaacucauaaccaaaagaaauauugcucaauagaaacagacccagauuugaugaaaaguaucaauccacagacuuaagaaacugaacaaauccagucaggaucgacacaaagaaaauaaaacacaugggcugggugcgguggcucacgccuguaaucccagcacuuugggaggccaagguggguggaucaugaggucaggaguucgagacuagccuggccaacauggugaaaccugucucuacuaaaaauacaaaaaauuagccgggcaugguggcaagugccuauaaucccagcuacuggggaggcuggggcaggagaaucgcuugaacccaggaggcagagggugcggugagcugagaucucaacacugcaugccagcacaaaaaagaaaagaaaagaaaacauauaggccgggcaugguggcucacgccuguaaucccagcgcuuugggaggccaagguggguggaucaugaggucaggagauugagaccauccuggcuaacauggugaaaccccaucccuacuaaaaauacaaaaauuagcuggguaugguggugcgcaccuguaaucccagcuacucgggaggcugaggcaggggaauggcuugaauccgggaggcggagauugcagugagccgagauugcgccacugcacuccagccugacgucagagcaagaugccaucucaaaaaaagaaaaaagaaaauagaaaauaaaacauaaucaaacugcuaaaaaucaucacaaucaugucauaaugaaauugcuauaauucaaugacaagaggaaaagucuuaaaaacaauagaguagauaaaaauaaaacaucuacagggaaaaauaggucagacuuuucaucagaaauaaugcaaaccacaggacaucagaauuacuucuuuaaaaugucaaagaaaaaaauaccugugaaucugggagcuagggaaaauauauuucaaaaaaauauauuucaaaacaguacuguggauuuacgacauaugaggaaguaaaauauacaagaaguaaaauguaugacaacuaaagcauaaauuauaaauuaugggaggaggaaaugaagaacacuauuauaagguuguuauauuuuauacaaaaugagaaaacaauacuucauuguucacccuguaaguuaauggagcauauugcaaaccuuaggacaaccacuaauuuuuuuuuucuuuuuuuuuuuugagaaaggguccuacccuguugcccaggcuggagggcaguagugugaucacagcucaguggagucuugacugcccaggcucaugagauucuaccucagccucccgaguagcugggaccacaggcaugcaucacuacaccuagcuauaccacuaaaaauuuuaaaagaaguagaacaaacaagcaaauaaauucaauaccaaaaaaaaaaaaaaaaaaaacaccaaaaaacaaaacaaaacaaaacaaaacaaaaaaauccucaguccaaaagaaggcagagaaaaaagaaaaaggaaugaaaaauuagauaugacaaacaguuugaggguagacuuaaacccaaucauauugauaacuacauuaauugcaaauggaccaaauguauaaauucaggcagacacugucacacuggauuaguacacgcugucuauaagaaacccacuuuaaauauuaagaacccagaaaagaaagaguaaagaaaugggaaaagaaaaaccauuuaaaaaauccauaaaaaagauaaaguagcuaaauugauauuagacaaaguagauuuaaugacaaagaauauuaacagagauucauaggaacaaaugauaaaaggucuaauucucaggaagucagaccaauucuaaauguguauacaaccaauaacagagugugaaaauacauaaagcaaaaacugacagaacacagaaaugaacaaauccccaauuauagcuagaaauuucuuuauuuuauuuuuuuugagacagagucucacucuguugcccaggcuggagugcaauggcacgauccuggcucacugcaaccuucgccucugggguucaagcaauucuccugccucagccucccaaguagcugggguuacaggcacccgccaccacacccagcuaauuuuuguauuuuugguagagaugugguuucaccauguuggucaggcugguuuugaacuccugaccucaggugauccacccaacugggacugcuggcgcaagauaccacaaccaacuaauuuuguuguuguuguuguugagacagggucucucauuccaucacccaaacuggagugcaguggcaagaucuuggcucacugcagccucaaccucuagaguucuggugaucuucccaccucagccuccuggguagcugggacuacagguguacaccaccacgccuggcuaauuuuuuguagaggugggguuuugccuguugcccaggcuggucucuaacucuugggcucaagugaucuacccaccucagucucucaaagugcugggauuacagguguaagccagagugcccagcccagcuaauuuuuuuucauuauuuguagacaggucucccuguguugcuuaaacuccuaggcucaggggauccuccuaccaacaccucccaaagugcuggcauuacaggugugagccggcgcaccuggcccagauaauuuuuuuuuuguuauuuuuagagaugggucccccuauguugcccaggcuagucucaaacuccugggcucaagagauucucccaacaaggccucccaaagugcugggauuacuggugugagccaccacaccuggccccaucuaauuuuucuauuuuuuguagagacagggucugccuauguuguccaggcuggucucaaacucaguucaagggauccuccugccuuggccucccaaaguacugggauuagaggugagccaccaugccuggcacauacauaguugaaaacgucaacaucuauauuucauuaauugauagaacaacuacacugauaauuguauggacacagaagauuugaauaacauagaaaauaccacccagcaagagccaaauauauauuauuuucaaguacacauggaauauuugccaagacagaccaucugcugugcuauaaaaugagugugaacacauuuaaaaggaugugacauguggcaagguaaagaucaauacagggaguacaucuuaaaguggcaaauaggcaaggcaggguggcucaugucuguauucucagcacuuugggaggcugaggcgggacacucacuggagcccaggaguuuugagaccagccuggguaacauggagagacccucucucucaaaacaaaacaaaaaauuagcuggguaugguggugugcaccuguagucccagugaaguggaaggauugcuugagccugggaguucaagguugcugugagcugagaucacgccacugugacagaaugagacccugucuuaaaaaaaaaaaaaaaaaaaaaaaaaguggcaaauaaaggucuguuuuauuuuugguaacucaguauaguuauucuagacgaaguuaaaucaacaagauagcuugguuauuugcaacauauuggacaucuggauuugcuucauuucagaguuccauauaucuagucucaugagcuguauuacauuauauuuuccaaagauugguaauggaauaauuuugccuuguccaggauaaaagauguagugcuuggccaggcaggaguaugucugggugagagcaaacuauacuuagaugaaaggguaagauuucuaguaagagcagauguagguacuugucuguggaaaaagauauuuuaucuuuuaaaaacucuuuuuacauaaguuuaaaaaguuacauuuccaugauuuacauucuuucaugaguuuuagugauuagaaaaguuuuagugauuagaaaaaaaccaaacuaauucuauguaaucaauuuuuacucuagcuuuaagaauaacaauacacuacuaguucuucuaauuaagagaaacuuagaauucaaaaaaaauuguccuagaaggguaaaauuauacaaaaccacaucuaucuaucuaucuaucuaucuaucuaucuaucuaucuaucuaucuaucuaucuccauccuaaucugguagugaagaguuuuaaguaguuuucugauaauaauauaguaucuauguuaagcccagagaaagaaauccuugugccacaaacacuaauuagggucauaguaagaaaggggugaauauauucauacuugaauuugugaaaaaaucauauuaguaaaaugauaaaucaguauguacacugcugcuuaauauuaaguaaaacauuuucuggauuuugaacuuuucaaguuuucuggauuuauacuacagcggcucaugauuuacuauaauuguaccuucuucacacacuuuguagcauuuaaaggacugaaaagguuauacucaugucuauguuucaucaagaaaaacaguauaccauccaaaagaccagagacagaauacuguuggguuuacuuuaggguccugucuuacagagauaucuuuuaaaaacgaaagaccuaaaauguucauauuaauuauuagccuaauucaggcaaguauacuuaucaaccgagaugaagacuacaacaucacauuaagagugcagaauguguguuguguguguaugaguauuuuuaaggaaggcaagcagacaaaacagacagacagacauucuuccacucuagacggcucccucagaacugauaaaacauuccuaaagacuggaguuguuuggacaacaucuguaaugucaauucauagccuaauccaucaucuauacacagaagucaagugagaucccaaaggcaaaauuuccaauuaguuuugucuggaaaguuuagggcaaagguaauaaaaucaagaauccugugcugauucacugggaaaacauuuauuugccauacuucuucacuaaggaacaaaagcagucagugguuagucuggaaugugauucauuaggaauaucugggugauaaauaaacaaaaaaagaugaaaaaugguuguuuguaugacuugcaaaaccuuuguuuucuuucaggggacuucagaaacccuuuugcaaacacaggaauucucuucagaauuuuuuuaaucauuguuuuucucauuagagucagaaaacaagguuauggucuacagcaaauaauucuagaaggcuagaguguaaaauaucgauucccaaugggcacugacaaguuuaaccaguguuuauauucuuuuugugaagaaggucccaaguuaugccucuggucucuacaaaaugcaguacaggcugggaacagugucucaugcuugaaauccuaacacuuugagaggccgaggcagcaggaucacuugagcccaggaguucgagacuagcucggacaacacagugagauuccgucucuacuaagaaaaaauauuagcccagugugguggcauaugccuguagucccagcuacuugggaggcugagaugggaggaccacucgagcccaggaguucaagguugcagugagcuaugaucaugccacugcacuccagccugagcgacagagcaagacccugucucaaaaaaaaaaaaaaccaaaaaccaaaacaaaaaacaaagaaacaaacugucaaaaagcaguaaccggggcaugcauuaauguggauuucaguuuucuaaaucuguugguaaauuacuguugguaacuucuaucucuuccuuuguuuaacaaaaagccuaauaaugcuuguuaccuaggucacaggguagaaauaugagauuauacuauaaaagugcaaauauaaaauugcuggccaaaacaaaagaaauaugaacucuauaguauuaguucaugcuccaaguuauaagguacugucuuugaagcuauuuuuauuauauugaauuaauccauauuaaaaggcauguuuggccaggugugguggcucacgccuguaaucccagcaguuugggaggcugaggcgggcagaucacuugaggucaggaguucgagaccagccuggccaacauugugaaacuccugucucuacuaaaaauacaaaaaauuagccgggugugguggcgcaugcuuguagucccaacuauucgggagggugaggcaggagaaucgcuugaacgugggagauggaguuugccgugagccaagaucgcgccauugcacuccagccugggagacagagugagucuccgucuaaaaaaaaaagaaaaagaaaaagaaaaagaaggcauguuucaccuuuguucucuagacccaagcaacuuuugaucauacaguugacuuaaguauucaagagaaaugaacuacauauuuaugagagcuguuaaaaaagggcggggggggcuaguauaaauuguuuaaaauguaugcucaacaacaaauuuaagcuaaacuaaauuuucuuggcuuucauuuaagcauacauuaauaaacuuaagggcaggaaguuacccagucugugcauaccccuuuuccuuggcaaaaacccagccugauguccugaagaccuugguuucuucuuuugauguggugaugcucagcagaguuaauauaugagucauuccuuagggaaagacagggagaagagcuuucaugccuucaucaaacaaaaggcaaauagauuuuuuucuaagaagggucuguuggucuuccugaaacagcacugagucacugcaugcuuauagccauaguuauaagcaucugguaucaagucacaccacagccuuaacuuuugguaauuucuuuuuugucuuaaaaggaggauagacaaaugagcaauaaagcaauagucagaagucaagcugaauugauagggaagaagcuggcuaacaauuuuuuaaaaaaagaaugauuccacuuuaugguauuaacuacuacaauauuucacuuacugaaacuauuucacuauuuuauuucaacccauaugaaugcaguuuuccaaauaauauuuacuuuuagcaauagccaagagucaaaaaguaucagaaaugucuauacuaaggaaaaaacagcuuuuaaaaagugcagaauacuauacaguacuuccuccuuagggugccauauacagaggaggucauaaauaugaaaaagcaauuaagaugucagauuuuuuaaauguauaauuuuuuuuguuuucuuuuuagucaucaauugaccuguacuucaggguaaauguacaauuuuuaacacauauuuuaauaaugaaauaaucccaaacuuuaaagcagaaacaggcucugaaucuuacacaggggcacguaucucacaauuuucuuuguaucuaauuuauaacaaaaaguacuuuuuuucuauaaaaauggucauaugaaacaaaauggcucacagauaucauucaaaggauaacaccuugauguuacagcuucuaauaaaaccugaucuauucuacaauguaacugaauaguucccaacuuuucuacuuccaaacugcuucuagaaaguaaaacuaacacuuuaaacaugagaaaauccaaugguuaaaauauauggcaaacagaaaaauuguaaaauauauucagccuucuacuuauagcuaaauauuuggguauguuuuuaaauuauaaaaugauugucgaucguuuuucuucucuuuacaguucuuugucuagaagcugggcuuaacugaaagggauauggggcuuugugaagucuuuugccaggaaacugcuccaccuagugucaaaaauuguacauacaucacauuauauaggagaguaaauuguagcccauggacuccuuugcuauuaagaacaggcuuuauaaauccuuaauguuacauacaguuuacaaaugguucuuuaaucaucuuuuugucuuguaacuugaugaaucauaauguacaugcauauaaggagcauguccagaauacauuucucauaaucaaguaccaaaguuccuguuuuuguuaaccugguuaauuacagaauuaugaaucauauuucuauuagugggaaauaauuacaagguggcuaaugaaauaaccccaucacuucuccuaauuguguacaacaucuaaacuuuuuuuuuuuucuugagacagggucucauucugucgcccaggcuagagugcaguggcgcgaucauaaccucccugggcucaagugauuuuccaaccuuggccucaaccuccaccugaguagcugggacuacaggagcaugccacuacaccuggcuaauuaaaaaauuuuuuucguagagacggggucccacuagguugcccaggcugguauggucuugaacucccggccucaagugauccuccugccuuggccucccaaagugcugggaauacaggugcgagccacugcaccuggccuaagcuuuuuagaaauaaauuuuauugugcauaauugaggcuuacaauauguuguuauaguauacauacagauaacaaaaugguuauacuauaguaaagcaaauuaacauguuuaucaucuuacauaguuacuuuuuaaaaauaagaacagcuaaaaaucuacuuaacaaaaaucccuaauccauuguaauuuuacaacagugguaccuuagaucuuuagaccuguucauccuacacaugacaucuaaacuuaauccauaaguuauuuauuccucaaaaugguugcaaucuuguaaaaucugguauuuaagaggaauugaacauaccagugguuacaugaaacuggaaccaaaucuuccugucaucagacagcucauuuagaagaaauucuucugcuuuucccuucaaaaaagcuuuuucuuuuuacucuuaauuuuuuuuauacaacucauauaugcacaacuauauucuuuucuaaagcaucaugugaaaccuguuauuucuugaucaagaagagagaaaugauaguacuuauuuggcaaaugggugaaccaaauacacagaugucauacaaaaauccuuagaagacagcuagcucucucauuaaggcucccaggcucacuaugucucuuccgguguacuacugucauucaaugaguuggagcagggguuaacaaacuacaaacugcagaccaaauccagccugcuaccuguuuuuaugaauaaaguuuuaccagaaaacggccgcauucacucauuuauguacugucuauaauugcuuucucguuacagugacagaucugaguaguugcacagagacuggauagcccacgauguguaaauagcuacggaucugauccuuuacagaaaaagugaggccggauacaguggcucaugccuguaaucccggcacuuuaggaggcugaggcgagaggaucucuugaaccgaggaguuugagaccagccugggcaacauggagagaccccguuucuaccccuaaaaaaaacccagcugguguaguggugcacaccuguagucccagcuaccugggaggcugaggugggaagaucucuugagcccaggaggcugaggcuacagcgggccauauucaugccacuguacuccagccuggcaacagagagaaacccugucucaaaaaagaaacgaagauaaaagaaaaugaaaaagagaagguaugcucuguagcccuagguuagacuuuuuuuuuuuuuuuuuuuuuuuugagacggaguuuugcucuuguugcccaggcuggagugcaauggcgcaaucucggcucacugcaaccucugccucccccguucaaacaauuaucucaccucagccucccaaguagcugggauuacaggcgccccccccaccacgcccagcuaauuuuuguauuuuuagcagagacaggguuucaccauguuggccaggcuggucucaaacuccugaccucaggugauccacccaccgcagccucccaaagugcugggaucacaggcaugagccaccgagcccggucuagaccauuauuaagauagaaauuuugacucacaaaaacuggcugcauagagaugaaccaaagaggucaacagcagcuauguucucuuuaugcaaacauugacuuacuauucuuacucuggauauaauuuccgcuacaugagagaauaaauaagcauuccugaucgcucauguacuggaucuucuaaaagguaaccugaaugcuugcuaagacuaaaauaaaucugucaauggauuuuggggaauuaauaugcaauaaaagagugcuuaaaaggugcuaccuggccgaucacgaggucaggagaucaagaccauccuggcuaacacggugaaacccugucucuacugaaaauacaaaaaauuagccaggcaugguggugggcgccuguagucccagcuacucgggaggcugaggcaggggaauggcgugaacccaggaggcgggguuugcagugagcuaagauugcaccacuguacuccagccugggugacagagcuagacucugucuccaaaaaaaaaaaaaaaaaaaaaaaggugcuaucuuggaaaaaucugccagccccagaagcuucuuugcaccuaaucuacauacaaacucaaauaagguaaaugaaugaaauuuguaacuugcacuacuugcuaggcaaaauuuguucaagguagauaucaaaugaaugaacaaaaauaugccugcauaagaacuaaaaacagaggaaaugcaguuuacaaaugcuauuaauuucuaauuuauuuaauauucuuuauuucaaaguacaauauaccucacuauaaagauaaaccagagacaagcauauuagcauauguugaauaaaauuauuuuaaaaaucacucauugugggcugggcgugguggcucaugccuguaaucccagcacuuugggaggccgagguggguggaucaccugaggucaggaggucgaggccagccuggccaacauggugaaaccccauuucuacuaaaaauacaaaaauuagccggguguggugguggacaccuauaaucucagcuacuugggagugugaggcaggagaaucaccugaacccaggaggcagagguugcagugagccgaguucgcaccacugcacuacagccugggcaacaagagcaaaacucuaucucaaaaaaaaaaaaaaaauuauucauugugccuauuuuuugucuaaauuuaaguaaauugaaugcaaagagcauaauaaaauguuuacacagcaagaaguacaugcacuuauuugcuggagaaauaaaacgauuuacuaauauuuaauauaaaacuguuaugcaaauuaagaaaaagcuauauauagauuaggucauuuuucaucaacugucacaaauaagacucagauguuaggaacagacuguuuugccaauaaaagaagucgaauuauuuuaucucucauaggcuuugcaaagauucuauuuuacauuaauauauucaacauauauuuguugagcaccuauugaguacuaggcucuguucuagacaguuggaauacaacaguaaguuaaguagagaucauguaaaaccuaggaugauuuuacuuuccuccagacuaguuugcuucuaguggguagacgggcugggccacucacaguucuaagaagauaauaagauuauuuuaacuugaggcagggcaugguagcucaugccuguaaucgcagcacuuugggaggcugaggggggcugaucacuugaggucagaauucgagaccagccuggccaacauggugaaaccccgucucuacuaaaacuacaaaaacuagccaggugugguggugcaugccuguaaucccaccuacuugggaggcugagacaugagaaucacuugaacccacgagguggagauugcagugagcugagaucacaccacugcacuccaguuugggugacagagcaagacucugucucaaaaaaaaaaaaaagauuauuuaaacuugagcuucaguaccggugaaaguugauuuauaucuaguucaucacaucuuuuaaaguguggcccuuuagaguucaaauucaaagccugcagguuuaucagggccuauccuuggccagucucucuucuuuggguuuucuguauaacuuagaucuuggucuuauaauucuuuuacucucuuuaaacauauauacaaauacucauauauacauauacucaccuuuaaacauauauuuaaaaauuuauuggcugggcaugguggcucacgcccguaaucccagcacuuugggaggcugagguaggcggaucgcgaggucaggaguucaaggccagcaugacuaacacagugaaaccccgucucuaauaaaaauacaaaaaaaaaaaaaaauagccaggcguaguagcgggcaccuguaauuccagcuacuggggaggcugaggcaggagaaacacuggaacccaggaagcagagguugcagugagccgagaucgcaccacugcacuccagccugggauccagcacugcacuccagugcugggaucacaggcaugaggcagccugugacagccacucaagacagagugagacucugucucaaaaaaaaaaaauaaauaauaauaauaauaaauuuauccacucuuuuaagaaacuuuuaugggagaguugguccaaauugccuagucaucauuguuggaaaugaaaugaucagugguuuucaauuauucuauaacacuguacugaaaucaauugugggaaauguuccuaauuuguuaagaccagcuaaagcauauaaauugaaaauuauuacauuucaaaaauaaaucagaguaagcguagugauauugcuaauuauaauagcagcaaucauuuauugaauaccuugcauuuacuagguacugagcugaaaacuguacaaguaauuucauuaauccucaaaacagucuuaugagauggguacuauuauuaucacucccauuuacaguugaaugacugagguuuaaaaguuaagaaauuugccaaauaucacacagcuaguaauauuguacuagacauucaaaccuagcuguuuuacucugaagaggcccuauuuccuaucauaggaaugaaggauuuaaugaaagauuuuauucuuuuaacaaaaucgguuucaaucacuugcauauuccugaauauuaaagaaaagauuggacuuaaaguuaguauguuugguauuacaccugacacugggcauaccauaggaguuauguccuccauguaaauauguguaucaaaacgaaaggaaagguuuuuuuuuuuuuuuuuuuuuugagacggagucucgcucuauugcccaggcuggagugcagcggcaugaucuuggcucacuguaagcuccgccuccuggguucacgccauucuccugccucagccugccgaguagcugggacuacaggcgcccgccaccacaccuggcuaauuuuuuguauuuuuaguagagacgggguuucacuguguuagccaggauggucucgaucuucugaccucgugauccgcccgucuuggccucccaaagugcugggauuacaggcgugagccaccgcgccuggcuggaaaggcuuuuuuuuuuaagagacaggguuucgcucuguaacacaggcuggagugcagugggacaaucauagcucacugcagccuuaaacuccugggcucaaguagucuuccuaccucaacuuccugaguagcuaggacgauagguguucacccccacacccagcuaauuaaaauaauuuuuuuuuuaaagaaauggggucuuggccaggcacuguggcucaugucuguaauccuagcacuuugggaggccaaagcggguggaucacuugagguuaggaguucaagaccugccuggccaacauggugaaaccccaucucuacuaaaaauacaaaaauuagcugggcgguaguggcacgcgacuguaaucccagcuaccugcuaagcugaggcaggagaaucacuugagccugggaggcagaaguuguggcgagccgagauugugccacuguacuccagccugggcaacagagugagauuccaucucaaaaaaaaaaaaaagaaagaaagaaagaaagaaaaaaacccggggucuugcuuuguugcccaggcuggucuuaaacuccuggccucaagugaucccccugccucccucucccaaugugcugggauuacaggcauaagcuggccagaaagguagacuauuaacugcugaacuaauuaaugaacgaaugcgagaaacuauuaagaaaugcucuuuuuacuuacaugcguagacugguuuuagguaggcaugaauacaaguaaauaacagaauaugucuccuggcuuaguagagccauuugauggcuugguuuuugggugaaguugcucuacacacauauauuuauccagacuagaaacugcaaauacaacaguauauuggcuguauuagcaaugccaccuaguggcagccaaauauagauauauuuugaaaaaaguuguagaagaaugguucuuaacauuucacagucuuuggagaaccugaugaauacuacagguucuuucuugcuagaaaaaaagcuuauuugcaaugauacauaacaaguacagugcuuucagaaauuaacaggccuccugaaacccaccuuuuaacuauuaaaauuaauagaacaaagcaaguaaccuaguagcccaaccaacucuccguaagccaucagcagaaaaaauuuauuuauuuccccuucaucuccuccuuucugguuagcaaccacuauucuugcauaaacaguaucuuaacuugucccucugggcuagguacuuggucucugcaaauuacuugauuuacacuuuacucaaaucgauuuacaaaacuugaugguuaguaauuuuucccugaugauuuucauuaaauuuaaugaucaaauaaacaguaacuuuuauuuguaacauuuaaagaagugaugaggacuucuaagauaucuuaauuucaaguuauaaccuuucaguuauaucuaaaaauauugccgggcauguuggcucacgccuguaaucccaguacuuugggaggcugaggcggguggaucaccugaggccaggaguucaagaccagccuggccaacauggcaaaauccugucucuacuaaaaauacaaaaauuagcuggguguggcggugcacaccuauaauuuccagcuacuugggaagcugaggcacuagaauugcuugaacccgggaggcggugguugcagugagcugagaucacagcacugcacuccagccugggugucagagagagaugcuaucucaauaaauaaauaaauaaaaauauaaaugaaacuguuuacggauaaauuuaagacaaauucuccauuuuaaagccaaacacguagguaucuaauauuuuaggaaauuuaguaagucuuuuaggugacuaguauacaaccaauuauaacuuacuaaaugauacuuccaaaaaagauaccuuccacacucuaggaaucauucauucuaaacacaaauuucaaaaaccuaauugggaaauuuugccuaugcagaaaaaaaauucauauuucacuuuuaagcuacgauuuccaguaaagagagccauaauaaauaaugaauuacauuuuuuucuguuaaaauuaguuucuuuuucaccacaaacuguuaucaaaaggaggcccauauuuuucaccagacuacucucccaauaugaucauuuauucucuuuguugaggguuaguuauauggguauauugcagaggugccuguuucaucagcacauaauagaacaugagaaugucacauuucccuaagugaggauuauguuaagccuggaaaaugaaaguaaguguaauuaggauauccuaaacacaacugcauuuccuacauauaaaagaaaagaaauggugaccaauaaggauaaaauucuguugaucacuaaucagcaagaaaauggcauaagcuuaaaaaaaccagagauuauuugaaauuguuucuauuaaguaaaaacccagaucagauuuugaaaccuuugacucugcuuugcuucugguuucuuauuuuacucuuuucuauaauugccaaaguucacaaguaaauaguuuacgcuuauuaauuaaaauuuuuacacuugucacacuauugguuauugacuagcuuggcucuugggaggccuaagugagauaauucauuuaaagugaugcucacagagacuaccaccuaguaaacauucaauaaauguuagcugccuaucagucaggauagguuagauuaugacguaauaacaaacaacacaaagaucucaagcaacaucuaucacuuaugcucacauuucauuggucaaagcaaauaauauggcuggaguucaguaagguagggaugcaaaaucuucccauaggaauggguaccacaaaauggccaccaaacaugaauaaaaauaaaagaacugaccagcuaguauuagcaugaguaugacaaugauguuugccuuuuuuguuguuaguagugcuuaaccucuugcaaacugauuuccaccccaaccagucaauuaaaaaauaaagacuagugauaucuuuuguuuuccuuuugcuuuucugcaaauuauauuuuauaaaugcucuuucuucuucauucuuucuguuaaacccaggggauccuaaauggaagucaggaucaaaaaggucuaagaacuaaaggucauuuggucaaauggaaauggcauauacuagaucucucuuuauauuucuuuuauauuuaacagauuucuccccaagcuucuaaauauucaauuucuuuccuuccuuccuuuucuucuuucuuucaucucucucuuuccuucugucucucucuuuuuuuuuuuuuucugguagagauggggucucauuauguugcccuggcaggucuugaacuccuggucucaagcagggauccuuccuuggccucucaaagugcugagacuacaggcaucagccaccaugccuggacuuuauuucuuuuuuaaauauugacuuuuuuuuuuuuuuuuuuuuugagauggaauuucgcucuuguugcccaggccggggugcagugguggaaucucggcucacugcaaccuccaccuccuggguucaacugauucuccugccucagccuccugaguagcugggauuacaggugccugucaacacgccuggcuaauuucuuguguuuuuaguagagacgggguuucaucauguuggccaggcuggucucaaauuccugaccucaggugauccacccgccucggccucccaaagugcagagauuacaggcaugagccaccgcgccuggucaaauauuggcuuucuagucacuaucaucuaaaacaguggguuuugggggacaaaauccaacagauucaugauuuaaaaaaaaaaaacaaaaaccucagcaaauuuggcacagagggguacuuccucaaccugguaaauaauaucuacaaaaaccuacagcuaacaucauacuuaagggugagaaacuagaggccuucccauuaagguugggaacaaggcaggauggccccuucaugacuccucuucaacauuauuuugaaaaccuaaccaaugcaauaagacaagaaaggaaauaacagguauacagauugggaaaguagaaaaacugucuuuguucacagaugacauaauuaucuauguagaaaaucauaaggaaucaucaaaaaagucuuggagcuauuaagcaauuacagcaauguugcaggauauaagguuaguaaacaaccuuaaaaaagccaaguuuuuucuauauauuaguaauuaauacucauguucuaucaauagaguauauauuauacucaggaucuaucagaaaauauauguauuuauaaauauagcauauauauagcauauauauaauauagcauauauauauauagagagagagagagagagagagcaguuuuuuaaaaauaauugccaaacaggaacaaacaagauauccuucaguaagugaauggauacacaaacgggugguacauccauacagaggaauauuauuaaauagugaugaaaagaaaugagguaucacaccagaaaaagacaaggaaaaaccuuaaauguauauugcaaagugaaagaggucggucagaaaaggaucauacccuauaauuccaacuauagugucuucuggaaaaggcaaaacuauagaaacaguaaaaagaucagugguugugaaagguuugggggcagguggggaaguggaaaaaacaggugaagcacagggcauuuuuaagacagugaaacuauucuguaugauacuauagguauauacaugacauuaugcauuugucaaaacccauagaccuguauaacacagaguagaucccauaaacuauggguuuuaguuaauaauguaucaauauugguuccucaauuguaacaaauaaauuacacuaauacaauauguuaauaguagaggaaacugugugguggggaaagguguuauggcagugguccccaaccuuuugggcaccaggaaccaguuucguggaagacaaguuuuccacagaccugaggugggggaugguuuugggaugaaacuguuccaccucagauuaucaggcauuagauuuucauaaagagcaugcaagcuagaucccucguaugugcaguucacaauaagguucgagcuccuaugagaaucugaugcugcugcugaucuaacaggagguagagcucaggcaguaauucgagugauggggagcggcugcaaauacagaugaagcuucacuugcuugccagcccacugcucaccuacugcuguguggccugguuccuaacaggccagggaccaguacuggucuguggccuggggauuagggaccccugguguauuagaauccucugucuuuucugcucaauuuuucuguaaaccuaaaacuacacugaacaauaaagccuauuauuauuauuauuauuauuauuauuauuauuguuuuugagacaggguuuugcucuguuucccagguuaaagugcaguggugcaaucacaguucacugugaccuugagcuucugggcucaagcaauccucccuccuuagccucccaaggagcuaggaccacaggcacaugccaccacacccagcuaauuuauuuaucuuuuauuuauuuauguguuuuucagaaacggggucuugcuaggucugcucuugaaccuguggucucaagcgauccuccugccuuggccucccaaagcacugggagcacaggaaugagccacugugcccagcucuaauaauuuuuuguuuuguuuuguuuuguaggcguucucaguccuuuauaaauuucccuucucuuuccauucaacuacgggcaccagcaaccuaccuggauaaagugaggaucucauuuaacuugcagcauaauuacaguauaccuuuaaauuucucuuuucacauacuuucacauaauauguaauaaaugugaacaagugaacaaauaacuguuuucuauacaguuaauggcaucaaaaucuacccagucacucaguaaaaaaccaguaacuacacagaaaaauguugcaagaucucauuuauagagauagagaugggaggagauguagaucaaaggauacaaaguagcaaauauacaggcagaacaagucaaaagauccaauguacucuacauacacuaugaggacuauaguuaauaacaauguguuguauucagaguuuuugcuaaacuaguaaauuauagcuguucuugccaugaggaguaaaaacguaaaaauggguaacuacaugagauaaagaauauguuaauuuuuuccacaauaguaaccauuuuacuauauauauuuauaucuuauaacaucauguuauauaccuuaaauacacauaaaauauauuaaaacaaaacaaaaggaaauccaagaguuaucuuucauuccuucuuccuccauaauaacguaccacacucuugauuguacuucuaaaauuucugucauauuuguccuuuuucaucccaaaugcuauuuccauuccaagcaaucuuuuaaaacaucaaagaucuauaccaucuuuugucuucauuuugcuugacuucucucuacaaguucucuuuauaaauacuccuugcuauccauucuuccuaucaccuccugggaagcuugugucucucauaaggauaauccuaacugcuccucuucucuuccaccuucaaucuaucucccacacuauagccaggauuauauauucauaaauugcagaucuggcuguuuuauauauacuuaauuuuagggcauuuaaaauaauuuuuuuuuugagacaaggucucacuuugucacccagguuggagugcauggugcaaucauagcucacugcagccccuaucuccugggcucaagccauccucucgcuucagccuccugaauagcugagacuaacaguccugugccaccacacccgacuaauuuuuguauuuuuuauagagauguagagauguguugcccaggcuggacuugaacuccuaggcucaagugaucagcccgccuuggcuucucaaaaugcuggaauuacaggcaugagccauaauuucaaucucuuuugacauucagcagagucugcuaucuggguugcuuuucagaggcuuccaaauuaauuaaaugcuacaaaugaguuucuuaaucugguuuucccaaggaauaugaggacaggucuagacacgaacagaaaaguauccuguaaccuguaauuccuucuuuuccucucucccucaaccucuacuagugaauguaguguuauucuacuacgaaugcaguuauuagaaaaacagugauaugaguuaauucccuaggauuuaugucccuguuugaguuaaaucaccaagcaaacaugaacauaauucuaaaguuccaaguuuuaaacucccauaaacuuggagaaaugauauauuauagauuaauucccaaagcauucgucagaucauuaauccaguacccuucugagccaagcagacaaucauuccuuaauacuuauccuagcugcuucagagaugaauucauuauagcacagagauugcaagugcuuguagugaugaauuuuauucagcaauggguacugcuugacaaucuuucaccuguuuuuccccaaugaagaucaaacugcuuucaaauauggaaguguuuucaauuuauuaucuagggacaggaacagcaagaacaagcaaggcacauggggcacaaaauuuaaugaggcacuuauucauccauucuguaucugcaugacccugagagugccuauuuauauuuugugcccucaguaucuaacucaaccucucccuaguucuagcucugacauuauuccaguauauuugugaauguucaaaggaaaauugaucuucauucucucuuauuucuuuuucuuuuucuuuuuuuuuuuuugagacggagucuugcucugucgcccagguuggagugcaguggcgugaucucggcucacugcaagcuccaccucccagguucacaucacucuccugccucagccucccgaguagcugggacuacaggcgccugccacuaagcucggcugauuuuuuuuguauauuuaguagagacgggguuucaccauguuagccaggauggucucgaucuccugaccuugugauccgccugccucggccucccaaagugcugggauuacaggugugagccacugcaccuggccauucucucuuauuuccacuaguaaaagaauauuuuucagaaggggcacuuuuuuuuuuuuuuuuuuuuuugagacagagucuugcucugucgcccaggcuggagugcaguggcgccaucuccacucacuggaagcuccgccucccggguucaggccauucuccugccucagcauccugaguaugugggacuacaggcacccgccaccacguccggcuaauuuuuuguauuuuuaguagagacaggguuucaccauguuagccaggauggucucgaucuccagaccucaugaucugcccgccuuggccucccaaagugcugggauuacaggcgugagccaccacgcccagcccagaaggggcacuuuuuauacuuugguucaaaggacucaagaaagcauuuaguucuacauguuaauacuccaucaauuacauucaacaagaauaccaaaauaaauauccaaguauguaaaugauguuagaggauguaagggaagacauuucucacauggaauuuugcauauuuaaauggacuucauuuauuaaaauaacaauugcuuaagcaauuaaaucuagaaagaaaagaaaaaccuuccacgcuaaacuaauuuaaauaaacaaccuuauuugcuuaacugggguuuucucuuugcuuuuuaaauacuaacccuaaaggaaaaacaaaacagaacucuaagucaaacuuaaagcacugauuggaggaucagaaugcuuacaaaacacaaagguaauuaaaacaaaucuuagaauuuuuacuucugacauaaaagcaccaauaaaaagauaggaaauaucauuuuugcuuauuaaaauaaaauuauucuuaccagauaaagcagaaaggugugcagcccuguuccaagcccaacagaagacaaaauuccuaagccuauccaguaggcauacaaaagaaacuguuucucuauacguugcacauacugaaaaaaagggaugaggugaaaaccgugaauucucuauacagaaaugcgguauuuauaaaccaucaucaaaauuaaaucaacuaaaguaaguuucaaauaggaaaaaacuaauaagauuaaaaacccauugaagaggccuaauuucuuuaauacacaauggcaaagaugacaaaaaaauuaaucuaacuggaauaaaggucuuauuucuaaaccuuuaauaaaagccuuguuucuaaacuuuuaaaguccuacuauuuacaggacacaggaaaaagcaaauuaugaauaagauaauuuugaggauaauuuuagauauauuuaaaauaaaugcauuuagaacuguaaaaacuucucugugauuagcaguaaacuguuuuaaaauaccauucuagagucauuucagugauuggcaguaaacuguuuuaaaauaccauucuagagucauuucugugauuggcaguaaacugcuuuaaaauaccauucuagaaccauuuccuguuaaaauacauuaauguuuugcuauuuuaacaaaagagguuaacaaagcauccuauuuucccaucaguaauguuguacauguagacuacaggcaaaugaaccugucuuuuuauacaaauaaaacguaaucaucaaccuuggaugagaggccuaccuauuuggaugggucacaaaaguauguuagagaaaauaagaaaacuuuggcagugauuaacggauucaugcugcugugacggaaaaccuucaggaaaguuacauuuaaaucuuugauuacaggcagaguggccuguaaucccagcauuuuuggaggccaaggcagccagaucaccugaggucaggaguuugagaccagccuggccaacauggcaaaaccccaucucuacaaaaauacaaaaaaaauuagcugggugugguggcaggugccuguaaucccagcuacuugggaggcuacagcaggagaauugcuugaacccaggaggcagagguugcagugagcucagaucacaccacugcgcuccaaccugggugacagagcgagacucugucuuuaaaaaaaaaaaaaucuuugaagguaaaaggaaucacacacaccacauauaaauccucagcagccauaaaacaucacaagaauauuuuuaguguaugccuuuaaaaguaaaacauuugagauacuaguuaugagauaauguugaggguagaaauucuauaaaacccacauucaucccauuugaaacugagauuagagaauuagagaaugugcaagacuagaaacagaauugcucgaccucucaccuguugaugcacuccuucaacauaauacguagcuauaagcacagcaagcagcaguaaaaaagacaccacaaugcuuugacgaugccauaaucuuaaaaacaaauaaaaaaaauaaauaucucacagucucacuuucagcauucaucauucucagaacaauuucuugcugaaacaguuagguuaccuagcucagcugggcugagcucuuuuccuuacacaucauggccucuuggaguaacagaagggggucaagggaagauacauaggcagagaacccaaguucuuaucauaacccccacuguagccuuuuccuuacccaaagccugaucuuauuaaaccucaacuuauaauauggagaagcauuauaguauaauagaaagagcacuggccuucaagucagaggaccugggucagagacccuucauguugcacuuucagccagacacuuaaccaaccugauucuguuucuuguuuuuauaaucuuuauuuacuuauuuuuauuuuuuuuugagauggagucuuacucuguugcuggagugcaguggugcgaccucagcucacugcaagcuccaccucccggguucaagcuauucuccugccucagccucccaaguugcuaggacuauaggugugugccaccaugcccggcuaauuuuuguauuuuuaguagagacgggguuucacuauguuggccgggcuggucuugaacuccugucuuagugaucugccugccucggccccucaaagugcugggauuacagccgugagccaccaugcccgggcuuuguuucuuuuuuucagagacagggucuugcucugucacccaggcuggagugcaguggcaugaucuuggcucacugcaacuuccaccuccuggguucaagcuauucuccugccucagccucccaaguugcuaggacuacaggcgcacgccaccaugcccggcuaauuuuuguauuuuuaguagagaugggguuucaccauguuggccaggguggucucgaauuccugaccucaggugauccacccaccucagccucccaaauggccuaaaauuccaccuccuggguucaagugauuuuccugaguagcugggauuacaggcaugcacuaccacgaccggcuaauuuuuuuuuuuuuugagacagaguaucguucuguugcccaggcuggagugcaguggcaugaucucgguucacugcaaccucugccucccacguucaagcgauucuccugccucagccuccugaguagcugggacuacaggcacaugccaccacgcccggcuaauuuuuauauuuuuaguagagacgggguuucaccauguuggccaggucucgaauuccugaccucagaugauccacccaccucccaaagugcugggauuauaggugugagccaccacgccuggccuaaaauguuuauaauaauguacuuguuuuaccuucuuuauggaguugcccuaaggaucaaaaucagcugaaaauguuacaaaauacuuuauaaacucuuaguacaauaaaaauguuaagauaauaguacagagaauaacuuggaagggcaugccagaagauaaggcauguaaaaguucaacuuguucuuuaugguacuugaaacagggcuuacaaguacuaaauuuaaagacaacacauuuccauggcagaguucuuuuucauuggcucaaacuaucaguaaaacugccacauaugcugaaccuugcccugcuaaagaaucaguguaucuaaauuacacagaccugauuucucccaaugguaaaaucaggagagaaaauaaaaaucguauuuuucaguguucuccacugcagauucaacaugaaaaaacaguggacaacugugauaauccaguaagcaaacagcaaauagcaaugucuuucccuaaucuauuuuucuucaaccuaaagaaaggagaauaaauauguuccuaugguaauauucuaaagguaauuaauccauuuugauggaguagagggcagaaaguaagagauuacugaggauuuuuuaaaugaguaaaugagguguauguaaaagguagugggagaagacucuuuacuuugagguccauuccuucaagauuacaaggauuuccagagaaaaauacugcaagguaaugagcggcugucuccacaggacaauauucugccuuucuucccgcucccuccucuucuuuucauucacugaagaggggucugaaaaacaauagugcagagauuaaaacagaauuucuaacauuuaugcuuauucucuucaaucacuuuagaugaaaagaguuuuaucucccaaauaacaacuaauagcaaguccuagagucuugugaaaaauggcaacuaguaguaccuauaaucucagcacuuugggaggcugaggagggcagaucacuugaggucaguaguucaagaccagccuggccaacaugguggaacuccgucucuacuaauaauacaaaaauuagcugggcauggugguacacgccuguaaucccagcuacucgggaggcugaagcacaagaaucccuugaaccugggaggcagagguugcagugaacugagauugugccacugaagaccagccuggauaacagaaugaaagagacucugucucaaaaaaaaaaaaaaaaaaaaaaaggcaaccagucccaacucagcauagaaagaagaugaaugacaguaguucccccuuaucuacaguuucaguaacacauggucaacuauggucugaaaauaauaaauggaaaauucugaaaauaagcaauucauaaguuuuauuguuuuaaauuuauuuuuauuuuuuuaagagacagggucuccauuccguugcccaagcuggaaugcaguggcauaaucacagcucacuuuaaacuccaacucuuggggucaagugauccucccaccucagccucccaagcagcuaggacuacagguguguaccaccgcacccaacuaauauuuuugguuuuuguggagacacagucucacuacguugccugggcucaucugaaacuccugaccucaagugaucagcucgccuuggccucccaaagugcuggaauuacaggugugagcuacugcagccaagccccuaaguuuuauauuguaugcuguucugaguaguauaauaaaaucuugccaguccugcuccauccagccuaagaccugauucaucccuuuguuuaguacauccgcguuguauauguuaccccauuacuauauacagaacaacacaguguuuuuuccuauauccacuaggggucauggaauguaucccucauggauaagggggcuacuauauuauaguugccauuucuuaaucaguguuaccuagagaacaacugaggcaaaaccaacucccugccuugauaaacaucagaaucuuuuguagaggauguccuaaagaaaugguacugaaaauuccagcaguugaauuugggauagagcuauagauuuugggaaaauuacugaaauaagucuaaauugguccaccuucuaugaagggcauucuaucaaccuaggaucauauuacagaacaaagugguuuagaucgcaaaaauggugaggcaaacuaguugguuccaauccuggcucugccuucuauuagucacgugaucuugggcaaguuaguuaauacuuuugugacucaguuuucucuucuguaaaauggggaucacaauaguacauacuuuucagggucauuuuaaggauuaaaugagcucauauauguaaaguucucagaagaguuuaacacuuaguaagugcccaauuaaguuuagcuauuaauugucaccaucuauugaaauuacaaaaugcuuuuguuuuuguuuuuuuugagacagggucucauucuguugcccaggcuggggugcagugguagcaugauuuuggcucacugcaaccuccaccucccugguuaaagcgguucuccugccugagcuucccgaguagcugggaucacaggcaucugccaccacgcccggcuaguuuuuuuuuguauuuuuaguagagaugagguuucaucauguuggccaggcugguuucaaacuccugaccucaagugauccacgcaccuccgccucccaaagugcugggauuacagaugugagccaccacgcccagcacaaaaugcauauacacuguaaaccgguaauuccauuucuaggaaugauuagguauaaggugaaaugacuugcacaacuuuauugaccacagcauuauuuguacuagcaaaaaauaaucaauaacuuauauauuaccaauagaggacagaagagugauuaaaguacagcacacucguacaauggaaagaaaaacuaagcagccauaauaaagaauaaauuuuuuuuuuugggggacagggucuugcucugucacccaggcuggagugcaguggugugaucgcagcucacugcagccuugugggcuaaaucgauacucucaccucagucuuuccaguagcuagcuagaacuugaguagcuagcuagaacuacaggcgcauacgaucacauccagcaaauuuuuaaaaucuuuugcagagaugagguuucccuguguuguccuggcuggucucaaacuccugggcucaagagauccuuccgccuuggccucccaaaguguugggauuacaggcgugaaucaccacgcccagccuaagaaucaguuuuucauguacaguuauagcauaaucucuaaaauauuaaaaaacaccugguacagaagaguaaguuugacaugcuaauguuaauuuuaaauuccaauggggugagcagaagaggaagaauauacaaauguaugugcucucuaaaaggaaagaaaaaaauagcacacaaaagcuccuaaugggaagacacuaugauguaugcaaugcccaucucugaauccugaaacucuuggugaaauugccaaguuuacugacaaccaaaguaacccaaaagucagaucagugcugcaaaauguccucugcaaggcaauauggugauuaacaaacaaaugaggccgggcgcgguggcucaugccuguaaucccagcacuuugggaggccaagguggguggaucacccgaggucaggaguucaagaccacccuggccaacauggugaaaucccaucucuacuaaaaauacaaaaauuggcugggcgugguggcgcaugccuuuaauuccagcuacucgggaggcugaggcagaauugcuugaaccugggaggcggagguugcagugagccaagaucgcaccauugcacuccagccuggugacagagugagauuccgucucaaaaagcaaacaaacaaacaaacaaaugaaaacuacuauuucagauuccuugcacuuccucuaaaaguagaggauugcugugaaaauauuaccacacuagaguauuauuugccauguguuugagaugucaaacaauucaaaagcuaaaaaaaaaguaugauuacaacaaaaguaaaacuuuuuuuucauuuuccuuuaaaugcaugaaggaaaguuucuacuuaaaucauccauauuaauaaaagucaucauuuucaggguaacuguauaaacaggagucaaauacacugaaauuuaccacaaauuccaauuugguuaaaauaugaguuuauucaucucaaacgauaauuuuaaaauaaauuuuuaaauaauauucacauucuaacuuuuuugauaacuguauauuuaagaacaguguaguaaguuuauaaucuacuucuagaauuacaaaauagcacaauaaaauugagcacugagcaaagccaaauaaacacugaccauacuauaagauuaacaaguaauaaucuuguacuuggaacacuguuuaugugauuguggccaggcuccuucugccaucacugugaaauaucaccuuacaggcccugacugacccauaauuuaauuuacuaagaagauaauauaagauuaaaaauaaaagaaguaauauaucucuauuuuauuccaaugaaaaguauaucauuuaaacccauagcacuccucccugcaaaccaucaaaauuuaccugugaaauuuccauuaugauguuccuuguucauugcuacacgucucuggucacaauuuuuuccauucucugccauuucauagaucaguaacucuugaggagcuaauacagcaaaauaaaauccagcaauacauuacaaacuucugcuguguagcugugacugaauaaaacugaauacaggaauaacaucacaguaauaagccacaugauauguaugauguguuuacacuuuuuuucuuuuauaaccaaaauuugaacaauuuaguuauucuauugaacaauuuauauagauauucuaauacaaauaguaaaaauauaaaagccauauaguuguaaaccuuuuccuaguaguuauuucagggaucuuccagauugaaauuuggagguaaucuguccacagaaggaggauaucaagcacuaguaacuccaaauguuaacacacuauaaagucuaacuccuucuaauuuacaauuaaauaucauacuacuguguacucaaaauuaaucuuaucauuuuaccuuuuuacaguuuucuuucauauucccuuuaacauuauuauauaaaaauagaauauacuacaaaagaugcugcaacuguugauacauaaaucuaagaucauagaccaguuuuauuuaggaaacaauucuacugaauaaaaugauaugggcaaaaaaaaaaaccaaacuugaaauguuuaagauaguuaaauguacuuuauuuauaacaugcuucauuucauacuacagguaucagugcuuuuacuuuaauguaauacaacauauaaaaaccagauugccugugauuguaucauucuucagguguuaguaaagcaaaacuuucuacucaaaaagcacaucacuucaauaaaaggcuaaaaugcugaguccuuaauacaauaaaugcugaguccuuaauacaauauuaaaacuugcccagacacuuauaaaaagacaacuggggccgggugcaguggcucaugccuauaaucccagcacuuugggagaccaaggcaggaugaucacuugaggucaggaguuugagcccagccuggacuacacagugagaucccauccuacauaagauaaauaaauuagccaggagugaugacccaugccuguaguucuaguugcucaggaggcugaggugggaggauugcuugggcucaggagugaaaggcuacacugagguaugauuguaccacugcauuacagccugggcaaaagggagacccugcuucaaaaaaaaaaagaaagugaaaauaaauacaacccacaggagaaaguauuuacaaaucacauauauuucauaagaagcguguaucgggccugcaaacucuuacaacucaguaauaaaaagcaaauaauccaauuaauaaacggacagaggagcugcacagauauuucuccaaagauacacaaauugcuaauaagcacauaaaaagaugucuaacaucuuuagccaucaaggaaaugcaaauuaaaccacaaugagauacaaucucauaccuguuaggaugguuauaguaaaagacagauaauagaccaggcgcaguggcucacgccuguaaucccagcacuuugggaggccaaggcaggcagauagugaggucaggaguucaagacuagccugcgcaacauggugaaaccccgucucuacuaaaaauacaaaaauuagccuggcguggugguggguggcuguaaucccagcuacucgggaggcugaggcaggagaaucgcuuggacccccgaggcggagguugcagugagccaagaucgugccauugcgcuccagccugggugacaggaacaagacucugucucaaaaaaaaaaaaaaaagaaacaaaaaaaagauaauaauaacaaguguuagugaggauguggagaaaucggaacugcuggugggaaugcaaaagaguucagcugcuuuggaaaacaaucugucaguuccucaaaagguaaaauacaguuaccauaugacucagcaauucaggaauguucauagugacacuguuaacagaccaaagguuuuuuuuuuuuuuuuuuugagauggagucucugucgcucaggcuggagugcaguggcaugaucuuggcucacugcaaccucugccucccgaguucaagugguucuccugccucagccucccagguaacugggauuacaggugcccgccaccaugccuggcuaauuuuuguauuuuuaguagagacgggguuucaccauguugguuaggcuggucuuguacuccugaccuugugaucugccugccucggccucacaaagugcugggauuacaggcgugagccacugcgcccagccuauaacccaaaugucuuaucaacugaugaauggauauaggaaauacgguauaugguauacccaaacaaugaaauauuagccauaaaaagaaauaaaguaguaauacauacuacugcaucaauggagucugaaaauaugcuaagugaaagaagucagucacaaaagacuacuuguuaugauucccauuuauaugaaauuuccagaauaugcauauccaugauaacagaaaguggauuagcagaugagcuggagaaaaauggggaguagcugccaaugaguugugaguuuuuuucuggggugaugauaauguucuaaaauuguuuugauaguugcauagaugugaauauaccguuuaaaugggugaauuauaugauaugugaauuauguuucaauaaagcuguuuaagaauagucaccagcaggaacuauccaaacuuccaaauauucauaggaaauauauguuaugaauacauaugaauaauauauucauagauuauaaauaaauaaauaaauaaauaaucucauuuauucauucauucauuuaguuauguugcccaggcuggucucgaacuccuggccugaagcgauccuccugccccagcuucccaaaguggugggauuccaggcaugagccacuacccacgcgucucuauauuuaauagaagacccaagaguauuaggaguauucucauggccaaguggcucaaauuuuuauauuuuaugagcggauucagugacaauuuagaauucaaagucagauauaugaguuaggggguuauauuauuaagaaagaaaauucaugaagucacuugauaagaugcuuguauaagguuuguuuaccuauucacugaacaaauacuaacugaacacuuuguaugugccaagagucaugcuagauuuauauuuagcugaucagaauaugauauggucauggguccaaucuuccuguaguuugauagcuggugcuaauuuauuccuugucuaaacucuaacuauuguaacuauuuucaaaauuuaugccucauaaaggaaaacaagugaaagccuauaaaaaucacuagaaaaaaaagcacacauucaucacuguaauauucuccuuuuuaagauacaauccauuuguguauaccuuuguuuuguugucuucaaugcugaauaagcaaauaaacacaucaagaaauaaaauauagguuucuauuaguauagauagccuuaaguagacaaucauaagauuuaaaaucugaaaaaucuggauuugaucccagauuugccacugauuaguugugugaucuuaagcaaaguuucauuuucuuuaguccuucauuguuuggauucacaaaaugaggacaauaauugccacuuucaaaugauugauguguagaugaaauaaucuauguaugcauguguauguuuguugauacgcaugcaugugugacuauaaauaccaauacaucaaaagaguaggagguaauaaacguacaaaaugccuaaacuauaaaaaacaacuucacagcacaugccucauuguuauuguaucagugaugccaguguuguucauucagcucucauuuuaaaaguucgggggucuccaaugggcacugaggauacaaauauuaauaggauaaggaggucccuguccucaagaggaucacagucugguaaagaagccaaaugaacacaagaaaucaauuauaacagaaugggaugaaauaggcauuuuaauaaaauuagaugaaaagacaauguuuuagucaggucuuaagagucuaacagggccaggcaugauggcucacgccuguaaucccagcauuuucgaaggcugaggcgggcagaucacgaggucaggagaucgagaccacccuggcugacacggugaaagccugucucuacuaaaaauacgaaaaaauagccaggcaugguggcgggcgccuauagucccaacuacucuggaggcugaggcaggagaacggcaugaacccaggaggcaaagcuugugguaagcggagaucgcgccacugcacuccagcaugggcgagacagagcaagacuccgucucaaaaaaaaacaaaaaaaaacaaaaagucuaacagacuggagaaauuuguaaaucucucuaaacaucaguuuuucuuaauuuguaaaacagagauaacaugacacacaucagaggguugaggauuaaacaagauaauguacauaaaauacuaacauauugccucaccuuucacgugaccucaauauauacuagcuauuaugaagaucgugaaguagaaagcacuaucggagcucacaggacaaaauauucagaccaguucauagaagcuuaaaguuugacucugcaaacuuaagucauacuugugugaagauucagccaaaagauaauguagcccaagcaauuacaaaacaauaacaacaaaaaccaaagaugcuagagcaucacaauagguuuacaaaauggaaaucuauuucacaaaucugaauuuuauuaauaaaaaaaucaacugaggauguuugaaauggaaccauauaaaaaaguuaaugauuuuccaucugccagucauuuaacuugaagcuauacuuaaguucugcaaauacuuaaaacuauguggguuuggccaggugugguggcucaugccuguaaucccagcacuuugggaggcugaggcgggcagaucacccgaggucaggaguucgagaccagccuggccaacauggcgaaaccccgucucuacuaaaaauacauaaauuagcugggugugguggcuugcgccuguaaucccagcuacucgggaggcugaggcaggagaaucgcuugaacccaggagguggaggucgcagggagccgagauugcaccacugcacuccagccuggacaacagagcaggacuccaucucaaaaaaaacaaaaaaaaaaacaaaaaaaacuauguguguucauauucagccaaauccuauaggcaauaucuuuuaaaaaauauuuugaagauauuuaaacauuuguaaauaucuaaauauaugauaaauauuuacaaauaagauauuuaaggauauuuaagauauuuuaaagccagccauucaucucuaucacaguaaguaaaauuuauuuaauuugugaugaaaagauaaacagggcacaaaaagguuugccuuauaaauaacauucuaaaaccuuucuccuacaaaacacugauaauugaacucauuugccccuauuuacucuuucccauagugucauuguuuuacccaaaacauuuugggucuaugagugcguacuuauaacaaugguauugcacaauuauuugaagguuuuguuuuuaagcuauugcaacagggguuuucauuugagcaaauaaugugcucuuacacaacgugcuaaaaaagaacagcauacugacauuuccuucuccaaaauucucucuggaaaacauaauagucugaaauuuuguuuuguaagaaauaacccagggaacuaaguuauuuucaucagucuauuucuucauaaacaaaauaaauuugcaguuuaaaaaacaacuuuucaaaaccuucuugccauucccaaaagaaggaaauauagcauaaggccaaacaagagagccacugagguucuaaacaguuaagcuuauaaaagcaucaaaacccuuuuuuuuuuuuuuuuggcauuuugaccauuuagcaugauuuaaaaccaucccaaguaugaaacagccaaaauaaaagacccacuaguguuuuaauaguuaagcuuauaaaaacuucaaagcuuuucugcauuuuaaccauuuucuaaaggauuuaacauuuuuccuugccuuucaaaauucccuugaaaacauccucacuuugccucuucuucccccaaucauacguacuguaaaacuuuguaaaacugcagugccuccagaaucaucugcauucuuaugaucugucuaagaagcugaacauaacugaagaaaaucacacaauuacaaagccacuucaaauucuuaauucaacaaauauauaccaacgguccauuaugugccaguuauuauuauuauuaucauuauuauuuugagacagucucgcuguguugcccaggcuggagugcaguggcacaaucucggcucacugcaaccucugcuucccagguucaagugauucuccugucucagccucccaaguagcugggacuacaggcacccacuaccacaccuggcuaauuuuuguuguuuuuuuuguuuuuuguuuuuguuuuuuuuuuugagacagagucucauucugucgcccaggcuggagugcaguggcaccaucucggcucacugcaagcuccaccucccggguucaugccauucuccugccucagccucccgaguagcugggacuacaggcgcccgccaccaggcccggcuaauuuuuuuguauuuuuaguagagacgugguuucacuguguuagccaggauggucuccaucuccugaccucgugaucagccaccucggccucccaaagugcugggauuacaggcgugagccaccgugcccugccuauuauuauuuuugagacaaaguuucacucuguuacgaaggcuggcgugcaauagcacaauauuggcucacugcaaccucugccucccggauucaaacaauccuccugucucagccucccaaguagcugggacuacaugugugcaccaccacgacaggcuaauuuuuauagagaugggguuucgccauguuguccaggcuggccucaaacuccugggcucaagugaucugcccaucucagccucccaaaguacugggauuacaggcuugagacacugugccuagcccaguuauuaagaugccaaagcucaaaccuaaaauugaugauuccugcuaauaaacuuuuuuuuuacuuugacaacuauuucauucuuuguuuuugcucccaaaacguuuuacccuccuuuuuccuuucuuauuuucagacauugacuuucuuuuuucuuuuucuuuucuuucuuuuuuuuuuuuuuugagacagggucucacucugucccccgggcuggagugcaguggugcaaucauggcuuacugcacccucgaccuccuggguucaagugauccucccacuucagccucccgagcagcuggaacuacaggaacaugcuaacauguccagcuaauuuuuguauuuuuaguagagacuggguuuccccauuuugcccaugcuggucuugaacuccugggcucaagugaucccccugccuuggccucccaaagugcugggauuacaggcaugaaccauauccagcccuguuacauuuuuuuaaauaacaaaagcagugagagaauucaccaaucccacuacuauuaagccuacuaaaauauuuacacuucacccaugucagcauuuuucucucuuuaugacuuggcaguguccucuacuuaccaaaggccauuaugucaauauauauauaucauuuccuuccuccuucucagggacuuugcuccuucuguucucacuguguaaucaaucuuuaccccuuuauucucaccagaaaauuaaguacucaguauuucccauuuuucauuccuucuucauaaacagugcucaaaagaguugccgacauauacaggcuccacuuacucaucaucaaauuucugccugauccauugugauaugacuucugcuccgacaaauaaaaauaaauugcuuuugugaagauuaucgauuaccuccauuugccaaauccaaaggacaugucuuacugaaucucuuaccuucgcugaacacaaguauccacucccuauuucuugaaauacuuucauuuuuccuccuauuucucugacggcucccccugcucuauguccugggguucuucaaagccugguccuagauuccuuuuuauguuccuuuauauucucucccuaaugaugucaccuauucacucagccuuaaauacccucuacauacugacaauucuuucuuucaaaggcaaaaugauguugccauacugcuuuaugaaagugcuuuaugaauaugcuguaagaauaauuagaaucacagaaggaacuuuagagaauaucaagccuauucuacuuauucacagauaaacaucucagagguaagggacuuguauaaugucacagaacaaguuagugacaaaccuggaggcaggacccagauacaauggugaucuuaggaguacacugaccuacugggaagacaaccccacccuccaaacuaagucaaaaauuauuuuucugagaauuuugaaagggacaagcucaaucuagaaaagugagguaauguaagagcuggccccaaaaugugauuuaggaguuaaagacucaaaucuuuuuuccugagacagucuugcucuaucaccuaggcuggcaugcaguagagcaaucacagcucacugcaaccuccaccgucaguggagcuaucacagcucacugcaaccgccaccuuccagguucaagccauucuccugccucagccuccccacuagcugggauuacaagcauguacccccaugcccggcuaauuuuuuuguauuuuuuaguagagaugggguuucaccauguuggccacgcuagucuucaacuccugaccucaggcgaucugcuagccuuggccuuccaaaguguugggguuaugggcauaagccacugugcccagccuaagacucaaaucuaaucaaauugggaguacagguugcuguacguuuuuuauguuacacuggggggcauuauuaggcugggcucauaaccauaaaauuauuaacuaaacugccugaaaaaaauaauuuaaggggacugguuuuaugauaaaagagaaguucaacaaaacaaaauagaaagucuaucuccagcacagugcagcagaaguuagccuauauaaaucuccuaucuacuggggcacacagcaucaugauuaccaacggcuuugaucaucuuaccauccaccuuugaguucaugcucccaaauaguauuuuguuuauaaucugacuucucaugcugauuagcuauaaggagaguauaugcuuguaaugggcugaauugugcccccccaaauucauauggugaaguccuaacacucaugugacuauaauuuggagauacugccuuuaagaagguaauuaaaguuaaaugagguaauaagggugguacucuaauaaggacucacguccuuauuggaagaaguaccagacagcuuucucuucuaccuggacacagaggaaagacuauguaaggacacagagagaagguggcugucuguaagccaggaagagaguccucaccagaaauaaacccugcuggcaccuugaucuuggacuugcagccuacaaaacugggagaaaaacaauuucuguuguuuaaacauagaugggguuuugccauguuuugucugugguauucuguuaugacaacccuggcagagcaauacaauguugauuaguauaaauaaggguauccagauugcagaauuguuuuguuuuguuuuguuuuguuuuguuuuguuuguagagacagagucucacuauguuacccagagugaucuucuggguaccaagugcuccuccugucucagccucccaaagugcugggauuacauacaggugugagccaucuugucuagcuagacuaccuuuuauccagaaaaaccugauguauuuacuguaugugucuucaaacugcaacagugacuaaucuagcaucaacauacccuguuaaucuuacuuauuaucaucuucaucaugacccauuuuauagggaaaaaggaaaacuugguggcugaaagcugccaauacguccugacuuacuaguuuuagguuaaauaauuugcauuugugcauauuuguaaaauauccccauccuuauuuuucuuuuuugagacggaguuucgcucuugucgcccaggcuggagugcaauggggcgaucauggcucacugcaaccuccagcuccugaguucaaacgauucuccugccucagccucccgaguagcuggaauuacaggugugugccaccacacccagcuaauuuuuguauuuuuaguagagacaggguuucaccauguuggccaggcagaucucaaacucuugaccucaggugaucugcccaccuuggccucccaaagugcugggauuacaggugugagccaccgcgcccggcccccaucccuauuuuuauaucauguuuuuguuuugcuuugggggacucucaacaaguuagcuucucuacuuuaagauaauuuuuuuuuuuugagauggaguuucgcucuuguugcccaggcuugagugcaauggcacaaucucggcucaccgcaaccucugcuucccggguucaagcgauucuccugucucagccucccaaguagcugggauuacaagcgucugccaucacaccuggcuaauguuuuguauuuaguagagacggaguuucaccacguuggucaggguggucuggaacuccugaccucaggugauccaccugccucggcaucccaaagugcugggauuacaggugugagccaccacgcccagccaagauaaauaauauauaagugcacuacacagugacuggcacauagcagucgcuuaauguuaguuucuccaugcuguuuaauauuuuuaaaugcaguaucauacccaucaaucuccaugcuucucaaaugucacaauuuuccaaaaaaaucaugguaaaugcugcccugaguauucacuuacagguacuuccuuuccauauuaguaugcuauacaaaagccuauguaacugguuuccauagccuacauaacagaaguagccacagauuuagaacaaucuuaguuuauguugaauaacaaaaaugaauuauuauucaucaaucuaaacaucuugaaauguaagacaaggacaauccgucaaaaauuauuaugagguaaaaggguucuagucuauccacauagcuaaaguaagaugaaauaaucauuuuuaaugagagccacuuuucaaaauucaauaaaguagcaauaauuuuugaaaucugugaugauacaaugucagugagauuccuagauguaggaguaaauccaaguauuccuagucuguuuaaaauguugaaauguccucaaacagaaaucuaacacauauucuugaccuucaauggcaucuacuuugcaccgagugcacguauguaaguuaguuuuguuuguaagaaugagguugcugaaacaaaucuuauaggucuguggaugggguugagaacacaaaccgggcagaagcauaacucaaacaucaaauaauuuucauuuugaacacuuauauagauacaagaaaugcauuaaaagaguguaacagaccuuaacugcagcugaagcauuuaaaacagaguuaacauuaaaugugggguuuuuuuuauuuguuuccugcagaagugcuuagaaaacacugcaaaaaucagcucacaaagguucuuuguaggcuguauauccagugcuaagacuauaauacuccauucauuuuaaacauuagucacacuuguaauacagaaacaaugugcaaguaaauuacugagagucccccaccaagcaaaacaaaaaacauuuauggauaacaugauaaaagcaucucccugaguaacauaagaguuauuggaacaguuaacaagguagaaaaggaaaagaaagugagaguaacaaaaccauugauuuucauuuucuuggcaacaucaucccaaaauaaaacgaacauacuuucuuuaaaaaaaaaaaucaucuauccagaugaauuuuacuuucucaaaaaaaaauuaugucagugugcucaauaaaacacauuguucuucauacaaggcacacaaagauagccaauaaguauuaugcuucucaguaaccuuucuugcuuucagaaguaucuauuuguuuguuuguuuguuuguuugugacagggucuuccucugucacucaggcuagagugcaguagcauggucacaggucaccacaggcuggaacucuugggcucaagcgaugcucuggccucaaccuccagaaguaucuuuucuuaauuggauuagacuacuccaaaauagcuguagauuucccuaaaacuguuaagauuaaggaauugugaucuacucuuggaaacaaaauaacuaaucugaguaauauaucuugacaaacgaggcuuugauauaguuuuccacuugugcagggguauaaggccaaagauaauucaaauaaaaugcacaauaucagaguaacuaucagacauaucagagugucaucugauaugucuaucugugguauaucuaucaugugguuguuccaguuaaagaauguguacucugaaaauucauaauaaugugaauggggauauaugaaaaaaaauucuugaauuuuuuucaacuuucuaaggucuuggggagggcugggugugauggcucacaccuguaauaacccuaucguuuugggaggcugaggcaggaggaucauuugaggccaggagguccagaccagccugggaaacacagugagaccccaucucuuaaaagaaaaaaaugaaacaaaacaaacaaacaaacaaaaacaauuagccagguguggugguaugugcauguagucccagcuacuugggaggcugagaccagaggacugccugaguccaggagcuugagguugcagugagcuaugauuguggcacugcaccucaaccugggugacagaguaagaccguguuaagagaaaggaaaagaaaagaaaggaggggccgggcacgguggcucacaccuguaaucccagcacuuugggaggccgaggcgggcagaucacgaggucaggagauugagaccauccuggcuaacauggugaaaccccaucucuacuaaaaguacaaaaaaucagccgggcgugguggcaggcgccuguaaucccagcuacuugggaggcugaggcaggagaauggcgugaacccagaaggcagagguugcagugagcugagauugugccacugcacuccagccugggugacagagcgagacuccgucucacaaaaaaaaaaaaaaaaaaaaaaaaaaaaggagggagggaaggaagaaaggaagucagucagucagucuuggggaauuagacaaaaccccaaauuaggaugcaauuuaaaaacauucagaaucuccauuaaucucccaauaauggaucagcagguaaagaggguauuucuggccuaaaaaguuccucaacuuaaaucuagugauguauaaaauacacucaacucaucacagguuucuaauuguugaaaaauuauaaacugcccugggucugauuuuuuuuuuucuuuuuaaaacaaagucuugcucugcucugucauccaggcuggaguguaguggugucaucucggcuuacugcaaacuccaccucccagguucaaguaauucuccuguuucagccucuggaguaguugggauaacaggcacgcaccaccaugccuagcuaauuuuuguguuuuuaguggagacaagguuucuccauguuggucaggcuguuaucaaaugccuuaccucaggugauccuccugccuuggccucccaaagugcugggauuacaggcaugagccacuguaccagaggugggagguaggaggaucguuugaggccaggaguuccagaccagacuggccaacacuguggaacccugucuguaccaaaaauacgaaaguuagcugggagugguggugcaggccuguagucccagcuccuugggaggcugaggcacaagaaucgcuugagccugggagguggagguugcagugggccuagacagugccacugcacuccugccugggugacagagcaagagugugucuccaaaaaaaaagagauuagaaaaagaaaaaucccauuucucauuuucucuuaaucuacuucuaaauguuccugcaguuuuucauaaccaaugcaaucuuagcaaaacauuuucaucaaaaagauggcggaccggccgagcgcgguggcucaugccuguaaucccagcacuuugggaggccgaagcgggcggaucacgaggucaggagaucaagaccauccuggccaacacagugaaacuccgugucuaugaaaaauuagccgggcgugguggugggcgccaguagucccagcuacucgggagguugaagaaggagaauggcgugaacccgggaggcggagcuugcaauaagccgagaucgcaacgcuguacuccagccugggcgacagagcgagaccccgucucaaaaaaaaauaaaaaaaaauaaaaauuggaggacuaagaguaaggucaagaauuaagauaaugaaggaauaccagacuagaguugggagauuuggcuaagagugagaccuuggcauugucacuucacaugccugauucucuuuuuccucauucaguuauuagucacauggaguaaaugagugcaauaauuuccuuucuaguuguaaaaaaaaauuccaacuagcacaaggguagaguuuuggauguauguaauaacaacuacuuuuguauagugauuuauaguuuaaaaauagguuaacaaacauaaugcuaacagccaucuguaagggacuguuauuuuuauccuugcuuuuagcaaaugagaaacugagugcuccaagggccccaaauagcaagucggcagcauauaaaugucaaagcaggaguucaaccucgcuuuuccaaguccaaauucaauaguucuucuacuauacaaaacaguccagugagaggauuuucaguggucacugaggaauuccagagucacauauacacacaagaugaaaaaacagucccagaaguuuagcuuguccuaguauuuucaaauguuccccauuacuagaauuaacagaacacucaucccuauugauucuuaguacuuaaaguaucuacgaaacucacguaguaucuaugaaacuaucugaaacucccuacuuuacugucccuaaauaccuggggcauuugcacuuguauaacuggggugaaaauacucucacuggacuguuguguacacuaaaguagaagaacuaccgaauuuggacuuggaaaagucugggugaacacuugcucugacauuuauauccucuauucuuucuacucuaaagcaacaccacuguagggauacugaacuuuuucaugagccacacuuaugaauaagcuaagaaacaagucucaaaaaauugcuaagaaugggcauuauaaaugacaaucucugauaagccagaaauuaugucaaccuuuaguacaaaaaaaaaauaaaaaauuuucuagguaguuagaaguuaaugcacacaguccuaaauaacacaggccaaaauaaaagaaaaauuuuaaaugcucagaacuacuagaacaaagugaauuuagcaaggucacaggauaaaagaucaaaacuaauacuuuccaccauauacuuggaauaaaaauuggacuauuacauacuuggaauaauuuuuuaaaauuucagauucaguaacaucugaaaauauaaaauauuuagagacaaauuuaacaaaauauaagcaaaaucuaaaacgaaauaaagaaagaaaauaaauuauacagagccuaaauaaaugauuagcauguuuuguugauuguuuggaagacuugauauuguuacuaugucaauuuccccugaaacgguuuggcucuguguccccaccuaaacuguaaucccgauguguccagggaggguccuguaauccccacauguugagggagggaggugauuggaucaugggggccguuucccccaugcuguucucaugauagugagugaguucucacgagaucugaugguuauguguuugacaauuccuccuucacacuauuuucucuucugcugccuugugaagaagguuccuguuuccccuaccaccaugauuguaaguuuccugaggccuucucagccauacagaacugugagucaauuaaaccucucuccuuuauaaauuacccagucucagguaguaccuuuauagcagugugaaaacacacuaauaaaucccucaaagugauguauagccuuaaugaagaucaaucaaauucaagcaagcuuuauaaaaaaagcaauucaaauauuuauagaaaugcaaaaacuuagaguagcgaaaacaauugggauaaagaacaaaguugaaggacuugcacuaacugaugucaacaauuacuauaaaucuacaguaaucaugacagugugauauugguaaaaggauaguuagaagccaauggaaaagaauagagaauacagaaauaggccaggcacagcgguucaugcuuguaaucccagcacauugggaugccaaggugagaggaucacuugagugccagaguucaagaccagccugggcaacauaacaagaccccaucccuaccaaaaaaauuaaaaaauuacuccugugugguggcaugcaccucaugguaucuguggucccagguacucagggggcugaggugggaggauugcuugagccuaggaggucaagguugcagagagcugugaucgugccacugcaaucuaacaaucuagccugggugacagagauccuggcucaaagcccucucccugcaccgcccccaccccccaccaaaaacaaaaacaaaaacgcaagaacaacuuucaugugcuuuaaaauaauuauauauauacauuugaaaaaggugaaaaaccuugcuccccacucucccugcuagauguaaccacuuuuauuaguuuuguguaucugaccuuucuucuuucaaacacuccuauuauuguuugaguauguguccccuccaaaacucauguuaaaauuuaaccccuaauguggcaguagagugagacaaggccuuuaagaggugauugggucacggaggcucugcccuuaugaaugaauuaauccauucauaaauuaauggguuaauggauuaauggguuaucauggggguaggacugguugcuuuauaagcagagaaaaagagaacugagcuugcacacucagcucccccuccaugugauacucucggcacucugcagagucccuccagcaagaaggcccuuacccaauguggccacucgaucuugaacuuuucagcuuccacggcuauaaaaauuaaauuccuuuucuuuauaaauuacccaguuucggguauucugguauaagcaacagaaaacggacuaagaaaccuucuuuuuuuuuuuuuuuuuuuuuccuuuuaagacggagucucgcucaguugcgcagguuggagugcaguggcacgaucuuggcucacugcaaccucugccucccggguucaagcgauucuaaugccucagccucccuagcaguggggauuacaggugcccaccaccacgcccagcuaauuuuuguauuuuuaguagagauggggucucaccauguuggccaggcugaucuugaacucuugaccucaagugaucugcgcaccuuggccucucaguguugggauuacaggugugaaccauugugcccagcccuaagauaccuucuuagucuccguuuuguuaaaaaaaaaagucucucuuuuuuuuaacaaaaaaaaaaaaaaaaaaagagagaugggguuuugccauguuguccaggcuggucucgaacuccuggacucaagcgauccacccaccucagccucccaaaguucugggauuacaggagugagccacugcauccagcccagaucuuucuuuuaccugcccuuggcccucuccucucccuaucuccccaggugacucaucugguccaugguugaaaauacuaucccguauuuguauuucugguuuugaccucuagauuuauauauguaagugcgugacuuggaugauuuauuauuauuauuauuauuauacuuuaaguucuaggguacaugugcacaaugugcagguuuguuacauauguauacaugugccauguuggugugcugcaccuauuaacucgucauuuacauuagguauaucuccuaaugcuaucccucccuccuucccccaacccacaacaggccccggugugugauguccccccuccuguguccauagaugauucuuuaagugucucaaaauuaacauguccuuuucucccuacaccuacccaccuucuuguaacaaacaaaccuggucuucuccaaaccucccuucucccaguaccuggcacaaccacccacccagucacuaaauccagaagcuuagucaucccugacacuucccuuuuucuuaccacucaucuaacccaggaccaaguccuauaccaaauauauuugguauccacacacaacuguccaucuucuuugcuacccuucuaguccagaccaucuucaucuucuucuuggacuaugcaguggacucucaacuucucucuccauuucuguucuugcccgcuucaauucauccuucacacaugaacaacaaugaacuucuuauaaauccuauuacuccucuacuuaaaauuguagaaugauuuccuacugcacucaaaaucaaauucaaacucauucccuuggccugcaaaauucugcaugaccuggauccuguauauauuuccuauaucaucucaugucaauguauuccaagucuauuaugcuccagccucaaauaagcauauauccacauuguuaacucucucuuagacccucaugugcugccuuccuaacaauucuuauuucccauuguuuuccccagaaccugguguaaggccugggacacaaaauguuuguucacugacuggauaaugaacagauaaggcaauagaugucacuggaaaaugaucuuuccauuccaagaaagugcuaaaagacaucaugaaacaucaaaaguuucaauugccaaauucuguguuauggcuuacacagauaauguagucuguuaauaccaaaaaguuaacagaauggcccaaaagaaugccucauuugguuaagaaucucacauauguuguaaaauauagacaaagugaaguguauacucagauauuuauuuacuggaacuucauuaauaaugagcaaacaauaauuaaguaagcagcaacauaaagcuaugcuuuuaaaagagggcugggaaagaguucuuggcaauagcuuagggggccacaugaugauaaugaucacaaucaugguuaacuauaugcuacagacacuguucuaaaugcuuuauuuaaaccuauucauucaauccuaacaagaaggguauugacuucauuguccaggaggaaacugagauagcaagaaguaaaaaguaacuaauccaagaguugcauaguaauagagcuagaauuugaaaaaaagcagucuagcuuuauagcccuggcuuuuaacacuaccugccuaguccuuccagguaaucuauaaagaacaaaguuaucauuaaaaaacucaaggacaagagaaaauacucccaugaacuacugaaaagauuaaguaguucaagaauacaaacaaacucuugagcaauuauagguauauuagcugugauauaauuacucaauagauugcccuugcuuaauuuaaauaugccuuaaacuuuaaguaucaccuuuuaucugacacagaaaauuaucuccuguucaaauuuccuugaugcugcaaaucaaggagcauauuuuaaaauaagcuuuauauaagggccuacauaauaccuaacuucaguucagcaaacuccauccaaagcugcuuucccauauaaaauaaggaauuucuugaggcaauaugcucuuagcaauuuacuauuccucaaaauauuugcaaggcuuugugaaagcagaguaacaauuuacaaaaccacgacaaaguuaucacuucaauuuguccuguuuauuaggauucucuaaucuagaguucauuuccacaccaaaaugggagacacagcaagggcacuugggcaaaaacaggaaugacaguagcaccuagaacuaucaucuccgagaaagacuaaagagacuaaaaaguuuguuaaaucaauggaaccaaaaaaaaagaguacccaacaaugcaaagaauuaacucuucuacaauggcuauuuacccagaauaaaauaacuagagaaauggcucuauauauaauagauaauuaacauaacaaaauauuaaaauuacaaacagcuuggggagguuuuuuuuuuuguaagagcaaauaauacaguucucuccuacugcuuuucuuuuauuuucuucucuuuuuuuuuugagauggagucucgcucuguuguccaggcuggagugcaguggcgcgaucucggcucacugcaaccuccgccucccggguucaaacgauucucaugccucagccuccugaguagcugggauuacaggcgucugccaccacacccagcuaauuuuuuuguauuuuuuguagacaccggguuucaccauguuagacaggcuagucucaaacuccugaucucaggugaucuucccgccucggccucccaaagugcugggauuacaggcgugagccacggcgccuggccaguucucuccuacucuuuagcaacaacauucacaguagacacguguuaaggcuccuccgucauuuccacuugccagaaagauaacucaacacaugacagucaugaagcaugaacucagacaaacuauucugaagaauauaacugauuuucuuuccuuaaucuauuacacuucaaaucuagccaagcacaguuuuuguuaugcuacaauuuauaagacuaaacuagcuaaagagggaaaaaaaguuuguaaauaaggcuuaugugcguauguguguauuuacguguguauguggauagaucccuuuaauaccuaagaguaauuauuuucaugugaacuuggaaauauuaccaaaccauaauaagaugccuggauacaaccuuguuagaacagaaagaacacuugagaccuuacaguucagguucuagcacuaccuaagccagaugaccucaagcaagccaauuacuaauuacugauuguuucugagccuuaauuuucuccucuguuaaaugggaaucuacuuauacauucacagagauuccuucuaauucuaaauauugguuucagugaaauaauaauguuucuuuuuuuuuugagacggagucuggcucugucucccaggcuggagugcaguggcgcaaucucggcucacugcaagcuccgccuccuggguucgcgccauucuccugccucagccuccggaguagcugggauuacaggcgccugccaccacgcccggcuaauuuuuuguauuuuuaguagagacaggguuucacuguauuagccaggauugucucgaucgccugaccucgugauccgcccaacucggccucccaaagugcugggauuacaagcgugaaccaccgcgcccggcccaauaauaagguuucuuauuuaauguaaguaagauaggacuacuucuacucuuuaguuaacuauacguaggcaaaaaacuucagcuuuuucugcacuuggaaguucugaagugacaauacaugacgaccaaaaaggaucagauuuaaacucccgaaugcaaaacuauacucauuuuccaggaaccuauuuauuaaccauggugacuaauucaauggaucacgguaucaaacuauucuuugcuaacuuucaaagguggggcaaagaucaucucagaaaaguaugugauaauauuuucagauaaugaugcaaaguaacaguauucuacacugacauaucuccaguucuaagaguaaagugauaccauauuuucauauuuaauaauuucauguuuacuagcucauuuaaucuuugugacaguuguaugaaagaaagugagcagaauuuuuaucaacacaaucuagaccagcucagaauguuagguaaccuaucagccauuacuuaacaaguguuggagcccagacuucaauccaggucuucugauuuaaaguuuaauaguuaccaaaauccuaaaaaguggugauucaagccaaaagcgagaaguuggaaaagugagaaaaacuggauaaucaguccuucaauugaacauaaagaagauaagaucagauuuggcaguuauauaaucaagaagcaaauuuaccgaauguuaaacuaaugauacaucuaucauaauuccauaucucaaauuuugucaccuuguuucaaagccaagcgugaacaaauuuucaaacucaaaauaagaaaaauauguaaacugacaaacugauuuaacuagcuauagguaaacugguaaaaggcaucaugguucuauguauauuuucuucuggaaugugacucauagaaauuaaacuguauuaaucaauuguaaucaaguaggauauaucccucaaaggaaaaaaguaaccuucagugccuuaagauaauguaggcaaaguaguaaaauauaaaauuucuacucgagagagucacuucauaccuacacaaaucagucacauuugucuagguaccaccaucccucuuccacaguaaaaacauaagcuacaaugcauacaaugaugccuaguaaguaaguuucuuccuuucaucaucuaugcuaagaauacacaacuaaaaucagagcuaaugacaauacaauuacuagguaguagcaacuggaauauuaaauucuaucaugacaacaccagaaacacuuguacaagcuucuucaaaugaucaauguaaucuguccacaaaaaucucugacaagccccaaaguagaaaugaaagacguuaacauuaggauaaggagcgaugcugccaaaacacaucaacaguggccagucuacguguauuauuagauuuuuacauggaguugcagguaaauaaaagaugauuguguaaaaucuucuggaggucauaaguaaucuagcagugugacacagggccacauaugguuucuggaauuuuagagauuaagucgaccuucacguuuuacugcaaauaccuccacuguaauaagauauagaggucgggguucagggguuuggaaaggcagacaacucuuuuucauuaaagcagugaaaaaucugagaaguuccucuccaagggcucugcggagcgaaggcccauucccuuggcuacccuguaccaccagagcuuuagauggcacuugcacgccuggauuucguuuaggagcgaauacaucuagcaucaugcgccagagguucgggagagcaaaaaccaaacugacagauccugagaaauagcucagucaucagcagggaagaccuucuccacuuacuccaagguccuggacaucccgggacuaagagguucucuaaagaagccuagcaaggcuuccaaguacgcggagaggagaacgaacagcccggugucuggguucaauguccgggugaccaaccaugagaaggugucccaaauaaccuggcuaccgccagcgugagacauccagggugagacauccagucagcagcguccuaaaacacugcuggaagucggaaucacagugccccagauccgcaaugccuaagugggagagcuccggaagacgccaagcucugaggacagccucaggcuucgguccccaauucccugaguuaguuuaccuacccgcuccgaccccggcugcuccggaucucaggauccuggaagcugcuccuuacggacucucacacccgccgcugggcuccagacaaccggaacccgcucacgucacuuccgguccggucccucugcccccugagacagccuccagaagggauacguuccucccuccuuucggcgagcucgguugauccucgcgggauuucaguuaggcucuuagugcgggcccuguggguguggcaagaggaagaau

SEQ ID NO: 192290 - RNA, 10190 nt, Homo sapiens
ucgcuuugugauucuugauccggaacuugucacccaggaaccccggaagagguagcucacgcgauagaaacguguucgcugcccagaagaagggaaggcgcgagugaggaaaggagguacuguagguagguugguuggcuccuuacagggcgaaggagaccaauaucauuauucauuuucucgccaguaggaacguuucuuuucaccucguugcauuacccaccuucuucauuuucuccuuuauaaacugucuuccgcccaggggccgcugagcccucuguuccuguucugcgaaccguccuuuggaggaaaggaacaggcugcuggggaggggaagacucagaauuucuaguucccagcaaagccuccaggcaggcaguaucgaugcgcucucuccgaaauugauaaaauagcgagcaggccucauacccucagcugggcacuuaugaauauccccagcguuucgagcugucgagcucugcguggaaagaauugguuucuaagaauauagucgaaaauuuggggccgggcgcgguggcugacgccuguaaucccagcacuuugggaggcugaugugggcggaucaccugaggucagaaguucgagaccauccuggccaacauggcgaaaacccaucuauacuaaaaauacaaaaauuagccggcgugguggcgcgugccuguaaucccagcuacucgggaggcugaggcaggagaaugacuugaacucgggaggcggagguugcagugagccgauaucgcuccauugcucuccagccugggcgacagagugagacuucgucucagaaaaaaaaaaaaaagaaagaaaaaauuuccccccuuuuucacacaaagagauuaacuagagagguauuaauccuuacugacauaccccaggcaccauacuagacucugggaauauguuauacagggaaaguggggcaguggcuuaagggucagagaagauuugggaaagguuuguuuguuuuuuucgguuguaaacugcagacccggcgcgguggcucagccuguaauccaacacuuugggaggcugagacaggaggauugcuugagcccaggaguuugagaacagccugggccacauagggggccacauagugagacccugucucuuaaaaaaagauuaacggguggagcauggugcagaaggagguaaugggaucaagagcacuacugaaauggguuuacugaggcaggggaauuagaaggcaccaagaagaagauuuuauaggauguacuuauuuuguucugcugucauugcccagaauuauuuaugagacaaagaaugguuauuuguuuuaccuuagucuuaggcacuaggcuuauugauacgcuugucguaaguguacagaaaaagagacagacauguuguuuuagaggaguuagaugauaaucugaucagauuaauaugagauuagaacauccuaaagaacaaaaauauguguuaauuuuagcauuuuuaugauuagacacuccauugagauaugggacauaauaaauaaacuugguaacuuuuggaacuuucacuguccuguuuuugaucuuauuggguuuuuuuuuuuuuuuggagacaggguuuugcauuguuguccagccuggggugcaguggcacgaucauggcucacugcaauuuccaccucccagccugagguguccuccuaccuuauccccugaguagcugggaguaugggcauguggcaccacaucuggcuaauuauuuaaauuuuuuguaaagaugaggucucacuggguugcccagauugguuuugaacuggacucgagaugcugcugccucgaccucaagcaacuccuugaggccaggaguuccagaccagccugggcaacauagcaagaccaaguccauacaaaaauaaaaaauuuuuaaaaaaucaggagggugugguggcaugcaccuguagucccaucuacuuggaaggcugagguaggagaauugcuuaagcccaggaguuugaggcuguagcgagcuaugaucaugccacugaacucuagccugggugacagagggagaccccuucucuuuaaaaaaaaauaaagaaaaaggcaacuucucuguuugauccucauauuucucaucuuuaaaaugaggcuaauauaucuuccuuuuuauguguucauagcaacaauaaaugagguaauggauauaaaggauuuaguauguuauccagcacauaauagcuucucuauguagagcaguuccuucuccagauaguaccggaauguaguguaugggauauuugguuacuuugcagccuagaaauuauuucagagaauccuaauugcugacauugcauauuuguucaguuuggagucugguuguuagauuaucaaagaaaaguccugcugauauguaagcaucaaauagaaacuuggccaggcaugguggcccaugccuguaucccagcacuuugggaggcugaggcaggcagaucacuugaggucaggaguucgagaccagccuggccaacauggugaaaccccgucucuacuaaaaauacaaaaauuagccaggugugguggcgggugccuguaaucccauguacgugggaggcugaggcgggagaauugcuugaacccggaggcagagguugcagugagcugagauggcgccacugcacuccagccugggugacaaagugagaugccgucuuaagaaaaaaaaaagaauucucugucuuugucucuuuuagggggugggggcuguaaaggcacuagaaccauaaauacuaugucugugcagcccugucaccguauuuaggcacuugaguggaagagcacugaaacuaggugcacuacagcuuacccuaugugacccuccuacuccuggccacuccaugucagucuccuuugauuccuaauguucauuuccucaggauuauguuuuaguccuuucuucauucuacauauuuguccaaguggccucauacucuuccaucucuucaguaacuucaauuauaugguaaggucucucaaaucuauauuuccagcccagaccuuucugacuuuaaacugauauauccuagaccuuucuguccuuuaagcugauauauccuuuuuuuucuucuuucuagauaucucugagaugucuuuuguucagaacaaaacuaauucauuaucuuuuccauucaaaccugguauuucaccaaaauucuccauuuguucaaaucuagcugucauuauuaacuucucccuuucuuuugccaccagacuuccugucagucacuaaaucagacagguguaccuuagacacuuuuuuuauuucucauucccacuacuguugucuaaaugaccaucaucucaucuagacugcugggagaggccugauauaguaauguuaagaacaagggcucggcagggcaugguggcucacgccugcaaucccagcacuuugggaggucgagguggguggaucaccugaggucaggagcucgagacuagccuggccaacauggugaaaccccaucucuacuaaaaauacaaaaauuagccgggugugguagcacaugccugaagucccaccuacuugggaggcugaggcaggagaagcacuugaaccccagagguggagguugcagugaaccaagauugcaccacugcacuccagccuggcaauagagugagacuccgucuccaaaaaaaagaacaagggcucggcagggcaugguggcucacgcccguaaucccagcacuuugggaggccgagguggcuggaucaccugagaucaggaguuugagaccagccuggccaaccuggugaaaccccgucucuacuaaaaauacaaacaauuagcucgguguaguggcgggugucuguaaucccagcuauuugggaggcugaggcaggagaaucacuugaacccaggaggcagagguugcagugagccgagauugugccauugcacuccagcaugggagacaagaacaagacucugucucaaaaagaaaaaagaacaagggcucuggauuaagacgaccacuuaugagcugggugaauuuaggcaagcuauaacuuguguaccucauuuuucuacauccgaaaaauggggaucauaauuauauauagaugcuucucaacuuagggugggguuauauccugauaaacccaucauaaauugaaaguaccauaaauugagagccaggcacaguggcucaugccuguaaauguagcuacaugggaggcugaggugggagggaucauaugaggcccagaguucgagaccagccugggcaacauaaugaaaccccugugucuuaaaaaaaaaaguuuuuuuuuaaauuagcaguguguggugguaugugcuuguagucccagcuacuggggagguugaagugggaggauugcuugagcucaggaguucgaggcugcagugagcuaugaucacuccacuguauuccagccuggacaaaagagugaaacccugucucuuagaaaaggaaauagaaguuggaaauaaauuuaauacaccuaaccuaccaaacaugguaguuuagccuagccuaccuuaaaggugcucagaacacuuaauuuauuagcguacaauagggcaaaaucaucuaacauaaggccuacaaguguugaauaucucauguaauucguugaauacuguacugaaggugaaaaacagaauguuuguauggguaaaguuucuacugaauauguguugcuuuugaaccauuguaaagccaaaaagcuuaagcgaaacuacaguaaguccaugaccagcucuauuuaccuugaagugcuguuaggcacauuaaagaagacaauuccuauagaguguuuagccaguguguagcagaacacuucauaaauguuaacuauuacuacauuauagcagccucugaaaugaucucccuguaucuauugccaacugcuagucaaggcucagguaucuuuuagaacaggcgucccuguggccuguuaggaacugggccgcacagcaggaggugaguggugggcaacugagugaaguuuuaucuguauuugcagccacuccccaucgcuaacauuaccuccugagcuccgucuaauuagcgacagcauuagauucucaugcgagugugaacccuguuaugaacugcccaugcgagggaucuguguuguguacuucuuaugagaaucuaaugucugaugaucuguuacugccucccaucucacccccgaugggacugucaaacaccuuuuuauaacauuuaccagucuugcaauuauuugucuucacuacuuaucuaugaacagcugacaguggcccauauucaucacuauauccucagcuuaacaggguguauggcuggcacauagauagccaguaaacauuuguuuuauugaacuuaacuucucuuggucugaauuucuucauuuuugauauggcaguaauccucacuucucaguggaucaaauaacaauacaugucaaaguauuguggaaauuuugagcuauaaagacaaaguuuuggccgagcacaguggcucacaccuguaaucccagcacuuugggaggccgaggugggcggaucacgaggucaggagauugagaccauccuggcuaacacggugaaacccugucucuacuaaaaauacaaaaaaaaaaaaaaaaaauuagccgggugugauggugggugccuguagggaggcugaggcaggagaauggcaugaacccgggaggcggagcuggcagugagcugagaucgcgccacugcaugcuagccugggcgacagagcgagacuccaucucaaauagacaaacaaacaaacaaaaaaaccccaaaguuuuaaaacagcaugaaagaaauucaaaauuaggauuggaccauuucaaaaccauugcuaaaauguaagcuucauuagagaaaggacuuuuucugcuuugugcacuccuguaucccuuagauucuagaacagggucaaucaguauuuguggaagggaagcaguauaucauaaaacuaaaagaauugaaaaaguagaaaguagucacacuucuauuucagauacccauuccuauagcuauguucuuuguaauuguucgucuccaaaaucaaaacccuaugcaucgcucuaagucuuuccaguuuacuuucauuacaccuguucuucaacagcaugucuagauaaauagcaugcaucacuuuauuguccauaaaucagucuuugauaauacagguugcuuuuuaucagguaggccaaaagagaaaaauguaauaacacagguugcauggucuaucaugucaaacauucuuacccuuauccuaaauucccuuguaccacugugucuuggggcgugcuccuggcauaauuuaaacuuggauacauccaacuaccauuucaguaggaggggagagcaaaggaugaguguggauggagguuaguuuguaugucuggaggaagugauuaguaguuuuagucuuuuggcuucuaaguacuacuggagaaaaucacaaauaguauguugccauuaaaaagucaucauuaaucuuaaccaugcuuucaauauuccucugcaauccugccauauuuugccacaccuuuuauuuccgccuuucucuucucuacuccauuuuaacuucugucugagcuccuucccucagggggaauacuuuccugccuucaaauccguggaccuacuugauuuaaaacugaaauugggaaaggugucccuuuuccuuuccaaaaccacaucccuuuauaaagucuuucucuaucuugagcauuuaccugccuuucuucuggcuucauccuauuaacauuuaaauaugcuuauccuuucuucuuaggagaaaaaaaaaauugcuuuccucugugucgccuuauauccauugcuuuuucuuuuugcucuaucucuugaccccaccucaaacgaauuucugccccaccaaagacaguaaccccuuuuauguuaaaauuaguggaaagaauguuaauauaaugcccuaacuuuaaagaagaacauaaaggaaauuuauaaguacuuccagggcugucaucuaugccgugccaaucaugcagugcacaauuccaagggcaccacuuuacauuacaaauacagugcauuacaaauauaguggccccauguuuauaaaugcuuagauaauacuccacuagaaaaagaaacugauaguugcuugccacauagaagcacugugaauccagcagccucauuuguagacugauauaagugucuuauuggugacucaaauauuaugaacagcuuugccgaaguagcaagauuuucuaaaauaauaaaggaugacauuccuuuguuuuaugauagcuacacuucuggaaaauucaguauggacagucuccgacuuaggauuuuucaacuuuaggauggugugaaagagacacccauucaguagaaacuguacuucgaguuuugcauuuugaucuuuuccuggccuagugauaaugugguacaguacacucuugugaugcugggcagcggcagcgagccacagcucccagucacccaugugaucacgggaaucaacaacccauccucuaccguguacuguguugucagcuuuuuuggauauuguguuuuguguuuucacauuccaucaugucuacaaaauguccaucagugucuccuguuucuggugagaugaagaagaggaaggcaauuacucuugaaaugaaacucaagauaauugcccagcaugaagguggcaagccaguaauggccauugcacgugaguuaggacuuuggcaauccacgauuucaaccaucuuaagggauaagaagcaaaucagugaugcagcgaaaucgucagcaucaguuaaauccacugucaucacaaagaaaagggcuggaccaauugaugauauggaaaaauuacuuguuauguggauggaagaccagauacagaagcguauaccacuuagccuacugaugauccaggcuaaggcaagaagucuuuuuaauaugcuaaaagaccgugccagugauccuacauauacacaaauguuuaaagcaagucauggaugguuccagcgcuucaaaaggcgucauaauuuucacaauguaaagaucacuggugaggcagcacgugcugguaaugaaggugccauagcuuuuaaggaacagcugcauaggauaauuauggcuaaagaucuuugcaauaaggagcugauugcacuggaggaagaaagagguaaaggcguugaggcaguggaagaaguuacacccacggcaccuagaaaguucacagcaaagaaacuggcagaggcauuugcugcuaucagcaguggccuacacguuagaagaaauggacgucaauuacgagagauucgccacaguugacaggcgcagauacaggaugcucuugcuugcuacagagaaauauauagugaaaagaagaaacaagcuguacggucaaaacuugguaucuuccugaagaacaacacuaugcuugcuaaaccaucaacuaguguugaugucccaaugccuucuaccaccuauucucgauguucaucagaagagagagaaauugaggacccuguugcauccccaucauccagcaauuaauucuauuucagugcuucaaacauuuuucaggaccacugugcuuucagcuguguaaauuaauggugaguacccauacaaccauuguuuuccacuuacaguauucaauaaauuacaggagauauucaacacuauuauaaaagagccucguguuagaugauuuuuguccaacuguaggcuaauguaaguguucugagcacauuuaagguaggcuaggcuaagucaugauauucuguagguguauuaaaugcauuuuuggcuuacaguauuuucaauuaauuggguuaauugggauauaaccccauggaaaauugaggagcaccuguacauaguaaaacuaugcaaaaaauauuuuguguucuuaaguaaaaugauguugaguucucaucucaguuauuaaguuuuucagcugcacucacguccaaugggacaacucuucauuuuguaagguuuuuagcauccuugcucaggcuuaguaaauuucaguagugcaccucacuccaggcccauuaaugugacagugagguucuucugaggguaacugauuugauaccaucuccacugagaaccacugcauugugaaaacaccgauuagcacuguauuccaggaaaggguuauuuuugguuucuuuaaaucuuaggcaucuugguaaaacggaacaucuccacaagacuaagggaagacugaggaauagaguuuuugaacuuuaugcaacuucguuuacaucaagauucaaaaugaccuaaacuguuucauguggaugcuugaaucuuuucuaguacacugguggugggcaagaggguguuggaaacagggugcaggcauaagaucaaagguguguuuugccuuuuuucuggaugaccauuaaguguauagucaaaauguuucucugauaagccuauaccucuguaaguuguuacugccggauagugauaacuguuuuccuuuccuuuaagaugcccuccaaauccuugguuauggaauauuuggcucaucccaguacacucggcuuggcuguuggaguugcuuguggcaugugccugggcuggagccuucgaguaugcuuugggaugcuccccaaaagcaagacgagcaagacacacacagauacugaaagugaagcaagcaucuugggagacagcggggaguacaagaugauucuugugguucgaaaugacuuaaagaugggaaaagggaaaguggcugcccagugcucucaugcugcuguuucagccuacaagcagauucaaagaagaaauccugaaaugcucaaacaaugggaauacuguggccagcccaaggugguggucaaagcuccugaugaagaaacccugauugcauuauuggcccaugcaaaaaugcugggacugacuguaaguuuaauucaagaugcuggacguacucagauugcaccaggcucucaaacuguccuagggauugggccaggaccagcagaccuaauugacaaagucacuggucaccuaaaacuuuacuagguggacuuugauaugacaacaaccccuccaucacaaguguuugaagccugucagauucuaacaacaaaagcugaauuucuucacccaacuuaaauguucuugagaugaaaauaaaaccuauucccauguucua

SEQ ID NO: 192291 - RNA, 5241 nt, Homo sapiens
uuuacuaacggaccggaaggacucuagagaacgcucugcacuauggcuggucccgugagcuugcgagaccuucuaaugggagcaucagccuggaugggcucugaaagucccggaggguccccuacugagggcggagggagcgcggcuggcggaccggagccuccauggcgggaggaugagaucugcguugugggaaucuucggcaagacggcucuacgccugaauuccgagaaguucucucuugugaauacggugugcgaccgacaggucuuuccucucuuucgccaccaagauccuggggauccaggaccuggaaucagaacugaggcuggcgccgugggugaggccgguggagccgaggacccuggggcugcagccggggguucaguucggggaaguggagcugucgcggaagguaaccgaacugaggcaggcucccaggacuacagccuucugcaggccuacuacagucaggaaagcaaaguucuguaucuucuccucaccuccaucugugacaauucacagcuucuccgggcuugucgggcucuucagagcggggaagcuggagguggacucucuuuaccucaugcagaagcacacgaguucuggaagcaucaagagaagcugcagugccucagucuccuuuaccuauucucugucugucauaucuugcuucugguccaucccacuuguuccuuugauaucacuuaugaucgaguauucagagcccuggaugggcugagacagaagguccugccgcuccuuaaaacagccauuaaggauuguccaguuggcaaagacuggaagcuaaacugccgaccuugcccaccuagacuccuuuuccucuuucaacucaauggagcccucaagguagaaccuccucggaaccaagacccagcucauccagacaagcccaagaaacauucucccaaaaggaggcugcagcaugcccuggaggaccagaucuauagaaucuuccggaagagucgugucuugacuaaucagagcaucaacugccucuuuacugugccugccaaccaagcuuucguguacauaguaccgggaagccaggaggaggacccaguagguauguugcuggaccaacuuaggagucauuguacugugaaggacccggaaucuuugcuggugccugcaccccuuucugggccuaggcgauaccaggugaugaggcagcacagccgacaacaacuuuccuuucacauugacagcagcaguuccaguucuucaggccagcuaguggauuucacucuucgggaauuccuauggcagcauguggagcuaguucuaagcaagaaagguuucgaugacagugugggcaggaacccacagccuucccauuuugaacuuccuacuuaucagaaguggaucucagcagcuucaaaacuguaugagguggcuauugaugggaaagaagaggacuuggggucacccacuggagagcuaacaucuaagauuuuaagcaguauuaaagucuuggaaggauuuuuggauauugacacaaaauucucagaaaaccgaugccaaaaagcuuuacccauggcccacagugccuaccagucaaauuugccucauaauuacacaaugacuguccauaagaaucagcuugcccaggcucuucgaguguacagucaacaugcuagagguccagcauuucacaaauacgccaugcaguuacaugaggacugcuacaaauuuuggagcaauggccaucagcucugugaggagaggaguuuaacugaucaacacugugugcacaaauuucacucauuaccuaaaucagguagcuaaaauuuguucagcauuuugaaauaaaaacuuugagcuguguuuucauucuuguuuuaagauagucuguucacuauguauugauauuuuagaaagagcccuacagaaauuuaggugcaucagcuauacguuuucucuccugcuguaaaaggaaaauaucagcuaugacuacuuucuuauuuuuuuucauuuaaaggauacguccuagugaauugguaagugagaauuauuaaguaguauaaaauuucagacaucucauauuaacacuuugccuuggaggauuuguagaacuaaaaugaauguuauguuagaugaugguacaugauaaugguagcaggaggaaaaauucacuuaaaaacucuaaacuuuacauuuauaauauaaaguauuuuauauacuuucacuugcuucuucuguuauguguauuuagguaagguuuuuguuugugggguuagauguuguagaaugcaaaguaaauucgcacauuguguuuaugaaauuaauaguggcuguuauauuuuccaggagaaaaaccagaggcugauagaaauccgccugugcuauaucacaauagccgagcucgaucuacuggugcuugcaacuguggaaggaaacaagcaccucgagaugaucccuuugauaucaaagcagccaauuaugacuucuaucagguagacucugaauuuuuucuucuuccucuucugucuuuuuuuguuaaauaucaucugaguaaaaacauauuuucaauagcagaguaaguagaaaagcaaaugcaacugcaguauaauauauaaacaggagcaaauucuuuauguguacauauuuacuuacacaucaauuauugaucuuguuagaaugaagaauauuauuuaaaaugaaaaacuuacuggauuuuuuuucuuacccucuauagcuucuggaagaaaaguguuguggaaaauuggaucauaucaauuucccaguauuugaaccaaguacuccagauccugcuccugcuaaaaaugaauccucuccugcuccuccagauucggaugcugauaaacuuaaagaaaaagaaccucaaacccaaggagagagcacgagccugaguuuagcuuugaguuugggccaauccacagauagcuuagguaccuauccagcugauccacaagcaggaggagauaauccagaaguucauggucaaguagaagugaaaacugagaagaggccaaacuucguugaucgacaggcauccacaguugaguaucucccaggcaugcuacauucaaauugcccuaaaggucuccuacccaaauucuccagcuggucuuugguuaaacuaggcccugcuaagucuuauaacuuucauacagguuuggaccaacagggcuuuauuccaggaacaaauuaucuuaugccuugggacauugucaucaggacuagagcugaagaugaaggagacuuagacacaaacucuuggccugcuccaaauaaagcuauuccuggaaagagaagugcgguuguaaugggaagaggaagacggcgagaugacauagcucgagcuuuugugggcuuugaauaugaagacucucgaggucggagauucaugugcucugggccugacaaaguaaugaaaguaaugggaagugggccaaaggaaucagcuuuaaaagcccuaaauagugacaugcccuuauauauucugucauccucucaagguagagggcugaaaccucauuaugcucaacuuaugaggcuuuuuguugugguuccugaugcuccuuugcagauaauacuaaugccucagguaagaaauauaacccucugcagccccaaacaaguaaaaaaugcugauguuuguuuugauugauuuuaaaaaguacaaguuagccucaaaacuaauuauuucaggcugagggcaguggcucaugcuuguaaucccagaacuuugggaggccaaggugggaggauugcuugagcccaggaguuuaagaccagccugagcaacauagugagacuuguaucucuacaaaaaauuaaauuaaaaaacgaauuauuuaauuaaacaggucuuaaauuuaaauaccuuccauaccuaauauucuguuuuuuaaaaaauacauuguggguauuuuaauccguucaugcuaucaauucacaucauuucauucaaaggcagaacuugaaguuaaaauucuggagaaaaggccggguacagugagucacgccuguauuuccagcacuuugggaggccaaggcaggcggaucaccugaagucaggaguucgagacaagccugggcaacauggcgaaaccccgucucuacuaaaaauacaaaaaauuagccaggcgugguggaaggcgccuguaaucccagcuacuugggaggcugaggcaggagaaucacuugaaucaaccuguaagcggagguugcagugagccgagaucgcgccauugcacuccagccugggugacuaagaaagacuccauucccccugcaaaaaaaaaaguucuggggaaaagcagaauaauauuugagacuaaauaauauacuauuggauacaauuagaguuaggaguguacccauaucugcuuaaucuuauauauucuuuuauuuauuuauuuguuuguuuuuuugagacagucucgcucuguugcacaggcuggagggcaguggugcaaucucagcucacugcaccuccgccuccuggguucaagcuguucuccugccccagccuccccaguaacagauuacaggcacacgccaccacaccugacuaauuuuuuguauuuuuaguagacaugggguuucuccauguuggccaggcuggucucgaacuccugaccucgugauucaccugccucagccucccaaagugcuggaauuacaggcgugagccaccaggucuggccuuguauguucuuugaaccuaucgucuguuuaggcauuuaucuuucaguuguuucauauugagaaaugugaaaauaauuauacuaccuguguuuuucagguucagccaggcccaccaccauguccgguauucuacccagaaaaacaagaaaucacccuuccaccugauggccuuuggguuuugagauuuccuuaugcauaugugacugagagaggaccuuguuuccccccuaaggaaaaugugcaguuaaugagcuacaaggugcuccgugggguucuuaaggcaguaacacaauaaguguuuuccagccaguucaauccuauacuugagcugguuuuuguuuuugguauuuguggcuguguuuuugguauguguuuacuguguuuucccaaauccaaaauguguuuugguuacaggaguucaguauuuggaaacuaauuuguucuacuuuuucauuauauuguugauauuuauuguaaacgugacuacaacuuucuaauaaagauugguuguucuagaaaagaauauaaaauacauggaugaua

SEQ ID NO: 192292 - RNA, 45493 nt, Homo sapiens
aacuacaaaauugaaaguagagaggagggggcagccaauggaaaaaaaaauuugcacagcagccaauccuccugcggcguuuugugccuuugcccaacaggaaaaugugucucaugcagaggggcguuacccagucuccaaugggcgggagccgguggaacggaggagccaaugagugcgagauguugagugacagcuguccaauggaggcccuccgugcuaguacggcuugcggcuuaagcgccgccgcggucugcggaaugucaacuauucaacauggaggcggaggucgauaagcuggaacugauggugagugcaaagugaaggagaucuacuggguaguuuauuuuucccccauggccucggagguggggcacaauuuggagucgccggaaacuccgggcggcggaggcuggaccagagucgaguucccuccuccugcaccaaagggagccgccaccgucuggugucuaaaccgccucggguaagggguuacauccgggaaacucgucagggaaauggcgggagaugcugagggugcggggccuuuggaauuccuuguuccuugcccucaccuuuacaccccuuacgaaacugcgccgggugcagaccgcauucuguguuuguaccaaaaaagaugugaauggaacggucccuaagcgucccaagaagggagaggugguucacacuccaagaaaggggaacggagggugggguggggaauaaacugacgggggcgaggagaaaucccuguagggccaacccgcucacguucuaaaaggcgggccgagaaagucugagaaaggaugcuagacuuguaugcacaacuuccuaacggccaaggaacccguuucuguuugauccggagguggcaaaccgugggugagggaagaggugugagcgaaggggaucguaaccacgagcuccgcucccggagcgcgggcgggauugagacaggaaaggcauccugcucuggaguugugcacuuucauucaucugugaaaguagaaaacgggggcgaagaauuggaaagcacucccguuguugcuggcguguuuggccugcucggggggcgcccagcuggggggcuguccuaguuuucuuuaaggauccgucccucacuuguucucuuuauucccucccucccauccuuagauuaccagcuugaucgcccgcgcuuuuuuccucuuaguguccuuguucugucuucagcccuuuucguucagcauuaucuuuuuuuucuuuucuuuucuuuuuuuuuuuuuuucccagguugggcugcuuuccuuaaaaaccuggacuuuggaggaagcgccugccacugagcuccugucuuuuuuuguuuguuugcuugucuguuaaauacgauuggccgggcgcgguggcucacgccuguaaucccggcacuuugggaggccgaggcgggcggaucaagaggucaagacauugagacuacccuggccaacauggugaaacuccgucuauacuaaaaauaaaaaaauuagccgggugugauggcacgcgccuguagucccagcuacucgggaggcugaggcaggaggaucgcuucaaccugggagacggagguugcagugagccgagaucgcgucacuguacuccggccuugcgacagagacaacgucucaaaaaaaaaaaagauuaaguuuuaaaaaaguaaaagacuucuuucuucguuuguaauccgucccuccuucccacgccauucccuggcauuacugcuuagguauccuuugugccugcccugcuuucuucaagcugaaucuugggucucuaacuucuuccuuggaaaggauggguggugauccuggaagaaaccucacccaccccccauucccaccccagaaaaagugaggccuugauauaucuuauuuucuucuguugugcuaaugaauuggagugccucucauauacaaauuuaauuugaaggcuuucaauuacuuuuagcauuuuguguuuaaauuuucuuugugcagugugugugggguuggagaaguguagggagaaaugggagggaagaaggaagaauuuccugcagauuuucaaaccuguaauaaugaacuuuuaguuuuaaguuuuauuaucauuuaaaaaaaacaaaauguuaagcauuguaauuugauucugucaacaggcuuaaauguuaagacuaucuugcccuucucccauucugaauuccucccuacugauauagauauuucugcuuaaauucauaauucauuucugcuaaaugaugcuaauucugcuuuuaacagguuguuugcuucucaaauuggcuguuucuaauuuuuaaacuucgucuggcuuuuacaguagagucaguauucucacaggacuucuuuagauugaacaaauucucuuuuaagugaacaaugaugaaguaaacauuuugaaaaaguagguuuuagaaaauuauaagguagccagacauuuaaacuuuuagguauuguuugaaugaugggguaguauuuaaauucuuuuugaagacaggaaaaaaagaaaugagguuuuuuuccuuucuuacauccuugcaaguaaauuagugguagcuuuuuuuuuuuuccuuucagguuauuaguuuguuuccauaauuauuaggguuuagaaaugaauuuuuaucauggcucuaauuauuacugcuuuguguugacuagauaauaaaagacagugcaucucaucuucagauuuaccaugugcuucuagaaaaaaauguuauacuuguggaccaguuuauuuuauaagauuuuaagaguaaaugauuccugugcuaucuucugauuuuugguuuuacaucaguuaaauaaaggauuugucaagguaaaaggaaaugcauaauauuuaauuugaaaagaaaguguuuauccuaauuuuguuaauaccuuaaauuuuuuaaauauuuuucuuguuuguaauaacuuccaauucagaaaguuaaacacuuaucuuuuaaacaguugucuuuaaaaccugaaacuuggcuaccagcguuaaauauucuaauauuuuaguuauguggcccaggauuugacaccaagacacuuauauuucagcuguccuuuguaugagcccauuuccuuaguaggcucaauccgacuaaguaguugaauuggaccguuuaaagggagguuggugaaaauaaugaaaauauauuuuugcaucaaucaacauuacuaaugggggaauaagcuuauuguagggcaaucuuuguucucugacuuuuuccccuucacuuaaugauggggugguauuuguuuagcuuuguucuuucgugguacuacuagugacuguacacaaaagguaaugcagugugauacuaugauacuauuucuguuucuggguuuacaucugacuucugauuggguucuuauccguuaaaaaaguuaaaaugucaauuagcuuggaacuaaggaaacuuguuacuuaaaucucagucccaccuccccccaucauuauuuucucuuugacauuucuaaguuugaaggaaauggagaugcuuucugccucuauuuaagauuucaggaguuaacugaaauuuuaaaauccccuuggauaguauucaguuagauaggguuaauguucuguuuagagcacauugauucccuucuguuguuaugacagcccuuaguaaacucaagauaaaaagcuguaagaugguaagugcuuuuguguuuucuuuguuuagugguuuagauuccagagugauagauugaguauguagagauugagaaacuuauuauuuuacuuuucauuuguuuucuuugauacuuuuauucaaagggcuuguuuuacauggcguuuaaucaguaaauugccuugaagaaggagcuaaccaacaucucugcagagaacaaaaauauuuuucacaacuuugccuuaguaguaauuauaacugguuuuguuaauaccaauccuaaaguauuaacaauacccauucuaauuacuauuaaggcuuagggcauauuuacaaaauuccuuucuacaucuaugcauguuucuguucgaauguuaauuuguauauuagucaucaauaagcaacaucacuuugauauuuaagucuuauccuuuuuuaaaaaaacauugauauaaauguuuuuugguuuuggauguuuuucuguccaaaauggcaacccuacuuuaaauucguuucucacugaagcuucaaccgaugcaagaugcuuuuguguuccuuuccuacuuauuacugcuaacgaaugcucugacuuuauugcacuacuguacuuuacagcuagcagugcaauaguauugucaaagcaucugaaagcaggaugcacgccagaauuuugauucuuaccuuacaucuuucuucgguaucaguaaauaauuuaccacaaccuuuguugcugagaacuauaauguuguuacuaacaguauaucuuuuagaaagucauaauuugaaaaaaaaaaaccuuuuaacuaauuaaaaacaauauuuuacugcauuaugaaacacgucuggagaauauuuuuuauaucuaaguuguuaugguuugucuaaaugaguaauacuuuauaauuuguugcuuucuguuacauauuuggauagguucugucaaacuuuagguuuuauuugaguuuuaugaugaauugguagugauggaaacaauuucugcuguauauuuuuccugcaguuacuugccccaagucauuuuuuuuucuccagagacagagucuuucucuguugcccaggcuggagugcaguggcccaguuacaccucacugcagccuuguacucccgggcuuagauaauccucccuccucagccuccuaaguagcugggaccacaggcguguccuaccaugccuggcuaauauuuucuugaaauuuuuuguggagacagggucucacuguguugccgagguuggucuugaacuccugggcucaaacaguccucuugccuuggccucccagagugcugggauuauaggugugagccacugugccuaguccuccaaaucuuaauugguguuaauuuuguguauugucuaggaaaugguugaauuuaaaaccuaagaguguuuguuuuacaguuuauucuuaugagauacaauaguguggauucaucacuuuuaaaaaauaugaauuuuauugagauacaauuauauaaaauaaaaguaaguaagcuauuuguuaagcaaagccgaagucuugcuguguugcccagcuggagggcagcgacuauucacagaggcaaucauaaugcagcacagccuagaacuccuggcuucaagcaauccucccacuucagccuccugaguagcuuggacuacagggguguggcaugcccagugaacugacgaguuuugacaaauguauacagucauguaaccaccaccacagccaggauauagaacauuucuguuacuuuacaaaaagcuccuuuguggccaggcaugguggugcaccuguagaccuagcuacucggguggcugaggugggaagaucacucgagcccaguaguuccagaccaggcugagcaacagagugagaccccuacauuccuuugugccucuuuguggucaaccucuucuuccccaagucccuggcaaccacugaucucuaguuuaacuuuuccuagaauuucauauaaauggaaucauacauuauacagucuuuugugucuggcuucuugcacuuagcauaaugcuuugagauucauccauguuguauauuagcaguuggacaguuuuuauugcugaguaguauucauuguauagaauaucacaaacucuuuauccaccaacuuauagacaucgggucauuuccacguuuugcauauuaugaauaaaauggcugugguuggucucgaauucuugagcucaagugauccuccuguguugcccucccaaaugucuuuguuuaauuuuuuuuuuagcaauauuuuuuucuuuuucuuuagagacagggucucauacugucacccaggcuggagugcgguggugugaucauagcuuacuguaccaucaaacuccuaggcucaagcaaucccaccucagcuugcugaguagcuggaacuacaggugugcaucaccauaccuggcuaguugaaaaauuuuuuuguagagaugaagucucacuauguugccaggcugguucucuaacuccugggcucaaaugaucuucccacuucagucucccaaagugcugggguucugggagugagucgccaugaguaugucuuuguguggacguaauguuuucauuucuuuugaguaaauacugaaaugggauuucugguagccugauaaauguauccuugggggaaaaaaaguaugcuugaucuuauaagcaacugcuaaaauauuuuucaaaguggcuguacuauuuugcauucccaaagcuauugauaaggguucuaguuuuuccauaaccuuaucaacacuugguauuagguugaugcaaaaauaucaguuuuaauuuuaacccuucuaacaguuaugugguggugccccauuguaguuucaauuugcacuuccuuaacuaaugauguuaaaccuuuuuucauaugcuuauuuguaguuuguauaucuucuuuagugaaaugucucacaaucuuuugccuauuuucuuuucuuuuuuuuuuuuuuuuuuuuuugagacagggucuuguucuauuacccagguugcaguacaguggcggucacagcucacugcagccuugaccucccaagauucagaugauacucccccaccucagccucccaaguagcugagaccacaggcacgugccaccacuccuagcuaauuaaaaaaauuuuuuuuguacuagucugggcaacauggcaaaacccccucaucucuacagaaaaauugaaaaauuggcugggugugguggcgcaagacuguagucccacauacuugagaggcugagaugggaggaucaccugagccuggggaggucgaggcugcagugagccaugauugugccacugcacuccggccuauugacagugacauccuaucucaaaaaaauuuuuuuauuuuuauuuuuuuagagauggggucuuguuauguugcccaggcuggucucaaacuucugggcucaagccguccuccugccucagccuuccaaaguacuggaacuacaggagugaaccacugugccggauagagaauuguuauguuagcaauaucgagcccucuggugcacaaacauaucuuuucauuuauuaggucucuaaaauuuucucucgacaguuuugcaauuuucaguguguaggucugcuuauaauuuuuuaaaauuaaaaacuuuuuuucuuuuuuuggcugggcaugguggcuuaugccuguaauccuagcacuuugggaggccgaagcgggcagauuaccugagggaguucaagaccagccuggccaacauggugaaacccugucucuacuaaaaauacaaaaaauuagccuagugcaguggugugccccuguaaucccagcuacuugggaggcuaaggcaggagaauugcuugaaccugggaggcagaaguugcagugagccaagaucucaucacugcacuccugccugggcaacagagugagacuuugucucaaauaaaaaaaaaauuuuuuuuuuuuuuuuugcuuaaaacaauauuuaauagucuguuuagugugauuucuacuagugcucuuaaaaauagagcaaaggccaggcacgguggcucacaccuguaaucccaacacuuugggaggcugaggcaggaggaucacuugagcccaguaguucgagaccagccugggcaacauagccagacuccaucucuaauaaaauuaaaaaaaaaaaaguagaucaagaacaguuacaacauggguucuaaacgcauugaauuucagaagaaaguaagcuauuuguuaagcaaaaguccuuuaaaaauaguugggaaaauacagauaccagagggaagaaagauaccuaaaauguuaggcaugaacucaaggacaucauuuguagagaaugaaggacauaaauccucaucauaaagccauuuuauuccaaaugugugugugugugugugugugugugugugugugucuuauauauaaaauuucuuucuuaguuaccagcccuggccuuaagcgcagcugcuuuccucuuuggcuuuuaauuacaauuucuuacuguucucuagugggcuguuagaauaguggguaggauuuugauuuuguuuuuguuuuuguuuuuguuuuuuuaauaaccuagaggaggggccaagggguucauuugaggacauuguuucuuuuuuuauuuucugagauggcguuuugcucuuguuguccaggcuggagugcaaugcugugaucucggcucacugcaaucucugucucgcagguucaagcgauucuucugccucagccucccuaguagcugggguuacaggcaugugccaccacgcccgucccccccaaaaaaaaagaaaagaaaaaaagaccaucccagauuggcuaggugcaguggcucacgccuauaaucccagcgcucugggaggccgagacagaggauugcuugagcucaggaguuugagaccagccugggcaacauagcaagaccucgucucuacuaaaaauaaaaguaaaaacauuagcucgguguggugacaggugccuguagucccagcuacguaggaggcuguggcaggaggaucauuugagcccagaagaucaagacugcaaugagcuaugauugugcugccacugcacuccauccuggguuacagaacaagacccugucucaaaaacaaaaaugaagaaagaaagaauaucccagauaaauaaaauagcuauucuuaauuagauuuuauaagcucguacuucuaauuuaucucaauauauaacauuuuaaaaguuagaaucaguccuugauucuuugaguucaauauuuuuauucucauuuuauuauuuauuuauuuauuuugagacagagucucacucugucacccagguuggaguguaguggcaccaucuuggcucacugcaaccuccgccuccuggguucaagcuauuugccugcgucacccucccgaguagcugggauuacaggcgugcaucgccaugcccagcuaauuuuuguauuuuuaguagugacgggguuucaccacauuggccgggcuggucucaaacuccuagccucaugugauccucccaccuuggccucucaaaagugcugggauuacaggcaugagccaccgagccugguguagucucauuuuaucaauaaggaaauaaucuuagccaauuuuugcuaagguuucaucuagugauuuagugacugcaaaauaaauauaacuuuuuaagacauuuuuguuaguaaauguaagagcuguaguuuuacaaauccuuucucuccccacuuaauuugccuaauuguagauaaaagugcuuccuacuuuguuucauuauguguuuccuuuuguuuuuuuuuuugagauagggucucacucugucacccaggcuggugugcaguggcucaaucacagcuuacugcaaccuugaccucucgggcccaagugauccucccaccucagccuuacgaguagcugacaccacagguguugcaccaugaugccuggcuaguuuaaaaaacuuuuuuagaggcgugguuucccuuuguugcccaaacuggucuccaacuccuggacucaaaugauccuccuaccucagccucccaaauuguugggauuacaggcuugagcuaccaugccuggccuuauuaaguguuucuagaucgggcuaguaacagaggcuaaagauauuaagaaacuuaucugggagacacagauaaauauguugacuaauguaucugugauuaaguacacauauaaauuaaauacagaugacaugaugggaaaaauagauacuagauauuaugggggcacauuggaaagaggaaacuaaccugggaaagauuucuucuuagaggugagauauaaucugagacuugaaagaugaguagggauuagccaacugaaggagagggcaaauauuccaggcagaggaaauaguacaugugaacguccagagaugaguguuuauuguacaacugggggaaacugcaaggguugcaguauacuguugagagggagagcuaggaguauugagaaaguaagaucaauauucuagcuauuaaguuuucuuaccauacuguuuauuacguuugugaacuuuuuucccuauuuuuuuauuguguuaaaauacauguaacauaauguuuaugaucuuaacaauuuuaagugguauuaaauacauucauaauguugugcaaccaucaccaucauccaucuccauaaccuuuucauuuuguaaaacugaaacucucaacugggcaugguggcucacaccuguaaucccagcacuuugggaggccaagguggguggaucaucugcggucaggaguuccagaccagccugggcaacauggugaaaccccgucucuacuaaaaauacaaaaaauuagcugggugugguggugugugccuguaaucccaacuacucgggagacugaggcaggagaauugcuugaacccgggagguggaggaugcagcgucgcccucuaaccugggaaccugggcgacagagugagacuccaucucaaaacauaaaaaagaaacucuauacccauuauacaauuacuccucuuuuccccuccccccagcgucuagcaacuaccauucuacuaucugucucuaugauuuagacuacucuaaauaccucauuuaaaugaaaucauacaguauuugucuuuuuauuauuggcuuauuucauucagcaaaauguucucaagauucauccauuuuuuuguggcagcauauugcagauuuccuucaauuuuuuaaggcggaauaagauuccauuguacguauguacuacauuuuacuuauccauucaucccuccauggacacucguguugcuuccuuguuuuagcuauugugaauaaugcugcuaugaaaauggguauacacauaucucuuuaagacccuguuuuuaguuguuuuagguguauacccagaaguggaauugguggauaauaugguaauucuauuuuuaguuuuuugagaagccaccauacuguuuuccacaacugcuauaccauuuuacauuuccaccaacaguggacaaggguuccaguuucuccacauccucuccaacacuugucuuuuuuuuuuuuuuuauggugacuauccuaaugacuaugaguagguuccuaaacacuuuuuuuccuugagauggagccucgcucugucaucaggcuggagugcaguggcgcgaucucggcuuacugcaaccucggccucugggggcgugaucucggcuuauugcaaccucggccucugggguucaagcgauucuccugacucagccucccgaguagcugggacuacaggcgcaugacgccacgccucgcuaauuuuuguauuuuuaguagagacaggguuucaccauguuggccgggauggucucaaucucuugacaucaugauccgcccgcuucggccucccaaagugcugggauuacaggcaugagccacugcgcccacacuccuaaacauuuuuaaucauuuuaaauucauauucuauaguaaucaugaaccuauauuccuuaauuuaaaacaucuacauguaaacauccaguuaaaguuuuggggccaggcgugguggcucacgccuauaaucgcagcauuugggaggccguggcgagaggaucaccugaggucaggaguucgagaaaaauacaaaaauuaugccaggagcaguggcucacgccuguauucccagcacuuuuggaggcugaggugggcagaucaccugaggucaggagcuugagaccagccuggccaacauggugaaacccugucucuauuuaaaauacaaaaaaauuagcugggcacguuuguaaucccagcuacucgagaggcugaggcagaagaaucgcuugaaccccagaagcggagguugcagugaacugagauggcgcccuugcacuccaguguggacaacagaguaagacucugacucaaauuaaaacaaaaaacaaauaacgaaaauuagccagguauggugguaggggccuguaaucucagcuacuugggaggcugaggcaggagaauugcuugaaccugggaaguggagguugcagugagcugagauugcaccacugcacuccagccugggugacagagugagacucucucaaaaaaaaaagaaaaaaguuuuggauaaaauauagggaaauucaacagcuccugauuaaaaccauuauauauugauuauucuauacuuguuauugcucuauuugcuacaagauaccauaaauaagagagacaucuuuuaaaaauaaaccuagcugggcaugguggcucacgccuauaauccuagcacuuugggaggcugaggcaggaggauuguuuugauuucuggaguucaggaccagcuuugggccacacagugagacacugucucucucucuuuuuuuuuuuuuuuuuuuuuugagaugggguuacgcucuuguugcccagucuggagugcaauggcacaaucuuggcucacugcaaccucugccuuccagguucaagcaauucuccagccucagccucccgaguagcugggauuacaggugcccaccaccacaccugacuaauuuuuguauuuuuaguagagaugggauuucaccauguuggucaagcuggccuugaaccucugaccucaggugauccacccaccucggcuucccagagugcugggauuacuggcaugagccacugcacccagcccugucucucuuuuuuuuuaauauuaaaauauaaaaauuaaaaaaauacauacauaggcugggcacggugacucacgccuguaauccuagcacuuugggaggcugagauggguggaucaccugaggucgagaguucgagagcagccugaccaacauagagaaaccccaucucuacuaaauauacaaaauuagcuggaugugguggugcaugccuguaaucccagcuacuugggaggcugaggcaggagaaucgcuugaacccaggaggcagagguugcggugagccgagaucacaucauugcacuccagccugggcaacaagagcgaaacgccaucucaaaaaaaaaaaaaaaacccaccauauauaaacuaaagaauuuaucugaauauucgugcaauaacaccaucccugucacuuacauguacuaccaugaccuacucugauuguucucaaagaaaauagaagaauugugguaaagugaauaauucaccccauuucuucacuucugccuguauccacauguuugucaugacuucaugaugggcagaguacauuuuucuccucuugaugugcuuuggucaauggcauguggguagaauugacagugugcagcuuugaacuugggccuuuaagagaccuugaaucuuucugcuuacucuuauguuuccucuagcuccaugagaauaucucauggguucaaagaggaugagagacaccaguagcaaagguccuaccaggcauccuccagaauugcugugugaagcaaagccaccaaacucagccuagccuagaguaccugaaccgggucaaugugcagguccaugaaaauaaaugaucaguuuuuaagccacugaguuucuugguaucacgugccauaauuuugaaguaugccuaggcucucuuuuuuuuuuuuuuuuuuuugagacaaggucucguucugucaugcagguuggagugcagugaugugaucaccacucaauccagccuggaccucccgggcucaagccuauuucagccuccugcguagcugggacuauaggugcaugccaccacacuggcuaguuuuuguauuuuuuguagagaugagguuucaccuucaccauauuggcuaggcuggucuugaacuccugggcucaagugaucuaccugccucggccuccccaagugcuaggauuacaggccugagccacugugcacagccgcggcugucauuugaguuacacaauuuaucuauuuauuuauuuauuuagagacagagucuugcucugucgccaggcugcaaugcaguggugcgaucucggcucauugcaaccuccgcuucccagguucaagcaauucuccugccucagccucccuaguagcugggacuacaggcgcacgccacuauacccagccaauuuuuguauuuuuaguagaaacaagguuucaccauguuggccaggauagucucaaucucuugaccucgugauucacccaccucagcaucccagagugcugggguuauaggcaugcgccacugugcccagccgaauuacauaaauuauuuaaggcuuggagcaguggcucacaccuguaauccuagcaguuugggaggcagaggcgggaggaucgcuuaaagucaggaguucgagaccagccugggcaacaaaacgagacucugucucuacaaaggaaaaaaaaaaaguuaaguagucuacuuugacugauaaaacuagccuuuuaggccaggcgcgguggcucaugccuguaaucccagcacuuugggaugcugaggcggguggaucacaaggucaggagauugaggucauccuagcuaauacggugaaacccugucucuacuaaagaauaccaaaaaaaaaaaaaaaaauuaggcgggugugguggugggcaccuguagucccagcuacuagggaggcugaggcaggagaauggcgugaacccgggaggcagagcuugcagugagccgagauugcaccccuacacaccagccugggcaacugagcaagacuccaucucaaaaaaauaaaaaaauaaauaguacaaauaaaacuagccuuuuagaggcaggggcuuauguauauauccuagcaauuguuccauaaaagccugcagauugggccgggcgcaguggcucacaccuguaaucccagcacuuugggaggcugaggcaggcggaucaccugaggucaggaguucgagaccagccuggccaacauggugaaaccccgucucuacuaaaaauacaaaaauuagccaggcaugguggcaggugucuguaaucccagcuacucgggaggcugaggcaggagaaucgcuugaacccaggaggcuugaacccagugagcugagaucgugccauugcacuucagccugggggacaagagcgagacuucaucucaaaaaaaaaaaaaagcuugcagauugggaacugaugaaccugaagcccuugcucacuuuuauccccucugguugccaauugccugaaauaacaugucugugaccugguguuagggcauguuacugcuuaucuguuuuggacaagcauagucaugcauuuguucuguuuggaagagagaauggguaauagucaauacuuucuccagcagaaaaaggcaaaaaccaauuuugauuguggagacaugauauaagugguccuuagcuugcugggaacuugaaauauuucccuuaaaacguguuuuaaaggguaguuggguucccaggugguuuguucuuucaaaugaaugaauguuuguucuuucaucuauucccuuuugucacugcacauuaggcuguauauuaaaaacuaaggauacaaaaaagcgaucucuugccaggaagauguuugaaaccauguggcgacauuaccauguaaacauagauuaaaauauaauacaguagaugguaaaccaaagccaugaacaaaguaaaaggagaguagauaaagguguuucuaaauguacauugaagagaagaaaauguacaaaaaguagauucuggccgggugcaguggcugacaccuguaauccuagcacuuugggaggccaaggcgggcagauuacgugagcucaggauuucgagacuagccugggcaacauagugagcacucaucucaaaaacaaaaaaaauuuaaaaauaaaaauaaaaguagguuuuuugauuauagccaaacuaguuccauuaagauacuuaauucucccuuaaaauguuucuauggaaaaugcauuucuuuuuuuuuuuuuuuuuuuuuugagacggagucuugcucuguugcccaggcuggagugcaguggcgccaucucggcucucugcaaccucugccucccagguuuaugccauucuccugcuccagccucccgaguaucuggaacuauaggcauccaccaccaugcccagcuaauuuuuugaauuuuuaguagagacgggguuucaccguguuagccaggauggucucaaucuccugaccucgugcuccgcccgccucagccucccaaagugcugggauuacaggcgugagccacugcgcccagccggaaaaugcauuucuaagccuguuuaguaaguccagaacacaccugucuaccaacucuucucuaugccuagcccaccauaggugagacugaaauacuuuuuuucacuuuauguaauuuaaugcuguugagauaaggucucucauaagaggauguguuuagagcuuuaagggcacugguccuuuguaggagagcauacgguggcaaugagaaucuagggguuguuuguaaaaagcaaguguuuuaaaacugaggaccacacaguauauugugacaaccgcaauauauucuuuucuccuugcugccuaauaguugaguaguauggaauaccuugugccacuuacuuaaagccuuaaacuggucauauugaaaacuagacuagaacaggcugggcgcgguggcucaugccuguaaucccagcacuucaggaggccgaggcgggcagaucacuugagcucgggaggucaagacuagucugggcaaaauggugaaaccccaucucuaccaaaaauacaaaaaauuuacuaggcguuguggcgugugccuguagucccagcuagucgggaggcugaggcaugagaauugcuugagccuggaggcagagguugcagugagcugagauugcgccacugcccuccagccuaggcaacagagugagacgcugucucaaaaaauaacaaacaaacaaaacaacugguugagcaucccuaauccaaaauuccaaaaucugaaaugcuccaaaauccaaaauucauuggaccauuucagauuuugaauuuucagauuagggaugcucaaccaguaauuauuaugcaaauauuccaaaauaggaggaaaaaaucagaaaucuaacuggcagaauguaaccugguuucccuuggggugcuuucaugaugauuuccauagacuuuuuucaccuaauuuuguauuuuauauaccacuuuucagaucaguauaaaacuuuuccccuuuauuuuuauuacugauuuuagagaaaacugguuucugaaauacgaauaucuugggcuuuacaaaaaucacuaguuuuauuuuaaauauuccauugccccuaaaaaguuaaacaauaaccucacugauuuccaaggcuuccaggaggcugauuuguaacugaaagggcugugaaugauguuuaucagaaucaaauuugcgcgauuuaucagacacuaaugaguuuuagauuaucauaauugcuuagugaauuucugccaucuaacuaaaaaaaauucuguuuaucaccagauccuagaacccuaucaauauugucucugcuguguaaauaguucugaguagugcaauauugcuuauaggguuuugguguuuggaaagaacaaugggcaggcugcagaaaguauguagcagaaacaagcaaaagucaucuuuaggaagaaaacaaggaacuagauuucacuauaaacauuaaaaucugaggcuuaaauguaaauuuuuaauuuauuagaagaagguaacuuuucuuuuugacaaauggguuuauuuguaguauaaagaaauaauggaauuuuaguauugaaaaggaucuuagauuccaacucauuugauaggagagacccaaagaaaugagggacuuaaccuagggacacauagcugguuagugauacuaggacuagaauuucuaccauguauccgaauucuuuuauuuuucuguaccauacuaccauguuguguucagagggaauuuuuaguugacuagcuuuguaacuuuagugauauuaauuuaaaacauaaaaaaacuuuaauuuuaggugaagaauguacauuuuuggaugggugugguggcugacaccuguaguuccagcacuuugagaggcuaaggcgggaagauuguuugagcucaggaguucaaguccagccuggguaacauagcgagaccuugucucuacaaaaaaauacaaaaauuagcuggguuugguagugcacgucuguagucccagcuacucaggaggcuuaggcaggagaaucaaaucucuugaguccaggagguugaggcugcagugagcugugauuugugccacugcacucgccugggcaacaaagcaagacccugucucaaaaagaaaaaaaagaauuuacauuuuuuccacaugugugacucuuaauggcuuaaauaucaucuauaacuuugucuaacuacauaagaaaacaguaauggaaauagaacuagaggcaaguuacuuugcuauuuucucauuuauaaaaugaaggguucagagcagacauuuaagaugauuuuucggcugggcgugguagcucacaccuguaaucccagcauuuuuggaggccgaggagggcggaucacaaggucaggagaucaagacgagccuggccaacauggugaaacccugucuguacuaaaaauacaaaacuuagcuggguaugguggugcacgccuauagucccauccgcucgggaggaugaggcaggagaaucgcuugaacccgggaaguggagguugcagucagccaagauugugccacugcacuccagccuggcaacagagugagacuccgucucaaacaaaaaaaaaaaagcuuauuuuucuaucuuucaacauuuuggcauccuuuuugcccccugcuuauucccuagcccacugacuucacuaauaagccaguacuggccaggcacagugguucacaccuguaauccuaguacuuugggaggccgagguggguggaucaccugaggucaggaguucgagaccagccugcccaacauggugauaccccgucucuacuaaaaauacaaaaaaugagccaggcaugguggcaggcgccuguaaucccagcuacuugggaggcugaggcaggagaaucucuugaaccugggagguagagguugcagugagccccgagaucgcgccacugcacuccagccugggugacaagagcgaaacucggucuaaauaauaauaauaagucaguacugccccuguguguuauuagacguucuauacaauuuuccacagaggauaacauucuacccacaagcuguuuuuuuuuucuuccuuccucccuuccuuuuggagauggggucucacuauauugcccaggcuggagugcagugacuagucacaggagagauuauaauacacugcagccuugaacuccugggcucaagcaauccuccugccucagcucuuuaaguaacugggacuacaaguacacaucaaaucuagcagaagcuguuuuucuugucuuuuuaaaaaaauauuuuaaaaauuauuuuauauuuuuuaaaaauauauuuuuuaaaauauaaaauuaaauaugcaauauaaaauuuuaaaauauauauuuaaaaauuauuuuauauauuuuaaaaauauauuuuuuaaauauauuuuuucaggaugggugugguagaaaauauuuuuuucagccaccguguccggcuaauuuauauaauuuaauuuguaaugaugccuauguuuaauaauugucuugcaaaaaaucuugacaguuuaggcugggggcaguggcccaagccuguaaucccaccacuuugggaggccaagcauggcagaucacuggaggucaagaguuugagaccagccugggcaacauggugaaaucccauuuuacuaaaaugaguaaaaauuagcugggugugguggcgggugccuguaaucccagcuacuuggaggcugaggcaggagaauugccugaacccgggagguggagggugcagugagcugagauugcaccacuauacuauagccuggaugacagagugagacuccuucuaaaaaaaaaaaaaaaaaaaaaaaaagacaguuuaguugauuucaucauaccauugauuagaaggguacucuuugguaucuuccuaaaauaaaaguuauuuaaaaguagaaaccgccucuuuuugguaccauuugaugguuaacacauuuugggccccuagguauugcaggaaaccauaguggaaaccucucucuuaaaaagaugccaggcugguggcucacaccuguaaucccagcgcuuugggaggccgaggcaggccgaucacuugaggucaggaguucgagaccagccuggccaauauggugaaaccccgucucuacuaaaaauacaaaaauuagucaggcguaauggcaugugccuguagucccagcuacuugggaggcugaagugggaggaucuguugagccugggagguuggggcuguagugagccgaguuguugccacugcacuccugcuuguaugacagagugagacccugucucaaaaaaaauaaaugacaaaaauauauauaugaauauagucuacauuugggaguuuugugucccccaaacucaucauguuuugugacauauacguuagauuauuguaaaaaucuuucaaaccuuggaggucucaguugccaaauuuaggacaauuuaggccuguagucccagcucucaggaggcugaggcaggagaauugcuugaaccccggaggcagagguugcagugagccaagacugugccacugcacucuagccugggcaacagaacaagacuccuccaaaaaaaaaaaggaaaguuaccauucaaggaacuacaugagauuaugcuaaacuucaagcagaacuaaauaucaaguuaaaaaauauguaaguuuaauacuucguuucauaaacauguuaaggguuucuagaauagagauucugucuuaggaaucucuggagccacaaauuccauaauuuaugguaaauuaaaugacuaaaacaagcuuuaaagacuuguauuuaaaguugugcuuaagaauguuauauaacucauugaaaaaagcuauggaauuguggucuguucaguaauuaagacaaacaaaaucaggucuugagugcucacagccuuuguuaacuuugauuugcucuggcuccuggucucuccucauucucuccauccacauguuuuauggguuaguguacuuuucuuauuuauaggaaaagauaaucccuaaguauaucuuaguaugagaaauuaugcaaauaggaauuucuuaauacacacacagacacaaacauuaguauuuuuaaggaguuguaauuauugauuaauuuaaucguggcaucucaucugacaaguauagaggauaaaugaaaagcuuccacuuuuuggaaaucauuuuaaacacacuuuguaauuauguacccaacauuaauuuuucuggcuuagagcaacucccugauguuagagauggaaauaagauauugaccuggaaaauauguuuaaaaacaaaaaccuucucuuucuuuuaucuguacccuccccccaaguuuuggcuauaaagauagaauuuuggucauugcagaguuuuccauuccaauuuaggucaaugauaagagaaauuauuagugauggaaacuaguuuauuucugaaauucuguuugaugacagcuucugaccuuagaagcauuugaauuucugacagccauuuugucuuacucuacauuugaaaguaggguccuaauagaaccuuuuauauacuaaaaauaacuguacaucauuucuuauuagaccugagaacugcuuuuaacaguuuuuccccuuccacuaaggcuucaggauuuugagaaucaaucuuuaguucagugauaaaguucauaauaagagcagcacccucccugcaaacagccuccuauguuuugggauaggaauaggagaccaugccuguggaaaucauguuuuccuuucuguaguaaacucuaaggacaguuauaucccugauaaacucgaggcaauauaugcuuuaagguccuguaaaagaugcggaauuucaugaaguuaagaauaauucauugauuauaccgcuugcagaaauaaaccacuuuuaggcuggacaugguggcucacgucuguaauuccagcacuucgggaggcugaggugggaggacugcuucagcccagcaugggcaacauaaugagauccugucucuguaaaaaaucaaaaauuagcugggugccauggcaugugccuguagucccaggugcacucggaaggagguaggaggaucccacgagcccaggaguuugacacugcagugagcuaugauggugccacaacacuucagccugggcuauagagcaagacccugucucauaaaaaagaaaaagaaaauucuuuuuaacacugucauauauccaucucaacuuuguauauguauacaucucuuuuacaaaaagaggccauaacauacucaaggcuguuuuuguauuuaaugagucauaaauauagugucaugucaaaucugucuauacauuaucauuuuaaaaacaaaugaccuuuugaaagguuaaauagcugcucauuacaaauacuacagaaauagaguaaaaugugaaagcccccccuuaaguauuuuuuuguauaucaucguuuucaauaauggcaugguauuccaaauauugauauuuacuuauuuacuuauuuaugagauagagucuugcucuguuacccaggcaggagugcaguggccaaucuuggcucacugcaacuuccgcuuccucgguucaacugauucuagugccucagcuacccaaauagcugggaccacaggcacaugccacuauccccagcuaauuuuaguauuuuuaguagagaugggguuuugccauguuggccaggcuagccuugaauucccgggcugaagugacccgcccgccucagccucccaaagugcugggauuacagggaugagccacugugccuggccccaaauacuuauuuuuuuuuuuguggagacggaguuucauucuugucgcccaggcuggagugcaauggugcaaucuuggcuuacugcagccuccaccuccgggguucaagcgauucuccugccucagccucccgaguaagugggauuacaggcuucugccaccaugcacagcuaauuuuuguauuuuugguagagaugagguuucaccauguuagccaggcuggucucaaacuccugaccucaggugauccaccugccuuggccucccaaagugcugggauuacaggugugaaccacugugcccggccaauacugauauuuuuaaauguaacuuuucacuuuaauucaggcauccuauauccauaauggccucagggugguaguucuccccuuuuuucuuccuuugagguuuacuacagaucaaguucccaugcuggcacccagguucaguaaauugggguuauucagacuguuacucccauaucauauguagcuuuucuugugaaauuugugacucuuuaagcccucuuaauuuuaguggcacauaguuguagcucuuugaucaaugggauugcaaauaaagguaacaauaugaguauuccugaaauaaauuuguucuguguuuuaaauugaaaguguauuuucugccagagguagaaaaacacugccuaacugaugagaguaucugugacccuaggaaauuauugacgucauuauuaguuuuuuguauuaauaucugacaauggcuacucaguaucuugauuuuggcucaaaauguaagagagaggcauagagaaaugaaugacuuuaaaauguuaacuacuuuuuaaauuuuucauagagcauaguuauuauggauaauggauauuuuauauacuuuuuauuuccacauuuucaaaugaguauguaucacuuauugaaauacuaacaaauguaaagagaaaaaaagaauaaaguaucauguuuacuauuagucuuuugguuuacacaauaaugauuugugcugaucuuuaguuccagaaagcugagucugaucuggauuacauucaauacaggcuggaauaugaaaucaagacuaaucauccugauucagcaagugagguaaucuccgaaauaaauaagcuuaaaaaaaaucagccuuaacugaauacuuuagaauuuucugauagcauuccuaauaguaauagaucauaagaauuauauuauuaaguuuauagaaucuuaaaaucuugcauuguguuggaaguuugguuauagcacacuggagaaauaguaccaauaguccgugaaauuuguggcuacuuuuuuuccccuaaccuuuaaaaaauaaucauugaguucagagguacaagccacuguggcagccucugaaauuccaagagagaauauagcuaccucuagggcaguuguucuucaguaaguuugaggggagaaguccuggcagucagcauauucucugaggaagguaaugauacacuauuagauuuuuuacuuauauuuuaugaauagugauuucuagauaaagcuaucuauuuaauuacucuaaguuuagguugauuagaaacauuaacucugcuuuaugucauaaaaucauuaaguguaaguauacauacauguucaugggggugaaaguaaauaaucuccaagcaucgucuguuaacauuaacacuaaaaucacuaauucaauaauguuuaucuuuuuuuccccaaagcccagguaucaggcuuaauuaauauuuaucuuuuuuuuuuuuugagacggaucacucugucguccaggcuggagugcaguggugcaaucucagcucaccauaaccuccacuuccuggguucaagcgauucucuugccucagucucccaaguagcugggauuacaggcgugcgccacaaugcccagcuaauuuuuuuuuuuuuuuuuuuuuuuguauuuuuaguagagacggaguuucacuauguuggccaggcuggucuugagcuccugaccucaagugaucugccuaccucagccucucaagguguugggauuacaggcaugagccaccacgugcgaccaauauuugucuuugauagcacuuaccagcagacaagaaacagugcauuuuacaguuaaaaaaaaauuccauacaauuaaaaaaauuuuuuuuuggauuggguagaaguauaaguuaaacuaacauuuuauagaaaauugggaaaauuucacgaauguucaguuuuuacuguuuauuucauggaaugcuagaauucuaugggaguguaguuuguacuguucuagcucccuauucuuuucuuucuuuccuuucucuuuuuucuucccuuuuuucuuucucucucucccccccgccucuuucucucuuccucccucccucucuuuuucucucuuccuucccuuccccuuacccucccuuccucccuuccuuccuucccuccuucccucuuucucuccuuccuuccuuccuucccucccucccucccucccucuuuuccuuccucccauccuucuucucccucccuuuccucccuucccuuccuuucccuuccuucuguuauccaggcuggaguucaggggugugaucuugggucacugcagccuccaccucccagguucaagggauucucccgccucagccucccgaguagcugggauuacaggcgcaggcuaccaugcucggcuaauuuuuguauuuuuuaguagagaugggguuucaccauguuaggcuggucucaaacuccugaccucaagugauccacccgccucagccuccuaaagugcugggauuagucgugagccaccacaccuggcccuuuccuuccuuuucuuccuuucuuuccucacuucccuuccauuccuucauuccuucucuuuccuuccccugccuucccuuccuuccuuucuuucuuuugucuuaaagauuccugugauauuucuucucagccuuuuggcuaagaucaaguguaguaucuguuuuuaucaguuuaaagaccguguguguguguguguguguguguguguguguguguguauguguguuuaagauagggucucacucugucacccaggcuggagugcgguaacaaaaucucagcucacuucagccuugacuuccugggcucaagcaauccucccaccucaguccgccaagugccuggaacuauaggcacacaccaccacacccagcuaauuuuuguauuuuuaguggagaugggauuuuaacauguugccuagguugguuuugaacuccuggacucaagcgaucuaccugccuuggccucccaaagugcugggauuauaggcgugcgccaccacgccugaccuagucaguaucuuucaaguacuguuuugaaagacauugacguguagugcucccauuuuuccucugacuuccaucucucaucuuuguuccaccuguggguauuuuuuuuccugcaacuuuuuaaaaaagcagcuuuauugagcuauaauucauauaccauuaaauucaccccuuuaaaguauauaauuaaguggcuuuuaguauucaugguuuuguagccauugccacaauaacauuuucaucaccucagaaagaaaccccauacccaugaguagcuacucccuaccacccuucccugcuauccugcaagcucccaaagacgaaucuacuuucugucuccacagauuuguugucugaacauuucagauaaauagaaucauauaauauaugaccuuucaugucuaacuuuuucacuuaggauguuucuuuuuuuuuuuuuuuugagaccgagucucgcucugucacccaggcuggagugaaguggcacuaucucugcucccugcaaccuccgccuuccgaguucaagcaacucuccugccucaacuuccugaguagcugggacuacuggugugugccaccacaucuggcuaauuuuuguauuuuuuaguagagacaggguuuugccauguuggccaggcuggucuugaacuccugacgucaggugauccacccuccucggccucccaaagugcugggauugcaggcaugagccacugcaccuggcccacuuaggauguuucuaaguuucauccauguuguagcgucaaucaguacuucauuugcuuuuacugcugaguaauacuccacuguauggcuauacuccaucuucuuuucucucucuuuuuuuuuuucugagauggagucuugcucuguccccuaggcuggagugcaguggugcaaucucagcucacugcaaccuccgccuccuggguucaagcgauucuccugccucagccuccugaguagcuaggaguacaggugcgugccaccacaccagcugauuuuuguauuuucaguagagacaggguuucaccauguuggccaggcuggucucaaacuccugaccucaugauccacccaccucggccucccaaagugcugggauuacaggugugagccaccgugcccggcccauacuccauuuucuuauccagucaucaguugaugguggucauuuguguuguuuccaccuuuuggcugcuaugaacauacauuuacaaguuguuguguggacauguguuuucauuucucucgaguauauaccuuggaguagaauugcuggccauaugauaacucagguuuaauauuuuaaggaacuaccaaacuguuuuccaaggcaucuaaagcauuuuacauucucaguuuaaaaaaaaaaauugugggcugggugugguggcucaugccuguaaucccagcacuuugggaaacugaggcaggcugaucaucugaugucaggaguuuaagaccagccuggcuaacaugaugaaacccgucucuacuaaaaauacaaaauuagccgggcgugguggcacgagccuguaaccccagcuacuugggaggcugagauaggagaauugcuugaacccaggaggugaagguugcagugaguccagauugcgccauugaacuccagccugggcgacagaucaagacugucucaaaagaaaagaaaagaaaagaaauuguaguaaaauguaaauaacaacauuuaccauuuuaauaugguccaggcugaacuccaauuccuagguuuauccucuggccucaauauccuuagcagcugggauuacaggcacguguccuuauaccugauagccaucuuaaucuuuuuuaagugaacaguucacuggcauuaacuacauucacauuauuguacaauaucaccaucaucaaucuccagaagguuuucaucuccccacauuguaacuguauauccauuaaacaauaacuccacguuccuuucuuccacuccuagcagccaccauucuacuuucugucucuaucaauuugacuacucuagggacucauauaaguagaaucauauaauauuugucuuuuugugacucauguaugucacuuauaauguucucaagauucauauauaguguagcagugucaguuuccuuucuuuuuaagguggaauaauauuccauugaauguauguaccacauuuuguuuaucgauucaucuguuaauggacauuugguuugcuuucaccuuuuggcuacugugaauaaugcuacuaugaacacugguaugcaaguaucuguuugaguaccugcuuucaacuuucggguuuauacccagaagugcaauugcuggaucacaugguaauucuguguuucaauuuuugaggaaauaugacuuuuuaacuccuguaauauucaauaacuucaagaaaaucucugcuuucucccuuuuucguguguuauaguugagaauaaagccaugauuuuaaucuuuguagauuuguccaacaucagucuuaaugauuuauauacauguaaaggaacaggaaagaaaguaaacaacuaguugcaguagccucuaauaccucugucuggcggcagggugguuauaguaguaguaaauauuuauugaacauuacuaugugccagccacugugguguguguguauguguguguuuguauacucacacccacauccauacauauaauuugguuuagcugcauuauccucauucuaguaccccucgugauuuggaggcagucaguaauucugcauaaaagucaacauuuuuggcuaggauuuguuuauuuacagagagcuaacaagaaacuauaaguuucuauuacuauauucuucaacuuuauuuguuccagaaacauaauuuuauuuauuuauuuauuuauuuauuuauucauuuauuuauuuugagacggagucucgcucugucgcccaggcuggagugcaguggcgcgaucucggcucacugcaagcuccgccucccggguucacgccauucuccugccucagccucccgaguagcugggacuacaggcacccgccaccaagcccggcuaauuuuuuguauuuuuaguagaggcgggguuucacuguguuagccaggauggucucgaucuccugaccucgugauccgcccuccucugccucccaaagugcugggauuacaggcgugagccaccacgcccggcagagaaacauaauuuuauuuuaugaacauuuucccuauagauucuuuuaagcuuaguaguauaauucauuuccuuuuguuucuuucaaaagacuuaauugaacugagcuuuuuguucauauauuggcuuuucuuuucucccaucaccagcacuaucauuagcagaguauuuuuauguauuuuuguaaucauuuuuuuuuuuuuuuuggagacggagucucacccugucgcccaggcuggaaugcaauggcaugaucucggcucacuggguucaagugauucuccugccucacccucccgaguagcugggauuacagguacccgcuacuauccuggcuaauuuuuguauuuuuauuagagacgggguuucaccauguuggucaggcuggucuugaacuccugaccucaggugauccaccagucuuggccucccaaagcugagauuacaggcgugagccaccucgcucagccauucuuguaaccuuuuaucauccacucaugauaacuaaaacccuaaaaugaauugaaguauuauaggcacaaaauuaacuaaagugcagcacaguuuacaaacacuaauaaaagaaucguagaggcuccuggccgggcgcgguggcucauaccuguaaucccagcacuuugggaggccaaggcggguggaucaccugagggccaggaguucaagaccagccugaccaacauggagaaaccccaucucuacuaaaaaaaaaaaaaaaaaaaaaauacaaaauuagccaggcguaguggcgcaugccuguaaucccagcuacuugagaggcugaggcaggagaauugcuugaaccugggaggcgaaaguugcggugagcugagaucccgccauugcacuccagccugggaaacaagagcgaaacuccaucucaaaaaaaaaaaaaaaagaauguagugguucccaacagccaguuacucaaauaaaacaggcuaugcgcacaacaguuuuuccuuugugguauggugcuaaguccuaaccacaguccuaaccugucauaaacaggccauaaaugcaaaucauguuguccuaaauuacucacugccaugucagucuuauugaucgagcuaaugucauaaaaacauguauuauggguagcugcccaacuacccuguccucucuuuuagcucuauggccauuuauuucuuaugcuuuauauaccaacuuuccuuuccuaguuuugugagauccucaaggauuaguucuugucacuuuuauuuuuuccuguaugaaucuguauuuggggaacucaucauucuccugaguuauauuaauacaugcagaucucuggguauuucacuacugagcuacauuccaguuaccuaaagaucauuuauaauuaaguuacauaauuuauuaucaccucaugaggaagaugacuucuucccuccuaccaauuucccucccaauguuaaacuuuuuuuuuuuuccccagacagagucucacucuguuguccagacuggagugcaguggcaugaucauggcucacugcagcuuugaccuccugggcucaggugauccucccaccucagucuccugcguagguggaaauacaggugugugccaccacaccugguucuaauuuuuuguauuuuaguaaggaugggguuuugccauguuuacuaggcuggucuugccugggcucaagugauccuccugucucagccucccaaaguguugggauuauagaugugagucaccaccccggccuaaacuuuuauuuuugucaaauucuugaauauauuugaagaguugcagaaauauaaagcuuauaauuacaaagaauaaugcuucacacucccacccucaagaaggauaccacucaucucagugucuuaugguauuuccuuuauauuucuaaauaguuuuccuuguacugcaucuuuauuuuuccugaucugaaacaucuacuaauuuccuggauacgaacuguuauacuucacauccuggcucugccucuuauuagcacugugauuuuagccaagucaguuaaccuuucuguacuuuaauuuccucaucuguaaaaugggaauauuacuauguaccucagagauugagagaaaauaaaauuaguuaacauauauaacuguuuaguccagaguaagugcuauacauuagcuguuaucauuaauaauaauuuccuacuauaggccugauguaguagcucacacuuguagucccagcuacuugggaugcugaggugggaggaucacuugagcccaguaguucaagugagcuaugauugcaccacugcacuccagccuaggugacagaguaagauucuaacuuuuuuuuuuuuuuuuccugagacagagucuugcucuguugcccaggcuggagugcagugacaugaucuuggcucacugcaaccuccgccucccagguucaagcgauucuccugccucagccuccugaguagcugggauuacaggcacaugccacccugcccagcuaauuuuuguauuuuuaguagauucagggcuucaccguguuggccaggcuggucucacacuccugaccucaugauccacccgcuucagcuucccaaagugcugggauuacaggcauuagccaucacacccagccaauucuaacucuuaaaaaaaaaaaaaaaaaaaaaagaauuuuguacuauggaagauaaaguuuaaauacuuuacuacccauauuuauuccugucuucacaauuucuguaacucuuuuauauaagcccuauugaauacugugucugcuuuccuuucuucacaacuuauuuuucuagagcuaauaauuguuuucuuuuuuuuccuuccauuugcuuaguuuuucuuuucuuuucuuuucuuuuuuuuuuuuuuuuuugagacaagguuuugcucugccgcccaggcuggagugcaggaguuugagaccagccuggccaacauagggaagccccaucucuacaaaaaauaauuuaaagguugggcgcagugguucacgccuguaaucccagcgcuuugggaggccgagguaggcagaucaccugaggucaggaguucuagaccagccuggccaacauggcgaaaccucaucucuacuaaaacuacaaaaauuagcugggugugguggcacacaccuguagucccagcuacucugugaccauggcuuacggcaguaucugccucccaggcccaagugauccucccugcuuagccgcccgaguagcuagcaccauaggcaugugccagcacaccuggcuaauuuaaaaaauaauaauaguuauuauuuuuugagauggagucuugcucugucgcccaggcuggagugcagugguaccaucuugguucacugcaaccucugccucccaggcucaagugauccucccaccucagccuccugaguagcugggacuacaggcgugugcuaccacgcccggcuaauuuuuguauuauuaguagagaugagguuucgccauguuggccaugcuguucuggaacuccugaccucaagugaucugccccucuuggucucccaaagugcugggacuugcaggcgugagucacugcacccagccuuugaauuauuuuuuguagagaugagguuucacgcuauguugcccaggcugguacugaacuccugaccucaagcgauccucccgccuuggcaucccaaagugcuagaauuacaagcaugagccaccauggcccagccugcuuaguuuuucuauauacuuuucacuaauucagccucagacauuucuaacaacuguaaaacucuucucaauauugucagacacacuacauguucuuuaaguuuuauuuucucccauggaaacauccuauccuuucuggugucucuauccugcucccaucugaccuccugcucuauaggcuucuugaauugcugucuuucugggauuuuuuuuuuuuuucagauggagucgcacucugugguuaggcuggagugcaguggcgugaucuuggaucacuacaaccucugccucccagguucaagcaauucucccaccucagccucccgaguagcugggacuacaggcgcaugccgacacgccuggcuaauuuuuuuuuuuuuuuuuuuuuuuuuuuuuguauuuucguagagacgguguuucaccauguuggccaggcuggucucgaacuccugaguucaggcaauccgcccgccucggccucccaaagugcugggauuacaggcgugagccaccgcgcccgaccuuuuuuuuuuuuugagagggaguuuugcucuugucacccaggcuggaaugcaauggugccaucuuggcucacugccaccucugccucccaggcucaagugauucuccugccucagccuacugaggcaaggacuacaggcgcccaccacaaugcccggcuaauuuuuguauuuuuaguagagacgggguuucgcuauguuggccaggcuggucucgaacuccugaccucaggugauccacccgucucggcuucccaaaguguugagauuacagucaugagccacugcgcccggcauuucugggauuucuuuaccauuauuuugguacuucccuuuguuuuauuccuguguuguaucauauguuucacucuuuggugguuuauuucuuugaucuggaaguauaucauuuagacgcuuccugaggaagauuacacagaaaguuaacuuuuugagaugcugaauguuugaaaaagucuuuauuguacccuuuaacccuuuuucuuuuuuuuuuuuuuuugagacggagucucccucagucgcccaggcuggagugcaguggcacgaucucggcucacagcaaccucugccucccggguucaagcgauucuccugccucagccucuugaguagcugggacuacaggugcccgccacaaugcccagcuaauuuuuuguauuuuucguagagacgggguuucaccguguuagccaggauggucucgauuuccugaccucaugaucugcccgccucggccucccaaagugcugggauuacaggcgugagccacugcgcccggccuaacccuuuguuugaugagugguuugguugaauauaggauucuagauuggagauuuucucuuaauuuuaacaucauuacuucgugguuuucuagcuucuauuguugcuguugaaaaauggaugccauucucauuccugauccuuugucugugcuuuccuccucagccuaccccagucccuuaccuaucaccuggaaguuucagaauauuuuuucuauccugcgaaaauuuacaguuaugguauagaucuuuuuauuaauugugcugucacuugguggggccugaaaauauaugaaucuuaccuaaucauaaaaaaagaaaucuggcaggauacaguggcucacaccuguaauucuagcacuuugggaggcugaugcaggaggaucacuugaggccaggaguuuaagaccagccugggcaacacagugagauuccuguaucuauuuaaaaaaaaaauuaaagaaaagaauuaccaaguggcagaagggguccaauugaaaugucuuuuauggaauagugguaauguauauuacaaaauaaaucuggaaaaccagcauaguuuauaaauacaguuggguuggcaugaauuuuauauuuuguguguauauaaguaaauugauauuuauacauacuuuauccccaugauaguauguuuacgaauuuuggccgggcgcaguggcucacaccuguaaucccagcacuuugggagguugaggcgggcggaucacaaggucaggagauugagaccauccuugcuaacacggugaaaccccuucucuacuaaaaauacaaaaaauuagcugggcgugguggcgggcgccuguagucccagcuacuccggaggcugaggcaggagaauggcaugaaccugggaggugaagcuugcagugagcugagauugcgccacugcacuccagccugggcaacagagugagacuccaucucaaaaaaaaaaaaaagauuuuuauaaguaguuucaaguucuuauucuuuaagaacaaauacuaauagugccuuuuaucuucuucugaauagcauuuagaauuguauuuuagaaauauuguauaauuuauuauugugaacuauccaucaaauguuauauaucuaaggugacccuuauuugcuguuuaauauugcuaauuuuuuugguggguuauuucuguaccuaggcuauaaauuccuugagaauaggaucuaggucuuauacuuuucucucuuccccaccucccaucugaugucauguggcugcauaauuaaauacucaacaguguucaauuaaauggaugguagaauguguuguauguauacaguauuuuaauucuuaaaaaguuuaaucuuucauaauuuaauacauguucacuuuuuuccugacauagaaaaauccaguuacacucuuaaaggaauugucagugauaaagucucgauaucaaacuuuguaugcccgcuuuaaaccaguugcuguugagcagaaagagaguaagagccgcauuugugcuacugugaaaaagacuaugaauaugauacaaaaacuacagaagcaaacagaccuggagguaaugcuuucaguugacagguuagauuuguuuagcuuuagcucugaguguugcuuugaaaaauaaaccugauguaacuuaaauuuugaaacucagcagucaguuugaacuauugaaagauuuuccugauacccugaaguauaauagcucuuauuucuguuuauuuaaaaauaagcauuuggacuugacaugguuaauaaagaauugugcugucuugaauuauguaaccauggcagaaaacuugguaauacuuauaaaaucuagcagcuuagcugguuccuguaaguacuagugagacugagaugucuagaaaaggguggcuuagagugcuguaucaaggagcugugucuggacauggcagaaaauagcguagucugccacgagcaugggaaggaggaagggcugcauaugugauauuuauuugccaacucuacacuaaauuuuggcuuaagauacuuugaauuaugggcuuguagcuagaguaaaucagaaagguuaauuacccaggucaguuugaucaagaauacuuuauauugcaaauggaggggaaaaaauagaauaauaucugcuuagaacgauaaaaugauaccuuagauguaucuguuauaucacaaggagaugaaugauggaggaaggaagggcaauugaacagggaauagagguaauggggagacagaauuuaaaacaggguugugucacaugcuaguaaauuaaaugcaaaaaaaaguauguauaugauaagcuuuuauaaaucaucucaaaucacacauucuucauuauaugugccugacaauagagcacauaaccuuguucuuggaaaacaaauagcugauuaaguauaguuccagauguacaugacaacauaucuguauagaaccauaaauuuauugaagcacagaauaaacuugggugagagggcaaagggaaaaaugguauuuugaauauuuacaaauuucccccacuggauauaauaaauugaugguauauuuuugagacuacaaauugguacauaaaaguaguuauauaguaauagaggauuuuuuuucuuuuuugagauggaguuucacucuugcugcccaggcuggagugcaauggcaccaucucggcucacugcaaccuccaccuccuggguucaagugauucuccugccucagccuccggaauagcugggauuacaagcgccugccacaaugcccagcuaauuuuuugugguuuuaguagacacaggguuucaccauguuggccaggguggucucgaacuccugaccucagaugaugaaucugccucagccucccaaagugcugggauuacaggcgugagccaccauguccagccagugauaagaggauuucagucaucugaguaucuguaaaggucuucaguugaagaaauaccugaaaugaacaauacuuaugucaaaggcugaaaacuaagggagcuuuuacuuuggaucaaguuauggcaaacaagaagaaugauuuaaaaguuauaaaacuugaaagagguggucauauuuuagaaucaaugaugaccaaauugggaaauguuggauauagugagucuuguaccuacugcuuuaaaaaugagguaguaugcugggcacaguggcucaugccuauaaucuuggcacuuugggaggccaaggcaggaggaucaguugaggccaggaguuugagauuagccuggacaacauagugagaaccuaucucuaccaaaaaaaaaaagaaaaaaaagaaaaagaagaagaaaaaaauauuuuaaauuuacugggcaugggagugcaugcugguaguuccaacuauuuggggcagaaggauccuuugaccccagaaguuugaggcugcagugagcuaugauugcaccacugaauuccagccugggugacagggugagacugucccccaaaaauuuuaaaauaaacuaaaauaaaaaugagauaguaguagaaaguucagagggaauacagauaugaaacuuaaucuucugagagauguuuaaaaggguagcuuaauaaacaaaccauuauauugauaaauuuuuaugauccaaaugugaaugggaaugacaucuguagagcugauaaccaaaaacaguuauaugagcccagaguuuaaaggacuugcaagguacaauuuguaaauaaauuucaaauauuaaaaggucacagggacaaaccugugaaauuaguuaggaaagccaaagaggccgggugcgguggcucacaccuguaaucccagcacuuugggaggccgaggagggaggauuacgaggccaggagaucgagaccauccuggcugacauggugaaaccccaucucuacuaaaauaacaaaacauuagcugggcaugguguugcacgccuguaguaccagcuacucgggaggcugagacgggaaucgcuugaaccugggaggcggagguugcagugagccaaaaucuugccacugcacuucagccuggcaacagagcgagacucugucucaaaaaaaaaaaaaaaaaaaaaaaaaagccaaaggcagauagagcuaaggccucugaaauuuucuaaaauaaccaaaagguuauuuuaaaggggcuuuaaaauuaucuggggaacaagaaggacaagaaaaggauaaagucucauuggaaccaauagugcuauguuuauagauaacagaauguauaucuguucagguauuaucuugcuauaaucuuuaucaaagagugguuuuucauuuggaaggguagaaaauguauuugaauuuguaauaguuaaaaagaacaccugaauugauaauacuaaauaauaaauacagaacagaaaaggagguaggagaaagggaauacauacuaauuucauaaucuuucuuaggggauguuaagacauugacaaaagaagaaaaaaaaagacaaaagacacugaaguuuauuuauuuauuuaauuuuuuuguuuguuuguuuuuugagacggagucucccucugucgccgaggcuggggugcaguggcacaaucuuggcucacagcaacuuccgccuccuggauucaagcaauucuccugccucagccucccaaguagcugggacuacaggcaugcgccaccacgcccagcuaauuuuuuuguauuuuuaguagagaugggguuucaccaaguuggccaggcuggucucgaacuccugacugcaagugauccaccugucuuggccucucaaagugcugggauuauaggugugagccuccgugcccucauauuuaaacugagguuuaaauauguucaauuauaaaggugaucucaucaaaagaaaaaagggacuaaacuuacacccaaacaaaaaauagcaaaacaaacgcccaaaacauauauaauaauaaauagaaaauuaaaaaggcauuaaaaguagaauaugugguauucuaugaucuuccaaaauaugugugauaaagaagaaaaauuucuacaaacuuuagacugguuaacuugacuuuaauuccuggaaaaauucuuugagaauuuauuaaacagauggucugaaagcuuuuguagugaucacaaggggcaauguggauucauuagucucauagcuggguauggcagugugcaccuguagucgcagcuacuugggaggcugaggugggacgauugcucgagcccaggaguuagagguugcagugagcuaugaccgcaccacugcgcuccagccugggcgauggaacgagacucugucucuaaaacaaaaacaaaacgaaaaagcaaagucuugucagaauaacauuuccuuuuuuugagguagaagaaggaaauccuguaacuggguuguaguaagacguaugauuguuuuucaguuuauccuugugaacauguugggcaaauguugaucaguggaaccagcugcauaucagaaucauauagguucuguggcuguucuagauuugggcuguccuauuuacauaacguaauguggcuauauaaauuuaaauuuagacugggcaugguggcucacgccuguaaucccagcacuuugggaggccgagacagguggaucaccugaggucaguaguuccagaccagccuggccaacacggugaaacccccgucucuacuaaagaaauacaaaaaauuagccaggcaugguggcgggcaccuguaaucccagcuacucgggaggcugaggcaggagaaucuccugaaccugggaggcggagguugcagugagcugagauugcgcuccagccugggcaacaagaguguaacuccauuucaaaauuaaaaaaaaaaaaaaaaaggaagaaagaacgaaaaaaagaagaaaagaaauuuacauuuaagguaguuaaaugaaagaugaacauuaacuucuucaccuacugauuggacagugcugauaaagaauauuuccagcaucauggaaaguuuuauuggacagugcugcccuagagauucugauucuguaggucugggguguuccagauuuggcagucucucuagagaugaccuauauaguuggcagaauuguaacuacuugauucuucagguuguaccuccuauuaauuccccacauaacccuuuguuucagccagccuguuuguuggugcucugugaaagucccuuacaacuucccuucagccucccuucuuuugcugcuaccugcuuuugguggaugcuauuggccauuuuucuuucucaguaucuguuauccuuuccugccuaccagaauauagacaugcagugcauaaugacguuuuggucaacaauggaccaaauauauaugacaguggucccagaagauuauaauagcguauuuuuacuguacucuuauguucagauguuuagauauaaaaauaccauguguuaccacugccuacgguauucaguacaguaacaugcuguacagauuuguagcccaggagcaguaggcuauaccauauagccugaguguauauauacaaucccuguuuguguaaguacagucugugauguucacacgaugaaacugccuaacgaugcauuucucagaacguauuccugucauuaagugacacaugacuauacugacuuucuugagauguguguugucccucauagcgaugugccugagaugaaucuggccccauccucagcuccaggggugcaucugauuggcauagggaauggacuuuauuuuuuaacuaacagugguugaggaauggguuuguaacccaaaugacaugugaguaaggauagucuggaaguagguuacuaggaagacuuuacucacugcugagagaacccugagaagagaaagcuucuuuucuucuucuggacauuguguagaguugugauaccuagcaccguuaaagccauuugcugucagcuugaggguaaaggcacuauccaggauauuagagcugugagauggaaaaaauggaguccuuacauuguucaguugcuaaauaagucagcccagaagucuuuccuuuuucugaaguuauuguggaaugauaauacauuuuccuuuaucuuuuuuuuuuuuuugagacagaguuucacucuugucgcccaggcuggagugcaauggcguaaucuuggcucacuguaaccuccaccucccggguucaagcaauucuccugccucaaccucccgaguagcuaggauuacaggugccugccaccaugcccagcuaauuuuuuuguauuuuuaguagagaugagguuccaccauguuggucaggcuggucucaaacuccugaccucaggugauccacccaccucagccuccuaaagugcugggauuacaggcaugagccacugugcccggccucuuucuuuuuuugugugauuuagucuugcucugucacccaggcuggauggaguucaguggugcgaucuugggucacugcagccuccgccucccagguucgagggauucucccaacucagccuccugaguagcugggauuacaggugcauaccaccaugccuggcuaauuuuuguguuuuuuaguagagaugggguuucaccauguuggucaggcuggucucaaacuccugaccucaagugauccacccgccucagccucccgaagcgcugggauuagaaggcaugagccaccgcguccggccucuuuuuucuuuucuuaagaugaggucuugcucugcugcccaggcuagagugcaguagcaccaucagggcugacugcagucucgaccucccaggcucaagugauccucccaccacagccucccgagcagcugggaccacaggugugcgccaccaugcccagcuaaaaauuaguguacuaauuaguuaaaaauuagcuacucgggaggcugaggugggaggauugcuugagaugggagguugaggcugcagggagccaugauugugccacugcacuccagccugggcgacagagugaccccguuucaaaaauagaaaacaaaaauuuuggaaaaaaauuagaugguuguaucuguacugaacaucuguagacuuuuuuccuuaucauuuauuccuuccacaauacaguguaacaauuauguacauagcauuuacauuguauuagguauauaaguaaucuagagaugauuuaaaguauacaggaggauauguauaguuucuaugcaaauacuacgcaguuuuauauaagggacuugagcaucuguggauuuuguuauccuggaaucaaucucccacagauacugaggguugacuguacuuuuagaauauggcauccaaacaugacuucuuugguucugcuauaauccuuaaauuguuugauuucuuggucuuguuucuucaacuuaauugcaaguucuuuagaagcucaaacaucauaggaccuuguauauaaauagccaaguaucuguuuuuucccuugccuuucuaaaucugugauuacauacauaguauaagcuuagggaaacauuuauuggugugacaaugcagaaguuaacuaaacugauuuaagucuuugaaaguuuuugaaauaaagauuuuaucauuuauuuucuagcugucaccacugacuaaagaagagaaaacugcggcagagcaauucaaauuucacaugccagauuuaugaagaaauggacuuggaaaggaaauucuaacagagaagagcuuaauuccggagaaauuuaggaagaugucuuguuaacccuugaugucuagagauugggggcuggugaaggggguuuggcuucaaugacuggauaaugauaucuuucaugagagagauuauaagaagaagggcagauaauauaugaauaaaguucagccaaaaggaucaaaugagaauaaaacgauuuaaauauauguacacacgcaugcacacacacacuuagucuuguaauuucaggccagaaauucucaacacuauuuugcaucuguuuucuuuuucuaagucaugauaauauagauguucuggucuaucauaaaagaauguuuauguacauuucagucauucgguauguggcuuuguaaauuaaaguauaggcaaaacauuuguguuauacaugauauauaauuucauuuuguaaauguugauugcacauguggucacauuauuguugagacugcuuuuaugugaccuguagucucccacagaaccuaaaguaauaagcuggcuuuucugugauagccacguuugcguauuucuuucccuauuucccuugccugcuaauguugaacagcaugaacuugcuuucugaugcuguuuuagacugucccuguuguaucucaauaauaucuuuguuuuccuucagccuuuauuacuauaauuguucauucuacaugaaagcuaggaaacugaaauuagaagagcacuuaucugcuacuugccaguuuugcgugaguguguuauauguaugugucaauuucccuuuaaaauaacuauuuauuuuaaaauaacuauuggcaauaaggaaacuguucaaaguagaggcagaucuugauagaaagauguuaaucacaggguuguuuauaauagcaauauacauacacauuuggcuaguacuaggugaauaggaaaauaaaucaugcuguauguauacaauaagaggucaaguugccaauaaauuauuacuguuaauguucugggaaaugcugaaacuaugcuaagugggggagagggaaagcagguauugcaguuuuguagugaagauugggcuuuggagucauaucugagauguaaguagcagcuuuuaaauucuagcuaugacccugugcagaucacuuaacuuuugagugucaggauguuuggaaggacaagacaggaaaguguuuuaauacaggguucaguauuuaguaagccuucaauaagugauauuacauacauguaauaaaaacuaagcauugaaaggacuaggaaaaaugcaucaaauguuaguucugcagguuauagaauuauacuuuuauguaauuuuaaaauuucaguuaugaacauguuuguccauuaacaaacuuauaauagcugaaaaacaggguugugagaacagcuucaguuaaaauuguccugucuaguuugaauauuucaagaacagaaagccuuuuuuuuuuuuuuuuuuuuuuugagacggagucucacucuguugcccaggcuggaaugcagugguacgcucucagcucacugcaaccuccaccucccagguucaagcaguucucugccccacccucccgaguagcugggauuacaggcgcccgccaccacgcccggcuauuuuuuuguauuuuuaguagagauggggcuucaccaucuugaccaggcuggucuuuaacuccugauggugauccacccaccucggccucccaaagugcugggauuacaggcaugagcuaccgugccuggcccccuuuuuuuuaauuacagagaaauaaguuacaccuuaguaucagauauuaauuuucuucaguguucaggcaauuaguauuuagaaagcucuugucaugagauggcucugggaugugaugaugauuguugggauugaaaaaacgguaguaucauggagagaucauaauaaauucuuaguauuaaaagugguuuugcuuucaguuagggagaaaaauuagauuguacuauuuuuccucuaugauuuccuucaguuaucuuccaaauguuguuuuuuccccacagcccccuuaacauuguucucuaugcacuucucaauacauuuucauuuguuucucaagccucuuuguggaugacuccuaaauauaacuucuuccacuagcucuagauccguauuuccaauaaaauccccuaccugaauauucaaguuaaacauguccagaauacuuacugauuuuauuguuaauagccacuauucuguugucuggaauuaaaaccuguauaacuaauuugcaucccuuuaucuucuuagucaauaaaaccuacaauccucuuucuaaaauggu

SEQ ID NO: 192293 - RNA, 124267 nt, Homo sapiens
acagcguccugcgcgcaugcgcuucgcagcuucucucgccgccgcgcccccagcugcucugguuacgguugguguuugcgaauucucugcggcaccuucuucgcugaacuccaccgucaguuccauaggcgcgcgcccgcgucacgugggccgagguuccggcgcggcugcuggccggcggcugagccgggagaaaggagcugcggccaccguucgcccuacuucugcgccucggggcgggcgcgccgguaaaaauggcgaaauggggguaggcggcgcuggaccugaagagauggggcgcgcagguggggcgguugucagagcccccugacgugggcgccgggcuuuuaucggcgauuugaucuggcgaccucgggccggcgccuaagaggucagacugcggagccugcgggucgccagcggccccgccgagagccggaggcaauggaugaacagagcguggaggugaggggguugugaggguggugguuaguccccgcccccacccgaugagcgguuuuuauucggggagucgugcccauguccucccuccaguagggcaccccuaccccgccccugccgcuguggagagggcuggcccgguaccaaggaugccgugcccauucugcagcgcuccgggugucuugugcucacuguuccgcagucagguggugcguauccuggaguuuucaaggaugucuuggcacagguacucauccccaccggguguuugcaaacagcauccuuuuccgaccaaaacugcagauucaucagauggauguacccugccacucgccaccaguccuugcgaguucuugagcugaucuaaaucuccuuccaaauggauagucaucuuucccucucaguggcacauuuugcaggcuucugcccuuccuuccuagauugaaucagcauauauuaucucauguguaguuuccagaacaaacucuucuuuuuauaacugauucuuguaagcugugaguuaaaauaguugggauauguaggauauguaaguaaaggcuaggaauauauuuuaaaagauuguuuauugaacauaauuguguaaucauuaucaaauuuugaaccuuucagauacugaaauaggaaauccuugcuuuuuaguaagggguaacuauguuauggauauuccacuugaaacuagucauucaguagucuuauuguccaccccguugcagguuacagaaucugcaucucccagguucuuucuggcccuacagagucaugaugagauuaaugaguaauuuucuccuuaauuccucauauaaaguauuauaaagguuuuguaaacuuaucuugguuuuaggaggguuuaauucuagaauggagugaaaguaaaugucaguaauauaaaaacaaaguauacaauacaauaaguauacguuuaauuguauccuuuuucuuguuaaaaacuuuucaguuacuuccuaaauugauuaaauugaggcuugcaaacauaauacuguuucuuguauuuacauauuuuuguuguuguuguucccaagaucgcuuugaacuaccgucaacauuuucaauuggggcagaaucucagguucaaauaaguagcuagucuguuguaacaucagggcagcaauucagauuucuggauucugaauucauuuuuuucugggucacaguacacugccuuuaggaugugucuuuuuaaacuucuuuuuccucuaaauuauaaaaucaguuuauaccuuuuggggaaauugcagaaaaaguuaaaaguucauguuguguauucagucauauagucugccuuuuuuccuuuuuucuuuuuuuuuuuuuuugagacagaaucucacucugucacccaggcuagagugcaguggcacccucuuggcucacugcaaccuccgccuccuagguucaagcaauucuucugccuuagccuccuguguagcugggauuacaggugcacaccaccacgccuggcuaauuuuuguauuuuuaguagagacgggguuuaaccauuuuggccagguuggucucgaacucccgaccucgagugauccaccugccucagccucccaaagugcuaggauuacaguaaugaaccaucaugccugggccuuuuuucccugcuguuauacauuauaugcauuuuucuauaucauuagaugaagaaguauuucuggugacuguaaucuauguguaacugccauaauuuacuuaauauuuggacauuugggcuguaccuagauucuugccauuauaauuacugcuuuagugaaaauuuuucugcaugucuguguuugcauuuccuauauuuuccuuagaauagaaucaucgugaaaccaaacgggaguacauuuuccagauguuuugagguacucuguaucuugaccaaccaaauccugauauggaauaguuaaaauugagagaucagcccaaaauaaauguaaaugucaaguuguuuugagcuugccuuuuacucuugauucaguagccuaaacugguggaccuuacaucuuuuacuguuuucagagcauugcugagguuuuccgauguuucauuuguauggagaaauugcgggaugcacgccuguguccucauugcuccaaacuguguuguuucagcuguauuaggguaaguuguauuucuuuuuacaugcaguuaguauauauaguauauauuguaaggauuaaccauuucccuuaucuuuuuauuuuacauuuuuugcccuaaagugcuugcuugcacugugcuugggguugaggaauacuaagauaaaugacaaauugccugccuugaaggagcuuaaaucuaauugagggaauggaguuuagaauguuuauuuugaagaaugugcgguaucauaaggaggcacuaaagaagugcuguggggcucagaagaggacugguuuauauguguuuggugaguaagauagagaaaaaguguuuaaucuuacaauuacaagacacucuagagaugaauauaaucuaguggcuuuaaaacuugaguguuggugcuuugggaggccgagguagguggaucacgaggucaagagaucgagaccauccuggccaacauggugaaacccugucucuacuaaaaauacaaaaauuagcugggcaugguggcauguaccugugucccagcuacuugggaggcugaggcaggagaauuguuugaacccgggagggcagagguugcagugagccgagagagcgccacugcacuccagccuggcgacagagugagacuccgucucaaaaaaaaaaaaaaaacuugaauguuggccugagcgcgguggcccaggccuguaaucccagcacuuugggaggccgaggcggguggaucauggugucaggaguucgagaacagccugaccaacauggugaaaccccaucucuacuaaaaauacaaaaauuagcugggcaugguggugugugccuguaaucccagcuacucaggaggcugaggcaggagaaucgcuugaacccaggaggcggagguugcagugagccgagaucaugccagugcacuccagccugggugacagagcgagacucugucucaaaaaaacaaaaaacaaaauaacaaaaugaggaaguccaagauuuugguuguguaugcgagaguccaauagcacaucuacagagcauaguugaaaacugccuuguucacauuccccuucaauuauuuauuuuccugagaaaaucaaagaggucacaugcucuucaccucaaacuuucuguuucagcugggcgcaguagguagcucacgccuguaaucccggcauuuugggaggcugagguguguggaucaccugaggucaggaguucgagaccauccugaccaauauggugaaacccugucucugcuaaaaauacaaaaauuagccaggcaugguggcaugcuccuguagucccagcuacucgagaggcugagacaggagaaucacuugaacccgggaggcagagguugcagugagcagagauggugccacugcacuccagccuggcgacagagcgagacuucgucucaaaaaaaaaaaaaauuucuguuuccuuauucuugccuaaggaagauacauaugccuuugucaagaguauuauccguaacacuuaaauaauuuuuuucuagucacacagcucacaauugaugguacuggauuugaacccauuaaguucaagaacucuauagccuguucuuugucacuguaccaugcgcagaagacccaguuaaauaugauguuaguucucauacuucuaaaacuaagagauucacucuuucuuggccuucuuucuucagcuguagaauucagauaugauuugcuuuacagggugguuauggcauuaaaugagauaaccuaaggaguaauucagaaauuaugaaauacuauaucuacuuguuuguaagguguuauuuuauuguuaaaauagcaacuaauacacauuaacacuuacccauguuuuaauaaacagugaaacugaugcuagauaaauuaaguaauuggacuccguuauaguuaauuaagugguagaaucuggaucugggcgcauuucuuuugaugaaggucccaugugcuuauggucucugguuguuaccuuaugccucauugauucuguauuuuuucauuguuacaucuucuuccuccugccccuuaaaugcauuuauuucuuaauuuccuaagaucuuguugcugucguucucuacucugagguuucugggaguauucaccuacuuugggaaauuugauuuacuuuagcagcuuuagcuaucaucucuguguguauggcuccuaaaucuauuccuucagcacugacuuuuggaugucuuguccuucuagcaucuugaacuuuguucaagaucagauuauucauauuauuuucucaaaccgauucuaaguucauucuuuuuguucuguucugcuagucacucaaacuggaaacuuuauaccaaugauuuuuuuauuuuuuauuuuuuauuuuuuuuugagauggauucuugcucuguugcccaggcuaaagugcaguggcgugaucuugggucacuacgaccuccgccucccagguucaagagauuuuccugccucagccucucaaguugcugggaguaucagcgcacuccaugaugcccggcuauuuuuguauauauauauguauauauguguguguauauauguauauauauaaacauguauauguauauauguguguguguguguguguguguguguauauauauauauauauauuuuuuuuuuuuuuuuuuuuuuuguagagaugggguuucacuauguugcccaggcuggucucaaacuccugaccucaacugaucuucccuccuuggccucccaaagugcugggauuacaggcaugagccgcugccucuggccuauaccaaugauuuuuaagugcaauuaguuauuaucucccuguuucacuuauauuugucuuacccuucuguuuuuaucauuaccaugcuaauagagaaguaugaacauugguuaccucaugcuuagauuauuuaauuacuuucugucugaucucucagguuugagucuuuucuuaucuccaguccauuuucuguccugcuacuauauuaauauuuuucacugauaucucuuucuuuuccccagaagccucagaaauguauuauguaaaggauaaaauccaagaauguuagccuuguguucagaccauccagaucugguucugaccuuucuuucuagggcugucuugguuccugaaugcacuaaucauuuguucauucauucagcaaauauugauugcuugccuacuuguuuucaagccagucauuuuuuauuagguauaacugacaugcaguaaacuacacauauuuaaaguguacaguuuuuuuguuuguuuuguucuuuuuuuuuuuuuuuugagacggcguuuugcucuuguugcccagccuggagugcaaugacgcgaucuccgcucacugcaaccuccaucuccuggguucgagugauucuccugccucagccucccaaguagcugggauuauaggcaugcaucaccacgcuugacuaauuuuguauuuuuaguagaaacaggguuucaccauguuggucagguuggucucaaacuccugaccucaggugauccacccaccucagccucccaaagugcuaggauuacagaugugagucacugagccuggccaaguguacaguuuugacauauauguauucuugugagacaaucauugcauccaaguuagugaauauaucugucauccccaaaaguuuccuugugccucuugguaauuccucccucuacuugccuuguccccaggcaaccauugaucugcuuucugucacgauagauaaguuugcuucagagauaagggggauggaaaaagagaaaaaagauaaguuugcauguuuuggaauuuuauacaaaugaaaaucauacaauauguacucuuacggaucuggcuuuuuuucacucagcaaaaauacuguauguaucaguaguauuccuuuuuauugcuaaguaguauuccauuguauguauuuaccacaauuuguuuaugcauucaccuguugaugggcauauggcauguuuacaguuuuugcuauuacagugaaaauugcugcgaacauucguguacaagaagcuuucuuuucucuuggguaaauaauuaguaauggaacggauagagauuaugugguagauguguguuuaacauuuugaaaauugccaagcuauuuucuaaaauacuuguaucugggagcuaaacaaugagcauacauggacauaaagggggaaaugcuagacacuggggacuucaaaagagggagaggaggagagggaugaagguuaaauuaaaaaaaggauugggaggccgaaguggauggaucaccugaauucgggaguucgagaccagcuugaccaacauggagaacucugucucuaccaaaaauacaaaauuagccaggccuggugguacaugucuguaaucccagcuccuugggagccugaggcaggagaaucacuugaauccagaaggcggagguuguggugagccgagaucgcaccauugcacuccagccugggcaacaagagcgaaacucugucucaaaaagaaaaaaaaggaaauaguuuuauaauuuuacauucucaccagaaguuuaugagaguuccaauuccuccacauuaaugcuaacaguugguguguucgguuuugugaauuuuagccauucucagggacguguagccauucuuacagguaucuccuuguuuuaguuagcguuucucuguugaguaaugauguuagcaucuuuuccaggaguuauuuaccauccauauguugucuuugguaaggggucuguucagugccccccauuuugugcuaaaauaaauauaacaaaauuuuccauuuuacccauauuuaaggguacaguucggugucuuuaauuacauucauaauguuauacaaccauaucacuauuuccaaaaucuuucaucaccccaaacagaaagucuguacccauuaaaaaaaaagaaaaaagaaaauaaacauaaguaaacauagaaaagguauauuaaaaauacaguauaaaagauaaaaaaugguacaccuauguagggcagcuccauucuaaucuuacgagacuacuguaguauaugcgguccaucauuuaccgaaacaucuuuaugugacacauggcuauauaccacuuuuuguuuauccuuuuucuuaaguuuuuuuguuuuuugagacagagccucgcucugucgccaggcuggagugcaaucgugcgaucucggcucaccacacccuccaccuccgagguucaagcgagucugcugccucagccucccgaguagcugggacuacaggugugcgccaguacacccagcuaauuuuuguauuuuuaguagagaugggguuucaccauguuggccaggauggugucgaucucuugaccuggugauccacccuccuuggccucccaaagugcugggauuacaggcguugagccaccgcgccuagccuauuuauccauuuuuaucucuugauggacacuuggguuguuuucacuuuuuggauauuggauauuguuaauaguucuguuguuaacaauuaucuguuugaguuccugcuuucauuucuuuugaauauauaucuagaagugaaauugcugggucauaugguauucuguuaauuuuuuuuuaauugugguaaaauauaccuaauguaaaauuagccuuuuuuuuuuuuuuuuuuuaaaugagacagugucucacucuguugcccacguuggagcacagugacacaaucauggcucacugcagccucaaucucuugggcucaagcaguuggccugcuucacacucuugaguagcugggaccacaagugugugccaucgugccuggcuaauuuuuuuauuuuuuguagagacaggguuuuacuuuguugccaaagcuggccucaaacuccugggcucaagugaucugccugccuuggccucccaagugcuaggauuacagaugugagccacuuggcccagccaaauuugcaauuuuaacuguauuuuuaaguguacuguuuagcggcauuaaguacauucacauuguugugcagccaucaccacuauccaccuuuaguacuuuuucaucaucccaaacugaaacucuguacuugauaaacaauaaauucucauuauucucuucccccuagccccuguuaaccacuauucuaccuucugucuuuacauugacuauucuaaguacaucauauaaauggaaucauaaaauauuuuuguuuauuucuaccucucuauucuguucuauuagucucuauuucuguucuuaugguaguaccacacuguuuugauuacuguagcuuuguaguaaguuuugaaauuaggaagugugaguccuccaacuuuuucaagauaguuuugacuauuuggcaucccuugagauuccaugugaauuuuaaaugcaguuuucuaccaauauaaaaaguaccauuggaguuuuaguagggauuacauugauucuguacaugccuuugaguaauauugcugucuuaacaauauuaaaucuuaugauccuugaacaugggugucuuuccauuuauuuaggacuucuuuaacuucuuugagcaguguauuguaguuuugcacguauaagucuuucuuuuuguuuuuuauuguuuugagacaggaucucacugucacccaggcuggagugcagugaugcgaucauggcucacugcagccucaacuuccuggguucaagagacccucuugucuuggccucccaaugcugggauuauaggugugagccaccacacucagccuccauguaugucuuucaaauucuugguuuuuuuuuucccuaagcauuuuauuccuuuugaugcuguugcaaauguguuauuuucuuaauuucguuuuuagauuguucauugcaagcuuauagaaaugccaguguuuuuuguguguuugucuccuguaacuguuguguuuauuagcuuuaacaauauuuuguggacucuuuagggauuuuuacagauaagaucaugucaucugcaaaaagauaauuucacuucuuuuuuaauuaggauacuuuuuauuucuuuaucuugccuaaguacucuggcuggaauuuuuaguaccuguauuaugucaaauagaaaugguaaaagcuggcauccuugucuuuuuccugaucuuaaggggaauuuuuccugaucuuaaggggaagaguuuuuagccuuugaaucguugacuaugauuuuuaugaguuuuuauauauggccuuuaucaaguugaggaaguucccuucuauuucuauugaguauuuuuaucaugaaaggauauuggauuuugucagaugccuuuucugcaucaauugagaugaucauaguggggguuuuccaugaagugguuuauuacauugaaugauuuuuguaguugaaucaucuuucuauucuaggaauaaaucccacuuggccacaguguauaauuuuuuaaauagucuguugaauuaguuuuauugggauuuuguugaggauuucccuagcacaauuucucuaguaaauaucuuaaacucccagaccacauauacauuaaaauuuuucauauagcauuaugaaugaggaugcacaguacaugucaauaaugauaucucugauuauauucugaagaaauggaaggaauuuaauaaauacuuauauuuuuaauuaauuucaaaugcaggauuaggcauuggaaauaguauuuaaucaaucaugagcccaugaucuaagauuuuuaauaauugcuguaauuaauguuucuuaaagaccuuguuuucuguuacaaaguugguuuuuuuuuuuuuguuuuuuuuuuuuugagacagagucucacugucacccaggcuguagugcaguggcacgaucuuggcucauugcaaccucugccuccuggguucaagcgauucuccugccucagccucccgaguagcugggauuacaggcacccaccaccaugccuggcuaauuuuuauauuuuuaguagaggcgggguuucaccauguuggccaggcuggucucgaacuccugacuccaggugauccacccaccucggccucccaaaguauugagauuacaggcgugagccacugugcccggcugauguuuuuuuuuuaaacucucuuuuuuuggucuccuguuacacuaacaguaauuuuauuuaccaucuggcuuauuuaguucuguaugcuagauaauuaauauauacaaucuuuaugauaauuacucauucuuacagguuuuuggaaaugaacaaaaggacagcuuuucccuuucuuugguagacauaccauaagaaguggacuuuuguuauaguuuagugguauagauguuuguaagaaacuauuuuagucugggcacaguggcucaugccuguagucccagcacguugggaggcccaaagauggaggauuguuugagcccaggacuucaagaccaggcugagcaacauggcaagaucccaucucugcaaaaaaaauuaaaaaauuagcuggauguggugggcacaccuguagccucagcuacuucagagggucaggugggaggaccucuugagaugaagagguugaggcugcagugagcuguguuugggccacugcucuccugccugagugacagagugagacuugucucaaaaacaaaaacaaccccagaaaguauuuagcauguuuuuguauguauauauaguuugccucaaacaguacauuaggggauguaagaaauuuuguaugcuuucacaaggcaucuaagauccucuaugaucggccuccuaguuuccuugcaauuuugagcuguuugggaauaaaaguccuuuguuaacaaauuuccuauuuacugccuguuuucucuuauagcuaaaaguauuuaaaagaguguuuuccacuccauuucccugcaaccuugccaucuacuuacccuucaacccauucuaacuuggcuuuagcucccuccacacuacucacauagcuccugcaaaguguagacucaguuuugcuaaauccaaugaaccuuuuguuggccuuaucuuuccuucucggagcauucagcauaaauuacuucaucuguuuuucuugaaacguuaucuuugguaucuuugccauaauagcuauaccaucuuccuaguaacuucauggucuauggauuuuuuuuuuuuaagagaccgagucuugcucugucauccaggcuagagacaguggcaugaucauggcucacugcagcccugaccucuggacucaguugauccucccaccucagccuccugaggaguagcugggacuacaggcguguccaccaugcccggcuaauuuuuaaauuuauuguagagaugguaucuugcuaugugacccaggcugaucuggagcuccuggccuuaagcaauccucccaccuuggccugccaaagugcugggauuaaaggugugagccaccacacccgacugguccaugacuuuuaacacuaccucuagacuuaaacuucccaacuuuaucuuuucaguccuggccuuuucucugccuccaguaucuaacuaccuucauuuggacuuguaguaugcaucugaaauauaucgucucuauaagagguuuuuuuuuguuuuguuuuuguuuuuguuuuuguuuuucaccaugccaaaucuguuucuuuuccagucaggaacccaguuuuuuauccaaaaaccuagcucaccuuaaucuuccuuuuuccucacauccaguaguaauugaacuauaaauguuagcagccaguuuguuuuuuuuuuaagauuaucuuagauacuuaguauauauugcuaacagcuucucucuaacccuuagagcgguuuugcaggguagauauguugauucucuuguugcauaugaggagacgagcucagucacuuguccaaugucaugugguccauaagugccagagcugggaaucagacacagaucugaauacuuucuaaagcuugugauucuuccaguuuaaugaaggagagaaaauaauuuuuaauuuuaauuuuauuuuauguuuaugauuuuuuaauugaaugagggggaaugcucuaaagauauuuguuuaauauuaugcauuaauauuguaccacugguucuuugguuuugguuugagagaaacauugcuuuucucaaaguauuaacauugucauauuuauuuuguaauuaaauuagauuguggaggcugagcaauuucaugccuguaugccuguaaucccagcacuuugggaggcccaggcgggcagaucacuugaggucagaguuggagacuagccuggccaacgugggaaaaccccaucucuaauaaaaauacgaaaaccaucuggguguggcgucgcaugccuguaaucccagcugcuugagaggcugaggcaugagaauugcuugaacccgggaggcagagguugcagugaguugagauugcaccacugcacucaagccugggggagggagugagacucugucucaaaaaauaaauaaauaaauuagauuguggaauacaagauaaaaauaccacaaauauucagagaauguaaaacucacuauagccugggaaaggcaggaaauuuuauggacaugauccagugacauuucuaugagacgggauauggagggagggaccauauaagcaaaugcacagauauaucgacaguguuauauagugcagcaguaagccuguuuugacugggagggagggagacauuuaaaauacgaucugguuacucccuaucauagucccagucuuuauaaguuuuauagucuagcagggcaaaggagaccaacaaauaagucgucguaauaaaguaucugaagggggaaguguagguugcugugguagagcauggcaauuguaucuaaaauagucugcagagugucagggaaagcuuuuuggagaaagcaacuuaugaacugaaaucuaaacaaugaguaggaguaacccagaugaagaaagguuuugaagaauaucuuaggcagagagaggaaacauguaaagacauuaccuugcuggguuauagggccaguucuggagaggaguucaugagaccaguucuggagaggagcugugacuuuaacagaagaguggcauggucaugccauuguuucaggggaagaaaccugacccaaauuucguuuuugccuagggaccaagguaauaauaauguucaagguuauuaagaauggaggaauccuuuuccauaggcuuuuuauuuuauuuuuauuuuauuuuuugagacagaaucaugcucuguuacacaggcuguagugccguggcgcugucucggcucccugcagccuccaccuccuggguucaagcaguucuccugccucagccuccugaguagcugggacuacaugcucaugccaccacaccuggcucaauuuguauuuuuaguagagacgggauuucacuauguuggccaggcuggucucgaacuccugaccucgugauccacccgccucagccucccaaagugcugggauuacaggcgugcucuguaugcuuuuucuuucagcuuuauuuucuuugcucugaaguaccuugcuugcuaucauuuuaagucuuuuacuguccuuuaagguuuccuugggaauuuuauuucuaaguuaauuauuuggcaucaaguuaaagcucauguucauuuuaaaaaguagaaagagauaaacaaauaacagauauugggaguacguugguguaggaucauaguuauuuaccucugaaccuauuuaucagacaauuaaaacauaaaguuuuuuuuauuauaaaccuguuguuuccugaaaacuagucagaaaaucuuaacaucuccuuuauaugugguauaacauugcucucaguuuccuaauaaauuauuaauauaauuuuugguuuaguagagacauuauucucuucuaaaaccuuuuuauaauuaugaggaaaccaagauaucuagaagcuucaauuacugaacuaugaaaccguuuuuuuuguuuuuuuuuuuuugagacagagucuugcucuguugcccaggcuagagugcaguggcaggaucucggcucacugcaaccucugccuccuugguucaagcaauucuccugccucagccucccgaguagcugggauuaugggcgccugccaccaucaccaugccuggcuaauuuuuguguuuuuaguagagacgggguuucaccauguuggccaggcuggucuccaucagcugaccucaggugaucugcccaccuuggccucccaaauugcugggauuacaggcgugagacaccgugcccagcccugugaaacuguuuuaagacuuaaaaguugugcuguauugcuuauucauuuuuuucgguuuaauuuacaugucuauaauguauguaacucagaauuagcuuccuuuuuuuuuucgaauuagcuuuucaaaaaauaaauuuaguaguaaacuagauagaaauaaaucaucacugugguuuauuuuugagugcaaaggagacagugccauuauuauaagacaauaauaagauuauauagacguucccugugagaaucaguuaguccugaaaucauugcuuuuccugugugagaguagccuuuuaacagcuauuuuguguugaguuuugucccuucaaaaguuuaucccuaugaggaugacagugagggaaacaguagauugccuguuacuuuuauaaguaucucuaaaacuaagcacuagagaguuaaacccauuagauuuguaguauuuuauauauauaaauauuauauaauauauuauacauuauuauacauuauauauauauuauauauauaauguauaauauauuauacauuauauauauuauauauauaauguauaauauauuauacauuauuauacauuauacauuauauauauaugauauguuauauaauaauauauuauauauuauauauuaugaauauuauauauuuauauauuauauauauuaagaauauuauauauauuauauauaaauauaaaauauuaaguaauauauauauauaguaaugauguuuucuaaucgauaucuaaucuuuugcccccuuagcgcuggcugacagagcagagagcucaauguccucauugccgguaaguguuuccuuacgauuauuugugaauuuugaaaauaguaagaucagaaugugccuugggauucauaaaggcaguuuuccugcagucugcccauuucucuucuucgugaagauaguugaguagaaauaagcaauuugacuagaaaaagaaaugcagggacuaauucaugugacuuaaaauuacguuuacuauguuguacucugccucucagaaaaucauuguauaacuucuuaauuuaccuuuuauaauuaagcaacaaauuuuuaauguuucugguuaaaaaauccagauaguuagggcauaauuuaucuuuuauaauuaagcaaaaaauuuuaauguuuucugguuaaaaaaauccagauagcuuggccgggcacaguggcucgcucauaccuguaaucccagcacuuugggaggccaaggcggcuggaucaccugaggucgggaauucgacaccagccuggccaacauagugaaaccuugucucuacuaaaaauacaaaaauuagcugggcgugguggcgcgcgacuauagucccagcuacucaggaggcugaagcaugagaauugcuugaaccuaggagguggagguuggagugagcugagaucguacugcugcacuugagccaaggucacgccacugcacuccagccugggccacagagcgagagucugucucaaaaaaauaaaaacaaaaaacaaacaaaaaaauccagaugguagagauaaauauaaaauaaaauaaaaagccuucugauucugauacucccuacccugucuucucacuuaauaauacuuucagaagaaauuguuggguuugguaucuauucuucuagacuguuuuuugugcauguauuuuguaaugcccuaauccaguaugauugugccuauauuuauauauauauaugcguaugugauucccauaugcuuuuucuuaaaauguaccaaugauauaauauuguuuugcaguuugcuuuuucauguaaaauaugguagauaucuuuucuugauuguauguauacauaagucauuuuuuaaaaaagugacugauaaucaguuuuaugacuauaccuugauuuauuuaugcccauauugagagacauuuagguuaucucuacuuuugguuucaaaaaauaaugcuggagugccaucuguuaaccauuuuucuuuuuguauucacuuuucuuuuuauuuuuuugagacagagucucgcucugucguccaggccggagugcaauggcgugauuucagcucacugcagccucgaccuccugggcucaggugauccuccuaccucaaccuccuuccuaacugggaccacuggugugugcuaccaugccagcuaauuuuguuuauuuuuuguagagaugagaugucacuguguuggccaaacuggucucgacuuccugggcucaagggauccuaccaccuugaccucccgaagugcuaggauugcagcgugaaccacugugccucgucccaccuuucuuacauuaucuuauaagaccagcauuaucaaguagaacuuuuuauaaugaugaaaguguucuaugucuacacuguccaguaugguagccacuaguuguguguggcugucgaucacuugaaaugugucuaguguggcuauaugaugaaauuuuacuuauuuauuuauuuuugagauggagucucacucuuucgccaggcuggggugcaguggcgcaaucuuggcucacugcaaccucugacucccugguucaagugauucuccugccucauccucccaaguagcugggauuacaggcacgugccaccacgcccagcuaauuuuuguauuuuuaguagagacagcguuucaccauguuggccaggauggucuugaucuccugaccuugugauccacccgcuguggccucccaaacugcugggauuacaggugugagccacugcaccuggccaaaauuuuauuuuuauuuaauuuuaacuuaaaagagucacauguggcuaguggcuaucguuuuggacagcacagcuguggauuuguguuuuguuuuguuuuguuuuugagacaggcucucacucuguuccccaggcuggagugcagaggcaugaucuuggcucacugcagccucaaucucccuggcucaugugguccuccuaccucagcuucauggguagcugggacuguaggcacaugccauugcacuuggcuaauuuuuuauagagacaggguuucaucauguugcccaggcuggucucgaacaccugggcucaagcaaucuaccugccucagccucccaaagugcugggauuacaggcgcgagccacuacgccaacaguacagcuuuagacucagaaguugagaauucaguccauauucugaaucauauguuuuuguuuagcuuuuuguuucuuuucauaaaugacguguuaauguggugaaaauaagucacagauaauauuuuucauugucuuuuuuuuuauuuuuuauuuuuuuaguuuuaauaguauuauggggccagguaguggcucauaccuguaauccuaguacuuugggaggaucacuggaggccaggaguucaagaccagccugggaaauauagcaagauucccgucucuacaaaaaauuuuaaaauuagcuggguuugauggugugcugcuguagucccagccacucaggaggcugaggcaggaggaucgcuugagccuaggaggucaaggcuacagugaaccaugaucaugcaugccgcugcauuccacccugggucauagagugagacucaucucuuaaaaaaaaaaaauaguguuaugguaugaguauuauugugcucucuauuuugagaaacguauuuauuuuauaaaauaaucucaaauuccugaauuaguguauguguauggauuuucuccccagugcuccacuccagcuacgagaacuaguaaauugucguugggcagaagaaguaacacaacagcuugauacucuucaacucugcagucucaccaaacaugaagaaaaugaaaaggacaaguauguccucaauuucuuuguucaauauugaauggauuuugccuuuguauuguuuaaugacacuauauugguaguugccuuuuaguuauuuaugaauaaguaguguuauauuucuuguuuuuaauucuuucagucaugcgcuguuacuguuaaguaacauauucuuauuguguuuauuuaacaacaguuauuucaugccauguauacacagauaccucucgcccuccccuccccccacacagaaaguacuuugcuagaugauaggcauacaaagguaaaugagacaugauuucuguuaacuguuuaauggggacacagugauaauacaguguuaagucauuuaagggacaagaaugaauaaauggucuuauguuccaugauugaagaauuuugaacauaucuggagaguuguuauggggagcagguaaagaaaggaaagagugauguggcagugauugguuuuuauagaugaagaagcuacaacaugguuaauuguaaggcuucacuguccagcaauaauaaaauaacuugaauuaggugagauuccaggaccccugaauguuuagaaauaaagccuugucacuuucuguagagucacaacaugguaaagcaagagguugaaaccucacaggucauuagaaaaaaauuuaucuguuucuucauuauacugaggaaauagaaccauagaaauaagagaacagggugugguggugugcaucuguagucccagauacuugggaggcucaggcaggaggaucucuugagcccagaggauggcuuagguaacauagcaagaacccaucucuuaaaaaaagaaaaaaaaaaaaaaaaagaaagaggcuuaauuaugguaguauaacacauuaaugcauaaucagaauuaaaaccuacuauucgggcgggugugguggcucaugccuauaaucucagcacuuugggaagccgagguggguggauuaccugaggucaggaguucaagaccagccuggccaacauggagaacccugucucuacuaaaaauacaaaaauuagcugggcgucgugguggacgccuauaaucccagcuacuuggggggcugaggcaggagaaucgcuugagcccaggaggcguaaguugcagugagccgagaucgugccauugcauuccagccuggguaacgagcgagacuccaucucccaaaaaaacaaaaacaaaaccaaaaaccugcuauucaaguuuaacuggacuuuuaaggaauucugucacuuguagcauuguagaggucucaccaaaaauaauuauuuaauuucuuuucuauacaauggcacauuucuuuggugaacacuuagguguuuuuccucugaagugguggguauuacuguuuggaaagaccuuuuaccucuuuuugggccucuucuauuagagccucucaaaaggaauagacugcuacaauuugcuaaccugcuagucuuucuuacuugcuguuugaugccuacuggccuccccuugcugcaagugaauacaggcuguuaauuaagaggaguuuuggcaaauuuucuauauuguaaaagcuauauuauaaauuuggucuuuuggaagucuugcuaaaugagcuuccaaacaguaccugauguauucuaacucuuauucauuucccauuuuauauucugauuacuuaugaauuagaaauauaaaauauaaacuuauguaaguauuuucucuaagcucaguguccuucaucaaugaaaugcuuuuugaaaaaugcaagagugggccaggcacaguggcucaugcuuguaaucccagcacuuugggaggccgggguggguggaucaccuaaggucaggaguucgagaccagccuggccaacauggugaaacccugucuguauuaaaaauacaaaaauuagcugggcgugguggcaugugccuguaaucccagcuacuugggaggcugaggcagcaagaauugcuugaaccuagaagguggagguuguagugggccaagaucgcgccacuucauuccagccuggaugacagagcuagacuccgucucaaaaaaaaaaaaaaaaauugcaagaguaugucuacuuuauaaacaagagaauacuuaaaacauuuuaauuaugguaaaauauacauaaaauuuaccaucuuaaucauuuuuuaauguacaguucaguuauguuaagcauguucacauguucagccaaucuccagaacuuuuuaaacuugcaaaucugaaacuguacccauuaaacaacuccccauuccuucuucgcaccagccccuggcagccaccauuguacuuucuguuucuaucuguuugaguacucuagauacugcauauaaguggaaccauacaguaccucucuuuuuguaacugguuuauuuuacuuagcauaauguccucaagguucauccaugugucagaauuucccaccuuuuuaaggguuaauaauauuauauuguauguauaugucacauuuuuuuuguccauucaucucucagugaaaauuggugucgcuuccaccuuuuggcuguagugaauaaugcugcuaugacuauggauguucaugucuuugagacucugcuuucaguucuuuugguuauguaaucagaaguagaauugcuagaucaugugguaauucuauuuuuaauuuaaguuuuugaggaaucuccauacuguuuuccauagugacuguaccauuuuacagucccaccaguagugcacaaggguuccaguuucuccacauccuggccaacacuugcucuuuuuuguuuuuuugauagcaaccauccuaauaugguaugagguuaggauucacauuucucuagugauuaguaguaaugagcaucuuuucauaugcuuacuggagaucuuuugcucauuuuuaaauuagaguuuuuaaaguuuauuuguugaguuacagguguuauuuauauauucuggauguuaaaccuucauucuuuucuuuuuuuuuugaggcagagucuugcucuguugcacaggcuggagugcaguggugugauuaucagcucacugcaaccucugccucccggguucaagcgauucucaugccucagccuucugaguagcugggguuguaggagugcaccaccacgcccagcuaauuuuuuguauuucuaguagagaaggaguuucacuauauuggccaggccagucucaaacuccuggcuucaaguguuccacccgccuuggccuccuaaagugcugggauugcgggcaugagccaccgcugcacccggccuguaguuuauuuguguauaugguauaaagugagggucuguauuagucugcuaggucuuucauaacaauacugcuaacugaguagcuuaaacaauagaaauuuauuuucucacaguucugauagguguuaaguccaagauuaaaugcuagcaguguugguuucuagugaggccucccuuucuccuugacuuauagauggccaccaccuagcucuguccucacaugaucuuugcuaugugcacgugcaugccuggugucuccuccucuuuauagaggacaccaguccuguuggauuuggguccugcccuugugauccuuacuuaaccuuaauuaccuccuuaaaggcucugucugcaaauacauucacacuggggguuaaggcuuuaaccuaugaauuugaggggggacauaguuaauccauaacagagucuaacuuuauuguuuuucaugugaauauccaguuuaaaagaacauuuaaaauugaguuguucauuuuccaugagggucuaguauuaaaucgugcaguuaaucaugugucuugauuauuguuaucguugaccacauguaggaaaaguacuugugcaugcucauguagguauagaugcauaaucaauaugauuauuaagcacaugcccaaaauguaguaguacaauagaauauaucaucuguagugcuguguggaaaugaugcaauauguguuauguuuuuaagaagcaaaucuguauuucgcaugugauuauaaaguccagaucaaugaaaacaguacuuuacaaaaaauuguccgcauaaacuucuuuagcuuccuuuucagaagccauggaguacauuuuauacuguguuucuugagauauaaucauuuaaaacugaccuguuugcccaagcuuaagaauuuguggaggugauuauguuccaauuuaauuuauaacuucauuuucuuuucauaauguauagaugugaaaaucaccaugaaaaacuuaguguauuuugcuggacuuguaagaaguguaucugccaucagugugcacuuuggggaggaauggugagcagaacaaauucaguauuuuuuuuaaguuagaggcuagaaggcacugaaauacuuauucagauagaaaauagugucauuaugcucucguagaaugaaaguuaaaaugcaucugcuuucuauacgcuuuauuaaagguauuguacuuuuauuccagaagaaucuuguuugugugguuugauggaccccuuauguaaauauuuuaaucuguaacaccuauaaaacauauccucuauucauuugcagaucuuuucguuguaggaucuaggucacuuuuuucauuaaaggucaguugaucagauguacuggccaacauuuccaauuuuaguuccuuuaaaauggagcacgaacuuagacacuugugaaacaacaugaguacgccuaucuagaucuuauaauuauuuuuuauuuuuuagauuauuuuuuccaauugaauucaagagcaguuuuuaaagacagucuaccauuauugagccugaagcauugaaguuagcuuucuuagaagcagcuuuuuuauuuuaaagucguguucuguuguuuacugaauacuuuuuuuuuuuuuuugagaauuucgcucuuguugcccaggcuggagugcaauggugggaucucggcucacugcaaccuccgccucccggguucaagugauucuccugccucagccucccuaguagcuaggauuacaggcaugugccaccaccacgccuggcuaauuuuguauuuuuaguagagacgggguuucuccauguuggucaggcuggucuugaacugcugaccucaggugauccaccugacuuggccucccaaagugcugggauuacagggguaagccaccgcgcccagccucugaauacuuaauuaaaugaucuccuuacaauaauaaguacaauuggcauaaauagguugagaauaaacacaauagauucuuaggaaaaauaaguuaugggugaaauggaaguggguagguaucuagaguugcuauaagaauugaucauucugugggcaucagucaguauguuuuacggagagaguggcaggccagauugguugaguagagcucaauucagagcuuucugcuagaauuugaauauuaaugugcuaacuagaaaaaauuaaguucucacauuuaauacuuuaaauacauagguuuuguaagagacaguagaaauguuuuuuucuauacuuaaagugaacauguaaaaaucuacaucuuuuuuggagacaauaaugggauacuuuggcuaaauaagacaauucuaguaagaacuuauaggagguuucuuauauuaaaauuuaauaauucugguuacaaaucaaaauuauuuuuagguaguuagcuauaaaaauuguucuuugagcugaaugcaacuggauuugugaggcuaacuuguaucagucuucugucucuguaguaacucugugggauggaaaauggguucauugcuuuuguuaauuuuguauccugggcuuuuucuucaagugucuuucuaauucauucagcugugguaaagacuagggauuuggugaugaacauaucaaacaauuacauacucaauuggcuugauaaauuauaggaauaaauacagagagcugaugaggaugcauaacuauagcagcugauccuguaaaucugagcuaagugcaaaggaugaguaggauuaagacaaaccaagaugggagagggaagauggagaauuauuauuauuauuuguuuuguuuuguuuuuuugagacagagucucacucugucacccaggcuggagugcaguggggugaucucagcucacuccaaccuccgccucccggcuucaagugguucuccagccucagccuccugaguagcugggauuacaggcgcaugccaccacgcccagcuaauuuuuguguuuuuuaguagagaugggguuucaccauguuggccaggcuggucucgaacuccugaccucaggugauccacccgccucagccucccacagugcuaggauuacaggcgugagccaccaugcccagcauuauuauuauuauuauuauuauuuuuuuuuuuuuauuuuuuuuuuuuuuugguuuuuauuauuaaaaaauuauuauuuuuugggggggacagagucucugucacccaggcuggaguacaguggcccgaucacagcucacuguaagcucugccucccggguucaagcaauucucaugucucagccucuugaguagcugggauuacaggugugcgccaacaugcguggcuacauuuuguauuuuaguagagacguguuuuugccguguuggccaggccagucaugaauuccucaguucaagugaucugcccuccucagcgucccaaaguacugggauuagaggcaugagccaccaccccuggcuaauaauuauuuuuuaauaagagggaguaauuuuuguaaaguccugguggaaagaaguuugaggacauggaagaagacuaguuugccuuagagaagagugacugacugauaagguuguggcagaugauuugggcugugguuaaagaucuugguucuuuuuaauaaguuaauuucuaguuaaaugaauauuuugcuaaagcccuuuauuuauaaucuugaaagaguuccuacuuggaccaagugauuuuaagcgggcacuggccugcuucaacaaaauuaaauuagcuaauaagguaaaguucauuugagagauuuaccaguuuauuaguguccauagaguguuacaaaggaauguaaaugcagaugagauaugugaaaguguucuaaagcuacucuaauuuaaauagcauggcggacauaccuuuaaaccuuuggcagaaauuuaugagcaacacgucacuaaagugaaugaagagguagccaaacuucgucggcgucucauggaacugaucagcuuaguucaagaagugguaagacuacuacuaaaauauaauuauuuuguuuuuaaucuguaauauauaauaauauauuuauauaauauaaguuaaucagauguugaaaucaagguuuucaagauuugcaaauuugauaggcuguaccuauagucaaauuccauaaauuucagaguaucugagaaauuugcauacaaagccccuggcuuguaaggaagcaguuggagucagagaauuaccacuuaugcagaauuagaaaaucagugaauuuaaaaagucuguuuguuacagagucaauaauuaacuuauuuuuucuuuuuuuugagauggaguuucacucuugucgcccaggcuggaguguaauggcgcgaucucagcucacuacaaccuccaccucccgggcucaagugauucuuuugccucacccucccaaguagcugggauuacaggugcccaccaccacgcccagcuaauuuuuguauuuuuaguagagacaggguuucaccauauuggccaggcugguuucaaacuccugacgucgugauccaccugccuuggccucccaaagugcuaagauuacagguguaagccacugugccuggccccaauaauuuacuucuaaacagaaucaguauugacuuuuacagucauucauuaaguuauacacucuuuggauccccagcuuuugggugaguuucuuuuacuaagcaaugaacuauuugugauguccugauuuagaacuccacagacuugaaagugcaauauuuaacauuacuguuuagauauuguuuaggucaaacagcuuuagugagcuauuuauaauguuauuucugugaaaaaaugugauaagcccccaagaaugaaauacuaagcauguuuuuagaauacauuuuguuucaaguuguuagaaugacagucauaaaugagguuuauggaccauuuccuaacuuaaaaugaaguuuguggaccauauccuaaauuaaaagcagaugucuucuuuguuuuaccucuuuaggaaucaagaaccaagugaucauuuauaacauucuuuaugcagaaaauuuguguuuuugauugcaugucugccauuuugaaauauaagcaaguugggucauuuccauuugaccuuccucuaacuaccuuuuucauauuaucuauucuuggcaauauuauaauguggugcuucuguuuuuaaaauuuacccaauuaaaauuauucuuaccucuuuaucuucuaggaaaggaauguagaagcuguaagaaaugcaaaagaugagcguguucgggaaauuaggaaugcaguggagaugaugauugcacgguuagacacacagcugaagaauaagcuuauaacacugauggguaaguguuuauguaugcugcugggguaccuggugcuuucagcuucuuugagauucagucuuugaagaauaagggugaucauccuaggaaggaaucuugagauuuuaggcaacuccauguuguuacaauuuagacagauaaauguuagacuuguauuuagaaaugauaggagagaaaaauuuucauagccauuuggaugaaaauccaaguuuucauagccauuuggaugaaaauccuaauggccagugggcaucauuguuagguagcuuuuucuccaaaucuaacagaauuccuucuacuaauguuccauauccuuuccauccauuuucauuggggaugaagaaacugacauuuguaaacaucggcgucauccccugccagcauuuucuuagagauuuaaagucucagcuuuugauuucuaguaggguucauuuuacauaugcuuaauuauauuuauugcugaccuuuuugcuuuucgaagauuccuucauucuucuuugauuguggagccugguauugaacuuaaauuuuaaguaagaauuuaauccaaugcuaugguuuguuuuguuugauuuguuuuggugaucuuaguccuuccaguguuuugcugacuaaaaaccagcuuugcauuuuuuaucauaguccaaagugaaauauauauacuuuaaauaaggugugaacaaagaauuuuuuuuuuuuuuuuggcuaucuugauucuccaagauuuuagccaugucuuugugucauccaaaauaaugauuuuauccauuuuauuuuuaacuuuuuaaaaaugagaugcaaauaucuuugaguuuguauauuuguauaucauuucaugaauugcuuuucuauuauaauccuauacuauuuaauaucugauuuuuaguuuuuuucccacagaccaaguagcaaauagucuuaaacaaucauucuucuaguaguuagauuggaaagcacaguucauccacccaguggagcaauuagacaaaaccuguagguauugauuguacuggucacaaugccacuuauauauuucauguaaaugaaaaucguaauuguucuuagauccucaguugcagucauacauauaggugaucuuaguuuuucagaacucuagauaauauuugagaucucuuuaaguucauuaagccauguagaguacuggauguugauacguauuaggacuuuaaaauugaggggaucuugacuguugaugugaucuucagucguagccaaauaaacauuugcauguggucuuguuuuucuugagugaguuuguucauugcuucauuuauuuaauugaaucaacuaaaagucaaauaauaccacaguacagaucucuuaaguuuauuaauuuuacuaccuguauaacugugaaauaacuucccuuucuaauaacugaacuugcccugcuuuuguggcuuucaaauuauuuuucauuaugaaaaauuauaauuugugauuuccaagguagcuuuuaugauuaaauaggauucuuucuaaggauaagagguggggaaaaggauauuuucaggguuaguuuaucuuuagaauagucuuauaagccucagauuuuuaauucauaccauaauaucugccacuaauuuauuauuauuauuauuauuauuugagauggagucucgcucugucauucaggcuggagugcaguggcacuaucucggcucauugcacccuccgccuccuggguucaagcaauucuccugccucagccuccugaguagcugggacuacaggcacgugccaccacccccagcuaauuuuuuguauuuuuaguagagaugggguuucgccauguuggccaggcuagucuugagcuccugaccucaggugauccacccaccuccgccucccgaagugcugggauaacaggcgugagccaccacaccugaccucugccacuaauuuuuuuuuuuuuuuuuuuuugagauggagucucguucuguugcccaggcuggagugcaguggcgugaucuuggcucacugcaaccucugcuucccagguucaagagauucuucuaucucagccucccaaguagcugggacuacaggcacgugccaccacgcccugcuaauuuuuguauuuuuaguagagacaggguuuuaccauauuggccaggcuggucucaaacuccugaccuugugaucugucugccuuggccucccaaagugcuaggauuacagacgugagccaccacccccggccucugccacucauuuuuaaguuuaauuauguauuguaauguuguccauaggcuaauguuuuaggauugugggaugugguuauaguagaaauuaugucugauaauauuagauucuagcuaauacuuuauuuuaacucuuuuugcaaccuagaaauucugaguuuuguuucaaaaauaaaaguucuaggcugaggcagguggaucucuuaagcccagccugggcaauguggugaaaccccaucucuaccaaaaaaaaaaaaaaaagaaaaauuagccaggugugauaguguguuccuguagucccagcuacucaggaggcugaggugggaggaucgcuugagccugagagguggagguugcagugagccgagaucacgccacuauacuccagccugggcaacagaaugagacccugucucaaaaaaauaaauaaaaauaaauaaaggccgggcgccuuggcucaugccuguaaucccagcacuuugggaggccgaggcggguggaucaucugagguugggaguuugagaccagccugaccaacauggagaaaccccaucucuacuaaaaauacaaaauuaaccgggcaugguggcacaugccuguaaucucagcuacucaggagacugaggcaggagaaucacuugaacccaagaggcaaagguugcggugagcugaguucgugccauugcauucuagccugggcaacaagagugaaaccccaucucaaaaaauaaauaaauaaaauaaauaaaaguucuaccuauuaaauguuuuuccuuaucaaauaacacuacagauugauaaaacuuuugcuguccucauggauguacuuccaguuuuucaaauuuuggguuuacaaagaaaauggccugauuugguaagcauaccuaucuucuuuuuguuucaaaacauauaaagcacuuucuuccuuuucuauaaggauaauuucuguaauuauaauuuuuuuguuuguaauuugagacagggucucacucuguugcccaggaaggacugcaguggugcaaucaaggcucauugcaugacugcaugcagccuugaccgcuugggcugaagugauccucaugccucagccucuugaguaaauugggcugcaggcaugcaccaccacuccuggcuaauuuuuuacuuuuuuguagagacugggucucaccauguugccuaggcuggucucaaauaccuaggcucaaguuauccucuugcuuuggccucccaaagugcugggauuacaggcaugagccauggccccggccaguaauaauuuguuuauccuuuucugucuccaacuuuuugagacuguucaccucugugggcauuuuuuuuuuuaaacagguccuuguauauucacaggacagaccuuuugcugacauuuaaccuaaaaaucuggcccacuuuguauucucuuuuaagccacaguuaaauuuggugaaaaaugauuucagaauagcugauugaaugaaauucauguuauugcuucuucccaagggaauaugaaaaucuagaaaaguaaauuuuuugcuuaaaguauauugucauugcacauuucguuucuuagaugaauuugaucucagugguaucuugucuaaaacuaauuagaauugguucugaaguuccauuuucaaggcuacuauaauauucagccucuuaaaguugaaugagaauuuuuaggguagcuguaaugaagaauuuuugcuuacuugaaguguauuucuuguuauuaaauauguucauuggaaguuaauuucauucuuaaaccaauaaugaacccaaguguugaugauucacuauuuuucaucaggucagaagacaucucuaacccaagaaacagagcuuuuggaauccuuacuucaggagguggagcaccaggugaugaaauauuaaauguaaugaaauagucuuuauccuuuuuucucuguauacuguaguuguuuuuuuuuuuuuuuuuuuuugagauggagucucucucugucgcccaggcuggagugcaguggcgcgaucucggcucacuguaaacuccgccuccuggguucacaccauucuccugccucagccuccugaguagcugggacuacaggcgcccaccacuacgcccggcuaauuuuuuuguauuuucaguagagacgggguuucaccauguuagcugggauggucucgaucuccugaccuggugaucugcccgccucagccucccaagcugcugggauuacaggcgugagccaccgugcccggccuucucuguauauuauaaacguuuuuuuuuugacagagauuaucuguaugagaucaaaagaucuguugaucuuuuguguuauaauggagauuuuuaugaaauuaggaaucagcugauucuugccaaguuuuuucuucauguuugggaacugcauuagaacuacauucugcuuuguaagaacagaacuauuuccauagaaaucugaauguauaagagguuaaaaucuccccacacugugacuuaagugguggcuuugagauauuauugccaguuacuuuacauguagcgauuauuacucuaaaauuuagcauuuuuauuuauugaggaaauauuaaguccuaaauagauagcaggcaucauuguagauauuggugauacagcagugaacaaaaugguaaaauucuguccucauagaguuuauauuuuagauuagggugggugaauaugaagcauauaguaaaugaguaaauaaaauauguaguguugcauaaauaucugauacauucacuugucuggaauuugcuuuuuguaauuucucucuaugccuuauacacagcugucuccugagauuuuuaucuuaaucauucugggaauucccuucacaucuuucuuguauugaaucucauguuuccugauuccuaugguuuccacuuucuugguuuacuuguuuuguuuuaacaucacacuucccucaguagcuuuccaggaaggguagucagaacacauuuuucuugacugcauugucugaaaauauuuuuauuuuaucuuuguacuugauugacaauuuggcuuguaggauucagcacauaaauauuuacuaaauacucuuauuuuucuucauuauccccauucuuuuuuccuuuucuuuuuacauacacacauauauaucuguagggcauuggccccaggaccuuaauggauaccaaaauccgcagauacucaagucccuuauauaaaauggcauaguauucucauauaaccuauacacaucucccauauacaaacaugugucaaauuaugaccuuuuggucaaugacagacugcauaugugacaguggucccacaagauuaaaauggagcugaaauacuucuguugccuaguagugaugucuaaugacaucauagccauuguaauguaguagcacaaagcauuaaucauguguuuauugugaugcuaguguaaacacacauacugcacugcuaguuguauaaaaauauaacacauuauuauguaugguauauaauacuugauaagcauaauaaacaacuguguuacugguuuauguauuuacuauaccauaccauucauuauucuagaauauauucuagaguuuacuccuacuuuuuaaaaaaacguugacuauauuccagaagaaggcauuguuagcauuguagauccauaugugcuaguacccgugaagaccuuucaaugggacaagauguggagguggaagguggugauauugaugauccugaccauguguaggccuaggccauugucuuaguuuuuaacaaaacaguauugagaugggguguacaccuguagucccagcuacucaggaagcugagguggaaggauugccucagcccaggaauucaaggcuucagugugcuaugauuguaccugugaauagccacggcgcucgccugggaaguauagcaagacccaucuguuuaaaaaaguaaagaaauaggccgggcgugguggcucaugccugugaucucaguacuuucagaggccaaggugggcagaucacuugagugaguucaagaccagccugggcaacauggugaaaccccgucucuacuaaaaauacaaaacuuagcugggcgagguggcacaugcuuggagucccagccacucgggaggcuaaggcaugaaaauugcuugaacccgggaggcagaggcugcggugagccgagaucgugccacugcacuccagccugggcgacagagcgagacccugucucaaaaaaaaaaaaaguaaauaauauuaacugaaaaauguaggcuacauggugauauagccugauaguguuuauguaaaguuugaaaacauucagaacauuguuuauggauguauguacacacauaguaauuguggaaacacauguauagugauaauaaacuucuguugaagggagcaaguugcuuuuggaagaaauggugucaaggaaggauauacacaguaagcauucaauuaauauaaguuaaauuuuuuuguauuauguguguauguauguacauauacacagugauuuuuagcauaccuuaaaaaucuuaagcaaacaguucaaauaacuuuagaucauuuuauauaaauuguucaaaaaaccguaaugccuugggcaaugccugacacauaauaauaugaaugacaaaauaugcagcuguuuguuguuuucugcuguuaccacuuaccauuaugucauugguugaugcaguagcucaaacaugauaucauuauucuugguaacccaagacuauaaacuuugauauauaucauaugauauaugauacuuuuuuuuuuuuuugagacagagucuugccuugucgcccacgcuggagugcaguggcgugaucuuggcucacuguaaccuccgccuccuggguucaagcaauucuugugccucagccuccugaguagcugggacuacaggcacgugccaccacgcccagcuaauuguuauauuuuuaguagagaugggguuucaccauguuggccaggccuugaacuagccaggucaugaggucuugaacuccucacccuaagugauccacccgccucagccucccaaaguccugggauuacaggugugagcuauugugcccagccauaugauauguuauuuuuggugagccuuaagcaacuguuauuuaaaagauauaaacucaccuguagguggguuuaugaauaucauucauauggcauuugauaguauauuagcuugcuaggccugucauaacaaaauaccaaugacugugagacuuaaacaauagaaauuuguuuucucaguauucuaggggcuggaagucuaagauucagguguuggcagguuucguuucuucugaggucucucuccuuggccuguagaugacugccuucuuacuguguccucacauggacuuuucugugugguugugcagcccuagagucucuuccucuuaauaaggacaccagucauguuagauuaaggcccuaccccaguggccucauuuuaacauaaucaccucuuuaaagauuaucuccagauagacugagguacuggagguugagccugcaguauauaaauuauggaggaaaggggcacaaaauucagcacauaacagauaguuuacaaagcuuuuucacuauagcuucauaauccuuauaacaaacuucacgaaguaagcagugguggauauuacuauuuuaguuuuguauguaaacagacucagaguuauguaauuagucaguggcagaauugggaguuacuucaaacugguuuuuuugaagaaaaaauuaguagucuuaucuuuuaucuaccaugguuauguuacugaaguuagauuuguuacuuuuucccaaaauaguguuucccaaauuaguaucagauagugcguguguguguguguacacacggguguauguguguacguuuuguauucugucaccuagaauacaaucugagaaauugcuuuuaaaagcuuucaccuuggucgggcacgguggcucacgcauguaaucccagcacuuggggaggccgaggcagguggaucaugaggucaggaguucaagaccagugugaccaacauggagaaacccugucucuacuaaaaaauacaaaaauuaccuggguaugguggcacccaccuguaaucccagcuauucaggaggcugaggcaggagaaucgcuugaacccaggaggcggagguugcagugagccgagaucgcgccauugcacuccagccugggcaacagagcaagacucugucucaaaaaaaaaaaaaaaaaaaagcuuucaacuuaccgguuuguucauuaauacauucauaagaacuucacuguaccagccugaaaguauauuuguacuugcuuaaaaccucauuuauccuaaaauguaaggagagaaaaaugcauuaguauuaaguauacuuauucauugacuuuacuguuagaauauuauagaaauaaaccuagauucuuuguacauucuuaauucucaagcucacuuugaguuauuuuuaucauuuuuuucaguuuauaaucagaauaauuuguaauuucuuaagaauuuugagguggcagugaauaguaauuuuguuuguucagauaauuuuuuuccucacacaguugcggucuuguaguaagagugaguugauaucuaagagcucagagauccuuaugauguuucagcaaguucaucggaagcccauggcaucuuuuguuaccacuccuguuccaccagacuuuaccagguaugacacaguuuuuaauuucauuuucauuugaaauuuauguggaaaugcauauacuuguuucaaaagaauguuuuuuuuuuuaaugccaucucucucucucuuuucuuuuauagauagggucucacuuguugcccaggcuggucucaaacuccuggacucaagugauuuucccaccuugaccccccaaauuacuagggaucauagacaugagccaccacacuuggccacuccauagcuuuuuaaggucuuguuuauaauggaguggucuggcaagcucuguuguauacauacaaaucuaguucuccugaaaagucucacagacugauacuuuugacucuuaagagaaaaugacaaugaacuagaaaucauuuuuuuuuccaagagcuccaucuuccguaguauagaaaaaaauaauugauuacauuagcuucaucaguguaccuuuugaauugaacuauaucuccuaacacaaaacucagaaacugaugaaaugccaaaagaauuugaaggugacgccauguuaucuccggauacuaaaagauagagagaggaaauaauuauggcaaaaaguauccuaguuuucaucuugggcuaaaccuuagaauuuuucugaacagcauauuccuucaagcauguuuguaaucauucugugguguuagacuggugguuucugacuagauguuggaaucacuugggauuuggcugaaaauuaaucagugcugggucauaccauaccccaggccauuugaaagaaaaucuuuggguguguauuagucuacuugggcugcuauaacaaaauaccauauacugggugccuuuaaacaacagaaauguauuuucucacaguucgagaaacaagaauuccaagaucagggugucagaaaauucacuuuuuugccucagcuugcagacagcugccuucuuucugugucuucaccugaccuuuucucuguucuugcuuggagagagaucagucucuggugucucuuucucuuuuuaugaggacacaagccuuauuguauuagacccaccauuaucaacucauuuagccuuaauuaucuuccuaaaggcccuggcuauagauacagucacauuggggguuagggcuuuaacaugggaauuuggggagacacaauucagccugugacauaggguucagauggacauuuucaguuuguucuuuuaaaaucuccuuagcuuauucuaugaugaggggugaagccacugcuucagauaaacauuuuggugugacagacuuuaucuuagagagaugacuuauggaauacuaucaaguuuuccuaccauggugagggcuguggcacauuuagaaaacagucuuuguuauaaaaauguuuauauguugagcugccuuuucuuuuuccucuaauaugugaugccucugaugaccacagagcauucauuguacuauuuuauuuuuuauuuuuuuaauuuauuauuuuauuuauuuauuauuauacuccaucucacucugucacccaggcuggaaugcaguggcgugaucucggcucacugcaaccuccaccucccggauucaagcaauucucacaccucagccuccuggguagcugggaauauaggcaugcaccaccacgcccagcuaaguuuuguauuuuuaguagagacgggguuucuccauguuggccaggcuggucucaaacuccucaccucaagugauuugccugccucgaccucccaaagugcugggauuauaggugugagccaccaugccuggccgcauucauuguacuagaguauaucauauaagccagggcuuuucaaucuuggcauuguugacauuuuaagcagaauaauuauuugugggguggggugagcuuuccuguguuuuauaagauguuuagcaguaucccaguagcacuccccaccccaccaccuugcaguugugacaaaaauauuuccagacauugccaaauguccuuggggacaaaaucaccccugacugagaaucacuguuauaagcccuucuuacucguuauagaugccacaguccuauaaacagaagggcaaaguuuuucugacagcuagaacuccagugguucucauugaccaguagaagucuuccuuucuuuuugauuaacaaccucauaaaauauucauaucuuuuuaaagcacugacuuuuuuguuuaaaucucauuucugaaugacagcacugaauauuauuaaaaggacuauguauuugcugucauuaaguagauuugguugaagaauguucaccaaaaucccuaggcugcuucauugauacuguggucagcuauuucaguuuugaagauuuguuuucugaaccauuucauccccuguggaaugaaacagauuuugaccuaagggucauauauaaaaauuaguauuuuucaauucaaaguguggugcauggaugaccuaagucagggcuauguguggcauuugucugaaaugcaaauucccaggccaauguccccagaaucuuuagaggugguauucagaaaugcgucuugagcacucuaaguaauaauacugcacuaaaguuugggaaccauugauguauguaaauucccauucuuauaccacuuucagcagcucaucaggcaggcaacaaugcucgcuagucuguuaauuaaucacuuucagggccuucucucuuucuccaguaaugcucacuaccuuauuggaaacuuuggcuuuuaauuuaauucuuauuagaaaccuguuuuauuaguugcaacauacaggaaaagagggccaaauaagaaagaucagcauucgugacauuaaguuacacaugaaacuuuagauaugcaaagcagugguguuucuauugccuuuaguucuaucaguuaguaauuggugauggagccacaauggagaagaaaaggucacuaaaucagugaaguguuauuuauuaaagacuaugugcccaguauuguuguaggugcugcaugggagaagaggaacuaaauauuuuacugugggcugggcgcgguggcucaugccuguaaccccagcaccuugggaggccgaggcgggcggaucaccugaagucaggaguuccagagcagucugaccaacauggagaaaccccaucucuacuaaaaauacaaaauuagccgggugugguggugcaugccuauaaucccagcuacuccggaggcugaggcagaaaagaaaaaauaaaagauacaauaguauagcugucaguucauagagaguuuuauguuucagggagaaauagucaaguugauaaggagaaccaguuuuuauauagcucagcaguuuauuuccuuaagaaacaaauggauacuugugguucucccuuuuuucccuuuguugaugaaguuaugaugagguuacuggucugaagauuugcagaucagugacuuccagauuccugggcuagagaugguuugaggguaguuucccauauucugugaagacaaagauucacugacaccaucaugagaugaauccagucaucauaaccagagcagucuacacuucuaagagaggaggagaaaauuuuaaaacuaugaaaagauaaagcagugccucaucugcagacacagaaugauaacaucaguaugauugaagauaaucucuaaaugaaugagcauaauauggagauguggugguggaauuagauggccuagcaguagcaauagcuuuguauauacauauaaagaaugcaaaaucagugagccgagaucgcgccacugcacuccagccugugugacagagcgagacugcgucucaaaaaaauaaauaaauaaauaaauaaauaaaauuuaaauuuaaaaagcaaaguaauuucuuucgcaaaagaaauuuuugagcaaauauuuccaacucuacgaaucugccagcaaguauuuauaaacauucauucagugaauauaugccagcuauauuuuaggcauguguuaagugcuagcauuaagcauaauacagagcucuuuggguuuauaauuaugauuuagaaaaacagguuauuggaacaguaauaaaauuaaugugguaacuggugauaggggaaguaaguauccuguuuaaugcugccccauaccacuaauuugucauuauacuauuuguguccaaaaaauuuucccuaggagaauguacauauguaaaaguauaucacaguaccuguuuucugugcucugaauguggucauuuucuccuagcaagugagacuaggguaaacuggacuguacucucuugguucaugaguguuaguaaccuaugcucuuuagccuggaagcuuucuacuucaccauucugaguugaaaauggcaucucuuguuguuuaauuuggguucugcugaagucuuuugacccuuaauggccaauaaaauaugauaaugauagucuggacuuagagcagaaauaacaguaacaacaacacaggaaauaaauuacacuggacauggcagaagaaauaauaugcagauuagcaggcaacuggggauugauuaaagucuuugcauguuguggaggauauucuguacuugaugagagaccugauugaaaguugcacaaaauuucaaaaacaugucaaauuugaaggcuauacugggaagacucccuuagagcucuuacuagguuuaugguuccagaaaggcuuccuaggcacuaauugcauugguccugcuaauuggaguuuguguauguugagugcuaggagaucauauaaugggaagaccuuagagcaaaccuccaagaguaugugacuucuaaucuguuaucugaagaaauaguaaggguuaaccaggcaaaaggauauggggaugaggaaugugagucuucuaagaaggauaacaacugacuagggauaucauaggaauucuugacauagucaauuuggauaguagcuauacaguuaaucacagggcaaaguacaucugcuuacuguguaaaagacgugaccuauuuagcuauacguacuuacauugaaauaaagaauuauuugucuauauuguauugcaagccacuaauuucuuuagacacuaucauaguguggcagugcuauagauguauauuuuaucuuguuuugauaauaaccaaaauuaugaugaauugaacuuuagaaaauauaucugaagauguggugaaaugguuugcaguuuauuguuuugggaaauuuguaauuuuauauaucaaauuuauaacacuauuaaaacaucguaugauagucuuuuucauaguauaguguuuuaaugaguuuugagguguucuaaugaaaguguacaaaccauccacaugauuaaagguaguuagcagcaaagugacuuuuaguccauucugugauuauaauacaguucucucugaagaagauuggaugggacuaaaguugcuugaaguaguuuugacuugccaagaaagugugagugugcuaguccaucacaguugccccuuaggugaugagguauucauccuauaaaaauguguagauuuauuugcuaguaaauaguuucaaaguauuugaggucuguuaauauuucccauaauccauuccagaguaggaaguuuggggauuaauuguguuaucacugacuguuguuucauuuuuuaaaggauguuuuauaucuguuucauaauucagauucacacccuaagcgucaguuucuuuuucccauuuccaugaguacuuuuuaaaguguauuucuuguacuuaguuuaauaauuauauaauguguugccuuuuuuucuuuuaggaaaaaaagcuuuuauaaaguauuuauuuauugauuuauugguugacugagacagagucuggcucugucgcccucgcuggagugugguagugcaaucuugauucaccgcaaccuccgcaucugggguucaagcgauucucgugccucagccucccaaguagcugggauugcaggcgcacaccaccacauuuggguaauuuuugcguauuuuuaauagagaugugugguagugcaaucucgaaucaccgcaaccuccaccucuaggguucaagugauucucgugccucagccucccaaguagcugggauugcaggugcacaccaccacaucuggguaauuuuuguguauuuuuaacagagaugggguuuuaccauguuggccaugcuggucuugagcucccgaccucagaugauccacccaccuuggccucccagagugcugggauuauaggggugagccaccucacccagccaaaaaacuuuuauaaaguauuuguaucuccaauuuaauugcaaacuugaugguuuuaugaauucauuugauuuaauguuauguucaauaaagauuuaaaaauauuucuuagauuuuaguuuaauaaaguuuuuaagauacuagugagggacuuggcuuuuuuaggcaaauggaauuuuaaacauguaagcuaaauaauuuuuuuugccuuuuuuuuuuuagugaauuagugccaucuuacgauucagcuacuuuuguuuuagagaauuucagguaagaguuuuugacaauucugguuuuuuuguauguguauauaaggaagagccagaaagguauucuuugguaagacaguaaucuagugaacugugucacucacuuuagaagucuuagaagaauaaguuuccuauuagaaauguagagauaauuugugcuggauuauauuguaucuuuagacugacugcuucucuagucugggaaaaggaaccuuuucuuuuuauuuugagacuggguuuugcucugucacccaggcuggagugcaguggcgugaucauugcucacugcagccucaaccuccugggcugcagcaauccucccaccucagccucccaaguaacugggacuacaagcgugugccaccacacagauggggucucacuguguuuccuaggcuggucucaaacuccugggcuccaguaauucucccaccucagccucccaaagugcuggaauuauaggcauuagccacggugcccugcccaaagugaggaaccauuuuaaauaagagagaucacuuagcuuugacuaagguggggggcuggacaguuagagguugaugagcccccucuuaccuauccucagaaauaaaagugcugggaagaaauccauugagauccauuuaucucagcucaaagugaagaauuguggauaaggggccauuauuguaagaaauguguaggcuuugucaguuguauguuaauuuuguuagcuuuuacuacuuuuucucuuaagaucagaagugaagaucguaacaugcaaagguucuuagcaauuugucuuugagggcagcauggaaguggaaacaaggacuauaaggucuucaggagagaaacuccaaauaauaggcaaaggccaucaaaauaaggccacacugggcagggcaugguggcuuaagcuuguaaucccagcacuuugggaggccaaggcggguggaucaucgaggucaggaguucaagaccagccuggccaacaugguaaaccccgucucuacuaaaaauacaaaaauuagcugggcgugguggugggcgccuguaaucccagcuacuugggaggcugaggcaggagaauugccugaaaccgggagguggagguugcagugagcugagaucgugccacugcgcuccagccugggcaacaagaguaaaacucugucugaaaaaacucuaucucaaaaaaaaaaaaagccacacagaauuuaucccucuucccauuuaauuugucuuuucuuaggguuacuuuuguggcuaaaacauagucucuuugagguuuuucccacacguauuaagguuuaguguacucuuguucuucaauauuaaaagaugauuauacugcagagaagcgaggaagaaacauucuggguuuuguuuuauuuuuaauggugaagacugcuuguugaagcauuaauuaauuuugggagacuuggugauacauuccuuuucccuuaaaugucacaauuuugaggguuuuuuuuccccugaaacuuaaaagauauugcugaauauuucaguaucuuuaaauuuucuuuauuucaggauguaagcauaucuaaacuuuuacaguggaauuuugaccuguucagucaccuuguuauuugucuaggauuucaaguauguaacaaagaaacugguuggucuuucuuuuugccuguugccauuucacaacaguuuugaucuugggauuugguugguuuucuuuuucguuagcacuuugcgucagagagcagauccuguuuacaguccaccucuucaaguuucaggacuuugcuggagguuaaaaguuuacccaguaaguuuuucauauuucuaauaaauuuugaaaccaaggucuuucuuucagaguucuguaguauacuaauuugauuacugagaacuguuaacucuucuuuuuuuuguuacauaugcuguccgcauucccuguuccccuucuucccccauauuagacaacuguuuguuuguccacaccuuguucucuaauacauucugcuggaaggccuauuggaaacaauguucccugaguucucauauguugaaaacaguuuuugccuuuuauauucuaaggcuaguauugcuggauauaaaauccuuggcucauauuuucuuucauuggguaucuucaauaugcaauuccauuuucuuuaggaaaagucugauaauaaacuaauuuucuuuaccuuuaaagauguuuggugauauugccuagaugcuaaauaaucuuuuugaguccaguaauuuacuauuacacauuuuagcccuccuggguuaguauucucaguuacacauugaagucuuucaauauguaguuucagauuauuuuuuuuuuuuuagaaaaguuuuguauaauggcauuacacaauaauauaucaucuuuuaugucuggcuuuauucaccuagcugaugagucauuuauucauugauaucuacugagugauuaucaugucgaaccucaaaaguugccucagguccuuucaagcaaaguagacuaaaaaugaagggguuaauaguacuuguaccucucuguagucauaucccaguagacacuggagauguauaaggaucucuguugucagccuucauugucucguugggggaacagauguuuaaacaaguaguuauaauaaaugugauucuuuuaaaacauagacaccugaaguacuagggaaauacauaggaaguaauucucuuuuuuuaaaagagucuugccaaauuaaacaaaaagggagggaguaauuaucuuuauaaaaauaaaaucuauaguagagauuuaaacaacuucucaaucucuagacagaaucuuauauggaauucuaauauuaaaaucauauagaaauuauauuuaauuacuuucagcauaggguauuaccuuuuuguauguuggucuuaaaaauuaauuuuugguuuaaaauuuuuuuuugcuucacucauuucuaaugaaauuauuuuucccauuagggucuuguuuuuuuauuaagguugauuuguaagaguucuauauauguuaaaacucuuaaccuuuguugugguuguugauauuucccuucauuuuugugccuuaauaguuucacuuuuuuuuuaaugcacaaaaguuuaaaguuguuaagaacucaaaucuauugguguuuuuaauuauuucuuccauugcuuugaggcuuagaaguacuucucaaucuagauaucagauauuaucugcauuuuguuuuauuguggcuuaauuuuuuuacacucaaacugauuauucuucuuuuaggauggaaauggaguugugcgagguuacuacuuaucuguguuucuggagcucucagcuggcuugccugaaacuucuaaguaagaaguguaauuaaauaacaaccuuaaugugcauuuacauaccuucccccuagcaauuuuuguuaauuuuuauuuuuguuaauuacuguauugguaugucuguuaagauguagaauaauauguucuuggcaucauaggaugguauuuuucuaaaaacaaaauauuuuuaagaaaacuuguauugcuuugcguuuuuagaaaucucuuuacuaucuggcuuagaagaagacuacuggauucucaugucugcuuuuauauucaauuuuuuuaaaauaucauuuugauugaaauacauguaugaaaucugucugcagaguucuacaaccaucaccaacaucuaauuuuauaacauucuauuuacuccacaaggaaucccuguacuccuuagcagucacuucccauuccccguuucccucagucccugagaaccacaaauguacuuuuugacaaggaggaauauuuuuuaaagugguuuuagauaauuguggaucuucuuugauauuacauccaaacugaacaagugguagguuguuaaauguuauuuacaaugugggaucuggaaucauauuaaugauuuuuuuuuuuaacucuguuacaugaaaucuguuaguuuaguauggaaugucugcuuucagcuaacaugaagcaagagggaugagaucuacccauuuuccugcaacaaccaaaaaaaaaaaaagaccucaugaaacaacauuuucuagacacuggacauggugguaacaaaugaaaguagucccugagagaugagaaacacaaacuaacucuacaauuucuccagcuuacagccuugagagaguuuucaggcugcaacacagggaggagcugggacugagggagaaucuggcagacuuaguugaggggauagugcugagagucuagaaaggacaauacagcuagagcgcauuggacaaaauaccagagaggagaaagcugcagagacugaagucuagagauccguaauggguuccccuugaguauucagcagaguacuuaucagggcauaugucugaggaaacuaccugagauuggggaaagaacuccuugacaggauuagagggaauagugagugacugguguucacacggggccaggaacugugucuauugcaaccugccacgguggagaaauuuauaauucaugggucacugauuggguauaacacuaaggaaguuuuugucucgauagcagaaauuagcccuagacugaacacugcucuggacccaccuaacaaaagugagaccugaaaggaucaaauuguuuucaaguaacuuaacugcaucccagaaggaagcucaagaaaauuuauaagguugcugaaguaucuaacauccaacagaguaaaauuuacagugucuuguguucagucaaagguuaauaugccagacuggcuggcccauaccuguaaucccagcacuuugggaggccaaggcaggaggauugcuugagaccaggaauuugagaccagccugggcaauauggugagacccugcauacgucucagcuacucaggaggcugaggcaggaggauugcuugagcccaggaagucgaggcugcaaugagcuguguccgcaccacugcacuccagccugaaugacagagugagacccugucucaauuuauuuauuuacuuaauguauuuugagucucacuuuaucacccagcuuggaguacaguggcaugaucucagcucacugcaaccucugccucccagguucaagcaauucuccugccucagccucccaaaauagcugggauuacaggcaugcaccaccacgcccagccaauuuuuguauuuuuaguagaaacgggguuucaccauauuggccaggcuggucuugaacucguauccucaggugauccgcccaccucagccucccaaaaugcugggauuacaggugugugccacugugcccggucaagaauucuuuauauauuuuggauacuaaaccuuuaucagacauaugauuugcaaauaguuucucccauuugguagguuuucuuuucauuuucuugauaaugugcauuaaugcacaaaaguuuauaggcuaucuucuuugucuuuuuguaaaccugaaaauuuuacaagauuggauauauaaauuagaauauauuggcuuucccaauguauacuucuuuucuuuuugagacagggucuugcugugucacugaggcuggagcacaguggcacaauuauggcucacugcagccucaaccuccugggcccaggugauccuccugccucagucucccaaguagcugggacuacaggaaugcacuaccguacccagcuaauuuuuuuguuuuuuguuuuuauggagacgggguuucgccauguugcccaggcuggucucagacuccugggcucaggcgaucugcccaccucggucucuuaaagugcugggauuacagguguuagccacuguguccagcuuacuuauuuucuuuuuccuuuuucuuuucuuuuuaacuuuuauuuuagguuugguguuacguaugaagguuuguuacauagguaaacucaugucauggggguucauuguacagauuauuucaucacccaggaauuaagcccaguacccaauaguuaucuuuucugcuccucuccuuuuucccacccucugcccucaagcauaccccagugucuguuguuuccuucuuuguguucauaaguucucaucauuuagcucccacaauauaagugagaacacgugguauuugguuuucuguuccuguguuaguuugcugaggauaauagccuccagcuccauccauccauguugcacaaaaaacauaaucucguucuuuuuuauggcugcauacuuauuuucuauuaggaaauuuuauagccuuugauuuucugaauacacaauaauuugcuuucuuaucacuuguacuggcaaaauacaguagaguauuucaaaauuuauauuuuaaaauugcaaggugauaaaccucaaaggauaauagaaauaacaauauuuaugaggaaacauauguagugaauauauggaaaaaauauugcauuaguaaaacaaaagcaacuuugaauuacuuguuuauucaaaauuuauuuauuuuuugagguguuguuuuauaccugauauaucgguaaacaucuuuacgaggaaaaaaggaccuauugccauucauguuuuggugguucguucaaaauacugcuguuuuggcugggcgcaguggcucacacccguaaucccagcccuuugggaggucaaggaggguggaucaucugaggucaagaguuugauacuagccuguccaacauuaugaaacccugucucuacuaaaaauacaaaaaauuagcugggcaugguggugugcacuuguaaucucagcuacuugggaggcugaggcagcagaaucacuugaacuggggggcagagguugcagugagcugagaccccgccacugcccucuagccugggcuacagagugagacucuaucucaaaaaagcaaacaaaaaaauacugcucuuuuucuggccgggugugguggcucacgccugcaaucccagcacacugggaggccaagguggguggaucaccugaggucaggaguucaagaccagccuggccaacaugaacccccgucuccacuaaaaauacaaaauuagcuaagcaugguacacgccuguaaucucagcuacucuguaggccgaggcaggagaaucacuugaaccuggagucagaggaugcagugagcugaaauugcaccauugcacuccagccugggcaacaagagugaaacuccaucuuaaauaaauaaaaaaaccccaaaauacugcuguuuuuauaaaugauaaaagaaauguaacugcguauaucaauaagguuucuucucagguaauuacuuagugaccuuaauguuuagaugaguuuguuuuuuauucuuacuuuacuaacuguauaguaauggucuguuuuucaauuuuagauaugaauaucguguagagaugguucaccaguccuguaaugauccuacaaaaaauaucauucgagaauuugcaucugacuuugaaguuggagaaugcuggggcuauaauagauuuuuccguuuggacuuacucgcaaaugaaggauacuugaauccacaaaaugauacagugauuuuaagguaacaggaaaaauuugauguugugguuuuuauuguggggaaauaauaucaucagaacuauauuucaaagaucauuugguuaacaaagaugaauauugaaauucauacuaacuauaaccuuaucaccuuuuuuuuuuuuuuuuuuuuuuuuuuuuuuuggagacauagucucgcucugucgcccuggcgcgaucucggcucacuacaagcuccgccucccggguucacgccauucuccugccucagccucccgaguagcugggacuacaggcgcccgccaccacgccuggcuaauuuuuuacuauuuuuaguagagacgggguuucacuguuuuagccaggauggucucgaucuccugaccucgugauccgcccgccucggccucccaaagugcugggauuacaggcgugagccaccgugcccggccccuuaucacuuucuuaacuguuuuauuuaaguggauaauaaucaaaaauuuguagucaaaaagucaaacuuuuuuugacaucuaguuagcaauuccauuaaagauaagcugggugcaguggugcgccgguguuuccaucuacuauggaggcuaagaugggaggacggcuugggcccaggaguuugagaccagcuuaggaaacauuaugagaccccccaucuuuuuaaaaagaaaaaaaaaagggggugggugggaaacuacaacuuccaguaaguauaguaauguuccauuugucuguugaacuucuagugaccucaccauuuggaaaucuaagaauagugagggauaaagugcugauuuuuuucacuucacagugcauauuauauuugagugacugguuuuacaacuuaauuuuauaaagcaacuaucaguucuuugucaauaacagcaaauuaaaaguagaagagucaagaugaaaguugacgaaaaccagcaauuuucuacuuuuuucuuaaacuuuuauuuuagguucagggguacauguguagguuuguuauacagguaaacucacaucauggugauuugguguacggauuauuucaucacccagauacuaagccuaguacccaauaguuauuuuuucuuauccucucccuccucccacccuccacccucaaguaggccccagugucuguuguuguuaccccucguuauauccuugaguucucaucauuuagcuuuuuuuuuuuuuuuuuuuuuuuugagauggagucucccucugucgcccagaggcgacauaucggcucacugcaagcucugccucccggguucacaccauucuccugccucagccucccaaguagcugggacuacaggugccugccacugcaucuggcuaauuuuguuuuuguauuuuuaguagagaugggguuccaccguguuagccaggauggucucgaucuccugaccucuugagccuccugccucagccuccaaagugcugggauuacaggccugagccacugcgcccggcccauuuagcucuuaaauaauaagugagaacaugugguauuugcgaaaaccaucaauuuuuuuuuuuuuuuuuuuuuuuuuuugagacagaguuucuaguugcccaggcuggagcgcaauggcgcgaucuuggcucccugcaaccuuugccucccagguucaagcgauucuccugccucagccucccgaguagaugggauugcaggcacgcgccaccaugccuggcuaauuuuguacuuuuaguagagaugggguuucuccguguugaucaggcugguuucuaacucccgaccucaggugauccacccacuucggccucccauagugcugggauuauaggcaugagccaccacgucuggccaaaaccaucaauuuuuauuguugauuguugguguaguauuuacaagaaaggauagaacguaaauacugacucaaacaacagcccuauuuagccaggugugguggcucacgccuguaaucccagcacuuugggaggcugaggcaggcagaucacuugggcucaggaguuugagagcagccuggccaauauggugaaauccuaucucuacuaaaaauacaaaaauuagccgggcugugguggcacgcgccuguaaucccagcuacucaggaggccaaggcaggagaaucgcuugaauccggcagguggagguugcagugaaccgagauuaugccacugcaccccagccugggcgacauagcaagacccuaucucaaaaauaauaauaaaguaaauaaaaacaacagcccuguuuaacgugggguagucuuuacaggucagaaguuuuugggcauuggcugggugccguggcucacgccuguaaucccagcacuuugggaggcugagguggguggaucaccugaggucaggaguucaagaucagccugggcaacauggugaaacccugucucuacuaaaaauacaaaaauuagcugggcaugguggcaggcacuuguaaucccagcuacuugggaagcugaggcaguugaaucgcuugaguccgggaggcagauguugcagugagccgagauuucaccagugcacuccagccugggcgacaagagugaaacuccaucuuaaaaaaacaaaaaacaaacaaaaaaagguuuuuggguaucauuacaugauguuauaauuugaugaucaaaauaagaacuugaauauuuaaaaaagauuaaaauauguucugaacugagaaguuucagaguauuuaacaguuuaaaaaguucucaucacaacaauuuuaaacauuuuuuucuugagagugauuuaauguacuccugaauuucccuuauucggagcucuuuguucuugagcauacuggacagaugaguugcuaucauaucagcauuuacucuuauguguuuuccguagcuuuucuggaaguauaaagaaguuuaacaagggauaugauuuucaguguagggaaaaagauauguuuuuguuauuguuuuguuuuguuuagagucagugucuugcuauauugcccagucuagucuagaauucucgggcucaagugauccuccugucucaacuucccaaguagguaggauuacaggugcaugccacggugccuggaaucauguuuuuugaggggagggauuauuuuaguuuucuucguauagcuuuucagacuuuugggguuuaacuauucaccaagagaaauaauuuauugcuauuucaugcuucagccauagagagaauuacaaaauuauucaaacaucaauuuuaccaaccuauaaaagacccauuuucuuauagccuugauuucauccuuauuagcguuacuuauuaguacagaaacaaauuccuguuaugacaucauuuuuuuuaagcaacauugagucuauaccauaugccugacacugaguugcuaauaagaaaaauauagacaugguuuuuguccacagggaacucaagaugaaauuggcagauaaaaacagaauuuacuacucucuuauuauaaaauaaugcuauaguagcaccguaaguaaauugcuaugaaguuuguggauagggggcuucacauuauccuauuaaugagacauugcucaaacuuuaaaccuuuuauuucaagauucugguggaauuuuguauguauuuauuagaaaguuauuuaaggcuuuucuauaacuaugaauguauguuucauucuuucauuaaaacagaaaguuaagaaauuuuaccugcugcuugguuuuguuuuaauggcaaaauauuagaacuaaugugcagaguuaaccagugguuuaaaucauucaaagaaaauaauaguguuuagacggucuuacuuuaaugucuuaccaguggguacuuccuagacugugaaucgucucugcucaguugagugaaucaucucuacucaguuccguucagaacguaauuuaaucucuugauuugauuugauuugauuugauuugauuugauuugauuugauuuuuugagacagaguuucgcucuguugcccaggcuggagugcaguggugcgaucucggcucacugccaccuuugccucccagauucaagcgauucuccugccucagccuccugaguagcugggauuacaggcgcccgccaccauacccggcuaauuuuuguacuuuuaguagagacgggguuucaccauguuggccacgcuggucucgaacuccugaccuuaggugaucugcccaccucggccucccaaagugcuaagauuacaggugugagccacugugcccggccaaucucucucuuuuuuuaauacucaaguucucauuuugaucauccaguuauaacauauaaugaugcccaaaaacuucugaccuauaaagacuaucccaacauuaaauaggacuguuguuuuauagucaguguuuauguucuguccuuucuugcauuaguauucuucacuaaaacuagauaucuacugccagauaacuguuaaauggucaguagguucuuacaauaagguguaaaauccuagaaaaaaaugaacagcuaacauuguguagccggguaaaagggcuggaaggaaugagagagauguagauguccaaauuagucuugccuugugguuuuuccuuucuucaaaaacaccuucacacaugcacugcaauuuuuucaccuuaaauauagucacguuaggcuauguaacaaagguagagguuuguuugcuuuaguaauaguuuuuuuuuuuuuuuuaauuaaaacaacucuggauagauuaagauucugucauuuauauauuaauacgauuuuauguaggugcaguacuuuuuuuccuaaccuaagcugaaauaaugccauauuguaauaagggcaguuuugauugcuaucuugaaggguucaggauauaguuuauuuagagcauguaacuccuugggggauaguaaagcaauccugggugguugagccaggaagugauuuuuuuucugaggggcaggaaauacgggaacgugagauggaauagagaaauauaaagagcagcacuuaaaacuuuguauuuugcuacaaaaaauuagccgggcguaguggcgggcgccuguagucccagcuacuugggaggcugaggcaggagaauggcgugaacccgggagguggagcuugcagugagccgagaucccgccacugcacuccagccugggcgacagagcgagacuccgucucaaaaaaaaaaaaaacuuuguauuuugcuggggccucauuuagggaagaaagggauaagaguuaucuuccuccuuauaggaggaaacugcauaguauauggcucucuucuucccaacucaugaucaucauuguauuuuaguuacauuauuauaauaaauaugccugaguagguuaguuugggaagcuuaacuacaauguacaauguuauuucuuuagaaagguaguuugaggacaacuggcuuuucagaaccuugugucauaaucuguggacuacaucuauaaacaacaaauacuagcagcucuaaguuuaugugaauuuuggccuuauaaucaaguuaacccaaauugcagaauucagugcuagacugauaauguuuuacuauuugaauuuuuuuuuuaauguggcacaauucuuuuaagguuucagguacguucaccaacuuucuuucaaaaaucccgggaccagcauugguacauuacucaguuggaagcugcacagacuaguuauauccaacaaauaaacaaccuuaaagagguaagaaaauaucuauuucuguuuugguguuuccuauuguccuuuuggcuuguuauauuuguaauuagauuuuauauauuuuauugcuauuuguaauuuuguaauuuguaauuagaaaaaaaaucuaguuaucuuguuccccauccuuaccaguucugcaguguccaguuuaguagacacuagccacauacggccauguaaauuuuuauuuuacuuuauuuauuuauuuuuuuugagaaggagucucgcucuguugcccaggcuggagugcaguggugcaaucucggcucacugcaagcuccgccuccuggguucacgccauucuccugccucagccuccugaguagcugggacuacaggcgccugccaccacaccgggcuaauuuuuuuguauuuuuaguagagacaggguuucacaguguuagccaggauggucucgauguccugaccucgugaucugcccaccucggccucccaaagugcugggauuacaggcaugagccaccacgcccugccacuuuauuuuuauuuuuuuuuauuuuggagacaggucggacucacucuuguugccaggcacaauuuccacuaacugcagcuucaacuucccaagcucgggugaucuucccaccuuagccucccagguagcugggacuacgagcaugugucauggcuaguuuuuguuuuuguggagauggguuucuccauguugcccaagcuggucuugaacuccugggcucaagcagucugccugccuuggccucccaaagugcugggauuacaggugugagccacugugccuggucuguaaauuuagcuuaauuaaaauuaaaaauuuaguuccuuaguugcaguagccacauuucaagugcuugcauugguuacugcaaaucuagagcauuuccaucauugcauaaaguuguuuugaacaguguggcuguaguuugagguaagcuguuuguguuucugucagugacuuaguuucucuuccacaaguuaucuuggauuuagaggauucuaggcuauagcacaauuaaaaguugucccaucuugaacucuuacuauuguugaaugagcacuggggaagauuaauugaugaauuuuuauuuuacagugguaaacuaaggaauguuucauuucccuuaggaaguuaggguguggcaggagguuuggagugcugagagucguuaauaggucagggaggaaaaugugaauaaauacaugcuuucagagauuuucauguuaaaugugcuauuuaaaacugccuguauucacuauacuguuugcuaauuguauguuuagcuuaggcuggauaugaaagaaggaggaugagcauaaauggggcaguuuaucuuugucaucaauuuuuuuuuauaaauaaaaggcaguagggauucagagaaaugguuuaagaaauggugccaagugagguggcucauuccuguaaucccagcauguugggaggccgaggccagaggaacauuugagcccagggguucaaaaccagcuugagcaacauagcaagauaccgucucuaaaaauaaauaaaaaugaaauuagccaagcaugguggcacacaccuccagucccagccacuugagaggcugaggcaguaggaucguuugagcccaguaguucaaggcuugcagugagcuaugauggcaccacugcacuucagccugggcaacagagugagaccauucucaaaaaauaaauaaagcaaugguuuuagaaacaucuggaugcauuuuuuuuucacuugagacaucuuuuacugugccagugagcuguggcuaauauuugugcuuuucuuguuuuaaaagagacuuacuauugagcugucucgaacucagaagucaagagauuugucaccaccagauaaccaucuuagcccccaaaaugaugaugcucuggagacacgagcuaagaagucugcaugcucugacaugcuucucgaaggugguccuacuacagcuucuguaagagaggccaaagaggaugaagaagaugaggagaagauucagaaugaagauuaucauguaauaaugaggccaguuuuagauuuuuguguuugauuaaaaaaaaacaguagcaucauggcuuuuaacauauuaugugcuaaaacaguaggcuaaaaauauuguccauugauuuccauuaguaauguauguaugcccuuauguaaauguuaauaagucagaaguuguugaaucaaagcauuucaagguugugaaaaaaacaauacauuguauaaaacaaaccgugauacacauuuuaaaaccuaaacuaccauacauuguggauuuuaaaaauguguucuggccgggugcgguggcucacaccuguaaucccagcacuuugggaggccaagguggguggaucacaugaggucaggaguucgagacuauccuggccaacauggccaaacccugucucuacgaaaaauacaaaaauuagcugggugugguggugcuugccuguaaucccagcuacuugggaggcugagguaggagaaucacuugaaccuaggaggcggagguugcagugagccaagauugugccacugcacuccagccugggagacagagcaagacucugucucaaagaaaaagaaaaaaaaaagguguucuauuuucauucacugaaacuaguacaugccuuaucauuacuuacguagguagacugauuuaggauucgguagcuagccagguucuaucccagcuaaacaacagucagaauccagaauaagaguucaagaaguaguugauauuuuuacauaagaagggaugcauagacaguugguuuuuuuguaguaauuuuuaagaugagagacuucaguuuuaaguuaaaaugaaggacccagugggucgagagaaugcacagauuaagugcuuugauaaacuagagauaauaggguuuggaauggagcagucaggugaagcaguuaaccuuugauaaacugaguuaaaggaaggguggaguuugcagguaaggcagcugaaaaguuggggaaguuuuugcuuaauaguggguauuuuuuuucugugcagauaggugacaguguuaauuaaugaccuugauaaugguaaaauuagguagaauugaggagugaugguuugaaacguuacucugugaggaagcugauguggaauaugugaaggauuccagucacacugagggcccagcugaaggcggcacgcauaaguuaguaaaaugauaucagucagugugguugugugauuuuucucuacagggcucagcagcugaggcacaggagcagaaaauagauuuuugaaaacuguauuauucuuuggugcuugguuuaugggcuggauggggugaucaacugaguagaaacauuuggaauagacgucuuguuuucuuggcauugaucuagcacgagcuuucagauggagaucuggaucuggaucuuguuuaugaggaugaaguaaaucagcucgauggcagcaguuccucugcuaguuccacagcaacaaguaauacagaagaaaaugauauugaugaagaaacuaugugaguuucccacuuuacuacuguaaagcauuuaagugguaauuauuagaagcauauuaacuaacucacacuuaaauguagggauauucagcacuuuuuugaaagauugaaucaauagucaguuuucucucucuaaucucugggcucuuagccaauaauuuuuguuuguguuuuaacuuuuaaauuugaauuuugaaauuauuuuauacuuaagaaaaguucagaauuucauguuuccuucacacagauucauucccuaugaauauuuugcuuuauauuucucuguauauaauuuuuucugaaacacuugagaucgaauauacuucucauuguguacuuuucuaaaaacaaggauauucuuacauaacuauagaauaguuaucaaaaucuggaaauuaacauugauguaauacuguaaccuucuaaaaauuugccaguaauguccuuugucaggaucauguugcauuuaauuguuaaaucgauuuaguuaucuucaaucuggguuacuuuuuuuuuuuuccuuuuuuuuugagacggagucucgcucugucgcccaggcuggagugcaguggcaugaucucagcucacugcaagcuccaccuuccggauuacgccauucuccugccucagccucccgagcagcuagaacuacaggcgcccgccaccucgcccagcuaauuuuuuguauuuuuaguagagacgggguuucaccguguuagccagguuggucuugaucuccugaccucaugauccguccaccucggccucccaaaguguugggauuacaggcgugagccaccgcaccuggccaaucuggguuacuuuuuuaaaaauuuguuuuucggcugggcacgguggcucacgccuguaaucccagcacucugggaggcugaggcggguggaucacgaggucaggagauccagaccauccuggcuaacacggugaaaccccgucucuacuaaaaauacaaaaaagaaauuagccaggugugguggcaggcgccuguagucccagcuacuugguaggcugaggcaggagaauggggugaacccgggaggcggagcuugcagugagcuaagaucacgccacggcacuccagccugggcgacaguugagacucugucucaaaaaaaaaaaaaaacuguuuuucaugacuaauacuuucugagaaauacagaauaguuuauuuuguagaaagucccucaguuuggauuagucugaaguuuccucaugauuagauagagguuacacacuuuuggcagggauacuacggaaaugauaauguauccuuuucacugcgucauacagaguggagcaugaugucaguaugucccauuacuugugguuaauuuugaucacuuaguugagguagcauccgccagguuucuucacuccaaaauuuguacuuuuuccuuuauaauuaauaaguaucuuauguaugggacuguaaauauccuauuuuucauccuacuuuuuccuaugaauuuugacacccuuugaugaguguugccugaaaaagguuacuguguugauugccaagugguguuuuucuaauuccauuauuucuuacucauucauuaguugcaauuuaaggaagagcuuuuccuucugcccuguuaauugaugaacuaaugaauuucauuaauguggauaauuuuuuuuuuuugagauggagucuugcucugucacccaggcuggcaugcagugucacgaucuuggcucacugcaaccuccaucuccuggguucaagugauccuuccaccucagccucccgaguagcaaggauuacaggcgugcaccaccacgccuggcuauuuuuuuguauuuuuaguggagacgggguuucaccauguuggccaggcuggucuugaacuccugacuucaggugaucugcccacuucagccucccaaagugcuaggauuacaggugugagccacugugccuggcgauuuuuggauuuuuaaaccaagcuugcauuccugggacacaucccacuuggucauaguguguaauuuuuuuucuuuuuucuuuuuuuuuuuuuugugacggaguuucgcacugucacccgggcuuaagugcaguggcaugaucucggcucacugcaaccuccgccucccggguucaggcgauucuccugccucagccucccaaguagcugggauuacaggcacccaccaccacacccagcuaauuuuuuguauuuuuaguagagacgagguuucacugcguuggccaggcuggucucaaacaccugaccucgugauccacccgucuuggccucccaaagugcuggaauuacaggugugauccacuucgcccagccguaauuuuuuuuuucuuuuuuuuuuauuugaaacggagucucgcucugucccccaggcuggagugcaguggcgcaauauccgcucacugcaagcuccgccuucuggauucacaccauucuccugccucagucucccaaguagcugggacuacaggugcccaccaccuugcccggcuaauuuuguuuuguauuuuuaauagagaugggguuucaccguguuagccaggaugaucucaaucuccugaccuugugaucugccugccucggccucccaaagugcugggauuacaggcaugagccacggcacccagcaauuuuuuuuuuuuccuaagagaaucuggcuuuguggccaggcuggaguaugguggcaugauuauagcucccuguaaccuucaacucuggccucaagugauccaccugccucagccuccauaguagcuaggacuacuggugugcaucaucacacucggcucaugauucuuuuuauauguuacugcauucuguuugcuaguacaguugucccucaguauccuugcgguauugguucuaggaccccgcccuuggauacuaaaaucugaggaugcucaaguaucuuauauaaaauggcagaguaguugcauauaaccuaugcacauccuccccuauacuuuuaaaucaucucuagauuacuuauaauaccuaauacaaugcaaaugcuauguaaguaguuguuauacucuauuguauacagaauaaugacaaggggaaaaugucugcgcaugacuuuauuuuguuuuguuuuauuuauuuuuuuuugagacggaguuucgcucuugucgcccaggcuggagugcaguggcacaaucucagcucacugcagccuccgucuccuggguucaagcaguuccccugccucagccuccugaguagcugggauuauacacgccugccacuacgcccgacuaauuuuuuguaguuuuaguagagacaggguuuugcaauguugaccaggcugguuuugaacuccuggccucaggugagccacagcacccggccggcuuuauuuuuugagacggggucuugcccugucacccaagcuggagugcaguggucgcgugaucacagcucacugcaaccucgaccuccugggcucaagugauccucccaccucaguuuuccaaguagcuaggacuacaggugcaugccaacacaccuggcuaauuuuuuaauauuuuguagagacagggucucacuauguugccuuacuauguucuaggcuggcccggagcuccuaggcucaagaagucccuccagccucggcuucccaaagugcugggauuacaggcaugaaccaccacaccagggcuuaaaaaauauuuuugauccacaguugguugaaugcacagaugcagagcccacagauaaagaaggccaacuauauuucguugaugcucuuaauaguguuguauguuucucugaguguuguaugugucucugcuucuccccauaggcaaaaucucugagccaaagcuuugaaguuggaguaaggauaaagguguaccucucuuacuuuagaagcugagcuaacuggauguuggggacaguagccuuaguucuuuccuuuucaggcuugggaccuccaccuuaugaauaagcuggggcagggaugaucugggccccaguauucucaucaugcugcauccagguagagcaucuaguccacaagugggucucagcagaagggagucuccaccucuuggccgugugugccuguacuauagcaucagcaauagguagcugggggcagaaugagagaugcugauaccuugccacucccaggaauauagcccuccucuuggaaguucgggaagugggaggccuguguucuucacugcaccagucuggaguggaauuucuguaacaccaaguuaggaaguggagugaucuugguucaaauacugcagaugcccacuugucuuacccaguuuuuauagauuuuuuugaguagauguuucuucauuugcuguaugcccuugggaccauuuccagagucguuaagugguuguuuuuaaaauaauugucaccaguuugacuaaagagcagaccuacagagcuccuuacauugucaagcugggugcuuaucuugagauuuccuuaaauacccaagacugucauugacugguacuguuucaaguaguauguuguuuaaaauaaaguaauagugauuguuuuuuaacaugagagacuuuguauggccgaguaggaaguaauacccucuuugcugaaauauuauuuuugaaaaaugguauuuagucauauacaguaauuugggcuuuuuuuggauguuaaaauguaguguuuuaagccuaacacuacauguaguguuuuaagcuuauugccauuaagcuaccaguucucugaagcuguaauuucuucuaacagugguucuuguauuuauuaguguuucuaacacuaauuaaauaggagagauuaaucucuucuaauagugguucuuagauuuuuuaguguuucauuuauuucuauuuuuuugccugacacaguucuuuuuuuuuaaucuuccuuuccuuuccuuuccuguccuguccuguccuccuugagacagagucucgcucugucguccaggcugaagugcaguagugcaaucuuggcucacuacaaccuccaccucccggguucaaccgauucugcugccucagccucccgaggagcugggauuacagguccccaccacaacgcccagcuaauuuuuguauuuuuaggagagacaggguuuugccauguuggccaggcuggucucgaaauccugaccucaggugauccucccaccuuagccucccaaaguucugggauuucaggcgugagucacugcgcccggccuugagauauauauauauauauauauauauauuuuuuuuuuuuuuuuuuuaaauuccuuuuuuucuuagcuuucuaagaagaacuggcugauuuuuuuuuuuuuuuugagauggagucucgcucugucgcccaggcuggagugcaguugugcaaucuuggcucacugcaagcuugccuccuggguucacgccauucuccugauucagccuccugaguagcugggacuacaggugccugccaccacacccagcuaauuuuuuguauuuuuaguagagacaggguuucaccguguuagccaggauggucucgaucuccugaccucgugauccgccugccucagccucccaaagugcugggauuacaggcaugagccaccgcgcccggccgauauuuuuuaaagguuguuuaaacaauaacauuaacgcuacuuaaauuuggaaaaugacaaaaaucuuucuccuuuuuguauuuagaaauaucuuauuucacagaaaaaucugcauaucauaaaauuuauugaggugugaaaaacaacguuuauuguaucacucuauauaaaugauggauuuuguauauucuuaggucuggagaaaaugauguggaauauaacaacauggaauuagaagagggagaacucauggaagaugcagcugcugcaggacccgcagguaaugaggucacuccacugccuccaagccauucuguuuucucucugcucuucucugacuguauuauauuuuaaauaggugguagccacugcuuguacaugguucaugguguuggaagugguauaucuuauaauauggauuuuuuagaguuuauuacuaaagauauuuaaaacaauagcuaacauuugaaaaauguuuuauguaccaggcacugugagaagcacuuuaaguaccuuauauuaauaaaauucugugugauacauucacugaugcauagagaaauuaaagcaacuugccaacuuuuaacaauuuaguaaaugagaguaauugaauccccagauuuguuuguaucccaugcucauauuuuauacuauucuuucugauauaaagucuuauuuguauaucuugcuagacuauagaaugaucucaguggaaucauugacucuuagacuuacgaaggaucuuaaagagcucauuuuauaguuuucaguuaccuggucauauagcugguuguuaguacaaccagacuagaaccccagauuguccuggguuuguggacccagcauuuuucucccaaacuaaaacacugcuucuccugggaagaacugacuuauauaaugaguacuuuuuuguguguucucggaucuauuuaauuaaguagugaaucuugguuagaguaauuaaaaguuagcuuucuacuguuucuguuuuacccauguucuccucaguaugaacacuggcauauucuuuuuuuuuuuuugagacggagucucgcucugucgcccaggucggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucuugaucuccugaccucaugauccacccgccucggccucccaaagugcugggauuacaggcgugagccaccgcgcccggccuggcauauucuuaauaugcugggauaacuaaagauuucuuaaauacuaguccucaccauuucaacuccaaccuaagcucuauauucuuucuacuccugacuuuaauccuggguaaucuuauccacaccuguauuucaguuacugucuauaugcugauuacuuuucaaguucuuucuuuagccuuugucuuuccauaguuuccaaacccaugucuuggugugugauucagcacuucccaaacacaaauuacugucuuuucaucugccagccugccugucagcaguagccaccgugacugauaaugcuauacauucuuuacuucuuccucucccuaaaacuuuaccuuuaguguauuaccaagaucuguugguucuguguccuaaaucgugcauaaauucauuugguacucccacuccuuugccauuucuagucuaggccucugucuuucaccuggguuccuuguauuuauuauuguuccccuccauuguauuuuuacagcauggauucagaaugaggguguuuuuuucuuucugauuaauaucuaaucauguuacuucucuaccagucuuggugacucacgccuguaaucucagcacuuugggaggcugaugugggugcaucgcuugaguccaggaguuugagaccagccugggcaacguggugaaaccuugucucuacaaaaaaauacaaaaaaauuagccagaugugguggcuaaauugcugccuguggucccagcuauuugggaagcugaggugggaggaucaccugagcccaggaagcggagccugcaguaagcugagauagcaccacuguacuccagccugggcaacagagugagacccugugucaaaaauagaaauaaaaauaaugaaaaauaauaucuaaucauguuauuucucuacuuaaaaacucuuuaaggauuauauuuauuauaggauaaaguccaaacuuguuaacauggcacauaaauuccuuugugucuggauuccuguuuguuuccuuagccuuauuucugucauuccucuguaucauucuuuagucaggaggaacuucaaagaaucacaagaucuaccaauuuggagagaagagcuuuaauucuuauaaagacuggccauccugggccgggugugguggcucacaccuguaaucccagcacguugggaggccgagguggguggaucacgaugucagcagauugagaccauccuggcuaacaugauggaacccccucucuacuaaaaauacaaaaauuagccaggugugauggcaggcgccuguagucccagcuacucgggaggcugaggcaggagaaugucgugaaccugggaggcggagcuugcagugagcugagauugcgccaccgcacuccaaccugggugacagagcgagacuccaucucaaaaaaaaaaaaaagacuggccauccugacaggcugggaaguguggccucuggcaaagacuaaaagcaggcacuuugcaggagggaaggguaacauaggaauugaugcugaauaaguuggccaaguacaacuaaaucgauucagcaggcuauaggaggagcugugaacaucaugaaaagggaaacacacgcaugcauaguagacaaacaugcauguuacaugcauuucauguuuacuuuggaguggggacugaacaauuuaaaugcauuacaauuaggcccuguugucaaaagguaaagccaaggacacgaaggcacucaaugcucagccucuguauacgggccagaaccaguccaugguuggcgacuccuaucaggagaaaguuacugaaaucagucucuuguccagucaaagcuguaguuacggcuguggaacagggagugagucagucagcaucuggcagucaguaagcugcaauuguuucaauauugcuuaucuugaggccagugcuugcuuagcuucuagaaaaaagaagaaauucuguugcaguuagaauguaguuuauucuuuaaguauagggagcgugugacuuaauccuugucugguauggcauuaggucuuacugacugacuaacuuuucagccuuguguguuuucuuuuaguuagguccauucuuuccucucuuaaacugugugguagagagauucuuguauauaacauuuauauacacuuaggguaaagaagaguuuacauuuuugaauuauauauucaucaaauauuuacugagcacuugagcuguguacaguuuuacuaucuagagauacaauauugaauaacaagauaucccuguucuuauggagccuauguuauaauucugaauauucuguaauaauccaggcacuguauucuagauguugaagacauaauaaugaaccaguuuauuuuuauuauaugcuuugggaaauuuauguauuuggcagaaauuuguuaaauaucaugccuaccuggaacauacaacacuaaguaauuuauaaccuaagggugaguauauuuaugaacaauuagcuagaauaugacaauguacauacaaaagaauuccaaaucauuuaaauacucccuucucaaggagaugaaauauaacuucuaccccuuaaauguaggcugugcuuaguuacuugcuucugaauaguacaguuucaaaagggggaaacaacuuugaaguagagaaacuuggcaaacauuaccuacccaggugauuaaauuuaguauuguaagugauaggucauguugauagcauguugacaguauuguaagugauaagucauguugauauguugacaaugguacuuuauaucuguaguaucuucccccuaaaaacccacaaacacaaucuaaucaugagggaaaaaaucauacccuuaauugaggaacauucuacaaaauauuugacauacuuucagacauaaggaaagucugagagacugucauagaccagaagagucuaaaaagacaggagcaacuaaauguauuucaguacucuaggugagacucuggaacagaaaaagaacauuaggggaaaacuacuaaaaucucaauaaaguauaggauuuaguuaauaauauaucaguauugguucauuaguugugacaaauauaccauaguaaugaaagguauuaacauuggggaaauuggaucuggguuguacaggaacucucuguauuuuuaccuuuccuguaaaccuaaaacuauacuaaaauaaaaaaauuaaaaaagccuuuuuuuuuuuuuuuuuuuuuuuuuuuuuuuugagacagagucuugcucuguugcccgggcuggagugcaguggcaugaucuuggcucacugcaagcuccgccucccagguucaccccauucuccugcuucagccucccgaauagcugggacuacaggcgcccgccaccacgcccggcugauuuuuuguauuuuuaguagagaugggguuucaccguguuagccaggauggucucgaucuccugaucuugugaucugcccuccuuggccucccaaaguacugggauuacaggugugauccacugcaccuggccaauaaaaagcuuuuuaaaccaaggcaaugaaaaagcuagaucggggugacacugggcagaguguggaaaugcuuuuuuuuaauaugcuuauuaugaagguccauuucaagccucgaaugguuuauguguuuuuuguuuuuguuuuguuuuguuuuguuuuuugagauggagccuugcuguauugcccaggcuggagugcaauggcacgaucucggcucacugcaaccucugccucccggguucaagccauucucuuaccucagccucccagguaguugggacuacaggcaugcaccaccauuccaagcuaacuuuuuuguauuuuuaguagagaugggguuucaccaugcuggccaggcugcucucaaacuccugaccucaagugauccacccgccucagccucccaaagugcugggauuacagaugugagcuaccacaccuggccugguuaauguuuuagaacuacacaauugucuaaagaguuaugugaucuaaagaauuacgauguuaaguuaugcguuaaaaaggggaugauugggcuuauauaaaagcuagguauaaaguuaaauguuuacuuaauaaucuuauuuuauagaccauauuaaauaaggagauagcuugaaacaagaaauauuuauugacucaacuggcuguaguccuggcuacuugggagacuguggccguaggaucacuugagccuaggaguucgaggguacagugagccaugauucugccaccguacuccagccugggugacagagcaagacccugucucuuaaaacacacgcgugcacacacacacacacacacacacacacacacacacacccccagcaaauacaaacuagauuuuuccuacucacuggauucaaugagccaauaaucuggauuagaaugauacuuaaaaccuuuuuagcacaaauuuuuuuuaacauaaauugucuuucauuuaacuucaaauaacugaauaaacuaaaagcaguucucauaagaagacgucugcagaugcuaccacgcccaacuaauuuuuuauagagacggagucuugcucucuugcccuggcuggucuccaacuccuggccucaauuaguccuccugccucagccucccaaaguguugggauuauaggcgugagcuauugcaccuggaccacagauguuagaagaaugaaugagcauaauuuuuaaaugaaaauccagcacugaucauuacaagauuuugugaugguaaauaucgguauguaauuuguaacaaagugaaggaugugaaaauguagaauauucuggaaagguaguuugagacuagacuauaauagggccuugagugucaugauaaugcauacaggcaguaugcuguaaugaacucaaguauauaagugugacauuuuagcaagauccauauggcuuggcacaaauggagaagaaccugucaccgauccgucugucuuuuuaugagguuuuuuuucuaugugaacuucagaagcaugguuuuuguuguuuuuuuguuuuuuugguuuuuuguuuuuuuguuuuuuugaaucucgcucuguugcccaagcuggaaugcaguggcacgaucucagcucacugcaaccucugccuccuggguucaagcaauucugccucagccucccgaguagcugggauuacaggugcccuccaccacggccagcuaauuuuuguauuuuuaguagagacgguuucaccauuguggccaggcuggucuugaacuccugaccucguaauccaccugccucggccucugaaagugcugggauuacaggcgugaaccaccgcgccuggcuguauagcuuuauucuuaauagccaaaagcuagaagcaacccaaauuguuuuccaauagaauaaagaaauaaauuggauauauucauaaauggaugcugcacaauaauaaugaaaaugaggcaguggcucaugucucuaaucccagcacuuugggaggcugaggcauguggaucacuugaggccaggaguucaagaccagccuggccaacauggcgaaaccucauuucuacugaaaguagaaaaaauuagcuuggugcaauggcgcacgcuuguaaccccagcuacucgggaggcugaggcacaagaaucauuugaaacugggagguggaaguugcggugagccaagauugugccacuguacuccagccugggugacaaagcaagacuuugucucaaagaaaaaaagaaaaauauuuaaaaagaaaaugaauaagauacuucuauauacagccauauagaugaaucucaugaauaauguugaccaaagaagaagagcauaagagcauacucuguuacuacuuuuauacaaauacaaaacaggcaaaacccaucuguaauuuaaguuaggaugaagguuauuuuuguagaguaggaguagugagcaauuuuaggaggcauaggaggggguucugggguacugauaauauauuucuucaucugggugugaucacuuugugagcauucauugggauguacauuuauauaugagacacacagaauagcuuggaaagagagaaacugaaaucagugccaacccaaagucuuugaugccuguggggaaaugugauaguggguagaaaggugggaacauaggccgggcaccauggcuccugccuguaaucccagcacuuucggaggcugaggcgggccaaucaccugaggucgggaguucuaaggccagccuaaccaacauggagaaaccccgucucuacuaaaaauacaaaauuagccaggcauggugcugcaugccuguaaucccagcuacuagggaggcugaggcaggagaauugcuugaaccugggaggcaagacuccgucucaaaaaaacaaaaaagaaaagaaagcugggaacauuugaaaggggaguagccaaaggucauacccacauuaaaaaaaaaagcaguuuuuguucaguagugagaauaauggccugaaaaagcagugagaaacaggagacaccgcuuucucuacuguaagugccuuuaacauggaagaaugagcaacuuacauuuuuaaaggagaaucagauauuagggcaauagauuccauucacugggcuacuggacuuaacuauacauaagaacgaucugaguagcuuuuugggaaaaaguccuggaucucaccuccguauccuuuuuuuuuuuuugagauggagucucacucugucaaccagacuagagugcaguggugugaucuuggcucacuguaaccucugccucccagguucaagcaauucuccugccucagccucccgaguagcugggauuacaggugccugccaccacaccuggcuauucuuuuguauuuugguuucaccauguuggcaaggcuggucucuaacucuugaccucaggugaucugcacaccuuggccucccaaagugcugggauaacaggcgugagccacugcacccagcuucucaccccaguauucuuguucaguguaucuaggauguaauuuuaaaaacuccuucagcugacugacauacaacccaauuugggaauuccuuaguaaaagaaaagagguaaaaacaguuuucagcugggugcgguggcucacaccuguaaucccagcacuuugggaggcugaggcgggcggaucacuagguuaggagauccagaccauccuaacacggugaaaccccguaucuacugaaaauacaggugugguggugcaugccuguaguccccacuacgggaggcugaggcaggagaaucgcuugaacccaggaggcggagguugccgugaguggagaucgggccgcugcacuccagccugggcaacagugagacugugucucaaaacacaacaaagaacaguuuucaaugugaaggggaaaucguuuucuguuauuuaauaggaauugcaguaauacagaggcugggaagaaaaacugucagugagauaauaauccuuagaagaggaggcagaagugggagacagugagaacaugaggaugugaaaagcauaaauuauuaauuggcuugaagcuucugaacaauggaacuuuccuccuaaguuauauccugcuggaucucucugaaauacucauggguaguuggaaccugacuuuuuaauauuuuauauuaucuacuuuccugcguguagcauuguuuuaaaauguucuaucucuuuaaaauauauuuaaacagcuuuauugaagaaggucaguuuuaagcaacauuuccauaucugguauuuguuaugcauuauacuaggugcuagagaaaagucagaugcuuuucuuggcuuaaagagcauaguccaauauagggguauaggcauaauaucugccuacagaugucuguaaugugcaucagucauuaacaugacaguccaaaaacuucaaauuguaccccauuauuuaaucaaaguagaaaaagucuaccaaacugucaugaccuauacauuuuacuguccagagacuugggggagauuucuauuuuggugucuaauucuuuguaaucuguuauacuaugggaauuugucuucuuuuaucuaaaaccagguggucaugggauauaaucuccuucuccuuacccuuaccucucauccccccaauugugcacaucguacacauugucaucuguuuuuuucuagggcucaggaugggguugaggcuugcuucugaauucuaaguacuaaugaggccaccacucaaucacugugcuaauguacaacugucugguuccuucuuucuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggcccugguuccuucuuucugcuucuuaucaugaaccugaacuccuaagagauagguccauagacaaguauucauauaauguuaaccaguucauuuuuucauuuaaguauagcuaaguuugugcauauauauaucauuuucuacgccucuuuugcagguaguagccaugguuauguggguuccaguaguagaauaucaagaagaacacauuuaugcuccgcugcuaccaguaguuuacuagacauugauccauuaauuuuaauacauuuguuggaccuuaaggaccggagcaguauagaaaauuuguggggcuuacagccucgcccaccugcuucacuucugcagcccacagguaaaauaauaacaaugauaauuuccuuuuuuucugugguucucuaaaagaacucuuggauuuucauuuaaguauuucagcuauguguggaacaugguguauuucuguguuuuucauuguauaccauaaaaaugacauuuaugucaaccaaauuaguuuuuaaauuaccguucaaaggugauuugugcaaaaacaaaguaaaaaugccugcaagaagguuuuuugugacuugcuacucagauuuugccugacaguuugauccauaugaaauacgguuaucuucuuuaugaauggacuuuuuuuggucaggcuucaugaauucccuuacuuccaaguggaacuauaucuaaauugaacguagaaaaaggugacuuacucauucuuugauguucaguagcuuaaaaauguaugccaguuggcagcacuguuuucugugcaaagguuauuuguuaaauagaaauuacauuuguguuacuauaauaaaauggagauuuguauagucaaauaugggcuuuuuuaaacucucggggauagagucauuuuggacaacuaaguauuugccuuuaaaagcuacauuuuaaaaaccauuuuuguuggaaugcuuucuaaaguauagucaguauauucaaaaauauaugccaaauauuuuucuaccuucuuaaacaauaguauuauauacaucaaaucaaugauuuagaacucugauuuugauguaguuuuaaggcaagauaacucauuuuucaaucaaaguccaaggcagaaccucuguguaaauaacagagaaauagagcucuucuacugguguagggacauggagcccagauuauuuaggcuucuucuuuccuaagagccagauauacuuccugaaagucuggauccucagcuuaaaagacuaucuucagguuaugaaacaguugccuuuuaugugugcgccaaguaugcuuuauauaaaguuuuacuuaaauguuaaguguuguuugcaaaggcccagugaaacagacagguucugauucuguagguagauauguaaguugguuuaaccuuuuugaaggacaauuuuguaguaguuuaaaaauaucuauauccuuuaaacuuguaauuucacuuugaggaguauauuccaaagagaaaacaagcagauguuuaaaaauauucaacaauacaguuauagcugaauaaauuacaguguaaccaugcaaugguauauuuuauagacaaguaaaaucguguuuuugaaaauaaucaguaucauugggaaaaaugcaaacuaaauaguaagauuucuguguaaaacuaguuuucuguguaaaaacaauacaaaugagaugaucugaauuucaaauuuaggugauaaaaugcuggcaauaaugagggcggggaaaauaguagaaagaaaaagcaaguuuuggauuuaaacaucuugaguugggcauaacagugugacaucaaauuagaaaggaccaguagacagcuaaaaauuaagaacuggggcugggcgcaguggcucacgccuguaaucucaacacuuggggaggcugaggcggguggaucaccugaggucaggaguucgagaccagccuagccaacauggugaaacccugucucuacuaaaaauacaaaaaauuagccggccauuguggcaggugccuguaaucccagcuaccugggaagcugaggcaggagaauggcuuaaaccugggagucggagguugcagugagccgagaucgugccauugcacuccagccugggcaacgagugaaacuccaugaaaaaaaaaaaugaacuggaauacagacaguuauuuuucuggaggugauacuggauaauuaaaaccaagggugugagauugcaaaggaguuuuaagaauauuuuaaaagaagagagccaggaacauaauccugaugaauaucuguuuuuacugagugucaggaagaugagccagauaaagagcuuuuagaaaggagaaaaaauacucauggaagccaaaugaaaauaccuuucagugaagggauguuaauaaaagcuagugugcagaaauauaugacuuucuuuuuauugaaaaggcuugcuugggucauuuuuuguuugauugauuguuuguuuguuuuugagacagagucucacucuguugcccaggcuggagugcucuacaauuuuuuguagagacagguuucaccauguuggccagguuugucucaaaacuccugagcucaagugauccaccugccucggccucccaaagugugcugggauuauaggcgugagccacugcacguggccugcuugggcuuugauguuuauuuuuuucuguguauuuauuuaacacauauuuagugaacauuugucagauuaacuucauguucuuaaccauguaaaggaguacuguaaaagguaucagguaaucuaguugaaccagauuuuaagguacauauagugguaaguagaacuagagucauguuggguccauucuaugaaaggacuugcaugcuagccggaggaauuuauucauacuaggcauggagagcuauuguuuuauuuuagaagugguuagauucaaaccguauuucagaaagcugacaguucugagaaaauuaucagaaauggaaguucuaauaaaaaaauuuuuuuuuguacagauagggugucacuaugcuccccuggcugaucuugaacuucuggccucaagcgauucucucaccucagccuccugaagugcugggauuacaggcauaagccacugcaccuggccagaaauauguauuuuuaauauaauguuauauauggcagauuugacaaaguauuugguuucuagauuuuucuuugucuuuuuuuucaauuauaaacauaauaaaagcucuguagaaaguuucagaaaaguggagaaguuuaaagaagaaagcacaaggcaguagggcagcuuuuaaacuuuuagaauuaaauguguaauucgaacuugaguaugaugugacucagauucuaacucugaaggugugaauaagguaggauucuuuaucuuuauuuucauuaauggaauuuagugcauguuuuauuguugauaccacguaaagcacgcuagcuuauuuuacacaucaaauuugcauauauucaugguacaaaugauuucauuaauauuaacguuuauguuaacaugacuugucaauuucucugaagcaucauauucucgaaaagauaaagaccaaaggaagcaacaggcaauguggcgagugcccucugauuuaaagaugcuaaaaagacucaaaacucaaauggccgaaguucgauguaugaaaacugauguaaagaauacacuuucagaaauaaaaagcagcagugcugcuucuggagacaugcagacaagccuuuuuucugcugaccaggcagcucuggcugcauguggaacugaaaacucuggcagauugcaggauuugggaauggaacuccuggcaaagucaucaguugccaauuguuacauacgaaacuguaaguaauauguucccagugucauuucuccacacguuauuugggaaacuagaugacugguuuuuucaaaagaauaauauuuaaauaccacucuuccagugaguuaagacuacaaauuacaugugacuuuuuucuucauccaaaauugauuccguauauuuuuacuauauaauagaacuaacauuucuugauugcuuacucuguauuuggcaauaaacaagacaaaauucuuaacaucauagaucuuguauucuaguagugggaaucagacauuaaaaaguguagacaaguaaguaaagaucauuucaguggguaaaaggugcugugaaggaaacaaccgaggagugggaugggaggagcagaugagacauguucuauugggguagucagagaaagucucugugaggaggcagcacuugaccugagaccugaaguuuaggaagguggcagcuauuuauagaucuagggcaagcaguguucuggguaaacagaacagaaacugcaaagucacugacacaggauuuauuuugcguauuugaaggauugaaggaagaccaguauggcaaagaaagcagagagaggagacuagcaggagacgaagucagagagagguaggcagaauuuagaucagggagagucuugcaaaaccucaaaaaggaguucgaguuuuauuaugauguaaggaggaagccucuagagaauaaaaauaagggguguuuauaaucugauuuacacuuuacaaagaugacuuugcuuguuguguggagaagggucugaaaaggguugaggacaggaauugugagaccaguaacagccuauuacauuaucuugugugaaauaugauggcauuuucuggaguuacaauaauggauagaggggcuuguucacagucuagcagccuuucuugacugagguucccaucuuucuuaguucucuuaaggaugugcuauucuauucuagaugcauaggagggaaguuaauccagucuuagaucagcagggcugaguucuuucucagaaccauaguugaaaaagccuaaauagaauuuuaggaaaguucuauuuagaaagaaacuaagaauuaugauuaaguuuuggccuaagcaacuuaauaggcagugguaucauuuauugagaagcaaaucagauaagaagcagguuauggggcuugggaggagguaagggcagaaaguuggguauucuuuuuuaaacauguuuaauuugagacaccugcuagauauccuaguaaaaugucauagacacgugaaugguacacaacuuugaaacucagagagaggucaaugcuggauauaaacaguugggagucaauaguauuuuauauuauuuaaauccagaagacugaauagggucaaguuuggagggaguuucaauggagaagcaaaauuuuugacucuguggcacuuaaacauuuaaagaucugauaaauaggagaggccagcaaaggaaauugaaagagcaaucauuaagguaggagaaaaacuagaagggauaauaucucaaaaaucaaaaauaaugcaucucaagaaguagagugguuaccccuguguuaaguguguuaaguaucacugagaagugucaaggcaagaggccaaguggccuuuuuaagaacuauucccauggaguaguguagcagaagagugaaugaggucagggaccagagcacaaaugcacaacuucuuuaaaagaaguuucacaaugaaguggguagaagcuggaggaggugcggggucaauaguuucuuguuggcagggguguccuuuuuuguguccucuccaaugucuuucaucugugaauuaaauccauuuuaaaauuggguuggguuguuuauuuguaguugacuuuuaggaguucuguauauauuuuaaauauuuaucuuuuaucacauauaugauuugcagauguuuucucccaguguguggguugccuuuucccucuguggauugugucauuuaacauuugaaguuuuuaauuugaagaagcccauuuuauguguuuuuccuuuuguucccugugcuuuuggugucauagccaagaaaacauugccuaauccagugucaugaagcuuucuccuguuuucuuccaagaguuuuaguucuugcuuuuagucuuacuuuuagucuuucauccauuaagaauuaaauuuuguuuauggugucagggaagggucugacuugcuugcccauggauauccaguuuucccagcacuauuuguugaaaagacuuuucuuuccucauugaaugguuuuagcaccauuguugaaaucauuugaccauauagacgaggguuuguuucuggguucucuuuguguguguuguuuauuaaaauuggcuguauuaauguuugauagugaugugaauaauccaauaaagauggguuggugaggagauaauagcaaaauauauagaauucucuuaauauaaggaagacaauuuaguagaaugaauaaagguuaugaauaggccauuaacauaagaaauacagauguacaauaaaaauaugaaaagauauucggccucaccugcuauucaaggaaaugguauauuaaaccaaaugguauauuaaaaccaaaaguacagcuuuuuggguggacuuucucaaaaagccuuuguuacauauuuugcagauacaguugacccuugaacagcacaggcuuguuguacuguacagguccacuuaauauucgaauuuuuuucaaccagagaaagauugaaaauacaguauucgggugaugccaaaccugcauauaggagggccaacuuucguauagguggguucugcaggucuuacggugggacuucagucgaggauuuuaguauacgcagggguccuggaaccaacccccacauauaccaagggacaacugucucuuccccauugccaccuuuuuuuccugcuaaucacagaguuuuaaaauuuuaucuuagacaacuguauuaauaauauucauccaugaauauuaauaauauaauuaacauucaugacaugaauauuaauaauauuauaauuaauaauaauauucauggcaauaauauucaugggucuuauuuuuauuuggaaggcuuuuuaacucccagguuaauaaaaauaacccuuaauuucuucugguacuuuuuguuuucuaacuuuuuuacauauaggucauuaauucauauaaaguuaauuuuauaugaugcugugugagguaaauggaaugauguuuuuccccaaaugaaugaaacauguuuuuugaaauaugaugcaauaugaaauccauccuuuauuauagaccagauucccaaacaugguucuguuuuugaacucauagaggucgaaacaacugaaauugccaguacucaaguuuuggacauacaaaaacgcaauuugguauuguuuaacccaguauuugucauguccucuaccagacuaacacuuuuuuuaacuacuguaguuuuauaguuuguaauacuaugauaggauauguuuauucuguucuugguuuucaaaauguuauuggugguucuugcacuuuuaauccuccuccaaaguauuuugacuggaauugcuuuacauuuaaagacuaguuuaggggugcugggcaccauggcuccugccuguuaaucccagcauuuugggaugcugaugagggaggauggcuucuugagcccaggaguucaacaucauauggcaagaccuuaaucucuacaaaaauaaauuuuuuugauaagccagucauggugguauguaccuguaaccccagcuacuugggaggcugaggugggaggauuacuugaggucaggaauuugaggugcagugagccgugaucgugccacugcacuccaaucugggcaacagucucucucucucucuuaaaaaaagagagacuaauuugggcaauugagaucuuuucagcaucaaacauucaugucuaggaaugugguacuucucuccauuuauucaggucaucuguuauauucauauccuuuuuuagaacucucaguuuuuuccauauaaguucuauauaugucuuguuaaauucauuucucaauguauuauaucuuagguagcuguugugaguggaaucucuuuuucucugauaguauuuucuaauuguuacugacauaaaagacaaaaauauugauuuuuauguuuauucuguauucaaccaauguggcaauuuuuuuuuuuuuuuuuuuuuuuuugauacggaauuucacucuuguugcccagccuggagugcgauggggcgaucucggcucacugcaaccucccccuccuggguucaagugauucuucuuugucagccucccaaguagcugggauuagaggcacaugccaccacgcccggcuaguuuuuguauuuuuaguagagacgggguuucaucauauucgucaggcuggucuugaacuccugaccucaggugauccacccaccucggccucccaaagugcugggauuacaagcgugagccaccacaccuggccuggugaauuuguuuuauuaacaguuuuucaauuaguuauuuugauuuucuaaguauuuauaucaucagcagauaaucauaauuuguuuauucauuuucugcuuacuuuuuguauugcauugucuaggcagguaccucaacaguuucuuaguaacagugguaggauuuuuauaauuuuucaacuuuauuuaggaauuccuuuaguuuuuuucucauuaaauuugagguuugcuguauguuucaauagguacuuuuuuguuuuuguguuucuuuuuuuugagacagagucuugcucugucacccaggcuaggguacaguagcucuaucucggcuuacugcaagcuccgccuccuggguucaugcuauucuccagccucagccucccgaguagcugggacuacaggugccugccaccacgccuggcuaauuuuuuuguauuuuuuaguagagacgggguuucaccauguuagccaggauggucuugaucuccugaccucgugaucugccugucuuggccucccaaagauuacaggccuguuucuaucaaguuaaaaaagcugugugcaauggcucacgccuguaaucccagcacuuugggaggccaagucgugcagauuacuugaggccaggaguucgagaccagccuggccaacauggagaaaccccaugucuacuaaaaauacaaaaaaauuaccugggcaugauggcauaugccuguaaucccagcuacucaggaggccaagccacuagaaucgcuugaacccaggagguggagguugcagugagccaagauugcgccaccacacuccagccuaggugacaagugagacugucucaaaaauaaauaaauaaauaaauaaaaaaguuaaaagguacauccuucuauuuauaguaauagauucuauaguauaguauaguaauauauucaaucuuucucugguugaaaaaaauucgaauauuaaguggaccuguacaguacaacaagccugugcuguucaagcgucaacuguaucugcaaaauauguaacaaaggcuuuuugagaaaguucacccaaaaagcuguacuuuugguuuuaauauaccauuugguuuaauauaccauuuccuugaauagcaggugaggccgaauaucuuuucauauuuuuauuguacaucuguauuucuuacuaaagaaauuuaguaacuaaagguuacuaaaccuguuuaguaacaacaauaccaauaauggcuaacauuuacuaaguguuaacugugugccagacauuauucuaacuauucuaagucacaugcauugacucacuuaaucuuaacaagaagucuaagagguaagguaagucaauuucauuccagauuuacagaugaggaaaccaaggcagcaggcauugaauaauguugcuaguuucacauugguaauuggcaaagccaaaaacuugaacuucagagccuaugcccuucacccuaauaccaaacugccucuuuucuuacuacgagaauuucuuuucuuuuuaaacugaagcuguguagaauuauaucaaaugauguuuugacauuugucaaaaugauuuacuauuuuguuccauuacuuuguuaucauaaaguaaauuauauuauuuuucuaauguugaccauucuggaaauacuggaaugcauccuauuuaguuugggccuauacuuuuuuuaaaaaaacacugcuguauucaguuugcuaauauuuuacuuaggauccuugacuacauagucauaagugaaaucgaucuauuucauuacacuauccuuaacccacuuuaguucuaauucugugcuuguuuuacagauuaaauucagauguuuuuguccuuuucuaugcuauaaaauuauuuuaacuauauguuauuugcuccuaugcuguauuaaacuuuaugucuaauaaaaagcauucauaaaacuaguauaguaacucagaguuagaacuuuaacagccuuuuuaauuucuguuggauuuguugguuuccucauauuuuuaauuuuuuuaauuuuuaauuuuuguggguacauuguagguauauauauuuauaggauauaugagauauuuugauacacgcuuacaaugcauaauaaucacaucaggguaaauggaguauccaucaucucaagcauuuauccuuuguguuaaaacaauccaauuguacucuuuuaguuauuuucagaaguacaauaaauuauuguagacuguagucacuguuguacuaacgaauacuagaucuuauucauucuaucuaacuauauuuuuguacccauuaaccauccccccagccacccacuacacucccuagccucugguaaccauugcuguauuaucuugaguucaguuguuuuaauuuuuagcccccacaaauaagugagaaugugugaaguuugucuuucugugccugauguauuucacuuaacauaacgaucuccaguuccacccauguuguugcaaaugacaggaucucauuccuuuuuuauggcugaauaguauuccauguguauauguaccacauuuuuuuuuuguuuuuugagauagagucucacucuguugcccaggcuggagugcaguggugcaaucucggcucacugcaaccucugccuccuggauucaagucauucuccugccucggccucccagcuagcugcgacuacaggcaugcgccaccacgcccagcuaauuuuuuuguauuuuuuaguagagaugggguuucaccuuguuggucaggcuggucucaaacuccugaccucaaaugauccacuugagucgggcuuacaaagugcugagauuacgggcgugagcuaccacgcccaaccuaacauuuucuuuauccauuugucuguggaucuuagguugcuuccaaaccaugguuauugugaauaaugcuguaguaaacaugggaaugcagauaccucuuugacauacuaauuugcuuucuuuuggguauauaaccagcagugggauugcuggaucauaugguagaucuauuuuuaguuuuucugaggaaccuccaaacuguuuuccguagugguuuuacuaacuuacauucccaccaaugguguaugagaguugccuuuucucuacaucuucaccagcauuuguuauugccuguguuuuggauaaaagccauuuuaacugggaugagaugguaucuuauuguaguuuugauuugcauuucucugaugaucagugauguugagcacuuuuucauaugccuguuugcuauuugugugucgucuuuuaagaaauaucuauucagauuuuuacccauuuuuaaucagauuauugaauuuuuuccuauagaguuguuugagauccuggucauuaaucucuugucagauguaguuuucucauacuucugcugcuacuuaagucaguuacuauaguuuuccaagaaaaacuaauuauauuugggucuuuaaauuuauugauauacagucauuuauucuauuuucuuaaauuuuuaaaacuucuugugcauauggguuguuaacuucuuuuucacuuauuuuauugcuuacuucuguuuuuuuuucuccuuugauuugaccugcucaagggauuugcuaauuuuguucaucuccucaaagaccaaguucuuagauuuauuucauccauugucuuuuaccauuucauuauauuucugcuuuugucuuuguuaaugcuuuuuuuuuuuuuuuuuuuuuuuuuuuuuugagacagagucucgcucuguccaccaggcuggagugcaguggcgugaucuuggcucacugcaaccuccgucucuugggcucaagcacuucuccuaccucagccuccugaguagcugggauuacaggugugugccaccacaccgggcuaauuuuuguauuuuuaguagagaugggguuucaccaugcuggccaggcuggucucgaacuccugaccucagguaauccacccacuuuggccuccugaagugcugggauuacuggcaugagccaccgcacccagacuguuaaugcauucuuuuuuccuuaaccaauaauucauuuauccuuuuaguggagaaauuggucaucauuuuucguaagucuagaacauuuaucuaagucuaagaacauuuucauuaacccucucccuagaacuccaaacccauuaaaagucguuccccaucuuccccuucuacuaucuucugguaaccacuaaucuacuuuuucccuauggauuuuucuucuucuggacuuuuuuuuuuuugagacggagucucucccuguuacccaggcuggagcguaguggcacaaucucggcucacugcaagcuccgcuucccggguucacgccauucuccugccucagccucccaaguagcugggacuacaggugugcgccaccaugcccagcuaacuuuuguauuuuuaguagagacgagguuucaccauguuggccagguuggucucaaucucuugaccucaugcgccacccaccucagccucccaaagugcugggauuacagaugugagccacugcgcccagccuggacuuuuuauauagacucauaccauaugaggucuucuaugucuggcuuauuucacuuaacacagcccuuucaagguucauucauguuguggcauauauuccuuuuuaugucugcaugauauuuuauuguauggcuguacuacauacuguuuauccacucauuaguugauggauauuuggguuguuuuuacuuuuuggcuauuaucaguagugcugcuaugaacguucauguacaaguuuuuguuuggacauaugguuuuguuugaguauaugcuuagaaguggaauuaauggguuacauggcaacuguguuuaacuuuuugaggaacuaccagugccagacuauuuuccaaaguagcugcaucauuuuauauucccagcagcaguauaugagggcuccagguuuuccauaccguuggcaacacuuauugucccucuuuuuuuccuugcccauugcauugucuuggcauccuugucaaaaaucaguggaccauaaauauaaggguuuguuucuagacucucaauucuguuuugaugauauauauguguauauggcaguaccacauagucuugauuacuuaguuauaguaacuuuugaaaucagaagugaguguuccauuuaagauuguuuuggguauugugggucucuuacauuuucaaauggauuuuaggauuagcuugucaauuucugcaaaaaaaaaaaaacacagcuacuauuauuuuagaaauuguguugaaucgguagaucaauuuuaagaauauugcuuuguuaacaguauuaaguauucuaaucagugaugaacacaggaugucuuugcuguugucucuauuuucuuucaagaaugugugguaguuuucaguggacaagucucacauuucuuuuguuaaauaaauuccuaaguauuuuaauuguauuuuaugcuauuaaaaaugaaauuguuuucuuaacuucauucucacauugucugcuagugcagagaaauacaauaaguuauuuugucuuauauccugcaaccaugcuaaaccuguuuauuaccuauuaaugaauuuuuuauuuuuauuguuuuuuacaauuuuauuuuuauucuuuuuuuaaaauguauuuuuaaaagagauuuauuuaacucacaguucugcaggcugaauucaagggcagggcccugccuucuggcaauagcauucuugcuugcuuauuuuuauugucuuccuagcuuuugaaucuaugcauauuaggucauauagucccuuuuuucccuaauuaauucauuuuaaggccguacauuuucuuuucacuacugguuuggccacagacauuuugauuucaaguaccauaauuguaauuuguuucuaacucagcauugauuuuucuuuuuaauccaauaauacuuuauaauuuccaaauguuugacggguuauauauuuguuaauaguuuaacugcauugaaauuuguaugauuuuucuuaaggagcucacagauaaucuuuuaaguuaagauuuuacgggcggugugcgguggcccaugccuguaaucccagcauuuugggaggccgcggcagguggaucaccugaguucagguguucgagacccagccuggccaacaugacaaaaccccgucucuacuaaaaauacaaaaauuagcugggcaugguggcgagugccuguaaucugagcuacucgggaggcugaggcaggagaauugcuugaacccaggagguggagguuguagugagccaagaucgcuccauugcacuccagccugggcaacaagagcaagacuccaucugggggaaaaaaaaaaaagauucugcucuacaagcaacaagaugggaauguuuuaugacaaaagucuaaaccaauuggggcuacagaauguuguuuauuuuuagacaguagagagaacagcuuccaugcaagguaagauuaaaacuuuuucugacagacuaaauagugaguuuugugcuguaguagccuauucagagguguucuuaaaugucuuugcagccacaaauaagaagaguaauucgcccaagccagcucgauccaguguagcagguagucuaucacuucgaagagcaguggacccuggagaaaauagucguucaaagggagacugucagacucugucugaagguaaauuugagggauucagaauguacuuuuagugggguaaauauuuauuaccugaaauugauguuaucguggagcuuuagaucuugaagggcaccaaaaaugcuaaaguuggauuugaaaguuucuuuuuuugaaacagggucucacuuugucacccaggcuggagugcaguggugcgaucuuggcucaccguggccucgaccggugguuuaagagauccuccugccucagccccaccaaguagcugggacuacaggugugcaccacuacgccuagcuaauuuuuguauuuuuuguagagacagguugcccaggcuggucuuaaacuccugagcucaagcaauccgccugccucaaccucccaaagugcucggauuacaggaaugagccccaccacaccuggcuggaaaguuucuugaucucaacagaacagacccuuaacaaaauacagccauuagacuauguauucuaaacaccuuaauuuuauuuauucuuuauuuuuguuguuuuccugagacagagucuugcucuguuuuccaggcuagggaugcaguggugcaaucauagcucacuguagccuugaccucccagacaaaagugauccuuccaccucagccucccaaguagcugggaccacagacacagacacaugcagccauaccuggcuuuuuuuuuuuuuuuuuuuuuuuuuuuuuuugccgagacaggguuuugcuacauuguccaggcuggucuugaacuuuugggcucaaacaaucuuccugucucagccucccaaaguguaaaauuacaggugugagccacaacacuuggccuggacuccuuaauuuuagaugcuuggcauaaaaaacaagggauauguuucaaaauuauuuuugaaguuuuuuuuuuuuuuuuuuugagauggaguuuuuuccucuaguugcccaggcuggagugcaauggugcgaucucggcucaccgcaaccuccgcccgccguguucaagugauucuccugccucagucuccugaguaacugggacuacaagugcacgccaccacgccuggcuaauuuuuguauuuguaguagagaugggguuucaccacauuggccaggcuggucuugaacuccugaccucaggugauccauccgccuuagccucccagagugccaggauuacaggcaugagccaccacaccuggccuauuuuugaaguuuuuauguaguuuuaaaaugauauauauagugagauuuucuaauguaacugagagagaccuuucauguuuauuugccuuuuuucugauuaucccuccuuuuauuuuauuuuauuuuauuuuuuggagacagagucuugcucuguuguccaggcuggaguguagcacaaucucagcucacugcaaccuccgccucccagguucaagugauccuuguguuucaaccucccaaguagcugggauuacaggcgcacaccaccaugcccagcuaauuuuuguauuccaucuuccuuuuuuugaaggcuccccaggaagcucucagucugggagcaggcacaguucuccccgagccuugauacauggcaguaucggugauauucugccaaaaacugaagaccggcaguguaaagcuuuggauucagaugcuguugugguugcaguuuucaguggcuugccugcgguugagaaaaggaggaaaauggucaccuugggguaaauuaaguuguuuuguauauguaaugguauaauagcuaauagcuuuguuuggaacuuuaaguaugcaucaugaugaacaaauuaauuucuaccuuguuaauuuuuuaguggacagaaaauacauuuauugcacuaaauuuuaacuuuuuuaauuuuuuuuauuuuuuuuaacagagccucgcucugucacccaggcuggagugcaguggcgugaucucagcucucugcaaccucugccuccccgguuuaagugauucuccugccucagccucccaaguagcugggauuacaggugcccgccaccacacccugcuaauuuuuguauuuuuaguagagacgagguuuugccauguuggccaggcuggucuugaacuccugagaccucaagugauacgcccaccucagccucccagaguguugggauuacaggcgugagccacugcaccuggccuaaauuuuaacuuuuuuaaaguaucagagauuuuacuuuuuuuuuuuuaaugggaugagauaguacuuuuuuuuuuuuugagauggagucucgcucuguugcccaggcuggagugcaguggcaugaucucagcucacugcacgcuccgccucccagguucaugccauucuccuaccucagccucuccaaguagccaggacuacaggcgcccaccaccacgcccagcugauuuuuuuuuuuuuuugguauuuuuaguagagaugggguuucaccauggucucaagagauaguacuuuuuuuaaugggaugaaauaguaccggaaguuuaguuuaaauauguuagagcucauuuucacaaugauacguaaccuuaucugaacucugccuuguaaauuuguauguguuggcgguaggggggcggucagccuuuuuuuuuuuuuucagucuauccuacacuugucaaagauguuaguguugggcuauauuaugugucacaggcauuuauauauauuuuguaugaaacaaagcacuuacagcaacuuuaacacugcuuuucugcuuuuaucucaucuuucuucucuccuguuaucaaaguauccucaaaacuuauaguuggaauuucccaaaaagauauauaguaguuaacacguuuaucucuccccuaggagacauaaacucaaauccccggcauggcaauuaaacuuccaucuauucaaaagauagagugauuauggauauuggcuauggauguggcagaugauuagccauuaauauccaucugcuuaucuauuuuauggauauuaaaccuauuucuaaauuuaaacaaugaaauaguucuauuuuggagacccugaaaagaauuuuaccuaaauuggagaaagauuaacacccuuuaaguuuacuuaauuuuauauagucaaggucuggcucauuaccaaaacuacaagaucagcuggugguuuagcuuucuggcucaaguuucaguaguagaaagguguuaaaaucacuggagauuaucuugucuucccuacguacuaccuaaccugauguuuuauacauuucuucaaauuaaagugcaacuagcucuuauauuuuauuugcuauggagauauuuuuaucugccuuuagucaccacaauuaaauauacaugaacuuaguuuuuuuuuuucuagaguguaaaauccugugcaagugugugcagcuugauccucauuuugcaguugauuuuaucugccagccugguucauguaggugcuguccagcucaugucuuuuuuuuuccugccugauuuaaaguaguguaagcaaaaaguuuaaauacuaaugaaaggcugggcacaguggcacacaccuguaaucccagcacuuuuggaggcugaggugggaagauggccugagcccaggaguuugagaacacccuaggcaacauagcaagaccuugccucuguuuauuuuuuaaauaaaaauaaauauuaaauacuaaugauaaguguuucaaaaugaaaggagaaaagaauaagugaaaaauuucccauccuuaacucccaugaccuaguuuuccaacccccugcccacacauauucaugcuguuauuaauuuuucaugugugcugugucuucucaguuuuuguguauauuuaaggaacugugacuauguagcuuuuuuaauacagaagauguacuuuauuuucucauucaauaauaucucucaggccaggcacgguggcucacaccuguaaccccagcacuuugggaagcugaggugggcagaucacuugagaucaggaguucgagccagccuggccaucauggugaaacacugucucuacuaaaaacaaaguacaaaaauugccgggcguggugcuggacaccuguaaucccagcuacuugggaggcugaggcaggagaaucgcuugagcccaggaggcagcgguugcagugagcugagaucacaucacugcacucuagccugggugacagagugagacucuaucucaaauaauagcaauaauaauauaucucaaaagucuuucccuauuagaacauauuauuuaaaacuucuauugguauuuauaaguuaaaauuuuauugagcuaauuauagguucacauucaguuguaagaaauaaugcagagagauccuguguauuuuucuccccuaaugauaacauuuugcaaaacuguaguacaauaucacaaccaggauaccaacauugauguaauccaccauuucauaacauuuuuuugugaauauuuagugaaaaaaaaauuuuuuuuuuuuuugagacagagucucacucuguugcccaggcuggagugcaauggugcaaccucggcucacugcaaccuccacgucccggguucaagaaauucucugccucagccucccgaguagcugggauuacaggcgcccaccaccauaucuggcuaauuuuuguauuuuuaguggagaugggguuucaccaucuuggccaggcuggucuugaacuccuaccucaggugauccacccaccuuggccucccaaagugcugggauuacaggcauaagccacugugccaggaccuuagugaaauauuuucagauaaaauuugaaauuuaguauuaagcaccagagcacguacccuacuuaguuuggugcucaguucaaaaagaaaauauagauuauugugucacuaguuauagagaaauaucaaguuguuuucuucuuugagggcuaaugcuaaaggaggucaucuggaaggacugcagaugacugauuuggaaaauaauucugaaacuggagaguuacagccuguacuaccugaaggagcuucagcugccccugaagaagguaaggaaugauaaacuuauaaguaagcaggaaaugagaauucugucccuuuuuugguggugggugguggguggugguggugguggugguggugguggugcugcugcugcuggugguagugauagggauagggagugguugguuuaauggaaauguuacugagaucugcuauucgacaugcuugaucugaacacaacauuccuugugccacugaauuugauuugcuaagauaccaaauacagaggaaggcaaaauggguaaguuacuauauaaaaggacaggccuuacuagaacaggcauuuguauggggaaaaaaucugcauauaguucaucuguucggucaauaaauauguuaaggcaccuacauaccaggcaucgaauuuuugcuagauuuauuaauacaaaguugaauuagauauguucacaaucuaauggggaagauaugcccuagaacaacuaauuagaauaguaaauguuaaguauuuuuuaaagucagucuuaauuagugucuguagauugcuuuauucuucuuaaagaagcauuccaaguuuugaccauuuuuuaaauccuguaugaugacugacuucagcuuguucucagcuguacuuucuaguguuucuuuugcauguucuuccaaguucauuauuguuuaucuaaaagcauagaagacauuuugcaauuuggggcaacagaggugcuuagaacaaggcuauguguauugcccuugcuguguccuuuauaaauugguagaaaagaaugucaacucucuuaaugauauuuggccuuguaauuuuuucauuucuuagugaaacuccaccaccuuccaccucugcacucauuugaauuucaaugauugaugaauuguagcucaaagcauacauacaggugccagcaucuacucagcugcccuaagaagaggguguguaggugguggcauuuucagguuucucaguuaaagaacacuaaauauuuugguuuucuuaauuggugcuucugugaugggcagcauuauuucaguagaagagauuaaauagaaaagauuuuuguaaaugauguguuuauuguuaaaacaucaagaaagaaauauuaugauugaagaucuuuauagaaugggccuguggggaauacuuucuuuuucuguuguuuuuuuuuuuuccccgagacggagucuagcucuguugcccagucuggagugcaguggcacagucuuggcucacugcagccuccaacucccggguucaagcgauucuccugccucagccucugcauagcugggauuacaggcgcuugccaacacaccuggcuaauuuuuguauuuuuaguaagagacgggauuucacuguguuggccaggcuggucuugaacuccugaccucgugaaccacucgccucagccucccaaagugcuaggauuacaggcgugagccaccaaggccggccggggaauaguuacuuucuaugugucuccauacauacuggauuguaguagcuuaaauuacuacagaauaugcuggaauuacaagcucauuuuucuuccaccaagcgcaguggcucaugccuguaaucccaguacuuugggaggcugaggcaggcggaucacuugaagucaggaguucgagaccagccuggcaaacauagugacaccucaucucuacuaaauauagaaauauuagccagaugugguagcagacaccuguaaucccagcuacuugggaggcugaggcaggagaauugcuugaacugggaggcagagguugcagugagcugagaucacgccacugcacuccagccuggacgacagagugagacucuaucucaaaugacaguaauaacaagcucauuuuuuucaugcaacauuuaugaaaugcuucuaauuuaccggauguugcauuugaugccagugauaaaauuccugaacuuacuaucuaguucagacuuucuccaccuuugcaccauugccauuuaggccacauaauucuuuauuuuacagggacuguucucugcacuguggaauguuuagcagcauccucagcuguuaaccacuagauaccaguaguguuucccuccgguuacaacaaccaaaaaugucucuagucauugccacauguuuccugggaggcaaaaucauccccagucaagaaccaauaguugaacuaaauaauucucaaccagaggugaccacuccuugagaaucacuugccagagugggccacaguuauuaauagaaauaaguuguagcucucagguaugcuagguauguguggugguauugguaggagggcggcaaggagagcaguugaaaaccaauuguuaggugucaggggagacuaauagccaguuguaauauaggacgaugagugcugugauaagguuuauaggcagcucaaaaaugagauacguaauaaaaauaauaguaauacuaaguucuuacuguguuaaagacuuuaccaguauucuguuauucucagaauaacucuacaugguaguugcuuuuguuaaccuaguuuuacaggugaguaagcugaggccuggagauguaauuuaccuuacccaaagucacaggguuagaaauuggaaggccagggccgggcgcaguggcucaugccuguagucccaacacuuugggaggccaaggaggguggaucaccugaguucagaaguucaagaccagccuggucaacauggugaaaccccaucuuuacuaaauauacaaaaauuagcugagugugguggcgggcaccuguaaucccaucuacuugggaggcugaggcaggagaaucgcuugaacccgggaggcggagguuacagugagcugagaucgcaccauugcgcuccagccugggcaacaagagugaaacuucgucucaaaaaaaaaaaaaaaaaaagaaaagaaauuggaagguugggcauguuggcuaaugccuguaaucccagcacuuugggaaggccgaggugggcagaucaccugaggucaggaguuugagaccagccuggccaacauggugaaaccccaucucuacuaaaaauagaaaaaucagccaggcaugguggcacacuccuauaaucccagcuacucgagaggcugaggcaggagaaucacuugaaccaaggaggcagagguugcaaugagcugagauuguggccauugcacuccagccugggugacagagcgagacucugucucaaaaaaaagaagaaaagaaaaaaaagaacuuggaagagcuagaauuugaaccuagagccagugcucuuaacugucgccucucucugcuaaccuagucccuaauccacccuuggaaagaucauccuaagggaugaguaggaguuagccagaugaagacuggugaaaggccagaagggagacagaccagaggccagaucaugaagaguuacguggaaugucccagcuagaauuugaacuuugucauuugaauaggaucuaaguuagaagugacacuuuaacauuucuacucuagcugcauucuggagaauggauuugggggugggaauagcauauguggaacuagaggcaggaaaauugguaagaagcaugguuaggugaaaugauuuggacuucuuuauuuuuaauuuuuuauagagacuuggucuugcuguaugcucagacuggucuuaaacuccugggcucaaaugauccuucugccucagcuucccaaagugcuggguuacagacaugagccaccacacccggccgcccgauuuggacuuaauuucagccuccaauuuaucaauuuacauuaucucagcacuaauuuuuauauauaaaauggcuggucagcacagaaaacacuggaacuuuuugacaccaguuucauuucuuauuuaaagcuaauugacagcuuguccuaaacugaagaaaggcauuugcuuggccauagugaagaucgguacauuuuccaagucuuugaaagaauggaguuauucauguaggauuuagaguuaaauggucaguguuauucaguaacacauuuuaucuuuauaugugggguguugugcuauaaauagcaccuagaacucaauaagaaaaauugcugugaaugugcaaaucaacagggacacagaaguacacccuuguaauuuguugguaucugaacagcuuguuuaccuccagagucccaggauagacugugagaaggagacuaacugaugaggcugagagaagguaguacaggagacaaaggaagcccugugccuccuguaaucagcuuuguuucucgaggagagugcggccuugcucacuguugccaguauuauucuaucaucagcaagagcaaguucucaggaaacccuuauauaccuauaagccuuaguagacaguugaauggauuugucuuguauccaugcuuaggaaaaacaagacucuuuauuuuagcugaauacaaaaagaagacauucggugucauaucacugugggguucucucucuuucucaaagagaagguugucuggaggacuuuaaggcguuguuugugguacuggcugggaauuugggacuacuaaagugucucuuaauugcucuuaagcaucaguuuaaaaauaacuuuuuucuuagauaugaacauaaauaggccuuuuccuuuuuacuggaaccauaugggacaaccuuugguuguauuagucgcugguuuaaugaucugaugcugaaaagguugacuuauuuuuucuuucaauugaugaccugcacaacuguagguaggccaguuuauuucuuguucuuuguaaaacuaaaggcuuugcucucugacuucuugcugaaguagcacauacccccuucaguuaaaucagggguacucaaaacaccaucuggggaaaagccuuggcaugccuguuaaaaaccuugcugguggccucuuuaagaggaauacaaagccugauggccugccauugcugaucauuuaggguaauuauuaagaugccuuuaacaaaauucaucgaaaaauuaacugacuugaacaaaaaggaaaauuaacucuuuuacauuaacaaaucucucaauaagaagguacaccugugguagagcaguuuucaggauuagaaaauucagcugcucagugucaucaggaacguguguguguguguggguggguggggguggggugguuuuaguguguguguguguguguguguguguguguguguguguguguguguguuggagggugggggugggguuguuuuaucuuuugcccugcuauucugagugagaggcuuagcucuucucagggcgguaagauguuugcugcaguucuagacaucagagucagaacagcauucugggaguggaagaggauugauuuauucuauauaucuccagcaacaaccuuucucuaagcaccucaacaacuuccucuucuaucucgucagccacugucaaggaaaguggccaaguccaguuauuuauuuauuuauuuauuuauuuuuuggagacagaguguugcucugucgcccaggcuggagugcaguggugcaaucuugacucacuguuaccuccaccucccagguucaagcgauucuccugccucagccucccaaguagcugggauuacaggcaucugcugccaugcccggcuaauuuuuguauuuuuaguagagacgggguuuugccauguuagccaggcuggucucgaacuccugaccucgggcaaucugccugccuuggccacccaaagugcugggauuauaggcaugagccaccgcgcacccagccagccaaguccaguuaguuggucucccucaccaacucguuccacauggauaugugguaagggaaaauaccugaacaauaucaggguccucuucgaaaggagaaaggcagauaaauuguuggugacuagaauauaaagugucaucuguaccaggugguuaauguauuuuccauagcaucugaaauucgagcaacuugauuuaagggaguuauaacucaaguuagcuuuacugagcacauacauaguaggugcucaaaaaauaugguagaugauugacagaguaauaagaugcagauuucuuuugcguuaacaaucucugaagcuccuuacaauuaauaguaucuuguaauugcuaucauugacguccagccauuugucuuuuucuuuacauucacaaagguaggaaacuuccagaucuuagugcuugauaaaagaccaggcguuuucaugcaggaauuucuuccuagcauuucuugggaaauguguguuuuuuuugaauucugaaaaaaauuagucaagaaguuuaauaaauggaaaacauuauucuaauugucuuauuagaauuaauuuuaacaacacagaaacauuacugauuugaaggaaucuacuuagggcaaguugaaaguaaaaacuggaaauacugauaccuggaaucaaagguuaaggucaacaggagcuccuuggaaagaagugauuacaaaucaguccucauuauaaauaucgccguuuuauguguguucauggcccugucugcugcuaaguaaauaauaaugaguuuacacaugguauacuuaauaaaaauugauugguguuccaagaaagauuuugaagcaaaauccuuauauuggcauuuuuauuaacaugugauucugcauaguacuguaaaccuugcugaguucuaaacgugacauuauucacauacuacccaguaauacccacaugcagucuagcauuugaauauucacuauaggccucagcucuuacaaauacuaauuaaaugauuuguuuuaaagauacacauguaggcuggaugcgguggcucacaccuauaaucccagcacuuugggaggccgaagcggguagaucacaaggucaggaguucgagaccagcuuggccaguauggugaaacacaucucuacuaaaaauacaaaaaaauuagcugggugugguggcacaugccuguaaucccagcuacuugggaggcugagacaggagaauugcuugaaccugggagguggagguugcaguaggcugagaucacgcaguggcacgccaaccugggugacagagugagacgccgucucaaaaaaaaaagauacacauguaaugaauagaguuugaaaaauguauuuaauaacuuuuuuaaaagaauaauguagauuuggggaauuccagagaauuccaauucauuguuuuugaauccugaagguugguauuugucgggaauucagaaacacuacuaauaagaggucaaauuugugccuugaaguucaacucaguguguuuuaguguuuucagcaacaguuccaugaagggccacaagguggagguggugcuucacagaacuagcuaguuuuggccucuuuaaccgucucugcucuuuuucuuuuuccccuacuucauaaaauuguuguaaacucuucacucuuuuagaacaggaaaguuuguuuuuuuguuuuuuuguuuugcugaagauggagacgauuucuaaauauuuaaggcugaaauaaugcuaaccaaacucuucuuaaaaagagaaaaggaagaguguaccacugaagccauguggggccacaguugccuuuguuggaagcuuuuuaaacuagagcagauuuuauuucuuuaagaguuaaaauacccaucgauuuuuccuugaguaaccuuugguaguuuguaccuaggaaagaauuugcucauuucaucuguuuuugguuucaugagcauacaguuacugauagcauuuuauuauauuuuacuguuuauagaaccuguaguugauguccucuuucauuccugauauuggaaauuuuguuugcucucuuuuuguuagugaaucuaccuagaggcuuuuuuaacuuuaucgaucuuuucaaagaaacaccauuuuguuucauugugguuuuuuuguuuuucugcugauuuuauuauguuuuuuauuauuuccuuccuuuuacuugcuuugaguuuaauuuccuuuuucuaguuucuuaaaguaguaguuuagauuauugauuugagauauuuucucuucuaauauaaauaaugucauaccuuuccuuuuaagcacugcuauagucacaucccacaaauuuugauauguuuuauuuguauuuaauucagaauguuuuuuauaauucuacaaaauuuucaacuuuuuuccuuuuaucuauugucucuccuuuguuauuuuugcuaucucuauggcauucuauuugacacaauuuagaccagucccuuuauccccuucauucuuaauucuuccuuccuuccucugucccucagggucuuguguucuguuaccuaggcuggaguacagugguacaaucauagcucacugcaggcuugaacuccugggcucaagugggccucccuccucagccucccuaguagcuaggacaauuacaggugcacaccaaugugugccuggcuaauuuuuaaauuuuuuuuuuuuuuuuuuuuuuuuauagagauggggcuuugcuaaguugcccaggcuagucccaaacuccugggcucaagcgauccuccugccucagccuuucaaguagcugggacuacaggcaugugccaccaggccuggcugaugagcauuuuaucuagcuuuaaagcccuuaaauaauuccagacaucugugucaucucaucauugauguuuguugguugucuuuccugguuuuucauaugcugaauaauuugggguuguauccugaacauuuucauuagguuuuuuuuuuuuuuuuuaauaagacucugggucuuguuuuaaucugccaguuuugcugucauucaaauucagucuucaucaguaugccuguuucuauuuacuuuucaaaguaaauaacuaugaauauccuuaaauaacuacacuacccaucucuccagguuuuauugcuacuuucaguggaaaagauagaguggaaugugcuugcuccauuguaccuagaaccuuccuuccagagaggauuuuacuuuugcuuuauucaaauaacacuagcuccugaacaauuuuuauguuaauuucuuaaaauuugaaccucaaccuuaaaucccaaaccgaaauuaggcacauaaaucuuacuuugaauuuugagguaagacuuuuuucccccucuucagagcccaguagaaacagacaaaauuccuugcuguuuuccuaugccaguaggcagacauuuuucuagucuguucuuucaauaggaauuuuagcauuggccaggcaugguggcucaugccuguaaugccaccacuuuaggaggccaaagcgggugaaucacuucagcucaggaguugaagaccagucugggcaacauggcgaaaucccaugucuacuaacaaauuacaaaaauuagccaggugugauggcacaggccuguugggaggcugaggugggaggaucaucugagcccugggaggucaaggcugugguaagccaugauugcaccacuguacuccagccuggguaacagagugagacccugucucaagaaaacaaacaaaaauuuuaacauuaugcaggggguggaguuuuagucucacuuuuaauucccuuucugugggggguucauuuuucuaucccaaggcaguguuuaaaaauccucacaggaagcucuccagggcaacuguggucccugacccacuaaugaaaguuccuuaucuuucuuuguuucugacacuguggauuuccuuucugccuuuuaaugugcuuguucauuaaaauaauguuuuacauuuauauuuuaucuugcuauuuguaaggauuuguagcagaaagauuuucagguuuucuugauugcuaucuugcugaaacaaauacuuuuuauagaauuauucuuuuaaaaaucaacugauguggccaggcacagugaccuguaaucccagcacuguaagaggcuaaagugggaggaucucuucucaagcccaggauuucaagaccagccugggcaacauauuauagcaagacccugucccuccaaaaaauuuuuaaauuagcagggcauggugucauguaccuguggaccuaucuacuugggaggcuaaggcggaaguaucccuugagcuuaggaguuugaggcugcagugagcuaugaucaggccacugcagcccagccuagggugacagagcgagacccugucucucaaaaaauaaaaauaaauacaaaucaaccgacauacacaaaaaaauuagaugcccaauuagaauacaaacuauuauuagaauugccagaauuucuaauauucauacaccauguggauuuguauaacacauuuauauuuauguuuuaggcuagggaauauaauuaugucuauaaugaaucaggauuaaaagaguuccuguuaucucuugugacugaaaaaaaaacaguguuugauuuggaaaaaaguauuaucaguauaauaaaauuaaugcugguuucaaauaauaacuuucagguacuauggaaagggcaauuuuaaacuuugagaacagaaauaaaaccacucuaaauagcuaaagagaaucgagguuugugcgguuacuuuugucuuuguuuuguuaguguuuaguuuguugaauucuuggcauuccauguaaaauucaauaggaaucucaguuuagcagauacggagauuucuguuuccuuuuacuuacagugguuucuuuucagaaacauguucuccuuccuuccugccaggaaugaguagcgacagugacauugaaugugacacugagaaugaggagcaggaagagcauaccagugugggcggguuucacgacuccuucauggucaugacacagcccccggaugaaggugcagcacaugaugucauuuuacacagauuacuaaaaccaccgcugccgcuucucuuucuucuucuucugcugcugcuacuucuacuuuuuccgcucuacugcuuuugcuucuucugcuucuacuucuuuuuuuuuuuuuuuaauuauugucauuugugagacaacauucuuugguuaacuauuauggugaguacuaaaaaaacacagccaguaauauuuggcuugguugcaccuaaugagugcuacuuacugggcagagacgggguccacaaccugcuuuuguauagucugugaccugagaaugguuuuuacuuuguaaagagucuuuaaaaaccaagcaaaagaaacaaagaagaauuuucuuuguggguuuuuuuuuucuuuuuuuuuuuuuuugccccgagauggagucuuguucugucacccaggauggagugcuguggcgugaucuuggcucacugcaaccuccgccuccuggguucaagcgauucuccugccucagccuccugaguagcugggauuacagguauacaccaccacgccuggcuaauguuuuuguauuuuuaguagagauggaguuucaccauguuggccaggcuggucucgaacucuugaccucgugauccaccugccuuggccucccaaaguccugguauuacaggcgugagccaccgugcccagcccaaagaagaauuuucaagagaguccauuuguggccuacaaugccuaaauauuuacccuucauaggaaaugauugccaaucccuggggagauuucagauguuuggguuuuuuuuccuuuucuagccuacuguaagauaacuuuaaccuuuuaaaauaaaaauaacuuagaaauacaugcagauuaugaaauaauuuuuauucccuccuacccccaaaaaaguuauuaggaaaaaaacaagagaaaccuacuauuaauauuuucccuuguuuucuucugucuuauuugcauugcauuucuucuucuuuuuuuuuuagacagagucuugcucugucucccaagcugaagugcaguggcacaaucucagcucacugcaacuucugccuccuggguucaagcaauucucccaccucagccuccugaauagcugggacuacaggcaugugccaccacauccagcuaguuuuuguaauuuuuaguagagacaggguuucaccauguuggccagccuggucucgaacuccugaccucaggugaucugcccaccuuggccucccaaaguacugggguuacaggugugagcuaccaugccagcccuaccuaaauauuuuauaaauaguuuuuuauucugcuuuuuucacuuaaauauauuuguauguuauuuaaaauuucauaaacuucauuuuuuauggcaaccuaauauucuaucauguggauauaccauaaguauucugcugucaagcaguuuucuggaauacagauuaaucaguaaaaggauauacugucaaguuagagaaauacacauuuaaaguuacccagaggccuuaauaaucaaucugaacauuccucugcaagauauccuggagugacaacauuguuaagccuaugccauuuucugcuuuauauuuugcauauuuuccuggugcucugguaucuuuuucaauacagaaccaagcauuugaugauuuguaaguauuaaggcaucuuuaguaacuuccucugcuucuaaaauaagcauccaaauuuugugcaaguuauuuggagugcugguggguuuuuguagugauacuugaaugcguaguuuaauuggcuuugaaauauguuuuauguuuauaaggucuugaaucuugagaauauacaccauugcuucuuguucccuuuuuaagcuguccccagauuguccccaggaggacaaaaugagacaauuccugucaucuuuuaauugugggugucuauuacacauuuuguuuuuuucuccuuuauuuuuccuuuguguuugcuuauaccugacucagaucacaaauucucugaagacagagauuuguucacaacccagcacaucuuuaucacuuaaauaacacauuugguaagauuauuuaaagacuugggaaggaaaauacugcccuuguuauaugcuuuuaaauuuuaaauuuuuuauuuauuuuuuaaucauagauacacauuccaguuuuccugauggugaacaaauaggcccugaagaucucagcuucaauacagaugaaaauaguggaagguaauugccaaaucaagagaacugacuugcaagcuaccuugacccugaauuuugcuguaguuggugcucaaauuugucaucagucagauaaucagauuuggucuuauuucuucauuaucucgaccugaaauaguaauuuggaaacuguuggaagguggcacaguuuagucuaagacagcaguaguacaugggaaaaacaguaugggaagaguucuuuguaauguaaggaaauaacaauguaguucucuauuaauuuagcaaauuuguacauucacaaaaggcaguuugucuacuacagcagaaggcugguuaacugccagaaaauguaccuccaggcccugcaugccgucaguaacccgcccggcauuggugcucuacugucuuuggcuagagcuuaguuguguuuaaauaaucaucuuuauauuugggguuuuaauuacaguuccauuagugccuguagauuagugaacagaaaauugcuuuggaagagauucugcccuguagacacuaugugaauaacugaaguaacacuagacugaaucuccuuuuuggaguauguaucuucucucacuuguucaaguacaggcacacuguucaaccgcaugguaucuuucuguugugugacuucuacaaauguaauuuuaaaugaaauuaaguuaacauggauucauuacguuccuggcccuguagacacguguaagauuauuuaaaauucuuucauuuuuuucugccucuuacuauacgacuguagugcaacaaauauuuuaaagcccccuuuucuucuuuauuuucauuaguuguacauugauuucagugucaacacauuuaaagauucauucauguugcacaguggcuuacaugaacgugaaacugugauauaagguuuucuuucauacucauaauuagcccaaaacaguugccaaacuuugccauugugcuccugcauuuguguuugagcugcuauauauuuguggaaauuacacugaaaguugacuaagagacuauugaaaaagcaugaauaauuaaauauacaugugagagacaucucaucugcuguauuuuacuuagugaauauuguucacucuuccgugucugaugucuugcugaaugcugugacucauaguuuacuuuuguucaaaauaguuugcacuuuuuguuaauaaaaucaacuugagaaaauaugccucugcuguuuauuaaauugggaccagaaaccccuucuuuucuacucauugccucauuaguaguguagagaagauccaaacauuugauuaguuuguguuuagucuaauggcgaggagugaugccuagcaucgaucccagucauucuaaaauuagaauaaaccugaaaggccaaaagauuucuucagagaugauagcuuuuaguucagaccuguuugcuuuuaggacaggaaaguaguuucccccucguuuccaagccaccuuauauacuaaagcugcucugaguuccuuggugaugucgggaacaccgcuguuuucccucuuccuugauguagucugcuaugcuaaauuuuagguagcagagagggaaggaagaggcacaggagaagaaccaguugcuccacucucugcuuguccuacuuucuugcucuuucuguacccugauagagcccucagcauguuuuuuuauuuuuauuuuuguaaccuuuccuuuuuugcugaagaacagucugcuguuaccuugcuucuguauuuaguauuuuaucucaaguucauuccuggaaaaucucuccugaauagaguuuucuuagggcuagagauacauuaaugcuuguguugucugugaacguguccuuucuggacaacuuuaacuacuugugucauugaucuuuaaguaaccuuugagguagaugaguuguguaucaaaccuguuuggccauggagccuuagguucagggagguuguaugauucucuucagguucaaaaccacuggcagggauggggugaacugcuggucuagugccuuuuccacuuuaucucacuugcagcagacccaacauucugauaccuaauaauuuaaaaccuaaagauuauucuuuuuuuuuagcuuuuaauuuugagauaauuucagguuugcaaaagaguugaaaaaauugugcaagaguuuccguauacccucugcccagcuucuccuuuuguuaaugccuuacauaaucacagaacagugaucaaaacuaagaaguuaauccugguugcaauauuguuuaccaaacuacagaauuuguucagaucgcaccaguuauuucacaaauguucuuuuucuguucuaggauccggucuaggaucccacauuguauuuuguuaccauguuuccucaggauccuucaguauaugacagcucuuccgccuuuccuugcuuucaugaccuugauauuuuugaagaggauguguuauuuuauuaaauguucuucuuauuuggguuugacagaugcuuuccuauauuaaauugagguuaugcauuauugggaaggcccuuagugcaucacaucaggggggauaugauguugauauauaaauauacauauauauacauacauacacacacacacacacacacacacacacauauauauauacuuuuuuuuuuuuuuugauggagucucacucuguugcucaggcuagaaugcaguggcaccagcuuggcucacugcagccucugcuucccaggcucaagugauccucccaccuaagccuccugaguagguguccaccaacacaccuggcuaauuuuucuauuuuuuguggagaugggguuucacuccaggcuggccuccaacuccugagcucaaagugaucccccugccucagccucccaaagugguagguugauugcaggcuagauugcaggugcgaugcuggccugauacugauuuuuuuuuuuuuuuuuuugagacagguucucacucugucggccaggcuggagugcaguggcaugaucucagcugacugcaaccucugccucccugauucaagccauucuccugcuucagccucccaaauagcugggauuacaggcaugcaccaccacgcccggcuaauuuuuguauuuuaguagagaugggguuucaccauguuggcuaggcuggucucgaacucugacaucaagugauccacccgccucggccucccaaagugcuggauuagaagcaugagccacugugcccgcccagcccugauguugauacuuuuuuauuggugaacuuaaccuugagauuacuugguuaagauggugucugugaggauuuccuacuauagauuuacguuuucccccuuuguaauuacuaaauauuuggggcagauacuuugaaacuaugcagauaccuuguuucuauuaauuauuauuauuauuuuuuuuuggaagacagggucuggcuuuguuacccaugcuguaguggugcgauguuggcucauacagccucaacccccugggcuuaagcgauccucccacuucagccuccuaaguagcugggacuacaggcaugcgcagucacacugggauaauuuuuguauuuuuuauagagauggaguucuugaguucuuggguucaagugacccucccgucucagccuccaaaagugcugcgauagaggcaugugccacugcgcccagccaaaacucuugcuuacgaauuuuagcaccuaguagucgaucuugccuaugggaauuauuacuguaauguuuuaaugguacuuuucuaauucacuaauuucuucuauguuuuuuguuagaaugcugugaggaaaagucccuucuuccccauuuuuguaauuucagcuacuuauuuauaucagcuacuuuauauaucuauauaugauggauauuuauuuuugaguuaugacucaauacuguuaauauuuuguagcuuggcuuguucuaauuuuagccauuggaaacucuuccagauuggcuccugugcccuuuucauaugucucauucuucuuuuuuuuuuuuuuuaagcauuucuuugcuuucugacaucacaagaugccuaccccagccauggaauuaaccacuuccuaaggaaccaugguucuuuuuauuggagaaugcuaucuagaaacaaagauuuggaugccacauauuuauuauuauuagacugucacugcuucuagucccacucaauggauagauagaaaauguaaauuggcugggugugguggugcacaccuguggucccggcuacuugggaggcugaggugggaggaucacuugagcuugggagguagagguugcagugagccaaaaucgugcuacugcacuucagccugcgugacagagugagacacugucucaaaaaaaagaaaauguauggccgggcacaguggcucaugccuguaaucccaguacuuugggaggcugaggcagguggaucaccugaggucgggaguucgagaccaaccugaccaacauggagaaaccccaucuguacuaaaaauacaaaauuagcuggcugugauggcgcaugccuguaaucccagcuacucaggaggcugaggcaggagaaucgcuuaaacccgugaggcggagguugcagugagccgagaucgugccauuugcacuccagccugggcaacaagagcgaaacucugucucaaaaaaaaaaaaaaagaaagaaagaaaauguauauagacagcuguuccuuagcaucugugagggauugguuccaagacucccuguggauaccaaaguccacagaugcucaaguccccuauauaaaacgguauaguguuugcauauaaccugugcacauccuccuggauacuuuguuuuggguuuugagacggucucauucuguugcccaggcuagggugcagcugugcauagcuuacugcagcuaugaagucuuaggcucaagcaauccucccaccucagccucucagguagcugggacuacaggugugagccaccacgccugaucucccagauacuuuaaaucaucucuggauuaccuguaauaccuaauacaauguaaaugcuauguaaauuauugugcuauuuuuuuuauuauuuuuuaaaaauaaauucugucuauuguugguugacuccauggaugcagaaaccaaagauaauagagggcugacuguauaguuaacucaugcaaauacacacauuuauguguauuucuguacauaucugugugugugugucacuaugacugugagucuauauugguaacaguucagcuccagaggccucauucuggccuucccucuuauuuauaaugccuuucucugacagaagccuagcucucauuagcuacaauauauguauguacuuguucaacccuaauauacaaguagcuucagaaccguuggccuccuguggauuccaggcuaugcccuacaaaaaacagauuuaccaccuaaaauacagugcuuguauacaguucuuuuagucuuuagcuuuucaguauugugucauaacauuuuuuucaaagauauuuagguucaaaauuacauuaguucuguucuuucacaaaaucccuucauugugauuuugugcuucguugguguaacagguucaucuguuauggucuacauucuguccucccccacauauccugguuaauuuguaaauuuacauacauuaaaauucagucuuucuggcauacaguucuguggguuucaacaaaugucuuguauccgccaccacaauacuauacagaacauuucagucacccccaagauuccccugugcuggcccuuuauagguaaccaccccccuuccccacagcuccuggcuaccgcugaucugaucugaucugaucuguucucugcccuuuuaguuuuugcuuuuccagagucauguaaacgggaucacaguuugaccucucgcuucgcaaagugcaguuaaguuucacucaucuugugugaaucagcaccuccuucuuuuuuauugcugagcaguaguaguccacuguguggauauaccacuguucauucauuugcccauuuggguuauuucuaguuuagggugauuagacucuuguaaacguuuggguacagauuuuugugugaguguaagcuuuuauucucuagaguguuacaugcuguauuagucuguuuucaugcugcugauaaagauauacccgagacugggcauuuuacaaaagaaagagguuuauuggacuuacaguuccacguggcuggggaggccucacaaucauggcaaaagguaaaaggcacaucucaugugguggcagacgagagcuugugcagggaaacucccccuuauaaaaccaucagaucucaugaggcuuauucaguauuacaaaaacagcacaggaaagucuugcccccaugauucaauuaccucccacugggucccucccaugauaugugggaauucaagaugagauuuggguggggacacagccaaaccauauaugccuagggacaggauugcugggugugcaauagagaauuugucuggccuuuguccuaguuccugggaagugcccucuaaauccuuggcauuccucaaguguuaggaguuauuuauggugggccuugcuaguguaugcuaaugagaugacucaggaucggggcuggcuacaccagaaaugcugugggugucauuagacaguuggagcucugaaccaugugauagcccaguucaacucauugccaaugauuguuaugccuacauaaggaaguuccaguaaaaaaucuggacaccugccgggcacaguggcucacgccuguaaucccagcacuuugggaggccgaggaaggcagauuaccugaggucgggaguucgagaccagccugaccaacauggagaaacccuaucuuuacuaaaaauacaaaacuagccaggcgugguggcgcaugccuguaaucccaacuacuugggagacugaggcagaagaaucacuugaacccgggagguggagguugccgugaaccaagauugugccaucgcacuccagccugggcaaaaagagugaaacuccgucucaaaacuggacacuaaagcuugagugaguuucccugguugacaguacucuguauuuauauauauauauauauauauuuacauauguauuuauauauauauaaauauauauaaauauaaauauauauauauuuauauuuauauauauauauaucagugugccuggagaguaaguuguccugaagucaaggggccuucacauuugggccucucccaggccucacccuauguaucucucccuuuagcuggcuuuauuuguaaccuuuugucauaaugaaacucugaucauaagugcauuucugaguucugugaguuguucuagucaauuauuaaacaugaguaggauagcaaauacgcccaaauuuguaaucagcugaucagaagugaggguggccucaggaucccggaacuuggagcuugugucuggaaugagggcagucuuguggaagacuuugcccauaaccuguacaguuugaccuaacuccgggugguuggugucagcacucauugcacugagucauaugguaaguagagucuuuacugagacgcugcccaaccuccacagugacauaccauucugcauucccaucaguagcacaugagaguuccaguggcaucucacaaauauuuggcacugccagaaguuuuuuagccauucuuuuugguuuuucuucuaaccaacugagcuaaccagccauuuuuuagccauucuaauagguguguaaugguauuuguuuugcuaauauuuugccagaacuuuuccaucuauauucagagcgauccuggucugaaauuuucugucgucaucugauuuggugucagaguaaugcugaccucauaaaaugaguguucuauuuucuggaaaagaggguguagaauuggugguauuuauuuauuauuacuuuuuuuuuaucucggcucacuggaaccuccaccucccagguugaagcgauucuccugucucagccuuccgaguagcugggauuacaggcaccugccaccacgcgcagcuaauuuuuguauuuuuaguagagacaagguuuuaccauguuggccaggcuggucucaaacuccugaccucaugugauccacccaccuucgccucccaaauugcugggauuacaggcaugagccacccugccuggccuuauucuuuaacuguuuaguagaauucaccaguguaaccaacuaggaggaaacuuuuuucuuuuuuuuuuuuuuuuuugagacagaguuucacucuuguugcccaggcuggagugcaauacugcgaucucagcucacugcaaccuccgccuccuggguuuaaaugauucuucugccucagccuccugaguagcugggauuacaggcgugcgccaccacaccuagcucauuuuuuuuuauuuuuaguagaaaugggguuucaccauguuagccaggcuggucuugaacuccugaccuggugaucugcccaccucagccucccaaagugcugggauuauagccgugagccaccgugccuggccaggaaacuucuuuuucuuagguguggugugguugguauuuaccuugcuuggugugcucugauuuuuuuuuuucuuuuuccuuucuuucuuuuuuuuuuuuuugagacagaguuucacucuguugcccaggcuggagugcaguggcaugaucucgacucacugcaaccucugccucccggguucaagugauucuccugccucacccuccugaguagcugggauuacaggugcgcaccaccacacccagcuaauuuuuguauuuuuaguagagacaggguuucaccagguuggucaggcuggucuugaacuccugaccuugugauccaccugccucagccucccaaagugcugggauuacaggcaugagccacugggcccagccuugauuuuuuuuuuucuuuugagacagagucccacucugucaccugggcuggagugcaguggcucgaucucagcucacuacaaccuccaucuccaagguucacacgauucuugugucucagccucccuaguagcugggauuacaggcgugcaccaccaugcuuagcuaauuuuuguguuuuuaguagagauaggguuucuccauguuuuccaggcugguuucaagcuccuggccucaagugaucugcuugccucggccuccuaaagugcugggauuauaggugugagcuaccaugccuagccuuuuuuuuuuuuuuuuuuuuuuuuuuuuuugagacaaggucuugcuuugucacccaggcuggagagcaguggcaugaucacagcuuacugcagccucaacccuccugggcucaagcaauccucccaccucagccuccugaguagcugggacuacaagccacacaccauguccagcuaauuuuuuuuuuucagagggggucucacugcauugcccaggcuggucuugaacuccuaaguuuaagcuauccucccaccucagccaaccaaagugcugggguuacaggugugacccaccucaccuagcuuugcuugauguucucugaguuucuuuuaucugugguuuugugucugucauuaguuuuggaaaacucuaagccauuaucucuucgaauauuucuucugcccauuaucuuucucuucuccuucuaggauucuaguugugcauauuuuacacagauacugucccacagcuuuuguauauuacguucuggguugauuuuguuuucccuucauuuuuuucuguuguguuucaguuaagguaauuuuuuuaacuuaucuucaagauguacugauuuucuuuucagcaguuuagagccuacugauuagccaacugaaggcauucaucaucucuguuuuggcauuuuucaugucuuacauuucuauuaauauuuaauuauagguuccaucgauuugcuguaaucacccauaugaucuugcauaguauccaccauuuuucuugacauaguaaacauaauuuuauuuuuuuuauuuuuuugagagagucucgcucugucacccaggcuggagugcaguggugcaaucucagcucacugcaaccuccaccuccaagguucaagcgauucuccugccucagccuccugaguagcugggacuacaggugugcaccaccacgccuggcugauuuuuguauuuuuaguagagacgggguuucgccauguugaccaggcuggucucgaacucaugaccucaggcaauccucccaccuuggccucucaaaacaauaauuauuuaaaauucucucucauuuccaaaaucucuguuaucugacucugguucugaugaauguuucauaucuucagaauguuuucuucuuggcuuuucauaugacucuauauauuuuguuaauagcaacacaucucacauaggacaagauacuuuggugaauaguuuuuacaccugaaaguaaggaggccuuuccugcugcuaagaccuuuguuggcagagguugaauuaauauauuauggcugguggaaaaguaauugugguuuucgcauuuuuuaauggcaagaaccaaaauuacuuuuaugccaaucuaauaguaguuaggaguugugcuugguucaagauuggauuugcuaugauuauccuuaguggucucgaguuccugugaugauaccuuguauuucugauugguguuggauaccagagcacuguguuucugacccugaguuuccaggcucagaagcuuugugcugggucuccaagagggucucucucucugcuuccguugcucugcuguccuccuccuggaaauacucugcuguuucuugaaguguaacgggggcuggggaggggcuggcguucuuggauuagguugcaguuuuaggcacugugucccuagguuugggagggucucuguuuacuugccccuucccagcuaauugugggcccagugauauuucugcccccuccucugggauggggcuuuucuuccauagucccuucucucugcugcagugacuuuucaccaguguccagacggcaacaguauuugugcuccuuuucccucauagggugcuuuuguucugugagaugagagaaaggguaugguaaguuccuuuacccaugcccaaggccgcuguauacuccccugggugugugucacagccgacacuucuuagggcucuuuacaguauuuucugagccccugguagagauuguaaagaaaaagccugcaagauagggcgacuccccuaguuucugcaggcccccgggucuuaacacuccugcagcccauauucugccuucaccaaucaucacuuuuagcuagccuauucuuuccagugucuguuuacaacgacccuacgaaacuagugcuaaugucuucucuccccuugcaggcaacugccccucuccauuuggugccacuugguuacucugcaaccucagcuuuccaauggauucgaaaaaauguccuaauuuauaguucaucuggcucguuugcauuguaagaguagaagaaaugcuccuucuaccccuacaucccggaguggaagcuggaagugcugugauuuaaaaauguauauauguaaaacacacauuuuauugaauguaaaacaugaguguaauuaauccuaaaaccagaauucagaaaaugagccauuuuuaauuuuuuuaucuaguuuuuuaaauguuugaauuauaaaggugauaagauuagaaaaauuugggaaauagaaaaccccaagagcuauuuucuuuuuugcauauucauuugaauuuuuaugugguaauauuuuuagauuucuccucauucuaccucucauucucacaucuaccaauacaugccuucauagucuagauuuauagaaguuuuagaacucugcuuagggaugcuuaagagcaaaugguaagauuagccacaguguaguuugggacaucaguaguacgggcugcucucuuucuaaaauccuuuucucuggcuggcauguugaccgggagucucccuuccauuccugcucugcagacccugcgggccagaguccuugcccgagaccuucaggucagucagugucuccuggugugcauuugggaaaggcugcugcauaggcucaccucccacuggguuucauuugaccuagugaacccguagcaacucgauuuggcuuaauuggccaccccuaauccuguagcugucauacuacucaauguaaugacuagcagggacaacuuuuucaucaucuuuaguuaaacuccaguuacucauuuggaaaaugguuuccccaaauguguaucauucuugacaguuuuucacauuuguuucccugguccuaaagcaagauuauaaaaaucaaauagaaccugugugugagggcccuuguuugcacaaugaggagaggacacacuucaucuggagguugcgugacuggggcagcauccuacagcucagcauaagaggcaggcucaaccaacugcccagggaagagcgcuucuuacuaaacauauucaacaguuggggcucucagaaaagaaugugacuuguuuuaaauguaaguaagggaucuuccauaagguuauuccuaggccaagcaaaaggagguucccuaaagcacaauagaaaaaguguucuuuacuaauugcuguuaagaugacagauggggcugggcguggugucucacaccuguaaaucccagcacuuggggaggccaaggcaggcagaucacuugaggucagguguucaagaccagucuggccaacauggcaaaaccccgucucuacuaaaaacacaaaagccaggcgugguggccgacgccuguaaucccagcauccugggaggcugaggcacaagaauugcuugaaccugggaggcagagguugcagugagccgagauugcaccacugcacuccagccagggugacacagcaggacucuugucucaaaaaagaaaaaaaaaaaaaaaaaagacagauggaaacuugcaaucaaaaagaaaaugaugcacuuagggaggccgaggugggaggguggaucaucugaggucaggaguucgagaccagccuggccaacauggugaaaccccaccuccacuaauaauaauaaaaugagcugggugugguggcgggcgccuguaaucccagcuacuugggagauugaggcaggaaaaucgcuugaaccugggaggcagagguuguggugagccaagaucacgucacugcacuccggccugggugacagaaugaaacuccaucucaaaagaaggaaaggaaaugaugcacacugacagcaacagggggcgggugugggggggaaugcucaguuaugcagcuugucaguacagacaguuguuucugauaauuugguaacuuggguaaauuucuaugauguucaaaugauuuuacuguaccuagugguucccuucugucuugcugugugcugcuccuucagaaagagguguuccuuuugaucuaaguaauacuauauuuuagggaauuuuuucaaguguaacacuuacuaaucaaaauguuccuuuucugucauucccugcuucaguaaaccccuucaaauauguccuucuuucaaaacuucaccuuuuuuuucucaauuguucauuugguucuauauaaagucaugccaaggacugaaugaauuuagggaauuaggaguugaagauuuuugaaacuauguaaaauuaauuguaaaggccuucuuuacugguaggcaggagaacagugcaguguauugacaagguugacucguuuggaaggucaguucccucccuucagaugcaggugucguaagugacuucccucccccacauuguccuuuuugucucugucuccuuuuacucacuuaucagcaguccuugggaggcuuuccaccacagcucaucugaugauuuccuuacuuucuucuagcuugaaacucaaagaggcuaagcgaaaggggaaagcuugguuagaugcagaguucuaagaaugaaguaguugggagauuugaugaccaccgcuuaguccuuggcaggucggguuccucuuuucuuuuaggauuauaacaccacucccucuccucgcaguucagcuaaugaagagaacauguauaaggcuaaauaccucucuucugggguaaaauaauguuacagcagcauuuagcaaaucuucuuuuuaaauguuccaagcuuccaaacuuaacguccaucucaggauuuuauuuuccaguucugaagaaaucugcacaaauuuaaacaguaaauaacuuaccuuuccuuuaaauaaaaagacaaaugacuagugguuuuuaaauugccagguuuuauuaagauaauuggcaaaauuucaacauacaccuuaccugaaugaacacuuuuaauaaaauaugaaggaucacucaugacuacaacugaacucaaaagugagauguagagcagauuuguaaauugauaaauuuauuugguaagaaauuauucacuucauucgcuucacuccauagagaauucuuugcagagaaauguuaugaacaagagaacaaagccugucucucaccaaagagcaccuagaguaagaguuuacaaugauguaucuggauuaucuaauucaucaaaguuuauuuccuuuucaaaaacaacugcugugucagucuggaguucccuauuucauguuuucuaauuauuacaauaaauagucuucaaaauagaagauaaaaugcugcuuuaagaaguaacaguuauuuuucaacaccauaccauuugucuggaaaaucauuguguuguaauacuggugguaucuuacuuuguuuugcaagagacauuuaagcuauuugcagaucagaauagaagagugggcauuuguccuuuaacaucacgugauuuucaaaggugaaaaaaauuucuuuugcuaacuuacgauucaaagaaaaauggucucaaauuaaaguguggacaaaacuguaguauucccuuuuauagccuugcuuagguaagaauguucacugagugaauaaauuagguuuaaaaauuaaaacaauaauuuagaucauuuucccacaaagccuuaucaaggauuugauggggaaggaagcacuugaaccacagcaguuuuaucuguaaacacugaacuuggccaugcaucauuuucaucugcccacuggauguugcacuucucacuggcacaguguuucaacaguggagugugguugucaugaaaaugcaguauugacacuauaccacuauaaauguggucaaaauuagacucaguguugacauugacauuguugccauuguccuuggaaaagguguuacuuucaaggagccuccuaaaugcaacaguaacuuuaaucauaauaauucaaggacaauggauggcacuucuagguaaagaaaagguauauacauauguguuucuacccauccucuuuaguacagaccuaaaugggauuaauagccccaguguguguugcuguaauguugccuaaccucaugucccucaaaaguacacaucuagaaagugaacaaaggaaaccuguaaauuagggacugacucccuuugaaacucacagugaauguacaaggaguuuguaaugacuucaguuggugaccugaaguuuguuucccuaaccaauauuacacucuuguuuggauuuauuuuacuauuuccuauucuaacuuguuuagcaggcaaacagauugaugcagaccauguuaaauugaaaaagggauacugccacucuuuaaggauugaguguagaacuuucaccaccacuaaauuacacaaugaauaaaaauacaaaacacauaauucacagacuauaccucagcauuaacaguuuauagauauuauauagauacuuuuauaucugucuaauauuuuuacaaucaccagguacaccaucauuaaauacaaguuacagaaauauguagauaccauuaguuagaggguuacuuauugcuuacgucagcaagcagcaaauaagggcacaggauuugaacugaagggaacuacuuccuaucaccaguggcguuaagagagaacacugcauuucacaaagcacugcuuuuaucuaguuuauagaaccaagagcagcauauaucagaccaauaaccacuauuuuaguauguauuauagaauuuuaaaggauuuaccuuacaaaugguaccuaacuacucuauaaauacgcauguugugaacaaaugaauaguugcuauuuuucacaauauugguuuauaacgaccacacuagaacuacuuugcuuuauuuuguagagagcuaauggcaugagaaaugaguuaacacugcuguguagucggaccuacaaaauccagaccccuaaagaugggucuguguuugucccaguucuauccagccauuuuuuuccccacugagaaagccuagcauguguaguaacuuuuucccuuuacccucuuuauucugaucaaaaacauuaccaauagacaacaauagaaauuuuaaaaagcuuuuuuuuuuacuucgcuaagcacuuuggacuauaauguguaccaauagucugcugccuuuguuuucuuguuuucuuagauaauuugauuugaaacugacacugcaccugauggguuaacaagaucuaggcuucagaaggugacagauaugagugaggaccauguguggggcaaagccucagaaugaugaaaagguuccggcacuauaguuggggccauguugacuccuuuucaaccauuugucacagacgugagaagaagaaaugacuucaaaaucaagagaaaacaaauacugaaagucucuacuuacauccaaauuuuaaaaaauaaaaucuguagauuaacaaucugaucauugcuaa

SEQ ID NO: 192294 - RNA, 124267 nt, Homo sapiens
uuagcaaugaucagauuguuaaucuacagauuuuauuuuuuaaaauuuggauguaaguagagacuuucaguauuuguuuucucuugauuuugaagucauuucuucuucucacgucugugacaaaugguugaaaaggagucaacauggccccaacuauagugccggaaccuuuucaucauucugaggcuuugccccacacaugguccucacucauaucugucaccuucugaagccuagaucuuguuaacccaucaggugcagugucaguuucaaaucaaauuaucuaagaaaacaagaaaacaaaggcagcagacuauugguacacauuauaguccaaagugcuuagcgaaguaaaaaaaaaagcuuuuuaaaauuucuauuguugucuauugguaauguuuuugaucagaauaaagaggguaaagggaaaaaguuacuacacaugcuaggcuuucucaguggggaaaaaaauggcuggauagaacugggacaaacacagacccaucuuuaggggucuggauuuuguagguccgacuacacagcaguguuaacucauuucucaugccauuagcucucuacaaaauaaagcaaaguaguucuaguguggucguuauaaaccaauauugugaaaaauagcaacuauucauuuguucacaacaugcguauuuauagaguaguuagguaccauuuguaagguaaauccuuuaaaauucuauaauacauacuaaaauagugguuauuggucugauauaugcugcucuugguucuauaaacuagauaaaagcagugcuuugugaaaugcaguguucucucuuaacgccacuggugauaggaaguaguucccuucaguucaaauccugugcccuuauuugcugcuugcugacguaagcaauaaguaacccucuaacuaaugguaucuacauauuucuguaacuuguauuuaaugaugguguaccuggugauuguaaaaauauuagacagauauaaaaguaucuauauaauaucuauaaacuguuaaugcugagguauagucugugaauuauguguuuuguauuuuuauucauuguguaauuuagugguggugaaaguucuacacucaauccuuaaagaguggcaguaucccuuuuucaauuuaacauggucugcaucaaucuguuugccugcuaaacaaguuagaauaggaaauaguaaaauaaauccaaacaagaguguaauauugguuagggaaacaaacuucaggucaccaacugaagucauuacaaacuccuuguacauucacugugaguuucaaagggagucagucccuaauuuacagguuuccuuuguucacuuucuagauguguacuuuugagggacaugagguuaggcaacauuacagcaacacacacuggggcuauuaaucccauuuaggucuguacuaaagaggauggguagaaacacauauguauauaccuuuucuuuaccuagaagugccauccauuguccuugaauuauuaugauuaaaguuacuguugcauuuaggaggcuccuugaaaguaacaccuuuuccaaggacaauggcaacaaugucaaugucaacacugagucuaauuuugaccacauuuauagugguauagugucaauacugcauuuucaugacaaccacacuccacuguugaaacacugugccagugagaagugcaacauccagugggcagaugaaaaugaugcauggccaaguucaguguuuacagauaaaacugcugugguucaagugcuuccuuccccaucaaauccuugauaaggcuuugugggaaaaugaucuaaauuauuguuuuaauuuuuaaaccuaauuuauucacucagugaacauucuuaccuaagcaaggcuauaaaagggaauacuacaguuuuguccacacuuuaauuugagaccauuuuucuuugaaucguaaguuagcaaaagaaauuuuuuucaccuuugaaaaucacgugauguuaaaggacaaaugcccacucuucuauucugaucugcaaauagcuuaaaugucucuugcaaaacaaaguaagauaccaccaguauuacaacacaaugauuuuccagacaaaugguaugguguugaaaaauaacuguuacuucuuaaagcagcauuuuaucuucuauuuugaagacuauuuauuguaauaauuagaaaacaugaaauagggaacuccagacugacacagcaguuguuuuugaaaaggaaauaaacuuugaugaauuagauaauccagauacaucauuguaaacucuuacucuaggugcucuuuggugagagacaggcuuuguucucuuguucauaacauuucucugcaaagaauucucuauggagugaagcgaaugaagugaauaauuucuuaccaaauaaauuuaucaauuuacaaaucugcucuacaucucacuuuugaguucaguuguagucaugagugauccuucauauuuuauuaaaaguguucauucagguaagguguauguugaaauuuugccaauuaucuuaauaaaaccuggcaauuuaaaaaccacuagucauuugucuuuuuauuuaaaggaaagguaaguuauuuacuguuuaaauuugugcagauuucuucagaacuggaaaauaaaauccugagauggacguuaaguuuggaagcuuggaacauuuaaaaagaagauuugcuaaaugcugcuguaacauuauuuuaccccagaagagagguauuuagccuuauacauguucucuucauuagcugaacugcgaggagagggagugguguuauaauccuaaaagaaaagaggaacccgaccugccaaggacuaagcgguggucaucaaaucucccaacuacuucauucuuagaacucugcaucuaaccaagcuuuccccuuucgcuuagccucuuugaguuucaagcuagaagaaaguaaggaaaucaucagaugagcugugguggaaagccucccaaggacugcugauaagugaguaaaaggagacagagacaaaaaggacaaugugggggagggaagucacuuacgacaccugcaucugaagggagggaacugaccuuccaaacgagucaaccuugucaauacacugcacuguucuccugccuaccaguaaagaaggccuuuacaauuaauuuuacauaguuucaaaaaucuucaacuccuaauucccuaaauucauucaguccuuggcaugacuuuauauagaaccaaaugaacaauugagaaaaaaaaggugaaguuuugaaagaaggacauauuugaagggguuuacugaagcagggaaugacagaaaaggaacauuuugauuaguaaguguuacacuugaaaaaauucccuaaaauauaguauuacuuagaucaaaaggaacaccucuuucugaaggagcagcacacagcaagacagaagggaaccacuagguacaguaaaaucauuugaacaucauagaaauuuacccaaguuaccaaauuaucagaaacaacugucuguacugacaagcugcauaacugagcauucccccccacacccgcccccuguugcugucagugugcaucauuuccuuuccuucuuuugagauggaguuucauucugucacccaggccggagugcagugacgugaucuuggcucaccacaaccucugccucccagguucaagcgauuuuccugccucaaucucccaaguagcugggauuacaggcgcccgccaccacacccagcucauuuuauuauuauuaguggaggugggguuucaccauguuggccaggcuggucucgaacuccugaccucagaugauccacccucccaccucggccucccuaagugcaucauuuucuuuuugauugcaaguuuccaucugucuuuuuuuuuuuuuuuuuucuuuuuugagacaagaguccugcugugucacccuggcuggagugcaguggugcaaucucggcucacugcaaccucugccucccagguucaagcaauucuugugccucagccucccaggaugcugggauuacaggcgucggccaccacgccuggcuuuuguguuuuuaguagagacgggguuuugccauguuggccagacuggucuugaacaccugaccucaagugaucugccugccuuggccuccccaagugcugggauuuacaggugugagacaccacgcccagccccaucugucaucuuaacagcaauuaguaaagaacacuuuuucuauugugcuuuagggaaccuccuuuugcuuggccuaggaauaaccuuauggaagaucccuuacuuacauuuaaaacaagucacauucuuuucugagagccccaacuguugaauauguuuaguaagaagcgcucuucccugggcaguugguugagccugccucuuaugcugagcuguaggaugcugccccagucacgcaaccuccagaugaaguguguccucuccucauugugcaaacaagggcccucacacacagguucuauuugauuuuuauaaucuugcuuuaggaccagggaaacaaaugugaaaaacugucaagaaugauacacauuuggggaaaccauuuuccaaaugaguaacuggaguuuaacuaaagaugaugaaaaaguugucccugcuagucauuacauugaguaguaugacagcuacaggauuagggguggccaauuaagccaaaucgaguugcuacggguucacuaggucaaaugaaacccagugggaggugagccuaugcagcagccuuucccaaaugcacaccaggagacacugacugaccugaaggucucgggcaaggacucuggcccgcagggucugcagagcaggaauggaagggagacucccggucaacaugccagccagagaaaaggauuuuagaaagagagcagcccguacuacugaugucccaaacuacacuguggcuaaucuuaccauuugcucuuaagcaucccuaagcagaguucuaaaacuucuauaaaucuagacuaugaaggcauguauugguagaugugagaaugagagguagaaugaggagaaaucuaaaaauauuaccacauaaaaauucaaaugaauaugcaaaaaagaaaauagcucuugggguuuucuauuucccaaauuuuucuaaucuuaucaccuuuauaauucaaacauuuaaaaaacuagauaaaaaaauuaaaaauggcucauuuucugaauucugguuuuaggauuaauuacacucauguuuuacauucaauaaaauguguguuuuacauauauacauuuuuaaaucacagcacuuccagcuuccacuccgggauguagggguagaaggagcauuucuucuacucuuacaaugcaaacgagccagaugaacuauaaauuaggacauuuuuucgaauccauuggaaagcugagguugcagaguaaccaaguggcaccaaauggagaggggcaguugccugcaaggggagagaagacauuagcacuaguuucguagggucguuguaaacagacacuggaaagaauaggcuagcuaaaagugaugauuggugaaggcagaauaugggcugcaggaguguuaagacccgggggccugcagaaacuaggggagucgcccuaucuugcaggcuuuuucuuuacaaucucuaccaggggcucagaaaauacuguaaagagcccuaagaagugucggcugugacacacacccaggggaguauacagcggccuugggcauggguaaaggaacuuaccauacccuuucucucaucucacagaacaaaagcacccuaugagggaaaaggagcacaaauacuguugccgucuggacacuggugaaaagucacugcagcagagagaagggacuauggaagaaaagccccaucccagaggagggggcagaaauaucacugggcccacaauuagcugggaaggggcaaguaaacagagacccucccaaaccuagggacacagugccuaaaacugcaaccuaauccaagaacgccagccccuccccagcccccguuacacuucaagaaacagcagaguauuuccaggaggaggacagcagagcaacggaagcagagagagagacccucuuggagacccagcacaaagcuucugagccuggaaacucagggucagaaacacagugcucugguauccaacaccaaucagaaauacaagguaucaucacaggaacucgagaccacuaaggauaaucauagcaaauccaaucuugaaccaagcacaacuccuaacuacuauuagauuggcauaaaaguaauuuugguucuugccauuaaaaaaugcgaaaaccacaauuacuuuuccaccagccauaauauauuaauucaaccucugccaacaaaggucuuagcagcaggaaaggccuccuuacuuucagguguaaaaacuauucaccaaaguaucuuguccuaugugagauguguugcuauuaacaaaauauauagagucauaugaaaagccaagaagaaaacauucugaagauaugaaacauucaucagaaccagagucagauaacagagauuuuggaaaugagagagaauuuuaaauaauuauuguuuugagaggccaaggugggaggauugccugaggucaugaguucgagaccagccuggucaacauggcgaaaccccgucucuacuaaaaauacaaaaaucagccaggcgugguggugcacaccuguagucccagcuacucaggaggcugaggcaggagaaucgcuugaaccuuggagguggagguugcagugagcugagauugcaccacugcacuccagccugggugacagagcgagacucucucaaaaaaauaaaaaaaauaaaauuauguuuacuaugucaagaaaaaugguggauacuaugcaagaucauaugggugauuacagcaaaucgauggaaccuauaauuaaauauuaauagaaauguaagacaugaaaaaugccaaaacagagaugaugaaugccuucaguuggcuaaucaguaggcucuaaacugcugaaaagaaaaucaguacaucuugaagauaaguuaaaaaaauuaccuuaacugaaacacaacagaaaaaaaugaagggaaaacaaaaucaacccagaacguaauauacaaaagcugugggacaguaucuguguaaaauaugcacaacuagaauccuagaaggagaagagaaagauaaugggcagaagaaauauucgaagagauaauggcuuagaguuuuccaaaacuaaugacagacacaaaaccacagauaaaagaaacucagagaacaucaagcaaagcuaggugaggugggucacaccuguaaccccagcacuuugguuggcugaggugggaggauagcuuaaacuuaggaguucaagaccagccugggcaaugcagugagacccccucugaaaaaaaaaaauuagcuggacaugguguguggcuuguagucccagcuacucaggaggcugaggugggaggauugcuugagcccaggaggguugaggcugcaguaagcugugaucaugccacugcucuccagccugggugacaaagcaagaccuugucucaaaaaaaaaaaaaaaaaaaaaaaaaaaaaaggcuaggcaugguagcucacaccuauaaucccagcacuuuaggaggccgaggcaagcagaucacuugaggccaggagcuugaaaccagccuggaaaacauggagaaacccuaucucuacuaaaaacacaaaaauuagcuaagcaugguggugcacgccuguaaucccagcuacuagggaggcugagacacaagaaucgugugaaccuuggagauggagguuguagugagcugagaucgagccacugcacuccagcccaggugacagagugggacucugucucaaaagaaaaaaaaaaaucaaggcugggcccaguggcucaugccuguaaucccagcacuuugggaggcugaggcagguggaucacaaggucaggaguucaagaccagccugaccaaccuggugaaacccugucucuacuaaaaauacaaaaauuagcugggugugguggugcgcaccuguaaucccagcuacucaggagggugaggcaggagaaucacuugaacccgggaggcagagguugcagugagucgagaucaugccacugcacuccagccugggcaacagagugaaacucugucucaaaaaaaaaaaaaagaaagaaaggaaaaagaaaaaaaaaaaucagagcacaccaagcaagguaaauaccaaccacaccacaccuaagaaaaagaaguuuccuggccaggcacgguggcucacggcuauaaucccagcacuuugggaggcugaggugggcagaucaccaggucaggaguucaagaccagccuggcuaacauggugaaaccccauuucuacuaaaaauaaaaaaaaaugagcuaggugugguggcgcacgccuguaaucccagcuacucaggaggcugaggcagaagaaucauuuaaacccaggaggcggagguugcagugagcugagaucgcaguauugcacuccagccugggcaacaagagugaaacucugucucaaaaaaaaaaaaaaaaaagaaaaaaguuuccuccuaguugguuacacuggugaauucuacuaaacaguuaaagaauaaggccaggcaggguggcucaugccuguaaucccagcaauuugggaggcgaagguggguggaucacaugaggucaggaguuugagaccagccuggccaacaugguaaaaccuugucucuacuaaaaauacaaaaauuagcugcgcgugguggcaggugccuguaaucccagcuacucggaaggcugagacaggagaaucgcuucaaccugggagguggagguuccagugagccgagauaaaaaaaaaguaauaauaaauaaauaccaccaauucuacacccucuuuuccagaaaauagaacacucauuuuaugaggucagcauuacucugacaccaaaucagaugacgacagaaaauuucagaccaggaucgcucugaauauagauggaaaaguucuggcaaaauauuagcaaaacaaauaccauuacacaccuauuagaauggcuaaaaaauggcugguuagcucaguugguuagaagaaaaaccaaaaagaauggcuaaaaaacuucuggcagugccaaauauuugugagaugccacuggaacucucaugugcuacugaugggaaugcagaaugguaugucacuguggagguugggcagcgucucaguaaagacucuacuuaccauaugacucagugcaaugagugcugacaccaaccacccggaguuaggucaaacuguacagguuaugggcaaagucuuccacaagacugcccucauuccagacacaagcuccaaguuccgggauccugaggccacccucacuucugaucagcugauuacaaauuugggcguauuugcuauccuacucauguuuaauaauugacuagaacaacucacagaacucagaaaugcacuuaugaucagaguuucauuaugacaaaagguuacaaauaaagccagcuaaagggagagauacauagggugaggccugggagaggcccaaaugugaaggccccuugacuucaggacaacuuacucuccaggcacacugauauauauauauauaaauauaaauauauauauauuuauauuuauauauauuuauauauauauaaauacauauguaaauauauauauauauauauauaaauacagaguacugucaaccagggaaacucacucaagcuuuaguguccaguuuugagacggaguuucacucuuuuugcccaggcuggagugcgauggcacaaucuugguucacggcaaccuccaccucccggguucaagugauucuucugccucagucucccaaguaguugggauuacaggcaugcgccaccacgccuggcuaguuuuguauuuuuaguaaagauaggguuucuccauguuggucaggcuggucucgaacucccgaccucagguaaucugccuuccucggccucccaaagugcugggauuacaggcgugagccacugugcccggcagguguccagauuuuuuacuggaacuuccuuauguaggcauaacaaucauuggcaaugaguugaacugggcuaucacaugguucagagcuccaacugucuaaugacacccacagcauuucugguguagccagccccgauccugagucaucucauuagcauacacuagcaaggcccaccauaaauaacuccuaacacuugaggaaugccaaggauuuagagggcacuucccaggaacuaggacaaaggccagacaaauucucuauugcacacccagcaauccugucccuaggcauauaugguuuggcuguguccccacccaaaucucaucuugaauucccacauaucaugggagggacccagugggagguaauugaaucaugggggcaagacuuuccugugcuguuuuuguaauacugaauaagccucaugagaucugaugguuuuauaagggggaguuucccugcacaagcucucgucugccaccacaugagaugugccuuuuaccuuuugccaugauugugaggccuccccagccacguggaacuguaaguccaauaaaccucuuucuuuuguaaaaugcccagucucggguauaucuuuaucagcagcaugaaaacagacuaauacagcauguaacacucuagagaauaaaagcuuacacucacacaaaaaucuguacccaaacguuuacaagagucuaaucacccuaaacuagaaauaacccaaaugggcaaaugaaugaacagugguauauccacacaguggacuacuacugcucagcaauaaaaaagaaggaggugcugauucacacaagaugagugaaacuuaacugcacuuugcgaagcgagaggucaaacugugaucccguuuacaugacucuggaaaagcaaaaacuaaaagggcagagaacagaucagaucagaucagaucagcgguagccaggagcuguggggaaggggggugguuaccuauaaagggccagcacaggggaaucuugggggugacugaaauguucuguauaguauugugguggcggauacaagacauuuguugaaacccacagaacuguaugccagaaagacugaauuuuaauguauguaaauuuacaaauuaaccaggauaugugggggaggacagaauguagaccauaacagaugaaccuguuacaccaacgaagcacaaaaucacaaugaagggauuuugugaaagaacagaacuaauguaauuuugaaccuaaauaucuuugaaaaaaauguuaugacacaauacugaaaagcuaaagacuaaaagaacuguauacaagcacuguauuuuaggugguaaaucuguuuuuuguagggcauagccuggaauccacaggaggccaacgguucugaagcuacuuguauauuaggguugaacaaguacauacauauauuguagcuaaugagagcuaggcuucugucagagaaaggcauuauaaauaagagggaaggccagaaugaggccucuggagcugaacuguuaccaauauagacucacagucauagugacacacacacacagauauguacagaaauacacauaaauguguguauuugcaugaguuaacuauacagucagcccucuauuaucuuugguuucugcauccauggagucaaccaacaauagacagaauuuauuuuuaaaaaauaauaaaaaaaauagcacaauaauuuacauagcauuuacauuguauuagguauuacagguaauccagagaugauuuaaaguaucugggagaucaggcgugguggcucacaccuguagucccagcuaccugagaggcugaggugggaggauugcuugagccuaagacuucauagcugcaguaagcuaugcacagcugcacccuagccugggcaacagaaugagaccgucucaaaacccaaaacaaaguauccaggaggaugugcacagguuauaugcaaacacuauaccguuuuauauaggggacuugagcaucuguggacuuugguauccacagggagucuuggaaccaaucccucacagaugcuaaggaacagcugucuauauacauuuucuuucuuucuuuuuuuuuuuuuuugagacagaguuucgcucuuguugcccaggcuggagugcaaauggcacgaucucggcucacugcaaccuccgccucacggguuuaagcgauucuccugccucagccuccugaguagcugggauuacaggcaugcgccaucacagccagcuaauuuuguauuuuuaguacagaugggguuucuccauguuggucagguuggucucgaacucccgaccucaggugauccaccugccucagccucccaaaguacugggauuacaggcaugagccacugugcccggccauacauuuucuuuuuuuugagacagugucucacucugucacgcaggcugaagugcaguagcacgauuuuggcucacugcaaccucuaccucccaagcucaagugauccucccaccucagccucccaaguagccgggaccacaggugugcaccaccacacccagccaauuuacauuuucuaucuauccauugagugggacuagaagcagugacagucuaauaauaauaaauauguggcauccaaaucuuuguuucuagauagcauucuccaauaaaaagaaccaugguuccuuaggaagugguuaauuccauggcugggguaggcaucuugugaugucagaaagcaaagaaaugcuuaaaaaaaaaaaaaaagaagaaugagacauaugaaaagggcacaggagccaaucuggaagaguuuccaauggcuaaaauuagaacaagccaagcuacaaaauauuaacaguauugagucauaacucaaaaauaaauauccaucauauauagauauauaaaguagcugauauaaauaaguagcugaaauuacaaaaauggggaagaagggacuuuuccucacagcauucuaacaaaaaacauagaagaaauuagugaauuagaaaaguaccauuaaaacauuacaguaauaauucccauaggcaagaucgacuacuaggugcuaaaauucguaagcaagaguuuuggcugggcgcaguggcacaugccucuaucgcagcacuuuuggaggcugagacgggagggucacuugaacccaagaacucaagaacuccaucucuauaaaaaauacaaaaauuaucccagugugacugcgcaugccuguagucccagcuacuuaggaggcugaagugggaggaucgcuuaagcccaggggguugaggcuguaugagccaacaucgcaccacuacagcauggguaacaaagccagacccugucuuccaaaaaaaaauaauaauaauaauuaauagaaacaagguaucugcauaguuucaaaguaucugccccaaauauuuaguaauuacaaagggggaaaacguaaaucuauaguaggaaauccucacagacaccaucuuaaccaaguaaucucaagguuaaguucaccaauaaaaaaguaucaacaucagggcugggcgggcacaguggcucaugcuucuaauccagcacuuugggaggccgaggcggguggaucacuugaugucagaguucgagaccagccuagccaacauggugaaaccccaucucuacuaaaauacaaaaauuagccgggcgugguggugcaugccuguaaucccagcuauuugggaggcugaagcaggagaauggcuugaaucagggaggcagagguugcagucagcugagaucaugccacugcacuccagccuggccgacagagugagaaccugucucaaaaaaaaaaaaaaaaaaaucaguaucaggccagcaucgcaccugcaaucuagccugcaaucaaccuaccacuuugggaggcugaggcagggggaucacuuugagcucaggaguuggaggccagccuggagugaaaccccaucuccacaaaaaauagaaaaauuagccagguguguugguggacaccuacucaggaggcuuaggugggaggaucacuugagccugggaagcagaggcugcagugagccaagcuggugccacugcauucuagccugagcaacagagugagacuccaucaaaaaaaaaaaaaaaguauauauauauguguguguguguguguguguguguguguauguauguauauauauguauauuuauauaucaacaucauauccccccugaugugaugcacuaagggccuucccaauaaugcauaaccucaauuuaauauaggaaagcaucugucaaacccaaauaagaagaacauuuaauaaaauaacacauccucuucaaaaauaucaaggucaugaaagcaaggaaaggcggaagagcugucauauacugaaggauccugaggaaacaugguaacaaaauacaaugugggauccuagaccggauccuagaacagaaaaagaacauuugugaaauaacuggugcgaucugaacaaauucuguaguuugguaaacaauauugcaaccaggauuaacuucuuaguuuugaucacuguucugugauuauguaaggcauuaacaaaaggagaagcugggcagaggguauacggaaacucuugcacaauuuuuucaacucuuuugcaaaccugaaauuaucucaaaauuaaaagcuaaaaaaaaagaauaaucuuuagguuuuaaauuauuagguaucagaauguugggucugcugcaagugagauaaaguggaaaaggcacuagaccagcaguucaccccaucccugccagugguuuugaaccugaagagaaucauacaaccucccugaaccuaaggcuccauggccaaacagguuugauacacaacucaucuaccucaaagguuacuuaaagaucaaugacacaaguaguuaaaguuguccagaaaggacacguucacagacaacacaagcauuaauguaucucuagcccuaagaaaacucuauucaggagagauuuuccaggaaugaacuugagauaaaauacuaaauacagaagcaagguaacagcagacuguucuucagcaaaaaaggaaagguuacaaaaauaaaaauaaaaaaacaugcugagggcucuaucaggguacagaaagagcaagaaaguaggacaagcagagaguggagcaacugguucuucuccugugccucuuccuucccucucugcuaccuaaaauuuagcauagcagacuacaucaaggaagagggaaaacagcgguguucccgacaucaccaaggaacucagagcagcuuuaguauauaagguggcuuggaaacgagggggaaacuacuuuccuguccuaaaagcaaacaggucugaacuaaaagcuaucaucucugaagaaaucuuuuggccuuucagguuuauucuaauuuuagaaugacugggaucgaugcuaggcaucacuccucgccauuagacuaaacacaaacuaaucaaauguuuggaucuucucuacacuacuaaugaggcaaugaguagaaaagaagggguuucuggucccaauuuaauaaacagcagaggcauauuuucucaaguugauuuuauuaacaaaaagugcaaacuauuuugaacaaaaguaaacuaugagucacagcauucagcaagacaucagacacggaagagugaacaauauucacuaaguaaaauacagcagaugagaugucucucacauguauauuuaauuauucaugcuuuuucaauagucucuuagucaacuuucaguguaauuuccacaaauauauagcagcucaaacacaaaugcaggagcacaauggcaaaguuuggcaacuguuuugggcuaauuaugaguaugaaagaaaaccuuauaucacaguuucacguucauguaagccacugugcaacaugaaugaaucuuuaaauguguugacacugaaaucaauguacaacuaaugaaaauaaagaagaaaagggggcuuuaaaauauuuguugcacuacagucguauaguaagaggcagaaaaaaaugaaagaauuuuaaauaaucuuacacgugucuacagggccaggaacguaaugaauccauguuaacuuaauuucauuuaaaauuacauuuguagaagucacacaacagaaagauaccaugcgguugaacagugugccuguacuugaacaagugagagaagauacauacuccaaaaaggagauucagucuaguguuacuucaguuauucacauagugucuacagggcagaaucucuuccaaagcaauuuucuguucacuaaucuacaggcacuaauggaacuguaauuaaaaccccaaauauaaagaugauuauuuaaacacaacuaagcucuagccaaagacaguagagcaccaaugccgggcggguuacugacggcaugcagggccuggagguacauuuucuggcaguuaaccagccuucugcuguaguagacaaacugccuuuugugaauguacaaauuugcuaaauuaauagagaacuacauuguuauuuccuuacauuacaaagaacucuucccauacuguuuuucccauguacuacugcugucuuagacuaaacugugccaccuuccaacaguuuccaaauuacuauuucaggucgagauaaugaagaaauaagaccaaaucugauuaucugacugaugacaaauuugagcaccaacuacagcaaaauucagggucaagguagcuugcaagucaguucucuugauuuggcaauuaccuuccacuauuuucaucuguauugaagcugagaucuucagggccuauuuguucaccaucaggaaaacuggaauguguaucuaugauuaaaaaauaaauaaaaaauuuaaaauuuaaaagcauauaacaagggcaguauuuuccuucccaagucuuuaaauaaucuuaccaaauguguuauuuaagugauaaagaugugcuggguugugaacaaaucucugucuucagagaauuugugaucugagucagguauaagcaaacacaaaggaaaaauaaaggagaaaaaaacaaaauguguaauagacacccacaauuaaaagaugacaggaauugucucauuuuguccuccuggggacaaucuggggacagcuuaaaaagggaacaagaagcaaugguguauauucucaagauucaagaccuuauaaacauaaaacauauuucaaagccaauuaaacuacgcauucaaguaucacuacaaaaacccaccagcacuccaaauaacuugcacaaaauuuggaugcuuauuuuagaagcagaggaaguuacuaaagaugccuuaauacuuacaaaucaucaaaugcuugguucuguauugaaaaagauaccagagcaccaggaaaauaugcaaaauauaaagcagaaaauggcauaggcuuaacaauguugucacuccaggauaucuugcagaggaauguucagauugauuauuaaggccucuggguaacuuuaaauguguauuucucuaacuugacaguauauccuuuuacugauuaaucuguauuccagaaaacugcuugacagcagaauacuuaugguauauccacaugauagaauauuagguugccauaaaaaaugaaguuuaugaaauuuuaaauaacauacaaauauauuuaagugaaaaaagcagaauaaaaaacuauuuauaaaauauuuagguagggcuggcaugguagcucacaccuguaaccccaguacuuugggaggccaaggugggcagaucaccugaggucaggaguucgagaccaggcuggccaacauggugaaacccugucucuacuaaaaauuacaaaaacuagcuggaugugguggcacaugccuguagucccagcuauucaggaggcugaggugggagaauugcuugaacccaggaggcagaaguugcagugagcugagauugugccacugcacuucagcuugggagacagagcaagacucugucuaaaaaaaaaagaagaagaaaugcaaugcaaauaagacagaagaaaacaagggaaaauauuaauaguagguuucucuuguuuuuuuccuaauaacuuuuuuggggguaggagggaauaaaaauuauuucauaaucugcauguauuucuaaguuauuuuuauuuuaaaagguuaaaguuaucuuacaguaggcuagaaaaggaaaaaaaacccaaacaucugaaaucuccccagggauuggcaaucauuuccuaugaaggguaaauauuuaggcauuguaggccacaaauggacucucuugaaaauucuucuuugggcugggcacgguggcucacgccuguaauaccaggacuuugggaggccaaggcagguggaucacgaggucaagaguucgagaccagccuggccaacauggugaaacuccaucucuacuaaaaauacaaaaacauuagccaggcguggugguguauaccuguaaucccagcuacucaggaggcugaggcaggagaaucgcuugaacccaggaggcggagguugcagugagccaagaucacgccacagcacuccauccugggugacagaacaagacuccaucucggggcaaaaaaaaaaaaaaagaaaaaaaaaacccacaaagaaaauucuucuuuguuucuuuugcuugguuuuuaaagacucuuuacaaaguaaaaaccauucucaggucacagacuauacaaaagcagguuguggaccccgucucugcccaguaaguagcacucauuaggugcaaccaagccaaauauuacuggcuguguuuuuuuaguacucaccauaauaguuaaccaaagaauguugucucacaaaugacaauaauuaaaaaaaaaaaaaaagaaguagaagcagaagaagcaaaagcaguagagcggaaaaaguagaaguagcagcagcagaagaagaagaaagagaagcggcagcggugguuuuaguaaucuguguaaaaugacaucaugugcugcaccuucauccgggggcugugucaugaccaugaaggagucgugaaacccgcccacacugguaugcucuuccugcuccucauucucagugucacauucaaugucacugucgcuacucauuccuggcaggaaggaaggagaacauguuucugaaaagaaaccacuguaaguaaaaggaaacagaaaucuccguaucugcuaaacugagauuccuauugaauuuuacauggaaugccaagaauucaacaaacuaaacacuaacaaaacaaagacaaaaguaaccgcacaaaccucgauucucuuuagcuauuuagagugguuuuauuucuguucucaaaguuuaaaauugcccuuuccauaguaccugaaaguuauuauuugaaaccagcauuaauuuuauuauacugauaauacuuuuuuccaaaucaaacacuguuuuuuuuucagucacaagagauaacaggaacucuuuuaauccugauucauuauagacauaauuauauucccuagccuaaaacauaaauauaaauguguuauacaaauccacaugguguaugaauauuagaaauucuggcaauucuaauaauaguuuguauucuaauugggcaucuaauuuuuuuguguaugucgguugauuuguauuuauuuuuauuuuuugagagacagggucucgcucugucacccuaggcugggcugcaguggccugaucauagcucacugcagccucaaacuccuaagcucaagggauacuuccgccuuagccucccaaguagauagguccacagguacaugacaccaugcccugcuaauuuaaaaauuuuuuggagggacagggucuugcuauaauauguugcccaggcuggucuugaaauccugggcuugagaagagauccucccacuuuagccucuuacagugcugggauuacaggucacugugccuggccacaucaguugauuuuuaaaagaauaauucuauaaaaaguauuuguuucagcaagauagcaaucaagaaaaccugaaaaucuuucugcuacaaauccuuacaaauagcaagauaaaauauaaauguaaaacauuauuuuaaugaacaagcacauuaaaaggcagaaaggaaauccacagugucagaaacaaagaaagauaaggaacuuucauuagugggucagggaccacaguugcccuggagagcuuccugugaggauuuuuaaacacugccuugggauagaaaaaugaaccccccacagaaagggaauuaaaagugagacuaaaacuccacccccugcauaauguuaaaauuuuuguuuguuuucuugagacagggucucacucuguuacccaggcuggaguacaguggugcaaucauggcuuaccacagccuugaccucccagggcucagaugauccucccaccucagccucccaacaggccugugccaucacaccuggcuaauuuuuguaauuuguuaguagacaugggauuucgccauguugcccagacuggucuucaacuccugagcugaagugauucacccgcuuuggccuccuaaagugguggcauuacaggcaugagccaccaugccuggccaaugcuaaaauuccuauugaaagaacagacuagaaaaaugucugccuacuggcauaggaaaacagcaaggaauuuugucuguuucuacugggcucugaagagggggaaaaaagucuuaccucaaaauucaaaguaagauuuaugugccuaauuucgguuugggauuuaagguugagguucaaauuuuaagaaauuaacauaaaaauuguucaggagcuaguguuauuugaauaaagcaaaaguaaaauccucucuggaaggaagguucuagguacaauggagcaagcacauuccacucuaucuuuuccacugaaaguagcaauaaaaccuggagagauggguaguguaguuauuuaaggauauucauaguuauuuacuuugaaaaguaaauagaaacaggcauacugaugaagacugaauuugaaugacagcaaaacuggcagauuaaaacaagacccagagucuuauuaaaaaaaaaaaaaaaaaccuaaugaaaauguucaggauacaaccccaaauuauucagcauaugaaaaaccaggaaagacaaccaacaaacaucaaugaugagaugacacagaugucuggaauuauuuaagggcuuuaaagcuagauaaaaugcucaucagccaggccugguggcacaugccuguagucccagcuacuugaaaggcugaggcaggaggaucgcuugagcccaggaguuugggacuagccugggcaacuuagcaaagccccaucucuauaaaaaaaaaaaaaaaaaaaaaaaauuuaaaaauuagccaggcacacauuggugugcaccuguaauuguccuagcuacuagggaggcugaggagggaggcccacuugagcccaggaguucaagccugcagugagcuaugauuguaccacuguacuccagccuagguaacagaacacaagacccugagggacagaggaaggaaggaagaauuaagaaugaaggggauaaagggacuggucuaaauugugucaaauagaaugccauagagauagcaaaaauaacaaaggagagacaauagauaaaaggaaaaaaguugaaaauuuuguagaauuauaaaaaacauucugaauuaaauacaaauaaaacauaucaaaauuugugggaugugacuauagcagugcuuaaaaggaaagguaugacauuauuuauauuagaagagaaaauaucucaaaucaauaaucuaaacuacuacuuuaagaaacuagaaaaaggaaauuaaacucaaagcaaguaaaaggaaggaaauaauaaaaaacauaauaaaaucagcagaaaaacaaaaaaaccacaaugaaacaaaaugguguuucuuugaaaagaucgauaaaguuaaaaaagccucuagguagauucacuaacaaaaagagagcaaacaaaauuuccaauaucaggaaugaaagaggacaucaacuacagguucuauaaacaguaaaauauaauaaaaugcuaucaguaacuguaugcucaugaaaccaaaaacagaugaaaugagcaaauucuuuccuagguacaaacuaccaaagguuacucaaggaaaaaucgauggguauuuuaacucuuaaagaaauaaaaucugcucuaguuuaaaaagcuuccaacaaaggcaacuguggccccacauggcuucagugguacacucuuccuuuucucuuuuuaagaagaguuugguuagcauuauuucagccuuaaauauuuagaaaucgucuccaucuucagcaaaacaaaaaaacaaaaaaacaaacuuuccuguucuaaaagagugaagaguuuacaacaauuuuaugaaguaggggaaaaagaaaaagagcagagacgguuaaagaggccaaaacuagcuaguucugugaagcaccaccuccaccuuguggcccuucauggaacuguugcugaaaacacuaaaacacacugaguugaacuucaaggcacaaauuugaccucuuauuaguaguguuucugaauucccgacaaauaccaaccuucaggauucaaaaacaaugaauuggaauucucuggaauuccccaaaucuacauuauucuuuuaaaaaaguuauuaaauacauuuuucaaacucuauucauuacauguguaucuuuuuuuuuugagacggcgucucacucugucacccagguuggcgugccacugcgugaucucagccuacugcaaccuccaccucccagguucaagcaauucuccugucucagccucccaaguagcugggauuacaggcaugugccaccacacccagcuaauuuuuuuguauuuuuaguagagauguguuucaccauacuggccaagcuggucucgaacuccugaccuugugaucuacccgcuucggccucccaaagugcugggauuauaggugugagccaccgcauccagccuacauguguaucuuuaaaacaaaucauuuaauuaguauuuguaagagcugaggccuauagugaauauucaaaugcuagacugcauguggguauuacuggguaguaugugaauaaugucacguuuagaacucagcaagguuuacaguacuaugcagaaucacauguuaauaaaaaugccaauauaaggauuuugcuucaaaaucuuucuuggaacaccaaucaauuuuuauuaaguauaccauguguaaacucauuauuauuuacuuagcagcagacagggccaugaacacacauaaaacggcgauauuuauaaugaggacugauuuguaaucacuucuuuccaaggagcuccuguugaccuuaaccuuugauuccagguaucaguauuuccaguuuuuacuuucaacuugcccuaaguagauuccuucaaaucaguaauguuucuguguuguuaaaauuaauucuaauaagacaauuagaauaauguuuuccauuuauuaaacuucuugacuaauuuuuuucagaauucaaaaaaaacacacauuucccaagaaaugcuaggaagaaauuccugcaugaaaacgccuggucuuuuaucaagcacuaagaucuggaaguuuccuaccuuugugaauguaaagaaaaagacaaauggcuggacgucaaugauagcaauuacaagauacuauuaauuguaaggagcuucagagauuguuaacgcaaaagaaaucugcaucuuauuacucugucaaucaucuaccauauuuuuugagcaccuacuauguaugugcucaguaaagcuaacuugaguuauaacucccuuaaaucaaguugcucgaauuucagaugcuauggaaaauacauuaaccaccugguacagaugacacuuuauauucuagucaccaacaauuuaucugccuuucuccuuucgaagaggacccugauauuguucagguauuuucccuuaccacauauccauguggaacgaguuggugagggagaccaacuaacuggacuuggcuggcugggugcgcgguggcucaugccuauaaucccagcacuuuggguggccaaggcaggcagauugcccgaggucaggaguucgagaccagccuggcuaacauggcaaaaccccgucucuacuaaaaauacaaaaauuagccgggcauggcagcagaugccuguaaucccagcuacuugggaggcugaggcaggagaaucgcuugaaccugggagguggagguaacagugagucaagauugcaccacugcacuccagccugggcgacagagcaacacucugucuccaaaaaauaaauaaauaaauaaauaaauaacuggacuuggccacuuuccuugacaguggcugacgagauagaagaggaaguuguugaggugcuuagagaaagguuguugcuggagauauauagaauaaaucaauccucuuccacucccagaaugcuguucugacucugaugucuagaacugcagcaaacaucuuaccgcccugagaagagcuaagccucucacucagaauagcagggcaaaagauaaaacaaccccacccccacccuccaacacacacacacacacacacacacacacacacacacacacacacacacuaaaaccaccccacccccacccacccacacacacacacacguuccugaugacacugagcagcugaauuuucuaauccugaaaacugcucuaccacagguguaccuucuuauugagagauuuguuaauguaaaagaguuaauuuuccuuuuuguucaagucaguuaauuuuucgaugaauuuuguuaaaggcaucuuaauaauuacccuaaaugaucagcaauggcaggccaucaggcuuuguauuccucuuaaagaggccaccagcaagguuuuuaacaggcaugccaaggcuuuuccccagaugguguuuugaguaccccugauuuaacugaaggggguaugugcuacuucagcaagaagucagagagcaaagccuuuaguuuuacaaagaacaagaaauaaacuggccuaccuacaguugugcaggucaucaauugaaagaaaaaauaagucaaccuuuucagcaucagaucauuaaaccagcgacuaauacaaccaaagguugucccauaugguuccaguaaaaaggaaaaggccuauuuauguucauaucuaagaaaaaaguuauuuuuaaacugaugcuuaagagcaauuaagagacacuuuaguagucccaaauucccagccaguaccacaaacaacgccuuaaaguccuccagacaaccuucucuuugagaaagagagagaaccccacagugauaugacaccgaaugucuucuuuuuguauucagcuaaaauaaagagucuuguuuuuccuaagcauggauacaagacaaauccauucaacugucuacuaaggcuuauagguauauaaggguuuccugagaacuugcucuugcugaugauagaauaauacuggcaacagugagcaaggccgcacucuccucgagaaacaaagcugauuacaggaggcacagggcuuccuuugucuccuguacuaccuucucucagccucaucaguuagucuccuucucacagucuauccugggacucuggagguaaacaagcuguucagauaccaacaaauuacaaggguguacuucugugucccuguugauuugcacauucacagcaauuuuucuuauugaguucuaggugcuauuuauagcacaacaccccacauauaaagauaaaauguguuacugaauaacacugaccauuuaacucuaaauccuacaugaauaacuccauucuuucaaagacuuggaaaauguaccgaucuucacuauggccaagcaaaugccuuucuucaguuuaggacaagcugucaauuagcuuuaaauaagaaaugaaacuggugucaaaaaguuccaguguuuucugugcugaccagccauuuuauauauaaaaauuagugcugagauaauguaaauugauaaauuggaggcugaaauuaaguccaaaucgggcggccgggugugguggcucaugucuguaacccagcacuuugggaagcugaggcagaaggaucauuugagcccaggaguuuaagaccagucugagcauacagcaagaccaagucucuauaaaaaauuaaaaauaaagaaguccaaaucauuucaccuaaccaugcuucuuaccaauuuuccugccucuaguuccacauaugcuauucccacccccaaauccauucuccagaaugcagcuagaguagaaauguuaaagugucacuucuaacuuagauccuauucaaaugacaaaguucaaauucuagcugggacauuccacguaacucuucaugaucuggccucuggucugucucccuucuggccuuucaccagucuucaucuggcuaacuccuacucaucccuuaggaugaucuuuccaaggguggauuagggacuagguuagcagagagaggcgacaguuaagagcacuggcucuagguucaaauucuagcucuuccaaguucuuuuuuuucuuuucuucuuuuuuuugagacagagucucgcucugucacccaggcuggagugcaauggccacaaucucagcucauugcaaccucugccuccuugguucaagugauucuccugccucagccucucgaguagcugggauuauaggagugugccaccaugccuggcugauuuuucuauuuuuaguagagaugggguuucaccauguuggccaggcuggucucaaacuccugaccucaggugaucugcccaccucggccuucccaaagugcugggauuacaggcauuagccaacaugcccaaccuuccaauuucuuuucuuuuuuuuuuuuuuuuuuugagacgaaguuucacucuuguugcccaggcuggagcgcaauggugcgaucucagcucacuguaaccuccgccucccggguucaagcgauucuccugccucagccucccaaguagaugggauuacaggugcccgccaccacacucagcuaauuuuuguauauuuaguaaagaugggguuucaccauguugaccaggcuggucuugaacuucugaacucaggugauccacccuccuuggccucccaaaguguugggacuacaggcaugagccacugcgcccggcccuggccuuccaauuucuaacccugugacuuuggguaagguaaauuacaucuccaggccucagcuuacucaccuguaaaacuagguuaacaaaagcaacuaccauguagaguuauucugagaauaacagaauacugguaaagucuuuaacacaguaagaacuuaguauuacuauuauuuuuauuacguaucucauuuuugagcugccuauaaaccuuaucacagcacucaucguccuauauuacaacuggcuauuagucuccccugacaccuaacaauugguuuucaacugcucuccuugccgcccuccuaccaauaccaccacacauaccuagcauaccugagagcuacaacuuauuucuauuaauaacuguggcccacucuggcaagugauucucaaggaguggucaccucugguugagaauuauuuaguucaacuauugguucuugacuggggaugauuuugccucccaggaaacauguggcaaugacuagagacauuuuugguuguuguaaccggagggaaacacuacugguaucuagugguuaacagcugaggaugcugcuaaacauuccacagugcagagaacagucccuguaaaauaaagaauuauguggccuaaauggcaauggugcaaagguggagaaagucugaacuagauaguaaguucaggaauuuuaucacuggcaucaaaugcaacauccgguaaauuagaagcauuucauaaauguugcaugaaaaaaaugagcuuguuauuacugucauuugagauagagucucacucugucguccaggcuggagugcaguggcgugaucucagcucacugcaaccucugccucccaguucaagcaauucuccugccucagccucccaaguagcugggauuacaggugucugcuaccacaucuggcuaauauuucuauauuuaguagagaugaggugucacuauguuugccaggcuggucucgaacuccugacuucaagugauccgccugccucagccucccaaaguacugggauuacaggcaugagccacugcgcuugguggaagaaaaaugagcuuguaauuccagcauauucuguaguaauuuaagcuacuacaauccaguauguauggagacacauagaaaguaacuauuccccggccggccuugguggcucacgccuguaauccuagcacuuugggaggcugaggcgagugguucacgaggucaggaguucaagaccagccuggccaacacagugaaaucccgucucuuacuaaaaauacaaaaauuagccagguguguuggcaagcgccuguaaucccagcuaugcagaggcugaggcaggagaaucgcuugaacccgggaguuggaggcugcagugagccaagacugugccacugcacuccagacugggcaacagagcuagacuccgucucggggaaaaaaaaaaaacaacagaaaaagaaaguauuccccacaggcccauucuauaaagaucuucaaucauaauauuucuuucuugauguuuuaacaauaaacacaucauuuacaaaaaucuuuucuauuuaaucucuucuacugaaauaaugcugcccaucacagaagcaccaauuaagaaaaccaaaauauuuaguguucuuuaacugagaaaccugaaaaugccaccaccuacacacccucuucuuagggcagcugaguagaugcuggcaccuguauguaugcuuugagcuacaauucaucaaucauugaaauucaaaugagugcagagguggaaggugguggaguuucacuaagaaaugaaaaaauuacaaggccaaauaucauuaagagaguugacauucuuuucuaccaauuuauaaaggacacagcaagggcaauacacauagccuuguucuaagcaccucuguugccccaaauugcaaaaugucuucuaugcuuuuagauaaacaauaaugaacuuggaagaacaugcaaaagaaacacuagaaaguacagcugagaacaagcugaagucagucaucauacaggauuuaaaaaauggucaaaacuuggaaugcuucuuuaagaagaauaaagcaaucuacagacacuaauuaagacugacuuuaaaaaauacuuaacauuuacuauucuaauuaguuguucuagggcauaucuuccccauuagauugugaacauaucuaauucaacuuuguauuaauaaaucuagcaaaaauucgaugccugguauguaggugccuuaacauauuuauugaccgaacagaugaacuauaugcagauuuuuuccccauacaaaugccuguucuaguaaggccuguccuuuuauauaguaacuuacccauuuugccuuccucuguauuugguaucuuagcaaaucaaauucaguggcacaaggaauguuguguucagaucaagcaugucgaauagcagaucucaguaacauuuccauuaaaccaaccacucccuaucccuaucacuaccaccagcagcagcagcaccaccaccaccaccaccaccaccaccacccaccacccaccaccaaaaaagggacagaauucucauuuccugcuuacuuauaaguuuaucauuccuuaccuucuucaggggcagcugaagcuccuucagguaguacaggcuguaacucuccaguuucagaauuauuuuccaaaucagucaucugcaguccuuccagaugaccuccuuuagcauuagcccucaaagaagaaaacaacuugauauuucucuauaacuagugacacaauaaucuauauuuucuuuuugaacugagcaccaaacuaaguaggguacgugcucuggugcuuaauacuaaauuucaaauuuuaucugaaaauauuucacuaagguccuggcacaguggcuuaugccuguaaucccagcacuuugggaggccaagguggguggaucaccugagguaggaguucaagaccagccuggccaagauggugaaaccccaucuccacuaaaaauacaaaaauuagccagauaugguggugggcgccuguaaucccagcuacucgggaggcugaggcagagaauuucuugaacccgggacguggagguugcagugagccgagguugcaccauugcacuccagccugggcaacagagugagacucugucucaaaaaaaaaaaaaauuuuuuuuucacuaaauauucacaaaaaaauguuaugaaaugguggauuacaucaauguugguauccugguugugauauuguacuacaguuuugcaaaauguuaucauuaggggagaaaaauacacaggaucucucugcauuauuucuuacaacugaaugugaaccuauaauuagcucaauaaaauuuuaacuuauaaauaccaauagaaguuuuaaauaauauguucuaauagggaaagacuuuugagauauauuauuauugcuauuauuugagauagagucucacucugucacccaggcuagagugcagugaugugaucucagcucacugcaaccgcugccuccugggcucaagcgauucuccugccucagccucccaaguagcugggauuacagguguccagcaccacgcccggcaauuuuuguacuuuguuuuuaguagagacaguguuucaccaugauggccaggcuggcucgaacuccugaucucaagugaucugcccaccucagcuucccaaagugcugggguuacaggugugagccaccgugccuggccugagagauauuauugaaugagaaaauaaaguacaucuucuguauuaaaaaagcuacauagucacaguuccuuaaauauacacaaaaacugagaagacacagcacacaugaaaaauuaauaacagcaugaauaugugugggcaggggguuggaaaacuaggucaugggaguuaaggaugggaaauuuuucacuuauucuuuucuccuuucauuuugaaacacuuaucauuaguauuuaauauuuauuuuuauuuaaaaaauaaacagaggcaaggucuugcuauguugccuaggguguucucaaacuccugggcucaggccaucuucccaccucagccuccaaaagugcugggauuacaggugugugccacugugcccagccuuucauuaguauuuaaacuuuuugcuuacacuacuuuaaaucaggcaggaaaaaaaaagacaugagcuggacagcaccuacaugaaccaggcuggcagauaaaaucaacugcaaaaugaggaucaagcugcacacacuugcacaggauuuuacacucuagaaaaaaaaaaacuaaguucauguauauuuaauuguggugacuaaaggcagauaaaaauaucuccauagcaaauaaaauauaagagcuaguugcacuuuaauuugaagaaauguauaaaacaucagguuagguaguacguagggaagacaagauaaucuccagugauuuuaacaccuuucuacuacugaaacuugagccagaaagcuaaaccaccagcugaucuuguaguuuugguaaugagccagaccuugacuauauaaaauuaaguaaacuuaaaggguguuaaucuuucuccaauuuagguaaaauucuuuucagggucuccaaaauagaacuauuucauuguuuaaauuuagaaauagguuuaauauccauaaaauagauaagcagauggauauuaauggcuaaucaucugccacauccauagccaauauccauaaucacucuaucuuuugaauagauggaaguuuaauugccaugccggggauuugaguuuaugucuccuaggggagagauaaacguguuaacuacuauauaucuuuuugggaaauuccaacuauaaguuuugaggauacuuugauaacaggagagaagaaagaugagauaaaagcagaaaagcaguguuaaaguugcuguaagugcuuuguuucauacaaaauauauauaaaugccugugacacauaauauagcccaacacuaacaucuuugacaaguguaggauagacugaaaaaaaaaaaaaaggcugaccgccccccuaccgccaacacauacaaauuuacaaggcagaguucagauaagguuacguaucauugugaaaaugagcucuaacauauuuaaacuaaacuuccgguacuauuucaucccauuaaaaaaaguacuaucucuugagaccauggugaaaccccaucucuacuaaaaauaccaaaaaaaaaaaaaaaucagcugggcgugguggugggcgccuguaguccuggcuacuuggagaggcugagguaggagaauggcaugaaccugggaggcggagcgugcagugagcugagaucaugccacugcacuccagccugggcaacagagcgagacuccaucucaaaaaaaaaaaaaguacuaucucaucccauuaaaaaaaaaaaaguaaaaucucugauacuuuaaaaaaguuaaaauuuaggccaggugcaguggcucacgccuguaaucccaacacucugggaggcugaggugggcguaucacuugaggucucaggaguucaagaccagccuggccaacauggcaaaaccucgucucuacuaaaaauacaaaaauuagcagggugugguggcgggcaccuguaaucccagcuacuugggaggcugaggcaggagaaucacuuaaaccggggaggcagagguugcagagagcugagaucacgccacugcacuccagccugggugacagagcgaggcucuguuaaaaaaaauaaaaaaaauuaaaaaaguuaaaauuuagugcaauaaauguauuuucuguccacuaaaaaauuaacaagguagaaauuaauuuguucaucaugaugcauacuuaaaguuccaaacaaagcuauuagcuauuauaccauuacauauacaaaacaacuuaauuuaccccaaggugaccauuuuccuccuuuucucaaccgcaggcaagccacugaaaacugcaaccacaacagcaucugaauccaaagcuuuacacugccggucuucaguuuuuggcagaauaucaccgauacugccauguaucaaggcucggggagaacugugccugcucccagacugagagcuuccuggggagccuucaaaaaaaggaagauggaauacaaaaauuagcugggcaugguggugugcgccuguaaucccagcuacuugggagguugaaacacaaggaucacuugaaccugggaggcggagguugcagugagcugagauugugcuacacuccagccuggacaacagagcaagacucugucuccaaaaaauaaaauaaaauaaaauaaaaggagggauaaucagaaaaaaggcaaauaaacaugaaaggucucucucaguuacauuagaaaaucucacuauauauaucauuuuaaaacuacauaaaaacuucaaaaauaggccaggugugguggcucaugccuguaauccuggcacucugggaggcuaaggcggauggaucaccugaggucaggaguucaagaccagccuggccaauguggugaaaccccaucucuacuacaaauacaaaaauuagccaggcgugguggcgugcacuuguagucccaguuacucaggagacugaggcaggagaaucacuugaacacggcgggcggagguugcggugagccgagaucgcaccauugcacuccagccugggcaacuagaggaaaaaacuccaucucaaaaaaaaaaaaaaaaaaacuucaaaaauaauuuugaaacauaucccuuguuuuuuaugccaagcaucuaaaauuaaggaguccaggccaaguguuguggcucacaccuguaauuuuacacuuugggaggcugagacaggaagauuguuugagcccaaaaguucaagaccagccuggacaauguagcaaaacccugucucggcaaaaaaaaaaaaaaaaaaaaaaaaaaaaaaagccagguauggcugcaugugucugugucuguggucccagcuacuugggaggcugagguggaaggaucacuuuugucugggaggucaaggcuacagugagcuaugauugcaccacugcaucccuagccuggaaaacagagcaagacucugucucaggaaaacaacaaaaauaaagaauaaauaaaauuaagguguuuagaauacauagucuaauggcuguauuuuguuaagggucuguucuguugagaucaagaaacuuuccagccaggugugguggggcucauuccuguaauccgagcacuuugggagguugaggcaggcggauugcuugagcucaggaguuuaagaccagccugggcaaccugucucuacaaaaaauacaaaaauuagcuaggcguaguggugcacaccuguagucccagcuacuugguggggcugaggcaggaggaucucuuaaaccaccggucgaggccacggugagccaagaucgcaccacugcacuccagccugggugacaaagugagacccuguuucaaaaaaagaaacuuucaaauccaacuuuagcauuuuuggugcccuucaagaucuaaagcuccacgauaacaucaauuucagguaauaaauauuuaccccacuaaaaguacauucugaaucccucaaauuuaccuucagacagagucugacagucucccuuugaacgacuauuuucuccaggguccacugcucuucgaagugauagacuaccugcuacacuggaucgagcuggcuugggcgaauuacucuucuuauuuguggcugcaaagacauuuaagaacaccucugaauaggcuacuacagcacaaaacucacuauuuagucugucagaaaaaguuuuaaucuuaccuugcauggaagcuguucucucuacugucuaaaaauaaacaacauucuguagccccaauugguuuagacuuuugucauaaaacauucccaucuuguugcuuguagagcagaaucuuuuuuuuuuuucccccagauggagucuugcucuuguugcccaggcuggagugcaauggagcgaucuuggcucacuacaaccuccaccuccuggguucaagcaauucuccugccucagccucccgaguagcucagauuacaggcacucgccaccaugcccagcuaauuuuuguauuuuuaguagagacgggguuuugucauguuggccaggcugggucucgaacaccugaacucaggugauccaccugccgcggccucccaaaaugcugggauuacaggcaugggccaccgcacaccgcccguaaaaucuuaacuuaaaagauuaucugugagcuccuuaagaaaaaucauacaaauuucaaugcaguuaaacuauuaacaaauauauaacccgucaaacauuuggaaauuauaaaguauuauuggauuaaaaagaaaaaucaaugcugaguuagaaacaaauuacaauuaugguacuugaaaucaaaaugucuguggccaaaccaguagugaaaagaaaauguacggccuuaaaaugaauuaauuagggaaaaaagggacuauaugaccuaauaugcauagauucaaaagcuaggaagacaauaaaaauaagcaagcaagaaugcuauugccagaaggcagggcccugcccuugaauucagccugcagaacugugaguuaaauaaaucucuuuuaaaaauacauuuuaaaaaaagaauaaaaauaaaauuguaaaaaacaauaaaaauaaaaaauucauuaauagguaauaaacagguuuagcaugguugcaggauauaagacaaaauaacuuauuguauuucucugcacuagcagacaaugugagaaugaaguuaagaaaacaauuucauuuuuaauagcauaaaauacaauuaaaauacuuaggaauuuauuuaacaaaagaaaugugagacuuguccacugaaaacuaccacacauucuugaaagaaaauagagacaacagcaaagacauccuguguucaucacugauuagaauacuuaauacuguuaacaaagcaauauucuuaaaauugaucuaccgauucaacacaauuucuaaaauaauaguagcuguguuuuuuuuuuuuugcagaaauugacaagcuaauccuaaaauccauuugaaaauguaagagacccacaauacccaaaacaaucuuaaauggaacacucacuucugauuucaaaaguuacuauaacuaaguaaucaagacuaugugguacugccauauacacauauauaucaucaaaacagaauugagagucuagaaacaaacccuuauauuuaugguccacugauuuuugacaaggaugccaagacaaugcaaugggcaaggaaaaaaagagggacaauaaguguugccaacgguauggaaaaccuggagcccucauauacugcugcugggaauauaaaaugaugcagcuacuuuggaaaauagucuggcacugguaguuccucaaaaaguuaaacacaguugccauguaacccauuaauuccacuucuaagcauauacucaaacaaaaccauauguccaaacaaaaacuuguacaugaacguucauagcagcacuacugauaauagccaaaaaguaaaaacaacccaaauauccaucaacuaaugaguggauaaacaguauguaguacagccauacaauaaaauaucaugcagacauaaaaaggaauauaugccacaacaugaaugaaccuugaaagggcuguguuaagugaaauaagccagacauagaagaccucauaugguaugagucuauauaaaaaguccaggcugggcgcaguggcucacaucuguaaucccagcacuuugggaggcugagguggguggcgcaugaggucaagagauugagaccaaccuggccaacauggugaaaccucgucucuacuaaaaauacaaaaguuagcugggcaugguggcgcacaccuguagucccagcuacuugggaggcugaggcaggagaauggcgugaacccgggaagcggagcuugcagugagccgagauugugccacuacgcuccagccuggguaacagggagagacuccgucucaaaaaaaaaaaaguccagaagaagaaaaauccauagggaaaaaguagauuagugguuaccagaagauaguagaaggggaagauggggaacgacuuuuaauggguuuggaguucuagggagaggguuaaugaaaauguucuuagacuuagauaaauguucuagacuuacgaaaaaugaugaccaauuucuccacuaaaaggauaaaugaauuauugguuaaggaaaaaagaaugcauuaacagucugggugcgguggcucaugccaguaaucccagcacuucaggaggccaaaguggguggauuaccugaggucaggaguucgagaccagccuggccagcauggugaaaccccaucucuacuaaaaauacaaaaauuagcccggugugguggcacacaccuguaaucccagcuacucaggaggcugagguaggagaagugcuugagcccaagagacggagguugcagugagccaagaucacgccacugcacuccagccugguggacagagcgagacucugucucaaaaaaaaaaaaaaaaaaaaaaaaaaaaaagcauuaacaaagacaaaagcagaaauauaaugaaaugguaaaagacaauggaugaaauaaaucuaagaacuuggucuuugaggagaugaacaaaauuagcaaaucccuugagcaggucaaaucaaaggagaaaaaaaaacagaaguaagcaauaaaauaagugaaaaagaaguuaacaacccauaugcacaagaaguuuuaaaaauuuaagaaaauagaauaaaugacuguauaucaauaaauuuaaagacccaaauauaauuaguuuuucuuggaaaacuauaguaacugacuuaaguagcagcagaaguaugagaaaacuacaucugacaagagauuaaugaccaggaucucaaacaacucuauaggaaaaaauucaauaaucugauuaaaaauggguaaaaaucugaauagauauuucuuaaaagacgacacacaaauagcaaacaggcauaugaaaaagugcucaacaucacugaucaucagagaaaugcaaaucaaaacuacaauaagauaccaucucaucccaguuaaaauggcuuuuauccaaaacacaggcaauaacaaaugcuggugaagauguagagaaaaggcaacucucauacaccauuggugggaauguaaguuaguaaaaccacuacggaaaacaguuuggagguuccucagaaaaacuaaaaauagaucuaccauaugauccagcaaucccacugcugguuauauacccaaaagaaagcaaauuaguaugucaaagagguaucugcauucccauguuuacuacagcauuauucacaauaaccaugguuuggaagcaaccuaagauccacagacaaauggauaaagaaaauguuagguugggcgugguagcucacgcccguaaucucagcacuuuguaagcccgacucaaguggaucauuugaggucaggaguuugagaccagccugaccaacaaggugaaaccccaucucuacuaaaaaauacaaaaaaauuagcugggcgugguggcgcaugccuguagucgcagcuagcugggaggccgaggcaggagaaugacuugaauccaggaggcagagguugcagugagccgagauugcaccacugcacuccagccugggcaacagagugagacucuaucucaaaaaacaaaaaaaaaaugugguacauauacacauggaauacuauucagccauaaaaaaggaaugagauccugucauuugcaacaacauggguggaacuggagaucguuauguuaagugaaauacaucaggcacagaaagacaaacuucacacauucucacuuauuugugggggcuaaaaauuaaaacaacugaacucaagauaauacagcaaugguuaccagaggcuagggaguguaguggguggcuggggggaugguuaauggguacaaaaauauaguuagauagaaugaauaagaucuaguauucguuaguacaacagugacuacagucuacaauaauuuauuguacuucugaaaauaacuaaaagaguacaauuggauuguuuuaacacaaaggauaaaugcuugagaugauggauacuccauuuacccugaugugauuauuaugcauuguaagcguguaucaaaauaucucauauauccuauaaauauauauaccuacaauguacccacaaaaauuaaaaauuaaaaaaauuaaaaauaugaggaaaccaacaaauccaacagaaauuaaaaaggcuguuaaaguucuaacucugaguuacuauacuaguuuuaugaaugcuuuuuauuagacauaaaguuuaauacagcauaggagcaaauaacauauaguuaaaauaauuuuauagcauagaaaaggacaaaaacaucugaauuuaaucuguaaaacaagcacagaauuagaacuaaaguggguuaaggauaguguaaugaaauagaucgauuucacuuaugacuauguagucaaggauccuaaguaaaauauuagcaaacugaauacagcaguguuuuuuuaaaaaaaguauaggcccaaacuaaauaggaugcauuccaguauuuccagaauggucaacauuagaaaaauaauauaauuuacuuuaugauaacaaaguaauggaacaaaauaguaaaucauuuugacaaaugucaaaacaucauuugauauaauucuacacagcuucaguuuaaaaagaaaagaaauucucguaguaagaaaagaggcaguuugguauuagggugaagggcauaggcucugaaguucaaguuuuuggcuuugccaauuaccaaugugaaacuagcaacauuauucaaugccugcugccuugguuuccucaucuguaaaucuggaaugaaauugacuuaccuuaccucuuagacuucuuguuaagauuaagugagucaaugcaugugacuuagaauaguuagaauaaugucuggcacacaguuaacacuuaguaaauguuagccauuauugguauuguuguuacuaaacagguuuaguaaccuuuaguuacuaaauuucuuuaguaagaaauacagauguacaauaaaaauaugaaaagauauucggccucaccugcuauucaaggaaaugguauauuaaaccaaaugguauauuaaaaccaaaaguacagcuuuuugggugaacuuucucaaaaagccuuuguuacauauuuugcagauacaguugacgcuugaacagcacaggcuuguuguacuguacagguccacuuaauauucgaauuuuuuucaaccagagaaagauugaauauauuacuauacuauacuauagaaucuauuacuauaaauagaaggauguaccuuuuaacuuuuuuauuuauuuauuuauuuauuuuugagacagucucacuugucaccuaggcuggagugugguggcgcaaucuuggcucacugcaaccuccaccuccuggguucaagcgauucuaguggcuuggccuccugaguagcugggauuacaggcauaugccaucaugcccagguaauuuuuuuguauuuuuaguagacaugggguuucuccauguuggccaggcuggucucgaacuccuggccucaaguaaucugcacgacuuggccucccaaagugcugggauuacaggcgugagccauugcacacagcuuuuuuaacuugauagaaacaggccuguaaucuuugggaggccaagacaggcagaucacgaggucaggagaucaagaccauccuggcuaacauggugaaaccccgucucuacuaaaaaauacaaaaaaauuagccaggcgugguggcaggcaccuguagucccagcuacucgggaggcugaggcuggagaauagcaugaacccaggaggcggagcuugcaguaagccgagauagagcuacuguacccuagccugggugacagagcaagacucugucucaaaaaaaagaaacacaaaaacaaaaaaguaccuauugaaacauacagcaaaccucaaauuuaaugagaaaaaaacuaaaggaauuccuaaauaaaguugaaaaauuauaaaaauccuaccacuguuacuaagaaacuguugagguaccugccuagacaaugcaauacaaaaaguaagcagaaaaugaauaaacaaauuaugauuaucugcugaugauauaaauacuuagaaaaucaaaauaacuaauugaaaaacuguuaauaaaacaaauucaccaggccaggugugguggcucacgcuuguaaucccagcacuuugggaggccgagguggguggaucaccugaggucaggaguucaagaccagccugacgaauaugaugaaaccccgucucuacuaaaaauacaaaaacuagccgggcgugguggcaugugccucuaaucccagcuacuugggaggcugacaaagaagaaucacuugaacccaggagggggagguugcagugagccgagaucgccccaucgcacuccaggcugggcaacaagagugaaauuccguaucaaaaaaaaaaaaaaaaaaaaaaaaauugccacauugguugaauacagaauaaacauaaaaaucaauauuuuugucuuuuaugucaguaacaauuagaaaauacuaucagagaaaaagagauuccacucacaacagcuaccuaagauauaauacauugagaaaugaauuuaacaagacauauauagaacuuauauggaaaaaacugagaguucuaaaaaaggauaugaauauaacagaugaccugaauaaauggagagaaguaccacauuccuagacaugaauguuugaugcugaaaagaucucaauugcccaaauuagucucucuuuuuuuaagagagagagagagacuguugcccagauuggagugcaguggcacgaucacggcucacugcaccucaaauuccugaccucaaguaauccucccaccucagccucccaaguagcugggguuacagguacauaccaccaugacuggcuuaucaaaaaaauuuauuuuuguagagauuaaggucuugccauaugauguugaacuccugggcucaagaagccauccucccucaucagcaucccaaaaugcugggauuaacaggcaggagccauggugcccagcaccccuaaacuagucuuuaaauguaaagcaauuccagucaaaauacuuuggaggaggauuaaaagugcaagaaccaccaauaacauuuugaaaaccaagaacagaauaaacauauccuaucauaguauuacaaacuauaaaacuacaguaguuaaaaaaaguguuagucugguagaggacaugacaaauacuggguuaaacaauaccaaauugcguuuuuguauguccaaaacuugaguacuggcaauuucaguuguuucgaccucuaugaguucaaaaacagaaccauguuugggaaucuggucuauaauaaaggauggauuucauauugcaucauauuucaaaaaacauguuucauucauuuggggaaaaacaucauuccauuuaccucacacagcaucauauaaaauuaacuuuauaugaauuaaugaccuauauguaaaaaaguuagaaaacaaaaaguaccagaagaaauuaaggguuauuuuuauuaaccugggaguuaaaaagccuuccaaauaaaaauaagacccaugaauauuauugccaugaauauuauuauuaauuauaauauuauuaauauucaugucaugaauguuaauuauauuauuaauauucauggaugaauauuauuaauacaguugucuaagauaaaauuuuaaaacucugugauuagcaggaaaaaaagguggcaauggggaagagacaguugucccuugguauauguggggguugguuccaggaccccugcguauacuaaaauccucgacugaagucccaccguaagaccugcagaacccaccuauacgaaaguuggcccuccuauaugcagguuuggcaucacccgaauacuguauuuucaaucuuucucugguugaaaaaaauucgaauauuaaguggaccuguacaguacaacaagccugugcuguucaagggucaacuguaucugcaaaauauguaacaaaggcuuuuugagaaaguccacccaaaaagcuguacuuuugguuuuaauauaccauuugguuuaauauaccauuuccuugaauagcaggugaggccgaauaucuuuucauauuuuuauuguacaucuguauuucuuauguuaauggccuauucauaaccuuuauucauucuacuaaauugucuuccuuauauuaagagaauucuauauauuuugcuauuaucuccucaccaacccaucuuuauuggauuauucacaucacuaucaaacauuaauacagccaauuuuaauaaacaacacacacaaagagaacccagaaacaaacccucgucuauauggucaaaugauuucaacaauggugcuaaaaccauucaaugaggaaagaaaagucuuuucaacaaauagugcugggaaaacuggauauccaugggcaagcaagucagacccuucccugacaccauaaacaaaauuuaauucuuaauggaugaaagacuaaaaguaagacuaaaagcaagaacuaaaacucuuggaagaaaacaggagaaagcuucaugacacuggauuaggcaauguuuucuuggcuaugacaccaaaagcacagggaacaaaaggaaaaacacauaaaaugggcuucuucaaauuaaaaacuucaaauguuaaaugacacaauccacagagggaaaaggcaacccacacacugggagaaaacaucugcaaaucauauaugugauaaaagauaaauauuuaaaauauauacagaacuccuaaaagucaacuacaaauaaacaacccaacccaauuuuaaaauggauuuaauucacagaugaaagacauuggagaggacacaaaaaaggacaccccugccaacaagaaacuauugaccccgcaccuccuccagcuucuacccacuucauugugaaacuucuuuuaaagaaguugugcauuugugcucuggucccugaccucauucacucuucugcuacacuacuccaugggaauaguucuuaaaaaggccacuuggccucuugccuugacacuucucagugauacuuaacacacuuaacacagggguaaccacucuacuucuugagaugcauuauuuuugauuuuugagauauuaucccuucuaguuuuucuccuaccuuaaugauugcucuuucaauuuccuuugcuggccucuccuauuuaucagaucuuuaaauguuuaagugccacagagucaaaaauuuugcuucuccauugaaacucccuccaaacuugacccuauucagucuucuggauuuaaauaauauaaaauacuauugacucccaacuguuuauauccagcauugaccucucucugaguuucaaaguuguguaccauucacgugucuaugacauuuuacuaggauaucuagcaggugucucaaauuaaacauguuuaaaaaagaauacccaacuuucugcccuuaccuccucccaagccccauaaccugcuucuuaucugauuugcuucucaauaaaugauaccacugccuauuaaguugcuuaggccaaaacuuaaucauaauucuuaguuucuuucuaaauagaacuuuccuaaaauucuauuuaggcuuuuucaacuaugguucugagaaagaacucagcccugcugaucuaagacuggauuaacuucccuccuaugcaucuagaauagaauagcacauccuuaagagaacuaagaaagaugggaaccucagucaagaaaggcugcuagacugugaacaagccccucuauccauuauuguaacuccagaaaaugccaucauauuucacacaagauaauguaauaggcuguuacuggucucacaauuccuguccucaacccuuuucagacccuucuccacacaacaagcaaagucaucuuuguaaaguguaaaucagauuauaaacaccccuuauuuuuauucucuagaggcuuccuccuuacaucauaauaaaacucgaacuccuuuuugagguuuugcaagacucucccugaucuaaauucugccuaccucucucugacuucgucuccugcuagucuccucucucugcuuucuuugccauacuggucuuccuucaauccuucaaauacgcaaaauaaauccugugucagugacuuugcaguuucuguucuguuuacccagaacacugcuugcccuagaucuauaaauagcugccaccuuccuaaacuucaggucucaggucaagugcugccuccucacagagacuuucucugacuaccccaauagaacaugucucaucugcuccucccaucccacuccucgguuguuuccuucacagcaccuuuuacccacugaaaugaucuuuacuuacuugucuacacuuuuuaaugucugauucccacuacuagaauacaagaucuaugauguuaagaauuuugucuuguuuauugccaaauacagaguaagcaaucaagaaauguuaguucuauuauauaguaaaaauauacggaaucaauuuuggaugaagaaaaaagucacauguaauuuguagucuuaacucacuggaagagugguauuuaaauauuauucuuuugaaaaaaccagucaucuaguuucccaaauaacguguggagaaaugacacugggaacauauuacuuacaguuucguauguaacaauuggcaacugaugacuuugccaggaguuccauucccaaauccugcaaucugccagaguuuucaguuccacaugcagccagagcugccuggucagcagaaaaaaggcuugucugcaugucuccagaagcagcacugcugcuuuuuauuucugaaaguguauucuuuacaucaguuuucauacaucgaacuucggccauuugaguuuugagucuuuuuagcaucuuuaaaucagagggcacucgccacauugccuguugcuuccuuuggucuuuaucuuuucgagaauaugaugcuucagagaaauugacaagucauguuaacauaaacguuaauauuaaugaaaucauuuguaccaugaauauaugcaaauuugauguguaaaauaagcuagcgugcuuuacgugguaucaacaauaaaacaugcacuaaauuccauuaaugaaaauaaagauaaagaauccuaccuuauucacaccuucagaguuagaaucugagucacaucauacucaaguucgaauuacacauuuaauucuaaaaguuuaaaagcugcccuacugccuugugcuuucuucuuuaaacuucuccacuuuucugaaacuuucuacagagcuuuuauuauguuuauaauugaaaaaaaagacaaagaaaaaucuagaaaccaaauacuuugucaaaucugccauauauaacauuauauuaaaaauacauauuucuggccaggugcaguggcuuaugccuguaaucccagcacuucaggaggcugaggugagagaaucgcuugaggccagaaguucaagaucagccaggggagcauagugacacccuaucuguacaaaaaaaaauuuuuuuauuagaacuuccauuucugauaauuuucucagaacugucagcuuucugaaauacgguuugaaucuaaccacuucuaaaauaaaacaauagcucuccaugccuaguaugaauaaauuccuccggcuagcaugcaaguccuuucauagaauggacccaacaugacucuaguucuacuuaccacuauauguaccuuaaaaucugguucaacuagauuaccugauaccuuuuacaguacuccuuuacaugguuaagaacaugaaguuaaucugacaaauguucacuaaauauguguuaaauaaauacacagaaaaaaauaaacaucaaagcccaagcaggccacgugcaguggcucacgccuauaaucccagcacacuuugggaggccgaggcagguggaucacuugagcucaggaguuuugagacaaaccuggccaacauggugaaaccugucucuacaaaaaauuguagagcacuccagccugggcaacagagugagacucugucucaaaaacaaacaaacaaucaaucaaacaaaaaaugacccaagcaagccuuuucaauaaaaagaaagucauauauuucugcacacuagcuuuuauuaacaucccuucacugaaagguauuuucauuuggcuuccaugaguauuuuuucuccuuucuaaaagcucuuuaucuggcucaucuuccugacacucaguaaaaacagauauucaucaggauuauguuccuggcucucuucuuuuaaaauauucuuaaaacuccuuugcaaucucacacccuugguuuuaauuauccaguaucaccuccagaaaaauaacugucuguauuccaguucauuuuuuuuuuucauggaguuucacucguugcccaggcuggagugcaauggcacgaucucggcucacugcaaccuccgacucccagguuuaagccauucuccugccucagcuucccagguagcugggauuacaggcaccugccacaauggccggcuaauuuuuuguauuuuuaguagagacaggguuucaccauguuggcuaggcuggucucgaacuccugaccucaggugauccacccgccucagccuccccaaguguugagauuacaggcgugagccacugcgcccagccccaguucuuaauuuuuagcugucuacugguccuuucuaauuugaugucacacuguuaugcccaacucaagauguuuaaauccaaaacuugcuuuuucuuucuacuauuuuccccgcccucauuauugccagcauuuuaucaccuaaauuugaaauucagaucaucucauuuguauuguuuuuacacagaaaacuaguuuuacacagaaaucuuacuauuuaguuugcauuuuucccaaugauacugauuauuuucaaaaacacgauuuuacuugucuauaaaauauaccauugcaugguuacacuguaauuuauucagcuauaacuguauuguugaauauuuuuaaacaucugcuuguuuucucuuuggaauauacuccucaaagugaaauuacaaguuuaaaggauauagauauuuuuaaacuacuacaaaauuguccuucaaaaagguuaaaccaacuuacauaucuaccuacagaaucagaaccugucuguuucacugggccuuugcaaacaacacuuaacauuuaaguaaaacuuuauauaaagcauacuuggcgcacacauaaaaggcaacuguuucauaaccugaagauagucuuuuaagcugaggauccagacuuucaggaaguauaucuggcucuuaggaaagaagaagccuaaauaaucugggcuccaugucccuacaccaguagaagagcucuauuucucuguuauuuacacagagguucugccuuggacuuugauugaaaaaugaguuaucuugccuuaaaacuacaucaaaaucagaguucuaaaucauugauuugauguauauaauacuauuguuuaagaagguagaaaaauauuuggcauauauuuuugaauauacugacuauacuuuagaaagcauuccaacaaaaaugguuuuuaaaauguagcuuuuaaaggcaaauacuuaguuguccaaaaugacucuauccccgagaguuuaaaaaagcccauauuugacuauacaaaucuccauuuuauuauaguaacacaaauguaauuucuauuuaacaaauaaccuuugcacagaaaacagugcugccaacuggcauacauuuuuaagcuacugaacaucaaagaaugaguaagucaccuuuuucuacguucaauuuagauauaguuccacuuggaaguaagggaauucaugaagccugaccaaaaaaaguccauucauaaagaagauaaccguauuucauauggaucaaacugucaggcaaaaucugaguagcaagucacaaaaaaccuucuugcaggcauuuuuacuuuguuuuugcacaaaucaccuuugaacgguaauuuaaaaacuaauuugguugacauaaaugucauuuuuaugguauacaaugaaaaacacagaaauacaccauguuccacacauagcugaaauacuuaaaugaaaauccaagaguucuuuuagagaaccacagaaaaaaaggaaauuaucauuguuauuauuuuaccugugggcugcagaagugaagcaggugggcgaggcuguaagccccacaaauuuucuauacugcuccgguccuuaagguccaacaaauguauuaaaauuaauggaucaaugucuaguaaacuacugguagcagcggagcauaaauguguucuucuugauauucuacuacuggaacccacauaaccauggcuacuaccugcaaaagaggcguagaaaaugauauauauaugcacaaacuuagcuauacuuaaaugaaaaaaugaacugguuaacauuauaugaauacuugucuauggaccuaucucuuaggaguucagguucaugauaagaagcagaaagaaggaaccagggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaagaaagaaggaaccagacaguuguacauuagcacagugauugagugguggccucauuaguacuuagaauucagaagcaagccucaaccccauccugagcccuagaaaaaaacagaugacaauguguacgaugugcacaauuggggggaugagagguaaggguaaggagaaggagauuauaucccaugaccaccugguuuuagauaaaagaagacaaauucccauaguauaacagauuacaaagaauuagacaccaaaauagaaaucucccccaagucucuggacaguaaaauguauaggucaugacaguuugguagacuuuuucuacuuugauuaaauaaugggguacaauuugaaguuuuuggacugucauguuaaugacugaugcacauuacagacaucuguaggcagauauuaugccuauaccccuauauuggacuaugcucuuuaagccaagaaaagcaucugacuuuucucuagcaccuaguauaaugcauaacaaauaccagauauggaaauguugcuuaaaacugaccuucuucaauaaagcuguuuaaauauauuuuaaagagauagaacauuuuaaaacaaugcuacacgcaggaaaguagauaauauaaaauauuaaaaagucagguuccaacuacccaugaguauuucagagagauccagcaggauauaacuuaggaggaaaguuccauuguucagaagcuucaagccaauuaauaauuuaugcuuuucacauccucauguucucacugucucccacuucugccuccucuucuaaggauuauuaucucacugacaguuuuucuucccagccucuguauuacugcaauuccuauuaaauaacagaaaacgauuuccccuucacauugaaaacuguucuuuguuguguuuugagacacagucucacuguugcccaggcuggagugcagcggcccgaucuccacucacggcaaccuccgccuccuggguucaagcgauucuccugccucagccucccguaguggggacuacaggcaugcaccaccacaccuguauuuucaguagauacgggguuucaccguguuaggauggucuggaucuccuaaccuagugauccgcccgccucagccucccaaagugcugggauuacaggugugagccaccgcacccagcugaaaacuguuuuuaccucuuuucuuuuacuaaggaauucccaaauuggguuguaugucagucagcugaaggaguuuuuaaaauuacauccuagauacacugaacaagaauacuggggugagaagcugggugcaguggcucacgccuguuaucccagcacuuugggaggccaaggugugcagaucaccugaggucaagaguuagagaccagccuugccaacauggugaaaccaaaauacaaaagaauagccaggugugguggcaggcaccuguaaucccagcuacucgggaggcugaggcaggagaauugcuugaaccugggaggcagagguuacagugagccaagaucacaccacugcacucuagucugguugacagagugagacuccaucucaaaaaaaaaaaaaggauacggaggugagauccaggacuuuuucccaaaaagcuacucagaucguucuuauguauaguuaaguccaguagcccagugaauggaaucuauugcccuaauaucugauucuccuuuaaaaauguaaguugcucauucuuccauguuaaaggcacuuacaguagagaaagcggugucuccuguuucucacugcuuuuucaggccauuauucucacuacugaacaaaaacugcuuuuuuuuuuaauguggguaugaccuuuggcuacuccccuuucaaauguucccagcuuucuuuucuuuuuuguuuuuuugagacggagucuugccucccagguucaagcaauucuccugccucagccucccuaguagcugggauuacaggcaugcagcaccaugccuggcuaauuuuguauuuuuaguagagacgggguuucuccauguugguuaggcuggccuuagaacucccgaccucaggugauuggcccgccucagccuccgaaagugcugggauuacaggcaggagccauggugcccggccuauguucccaccuuucuacccacuaucacauuuccccacaggcaucaaagacuuuggguuggcacugauuucaguuucucucuuuccaagcuauucugugugucucauauauaaauguacaucccaaugaaugcucacaaagugaucacacccagaugaagaaauauauuaucaguaccccagaacccccuccuaugccuccuaaaauugcucacuacuccuacucuacaaaaauaaccuucauccuaacuuaaauuacagauggguuuugccuguuuuguauuuguauaaaaguaguaacagaguaugcucuuaugcucuucuucuuuggucaacauuauucaugagauucaucuauauggcuguauauagaaguaucuuauucauuuucuuuuuaaauauuuuucuuuuuuucuuugagacaaagucuugcuuugucacccaggcuggaguacaguggcacaaucuuggcucaccgcaacuuccaccucccaguuucaaaugauucuugugccucagccucccgaguagcugggguuacaagcgugcgccauugcaccaagcuaauuuuuucuacuuucaguagaaaugagguuucgccauguuggccaggcuggucuugaacuccuggccucaagugauccacaugccucagccucccaaagugcugggauuagagacaugagccacugccucauuuucauuauuauugugcagcauccauuuaugaauauauccaauuuauuucuuuauucuauuggaaaacaauuuggguugcuucuagcuuuuggcuauuaagaauaaagcuauacagccaggcgcggugguucacgccuguaaucccagcacuuucagaggccgaggcagguggauuacgaggucaggaguucaagaccagccuggccacaauggugaaaccgucucuacuaaaaauacaaaaauuagcuggccgugguggagggcaccuguaaucccagcuacucgggaggcugaggcagaauugcuugaacccaggaggcagagguugcagugagcugagaucgugccacugcauuccagcuugggcaacagagcgagauucaaaaaaacaaaaaaacaaaaaaccaaaaaaacaaaaaaacaacaaaaaccaugcuucugaaguucacauagaaaaaaaaccucauaaaaagacagacggaucggugacagguucuucuccauuugugccaagccauauggaucuugcuaaaaugucacacuuauauacuugaguucauuacagcauacugccuguaugcauuaucaugacacucaaggcccuauuauagucuagucucaaacuaccuuuccagaauauucuacauuuucacauccuucacuuuguuacaaauuacauaccgauauuuaccaucacaaaaucuuguaaugaucagugcuggauuuucauuuaaaaauuaugcucauucauucuucuaacaucugugguccaggugcaauagcucacgccuauaaucccaacacuuugggaggcugaggcaggaggacuaauugaggccaggaguuggagaccagccagggcaagagagcaagacuccgucucuauaaaaaauuaguugggcgugguagcaucugcagacgucuucuuaugagaacugcuuuuaguuuauucaguuauuugaaguuaaaugaaagacaauuuauguuaaaaaaaauuugugcuaaaaagguuuuaaguaucauucuaauccagauuauuggcucauugaauccagugaguaggaaaaaucuaguuuguauuugcugggggugugugugugugugugugugugugugugugugugugcacgcguguguuuuaagagacagggucuugcucugucacccaggcuggaguacgguggcagaaucauggcucacuguacccucgaacuccuaggcucaagugauccuacggccacagucucccaaguagccaggacuacagccaguugagucaauaaauauuucuuguuucaagcuaucuccuuauuuaauauggucuauaaaauaagauuauuaaguaaacauuuaacuuuauaccuagcuuuuauauaagcccaaucauccccuuuuuaacgcauaacuuaacaucguaauucuuuagaucacauaacucuuuagacaauuguguaguucuaaaacauuaaccaggccaggugugguagcucacaucuguaaucccagcacuuugggaggcugaggcggguggaucacuugaggucaggaguuugagagcagccuggccagcauggugaaaccccaucucuacuaaaaauacaaaaaaguuagcuuggaaugguggugcaugccuguagucccaacuaccugggaggcugagguaagagaauggcuugaacccgggaggcagagguugcagugagccgagaucgugccauugcacuccagccugggcaauacagcaaggcuccaucucaaaaaacaaaacaaaacaaaacaaaaacaaaaaacacauaaaccauucgaggcuugaaauggaccuucauaauaagcauauuaaaaaaaagcauuuccacacucugcccagugucaccccgaucuagcuuuuucauugccuugguuuaaaaagcuuuuuauuggccaggugcaguggaucacaccuguaaucccaguacuuugggaggccaaggagggcagaucacaagaucaggagaucgagaccauccuggcuaacacggugaaaccccaucucuacuaaaaauacaaaaaaucagccgggcgugguggcgggcgccuguagucccagcuauucgggaggcugaagcaggagaauggggugaaccugggaggcggagcuugcagugagccaagaucaugccacugcacuccagcccgggcaacagagcaagacucugucucaaaaaaaaaaaaaaaaaaaaaaaaaaaaaaaaggcuuuuuuaauuuuuuuauuuuaguauaguuuuagguuuacaggaaagguaaaaauacagagaguuccuguacaacccagauccaauuuccccaauguuaauaccuuucauuacuaugguauauuugucacaacuaaugaaccaauacugauauauuauuaacuaaauccuauacuuuauugagauuuuaguaguuuuccccuaauguucuuuuucuguuccagagucucaccuagaguacugaaauacauuuaguugcuccugucuuuuuagacucuucuggucuaugacagucucucagacuuuccuuaugucugaaaguaugucaaauauuuuguagaauguuccucaauuaaggguaugauuuuuucccucaugauuagauuguguuuguggguuuuuagggggaagauacuacagauauaaaguaccauugucaacauaucaacaugacuuaucacuuacaauacugucaacaugcuaucaacaugaccuaucacuuacaauacuaaauuuaaucaccuggguagguaauguuugccaaguuucucuacuucaaaguuguuucccccuuuugaaacuguacuauucagaagcaaguaacuaagcacagccuacauuuaagggguagaaguuauauuucaucuccuugagaagggaguauuuaaaugauuuggaauucuuuuguauguacauugucauauucuagcuaauuguucauaaauauacucacccuuagguuauaaauuacuuaguguuguauguuccagguaggcaugauauuuaacaaauuucugccaaauacauaaauuucccaaagcauauaauaaaaauaaacugguucauuauuaugucuucaacaucuagaauacagugccuggauuauuacagaauauucagaauuauaacauaggcuccauaagaacagggauaucuuguuauucaauauuguaucucuagauaguaaaacuguacacagcucaagugcucaguaaauauuugaugaauauauaauucaaaaauguaaacucuucuuuacccuaaguguauauaaauguuauauacaagaaucucucuaccacacaguuuaagagaggaaagaauggaccuaacuaaaagaaaacacacaaggcugaaaaguuagucagucaguaagaccuaaugccauaccagacaaggauuaagucacacgcucccuauacuuaaagaauaaacuacauucuaacugcaacagaauuucuucuuuuuucuagaagcuaagcaagcacuggccucaagauaagcaauauugaaacaauugcagcuuacugacugccagaugcugacugacucacucccuguuccacagccguaacuacagcuuugacuggacaagagacugauuucaguaacuuucuccugauaggagucgccaaccauggacugguucuggcccguauacagaggcugagcauugagugccuucguguccuuggcuuuaccuuuugacaacagggccuaauuguaaugcauuuaaauuguucaguccccacuccaaaguaaacaugaaaugcauguaacaugcauguuugucuacuaugcaugcguguguuucccuuuucaugauguucacagcuccuccuauagccugcugaaucgauuuaguuguacuuggccaacuuauucagcaucaauuccuauguuacccuucccuccugcaaagugccugcuuuuagucuuugccagaggccacacuucccagccugucaggauggccagucuuuuuuuuuuuuuugagauggagucucgcucugucacccagguuggagugcgguggcgcaaucucagcucacugcaagcuccgccucccagguucacgacauucuccugccucagccucccgaguagcugggacuacaggcgccugccaucacaccuggcuaauuuuuguauuuuuaguagagaggggguuccaucauguuagccaggauggucucaaucugcugacaucgugauccacccaccucggccucccaacgugcugggauuacaggugugagccaccacacccggcccaggauggccagucuuuauaagaauuaaagcucuucucuccaaauugguagaucuugugauucuuugaaguuccuccugacuaaagaaugauacagaggaaugacagaaauaaggcuaaggaaacaaacaggaauccagacacaaaggaauuuaugugccauguuaacaaguuuggacuuuauccuauaauaaauauaauccuuaaagaguuuuuaaguagagaaauaacaugauuagauauuauuuuucauuauuuuuauuucuauuuuugacacagggucucacucuguugcccaggcuggaguacaguggugcuaucucagcuuacugcaggcuccgcuuccugggcucaggugauccucccaccucagcuucccaaauagcugggaccacaggcagcaauuuagccaccacaucuggcuaauuuuuuuguauuuuuuuguagagacaagguuucaccacguugcccaggcuggucucaaacuccuggacucaagcgaugcacccacaucagccucccaaagugcugagauuacaggcgugagucaccaagacugguagagaaguaacaugauuagauauuaaucagaaagaaaaaaacacccucauucugaauccaugcuguaaaaauacaauggaggggaacaauaauaaauacaaggaacccaggugaaagacagaggccuagacuagaaauggcaaaggagugggaguaccaaaugaauuuaugcacgauuuaggacacagaaccaacagaucuugguaauacacuaaagguaaaguuuuagggagaggaagaaguaaagaauguauagcauuaucagucacgguggcuacugcugacaggcaggcuggcagaugaaaagacaguaauuuguguuugggaagugcugaaucacacaccaagacauggguuuggaaacuauggaaagacaaaggcuaaagaaagaacuugaaaaguaaucagcauauagacaguaacugaaauacagguguggauaagauuacccaggauuaaagucaggaguagaaagaauauagagcuuagguuggaguugaaauggugaggacuaguauuuaagaaaucuuuaguuaucccagcauauuaagaauaugccaggccgggcgcgguggcucacgccuguaaucccagcacuuugggaggccgaggcggguggaucaugaggucaggagaucaagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccgaccugggcgacagagcgagacuccgucucaaaaaaaaaaaaagaauaugccaguguucauacugaggagaacauggguaaaacagaaacaguagaaagcuaacuuuuaauuacucuaaccaagauucacuacuuaauuaaauagauccgagaacacacaaaaaaguacucauuauauaagucaguucuucccaggagaagcaguguuuuaguuugggagaaaaaugcuggguccacaaacccaggacaaucugggguucuagucugguuguacuaacaaccagcuauaugaccagguaacugaaaacuauaaaaugagcucuuuaagauccuucguaagucuaagagucaaugauuccacugagaucauucuauagucuagcaagauauacaaauaagacuuuauaucagaaagaauaguauaaaauaugagcaugggauacaaacaaaucuggggauucaauuacucucauuuacuaaauuguuaaaaguuggcaaguugcuuuaauuucucuaugcaucagugaauguaucacacagaauuuuauuaauauaagguacuuaaagugcuucucacagugccugguacauaaaacauuuuucaaauguuagcuauuguuuuaaauaucuuuaguaauaaacucuaaaaaauccauauuauaagauauaccacuuccaacaccaugaaccauguacaagcaguggcuaccaccuauuuaaaauauaauacagucagagaagagcagagagaaaacagaauggcuuggaggcaguggagugaccucauuaccugcggguccugcagcagcugcaucuuccaugaguucucccucuucuaauuccauguuguuauauuccacaucauuuucuccagaccuaagaauauacaaaauccaucauuuauauagagugauacaauaaacguuguuuuucacaccucaauaaauuuuaugauaugcagauuuuucugugaaauaagauauuucuaaauacaaaaaggagaaagauuuuugucauuuuccaaauuuaaguagcguuaauguuauuguuuaaacaaccuuuaaaaaauaucggccgggcgcgguggcucaugccuguaaucccagcacuuugggaggcugaggcaggcggaucacgaggucaggagaucgagaccauccuggcuaacacggugaaacccugucucuacuaaaaauacaaaaaauuagcugggugugguggcaggcaccuguagucccagcuacucaggaggcugaaucaggagaauggcgugaacccaggaggcaagcuugcagugagccaagauugcacaacugcacuccagccugggcgacagagcgagacuccaucucaaaaaaaaaaaaaaaaucagccaguucuucuuagaaagcuaagaaaaaaaggaauuuaaaaaaaaaaaaaaaaaaauauauauauauauauauauauauaucucaaggccgggcgcagugacucacgccugaaaucccagaacuuugggaggcuaaggugggaggaucaccugaggucaggauuucgagaccagccuggccaacauggcaaaacccugucucuccuaaaaauacaaaaauuagcugggcguugugguggggaccuguaaucccagcuccucgggaggcugaggcagcagaaucgguugaacccgggagguggagguuguagugagccaagauugcacuacugcacuucagccuggacgacagagcgagacucugucucaaggaggacaggacaggacaggaaaggaaaggaaaggaagauuaaaaaaaaagaacugugucaggcaaaaaaauagaaauaaaugaaacacuaaaaaaucuaagaaccacuauuagaagagauuaaucucuccuauuuaauuaguguuagaaacacuaauaaauacaagaaccacuguuagaagaaauuacagcuucagagaacugguagcuuaauggcaauaagcuuaaaacacuacauguaguguuaggcuuaaaacacuacauuuuaacauccaaaaaaagcccaaauuacuguauaugacuaaauaccauuuuucaaaaauaauauuucagcaaagaggguauuacuuccuacucggccauacaaagucucucauguuaaaaaacaaucacuauuacuuuauuuuaaacaacauacuacuugaaacaguaccagucaaugacagucuuggguauuuaaggaaaucucaagauaagcacccagcuugacaauguaaggagcucuguaggucugcucuuuagucaaacuggugacaauuauuuuaaaaacaaccacuuaacgacucuggaaauggucccaagggcauacagcaaaugaagaaacaucuacucaaaaaaaucuauaaaaacuggguaagacaagugggcaucugcaguauuugaaccaagaucacuccacuuccuaacuugguguuacagaaauuccacuccagacuggugcagugaagaacacaggccucccacuucccgaacuuccaagaggagggcuauauuccugggaguggcaagguaucagcaucucucauucugcccccagcuaccuauugcugaugcuauaguacaggcacacacggccaagagguggagacucccuucugcugagacccacuuguggacuagaugcucuaccuggaugcagcaugaugagaauacuggggcccagaucaucccugccccagcuuauucauaagguggaggucccaagccugaaaaggaaagaacuaaggcuacuguccccaacauccaguuagcucagcuucuaaaguaagagagguacaccuuuauccuuacuccaacuucaaagcuuuggcucagagauuuugccuauggggagaagcagagacacauacaacacucagagaaacauacaacacuauuaagagcaucaacgaaauauaguuggccuucuuuaucugugggcucugcaucugugcauucaaccaacuguggaucaaaaauauuuuuuaagcccugguguggugguucaugccuguaaucccagcacuuugggaagccgaggcuggagggacuucuugagccuaggagcuccgggccagccuagaacauaguaaggcaacauagugagacccugucucuacaaaauauuaaaaaauuagccagguguguuggcaugcaccuguaguccuagcuacuuggaaaacugaggugggaggaucacuugagcccaggaggucgagguugcagugagcugugaucacgcgaccacugcacuccagcuugggugacagggcaagaccccgucucaaaaaauaaagccggccgggugcuguggcucaccugaggccaggaguucaaaaccagccuggucaacauugcaaaacccugucucuacuaaaacuacaaaaaauuagucgggcguaguggcaggcguguauaaucccagcuacucaggaggcugaggcaggggaacugcuugaacccaggagacggaggcugcagugagcugagauugugccacugcacuccagccugggcgacaagagcgaaacuccgucucaaaaaaaaauaaauaaaacaaaacaaaauaaagucaugcgcagacauuuuccccuugucauuauucuguauacaauagaguauaacaacuacuuacauagcauuugcauuguauuagguauuauaaguaaucuagagaugauuuaaaaguauaggggaggaugugcauagguuauaugcaacuacucugccauuuuauauaagauacuugagcauccucagauuuuaguauccaagggcgggguccuagaaccaauaccgcaaggauacugagggacaacuguacuagcaaacagaaugcaguaacauauaaaaagaaucaugagccgagugugaugaugcacaccaguaguccuagcuacuauggaggcugaggcagguggaucacuugaggccagaguugaagguuacagggagcuauaaucaugccaccauacuccagccuggccacaaagccagauucucuuaggaaaaaaaaaaaauugcugggugccguggcucaugccuguaaucccagcacuuugggaggccgaggcaggcagaucacaaggucaggagauugagaucauccuggcuaacacggugaaaccccaucucuauuaaaaauacaaaacaaaauuagccgggcaagguggugggcaccuguagucccagcuacuugggagacugaggcaggagaauggugugaauccagaaggcggagcuugcagugagcggauauugcgccacugcacuccagccugggggacagagcgagacuccguuucaaauaaaaaaaaaagaaaaaaaaaauuacggcugggcgaaguggaucacaccuguaauuccagcacuuugggaggccaagacggguggaucacgaggucagguguuugagaccagccuggccaacgcagugaaaccucgucucuacuaaaaauacaaaaaauuagcugggugugguggugggugccuguaaucccagcuacuugggaggcugaggcaggagaaucgccugaacccgggaggcggagguugcagugagccgagaucaugccacugcacuuaagcccgggugacagugcgaaacuccgucacaaaaaaaaaaaaaagaaaaaagaaaaaaaauuacacacuaugaccaagugggaugugucccaggaaugcaagcuugguuuaaaaauccaaaaaucgccaggcacaguggcucacaccuguaauccuagcacuuugggaggcugaagugggcagaucaccugaagucaggaguucaagaccagccuggccaacauggugaaaccccgucuccacuaaaaauacaaaaaaauagccaggcgugguggugcacgccuguaauccuugcuacucgggaggcugagguggaaggaucacuugaacccaggagauggagguugcagugagccaagaucgugacacugcaugccagccugggugacagagcaagacuccaucucaaaaaaaaaaaauuauccacauuaaugaaauucauuaguucaucaauuaacagggcagaaggaaaagcucuuccuuaaauugcaacuaaugaaugaguaagaaauaauggaauuagaaaaacaccacuuggcaaucaacacaguaaccuuuuucaggcaacacucaucaaagggugucaaaauucauaggaaaaaguaggaugaaaaauaggauauuuacagucccauacauaagauacuuauuaauuauaaaggaaaaaguacaaauuuuggagugaagaaaccuggcggaugcuaccucaacuaagugaucaaaauuaaccacaaguaaugggacauacugacaucaugcuccacucuguaugacgcagugaaaaggauacauuaucauuuccguaguaucccugccaaaaguguguaaccucuaucuaaucaugaggaaacuucagacuaauccaaacugagggacuuucuacaaaauaaacuauucuguauuucucagaaaguauuagucaugaaaaacaguuuuuuuuuuuuuuugagacagagucucaacugucgcccaggcuggagugccguggcgugaucuuagcucacugcaagcuccgccucccggguucaccccauucuccugccucagccuaccaaguagcugggacuacaggcgccugccaccacaccuggcuaauuucuuuuuuguauuuuuaguagagacgggguuucaccguguuagccaggauggucuggaucuccugaccucgugauccacccgccucagccucccagagugcugggauuacaggcgugagccaccgugcccagccgaaaaacaaauuuuuaaaaaaguaacccagauuggccaggugcgguggcucacgccuguaaucccaacacuuugggaggccgagguggacggaucaugaggucaggagaucaagaccaaccuggcuaacacggugaaaccccgucucuacuaaaaauacaaaaaauuagcugggcgagguggcgggcgccuguaguucuagcugcucgggaggcugaggcaggagaauggcguaauccggaagguggagcuugcagugagcugagaucaugccacugcacuccagccugggcgacagagcgagacuccgucucaaaaaaaaaggaaaaaaaaaaaaguaacccagauugaagauaacuaaaucgauuuaacaauuaaaugcaacaugauccugacaaaggacauuacuggcaaauuuuuagaagguuacaguauuacaucaauguuaauuuccagauuuugauaacuauucuauaguuauguaagaauauccuuguuuuuagaaaaguacacaaugagaaguauauucgaucucaaguguuucagaaaaaauuauauacagagaaauauaaagcaaaauauucauagggaaugaaucugugugaaggaaacaugaaauucugaacuuuucuuaaguauaaaauaauuucaaaauucaaauuuaaaaguuaaaacacaaacaaaaauuauuggcuaagagcccagagauuagagagagaaaacugacuauugauucaaucuuucaaaaaagugcugaauaucccuacauuuaagugugaguuaguuaauaugcuucuaauaauuaccacuuaaaugcuuuacaguaguaaagugggaaacucacauaguuucuucaucaauaucauuuucuucuguauuacuuguugcuguggaacuagcagaggaacugcugccaucgagcugauuuacuucauccucauaaacaagauccagauccagaucuccaucugaaagcucgugcuagaucaaugccaagaaaacaagacgucuauuccaaauguuucuacucaguugaucaccccauccagcccauaaaccaagcaccaaagaauaauacaguuuucaaaaaucuauuuucugcuccugugccucagcugcugagcccuguagagaaaaaucacacaaccacacugacugauaucauuuuacuaacuuaugcgugccgccuucagcugggcccucagugugacuggaauccuucacauauuccacaucagcuuccucacagaguaacguuucaaaccaucacuccucaauucuaccuaauuuuaccauuaucaaggucauuaauuaacacugucaccuaucugcacagaaaaaaaauacccacuauuaagcaaaaacuuccccaacuuuucagcugccuuaccugcaaacuccacccuuccuuuaacucaguuuaucaaagguuaacugcuucaccugacugcuccauuccaaacccuauuaucucuaguuuaucaaagcacuuaaucugugcauucucucgacccacuggguccuucauuuuaacuuaaaacugaagucucucaucuuaaaaauuacuacaaaaaaaccaacugucuaugcaucccuucuuauguaaaaauaucaacuacuucuugaacucuuauucuggauucugacuguuguuuagcugggauagaaccuggcuagcuaccgaauccuaaaucagucuaccuacguaaguaaugauaaggcauguacuaguuucagugaaugaaaauagaacaccuuuuuuuuuucuuuuucuuugagacagagucuugcucugucucccaggcuggagugcaguggcacaaucuuggcucacugcaaccuccgccuccuagguucaagugauucuccuaccucagccucccaaguagcugggauuacaggcaagcaccaccacacccagcuaauuuuuguauuuuucguagagacaggguuuggccauguuggccaggauagucucgaacuccugaccucaugugauccacccaccuuggccucccaaagugcugggauuacaggugugagccaccgcacccggccagaacacauuuuuaaaauccacaauguaugguaguuuagguuuuaaaauguguaucacgguuuguuuuauacaauguauuguuuuuuucacaaccuugaaaugcuuugauucaacaacuucugacuuauuaacauuuacauaagggcauacauacauuacuaauggaaaucaauggacaauauuuuuagccuacuguuuuagcacauaauauguuaaaagccaugaugcuacuguuuuuuuuuaaucaaacacaaaaaucuaaaacuggccucauuauuacaugauaaucuucauucugaaucuucuccucaucuucuucauccucuuuggccucucuuacagaagcuguaguaggaccaccuucgagaagcaugucagagcaugcagacuucuuagcucgugucuccagagcaucaucauuuugggggcuaagaugguuaucugguggugacaaaucucuugacuucugaguucgagacagcucaauaguaagucucuuuuaaaacaagaaaagcacaaauauuagccacagcucacuggcacaguaaaagaugucucaagugaaaaaaaaaugcauccagauguuucuaaaaccauugcuuuauuuauuuuuugagaauggucucacucuguugcccaggcugaagugcaguggugccaucauagcucacugcaagccuugaacuacugggcucaaacgauccuacugccucagccucucaaguggcugggacuggaggugugugccaccaugcuuggcuaauuucauuuuuauuuauuuuuagagacgguaucuugcuauguugcucaagcugguuuugaaccccugggcucaaauguuccucuggccucggccucccaacaugcugggauuacaggaaugagccaccucacuuggcaccauuucuuaaaccauuucucugaaucccuacugccuuuuauuuauaaaaaaaaauugaugacaaagauaaacugccccauuuaugcucauccuccuucuuucauauccagccuaagcuaaacauacaauuagcaaacaguauagugaauacaggcaguuuuaaauagcacauuuaacaugaaaaucucugaaagcauguauuuauucacauuuuccucccugaccuauuaacgacucucagcacuccaaaccuccugccacacccuaacuuccuaagggaaaugaaacauuccuuaguuuaccacuguaaaauaaaaauucaucaauuaaucuuccccagugcucauucaacaauaguaagaguucaagaugggacaacuuuuaauugugcuauagccuagaauccucuaaauccaagauaacuuguggaagagaaacuaagucacugacagaaacacaaacagcuuaccucaaacuacagccacacuguucaaaacaacuuuaugcaaugauggaaaugcucuagauuugcaguaaccaaugcaagcacuugaaauguggcuacugcaacuaaggaacuaaauuuuuaauuuuaauuaagcuaaauuuacagaccaggcacaguggcucacaccuguaaucccagcacuuugggaggccaaggcaggcagacugcuugagcccaggaguucaagaccagcuugggcaacauggagaaacccaucuccacaaaaacaaaaacuagccaugacacaugcucguagucccagcuaccugggaggcuaaggugggaagaucacccgagcuugggaaguugaagcugcaguuaguggaaauugugccuggcaacaagagugaguccgaccugucuccaaaauaaaaaaaaauaaaaauaaaguggcagggcgugguggcucaugccuguaaucccagcacuuugggaggccgaggugggcagaucacgaggucaggacaucgagaccauccuggcuaacacugugaaacccugucucuacuaaaaauacaaaaaaauuagcccggugugguggcaggcgccuguagucccagcuacucaggaggcugaggcaggagaauggcgugaacccaggaggcggagcuugcagugagccgagauugcaccacugcacuccagccugggcaacagagcgagacuccuucucaaaaaaaauaaauaaauaaaguaaaauaaaaauuuacauggccguauguggcuagugucuacuaaacuggacacugcagaacugguaaggauggggaacaagauaacuagauuuuuuuucuaauuacaaauuacaaaauuacaaauagcaauaaaauauauaaaaucuaauuacaaauauaacaagccaaaaggacaauaggaaacaccaaaacagaaauagauauuuucuuaccucuuuaagguuguuuauuuguuggauauaacuagucugugcagcuuccaacugaguaauguaccaaugcuggucccgggauuuuugaaagaaaguuggugaacguaccugaaaccuuaaaagaauugugccacauuaaaaaaaaaauucaaauaguaaaacauuaucagucuagcacugaauucugcaauuuggguuaacuugauuauaaggccaaaauucacauaaacuuagagcugcuaguauuuguuguuuauagauguaguccacagauuaugacacaagguucugaaaagccaguuguccucaaacuaccuuucuaaagaaauaacauuguacauuguaguuaagcuucccaaacuaaccuacucaggcauauuuauuauaauaauguaacuaaaauacaaugaugaucaugaguugggaagaagagagccauauacuaugcaguuuccuccuauaaggaggaagauaacucuuaucccuuucuucccuaaaugaggccccagcaaaauacaaaguuuuuuuuuuuuuugagacggagucucgcucugucgcccaggcuggagugcaguggcgggaucucggcucacugcaagcuccaccucccggguucacgccauucuccugccucagccucccaaguagcugggacuacaggcgcccgccacuacgcccggcuaauuuuuuguagcaaaauacaaaguuuuaagugcugcucuuuauauuucucuauuccaucucacguucccguauuuccugccccucagaaaaaaaaucacuuccuggcucaaccacccaggauugcuuuacuaucccccaaggaguuacaugcucuaaauaaacuauauccugaacccuucaagauagcaaucaaaacugcccuuauuacaauauggcauuauuucagcuuagguuaggaaaaaaaguacugcaccuacauaaaaucguauuaauauauaaaugacagaaucuuaaucuauccagaguuguuuuaauuaaaaaaaaaaaaaaaacuauuacuaaagcaaacaaaccucuaccuuuguuacauagccuaacgugacuauauuuaaggugaaaaaauugcagugcaugugugaagguguuuuugaagaaaggaaaaaccacaaggcaagacuaauuuggacaucuacaucucucucauuccuuccagcccuuuuacccggcuacacaauguuagcuguucauuuuuuucuaggauuuuacaccuuauuguaagaaccuacugaccauuuaacaguuaucuggcaguagauaucuaguuuuagugaagaauacuaaugcaagaaaggacagaacauaaacacugacuauaaaacaacaguccuauuuaauguugggauagucuuuauaggucagaaguuuuugggcaucauuauauguuauaacuggaugaucaaaaugagaacuugaguauuaaaaaaagagagagauuggccgggcacaguggcucacaccuguaaucuuagcacuuugggaggccgaggugggcagaucaccuaaggucaggaguucgagaccagcguggccaacauggugaaaccccgucucuacuaaaaguacaaaaauuagccggguaugguggcgggcgccuguaaucccagcuacucaggaggcugaggcaggagaaucgcuugaaucugggaggcaaagguggcagugagccgagaucgcaccacugcacuccagccugggcaacagagcgaaacucugucucaaaaaaucaaaucaaaucaaaucaaaucaaaucaaaucaaaucaaaucaagagauuaaauuacguucugaacggaacugaguagagaugauucacucaacugagcagagacgauucacagucuaggaaguacccacugguaagacauuaaaguaagaccgucuaaacacuauuauuuucuuugaaugauuuaaaccacugguuaacucugcacauuaguucuaauauuuugccauuaaaacaaaaccaagcagcagguaaaauuucuuaacuuucuguuuuaaugaaagaaugaaacauacauucauaguuauagaaaagccuuaaauaacuuucuaauaaauacauacaaaauuccaccagaaucuugaaauaaaagguuuaaaguuugagcaaugucucauuaauaggauaaugugaagcccccuauccacaaacuucauagcaauuuacuuacggugcuacuauagcauuauuuuauaauaagagaguaguaaauucuguuuuuaucugccaauuucaucuugaguucccuguggacaaaaaccaugucuauauuuuucuuauuagcaacucagugucaggcauaugguauagacucaauguugcuuaaaaaaaaugaugucauaacaggaauuuguuucuguacuaauaaguaacgcuaauaaggaugaaaucaaggcuauaagaaaaugggucuuuuauagguugguaaaauugauguuugaauaauuuuguaauucucucuauggcugaagcaugaaauagcaauaaauuauuucucuuggugaauaguuaaaccccaaaagucugaaaagcuauacgaagaaaacuaaaauaaucccuccccucaaaaaacaugauuccaggcaccguggcaugcaccuguaauccuaccuacuugggaaguugagacaggaggaucacuugagcccgagaauucuagacuagacugggcaauauagcaagacacugacucuaaacaaaacaaaacaauaacaaaaacauaucuuuuucccuacacugaaaaucauaucccuuguuaaacuucuuuauacuuccagaaaagcuacggaaaacacauaagaguaaaugcugauaugauagcaacucaucuguccaguaugcucaagaacaaagagcuccgaauaagggaaauucaggaguacauuaaaucacucucaagaaaaaaauguuuaaaauuguugugaugagaacuuuuuaaacuguuaaauacucugaaacuucucaguucagaacauauuuuaaucuuuuuuaaauauucaaguucuuauuuugaucaucaaauuauaacaucauguaaugauacccaaaaaccuuuuuuuguuuguuuuuuguuuuuuuaagauggaguuucacucuugucgcccaggcuggagugcacuggugaaaucucggcucacugcaacaucugccucccggacucaagcgauucaacugccucagcuucccaaguagcugggauuacaagugccugccaccaugcccagcuaauuuuuguauuuuuaguagagacaggguuucaccauguugcccaggcugaucuugaacuccugaccucaggugauccacccaccucagccucccaaagugcugggauuacaggcgugagccacggcacccagccaaugcccaaaaacuucugaccuguaaagacuaccccacguuaaacagggcuguuguuuuuauuuacuuuauuauuauuuuugagauagggucuugcuaugucgcccaggcuggggugcaguggcauaaucucgguucacugcaaccuccaccugccggauucaagcgauucuccugccuuggccuccugaguagcugggauuacaggcgcgugccaccacagcccggcuaauuuuuguauuuuuaguagagauaggauuucaccauauuggccaggcugcucucaaacuccugagcccaagugaucugccugccucagccucccaaagugcugggauuacaggcgugagccaccacaccuggcuaaauagggcuguuguuugagucaguauuuacguucuauccuuucuuguaaauacuacaccaacaaucaacaauaaaaauugaugguuuuggccagacgugguggcucaugccuauaaucccagcacuaugggaggccgaaguggguggaucaccugaggucgggaguuagaaaccagccugaucaacacggagaaaccccaucucuacuaaaaguacaaaauuagccaggcaugguggcgcgugccugcaaucccaucuacucgggaggcugaggcaggagaaucgcuugaaccugggaggcaaagguugcagggagccaagaucgcgccauugcgcuccagccugggcaacuagaaacucugucucaaaaaaaaaaaaaaaaaaaaaaaaaaauugaugguuuucgcaaauaccacauguucucacuuauuauuuaagagcuaaaugggccgggcgcaguggcucaggccuguaaucccagcacuuuggaggcugaggcaggaggcucaagaggucaggagaucgagaccauccuggcuaacacgguggaaccccaucucuacuaaaaauacaaaaacaaaauuagccagaugcaguggcaggcaccuguagucccagcuacuugggaggcugaggcaggagaauggugugaacccgggaggcagagcuugcagugagccgauaugucgccucugggcgacagagggagacuccaucucaaaaaaaaaaaaaaaaaaaaaaaagcuaaaugaugagaacucaaggauauaacgagggguaacaacaacagacacuggggccuacuugaggguggagggugggaggagggagaggauaagaaaaaauaacuauuggguacuaggcuuaguaucugggugaugaaauaauccguacaccaaaucaccaugaugugaguuuaccuguauaacaaaccuacacauguaccccugaaccuaaaauaaaaguuuaagaaaaaaguagaaaauugcugguuuucgucaacuuucaucuugacucuucuacuuuuaauuugcuguuauugacaaagaacugauaguugcuuuauaaaauuaaguuguaaaaccagucacucaaauauaauaugcacugugaagugaaaaaaaucagcacuuuaucccucacuauucuuagauuuccaaauggugaggucacuagaaguucaacagacaaauggaacauuacuauacuuacuggaaguuguaguuucccacccacccccuuuuuuuuuucuuuuuaaaaagauggggggucucauaauguuuccuaagcuggucucaaacuccugggcccaagccguccucccaucuuagccuccauaguagauggaaacaccggcgcaccacugcacccagcuuaucuuuaauggaauugcuaacuagaugucaaaaaaaguuugacuuuuugacuacaaauuuuugauuauuauccacuuaaauaaaacaguuaagaaagugauaaggggccgggcacgguggcucacgccuguaaucccagcacuuugggaggccgaggcgggcggaucacgaggucaggagaucgagaccauccuggcuaaaacagugaaaccccgucucuacuaaaaauaguaaaaaauuagccaggcgugguggcgggcgccuguagucccagcuacucgggaggcugaggcaggagaauggcgugaacccgggaggcggagcuuguagugagccgagaucgcgccagggcgacagagcgagacuaugucuccaaaaaaaaaaaaaaaaaaaaaaaaaaaaaaaggugauaagguuauaguuaguaugaauuucaauauucaucuuuguuaaccaaaugaucuuugaaauauaguucugaugauauuauuuccccacaauaaaaaccacaacaucaaauuuuuccuguuaccuuaaaaucacuguaucauuuuguggauucaaguauccuucauuugcgaguaaguccaaacggaaaaaucuauuauagccccagcauucuccaacuucaaagucagaugcaaauucucgaaugauauuuuuuguaggaucauuacaggacuggugaaccaucucuacacgauauucauaucuaaaauugaaaaacagaccauuacuauacaguuaguaaaguaagaauaaaaaacaaacucaucuaaacauuaaggucacuaaguaauuaccugagaagaaaccuuauugauauacgcaguuacauuucuuuuaucauuuauaaaaacagcaguauuuugggguuuuuuuauuuauuuaagauggaguuucacucuuguugcccaggcuggagugcaauggugcaauuucagcucacugcauccucugacuccagguucaagugauucuccugccucggccuacagaguagcugagauuacaggcguguaccaugcuuagcuaauuuuguauuuuuaguggagacggggguucauguuggccaggcuggucuugaacuccugaccucaggugauccacccaccuuggccucccagugugcugggauugcaggcgugagccaccacacccggccagaaaaagagcaguauuuuuuuguuugcuuuuuugagauagagucucacucuguagcccaggcuagagggcaguggcggggucucagcucacugcaaccucugccccccaguucaagugauucugcugccucagccucccaaguagcugagauuacaagugcacaccaccaugcccagcuaauuuuuuguauuuuuaguagagacaggguuucauaauguuggacaggcuaguaucaaacucuugaccucagaugauccacccuccuugaccucccaaagggcugggauuacgggugugagccacugcgcccagccaaaacagcaguauuuugaacgaaccaccaaaacaugaauggcaauagguccuuuuuuccucguaaagauguuuaccgauauaucagguauaaaacaacaccucaaaaaauaaauaaauuuugaauaaacaaguaauucaaaguugcuuuuguuuuacuaaugcaauauuuuuuccauauauucacuacauauguuuccucauaaauauuguuauuucuauuauccuuugagguuuaucaccuugcaauuuuaaaauauaaauuuugaaauacucuacuguauuuugccaguacaagugauaagaaagcaaauuauuguguauucagaaaaucaaaggcuauaaaauuuccuaauagaaaauaaguaugcagccauaaaaaagaacgagauuauguuuuuugugcaacauggauggauggagcuggaggcuauuauccucagcaaacuaacacaggaacagaaaaccaaauaccacguguucucacuuauauugugggagcuaaaugaugagaacuuaugaacacaaagaaggaaacaacagacacugggguaugcuugagggcagagggugggaaaaaggagaggagcagaaaagauaacuauuggguacugggcuuaauuccugggugaugaaauaaucuguacaaugaacccccaugacaugaguuuaccuauguaacaaaccuucauacguaacaccaaaccuaaaauaaaaguuaaaaagaaaagaaaaaggaaaaagaaaauaaguaagcuggacacaguggcuaacaccuguaaucccagcacuuuaagagaccgaggugggcagaucgccugagcccaggagucugagaccagccugggcaacauggcgaaaccccgucuccauaaaaacaaaaaacaaaaaaauuagcuggguacgguagugcauuccuguagucccagcuacuugggagacugaggcaggaggaucaccugggcccaggagguugaggcugcagugagccauaauugugccacugugcuccagccucagugacacagcaagacccugucucaaaaagaaaagaaguauacauugggaaagccaauauauucuaauuuauauauccaaucuuguaaaauuuucagguuuacaaaaagacaaagaagauagccuauaaacuuuugugcauuaaugcacauuaucaagaaaaugaaaagaaaaccuaccaaaugggagaaacuauuugcaaaucauaugucugauaaagguuuaguauccaaaauauauaaagaauucuugaccgggcacaguggcacacaccuguaaucccagcauuuugggaggcugaggugggcggaucaccugaggauacgaguucaagaccagccuggccaauauggugaaaccccguuucuacuaaaaauacaaaaauuggcugggcgugguggugcaugccuguaaucccagcuauuuugggaggcugaggcaggagaauugcuugaaccugggaggcagagguugcagugagcugagaucaugccacuguacuccaagcugggugauaaagugagacucaaaauacauuaaguaaauaaauaaauugagacagggucucacucugucauucaggcuggagugcaguggugcggacacagcucauugcagccucgacuuccugggcucaagcaauccuccugccucagccuccugaguagcugagacguaugcagggucucaccauauugcccaggcuggucucaaauuccuggucucaagcaauccuccugccuuggccucccaaagugcugggauuacagguaugggccagccagucuggcauauuaaccuuugacugaacacaagacacuguaaauuuuacucuguuggauguuagauacuucagcaaccuuauaaauuuucuugagcuuccuucugggaugcaguuaaguuacuugaaaacaauuugauccuuucaggucucacuuuuguuagguggguccagagcaguguucagucuagggcuaauuucugcuaucgagacaaaaacuuccuuaguguuauacccaaucagugacccaugaauuauaaauuucuccaccguggcagguugcaauagacacaguuccuggccccgugugaacaccagucacucacuauucccucuaauccugucaaggaguucuuuccccaaucucagguaguuuccucagacauaugcccugauaaguacucugcugaauacucaaggggaacccauuacggaucucuagacuucagucucugcagcuuucuccucucugguauuuuguccaaugcgcucuagcuguauuguccuuucuagacucucagcacuauccccucaacuaagucugccagauucucccucagucccagcuccucccuguguugcagccugaaaacucucucaaggcuguaagcuggagaaauuguagaguuaguuuguguuucucaucucucagggacuacuuucauuuguuaccaccauguccagugucuagaaaauguuguuucaugaggucuuuuuuuuuuuuugguuguugcaggaaaauggguagaucucaucccucuugcuucauguuagcugaaagcagacauuccauacuaaacuaacagauuucauguaacagaguuaaaaaaaaaaaucauuaauaugauuccagaucccacauuguaaauaacauuuaacaaccuaccacuuguucaguuuggauguaauaucaaagaagauccacaauuaucuaaaaccacuuuaaaaaauauuccuccuugucaaaaaguacauuugugguucucagggacugagggaaacggggaaugggaagugacugcuaaggaguacagggauuccuuguggaguaaauagaauguuauaaaauuagauguuggugaugguuguagaacucugcagacagauuucauacauguauuucaaucaaaaugauauuuuaaaaaaauugaauauaaaagcagacaugagaauccaguagucuucuucuaagccagauaguaaagagauuucuaaaaacgcaaagcaauacaaguuuucuuaaaaauauuuuguuuuuagaaaaauaccauccuaugaugccaagaacauauuauucuacaucuuaacagacauaccaauacaguaauuaacaaaaauaaaaauuaacaaaaauugcuagggggaagguauguaaaugcacauuaagguuguuauuuaauuacacuucuuacuuagaaguuucaggcaagccagcugagagcuccagaaacacagauaaguaguaaccucgcacaacuccauuuccauccuaaaagaagaauaaucaguuugaguguaaaaaaauuaagccacaauaaaacaaaaugcagauaauaucugauaucuagauugagaaguacuucuaagccucaaagcaauggaagaaauaauuaaaaacaccaauagauuugaguucuuaacaacuuuaaacuuuugugcauuaaaaaaaaagugaaacuauuaaggcacaaaaaugaagggaaauaucaacaaccacaacaaagguuaagaguuuuaacauauauagaacucuuacaaaucaaccuuaauaaaaaaacaagacccuaaugggaaaaauaauuucauuagaaaugagugaagcaaaaaaaaauuuuaaaccaaaaauuaauuuuuaagaccaacauacaaaaagguaauacccuaugcugaaaguaauuaaauauaauuucuauaugauuuuaauauuagaauuccauauaagauucugucuagagauugagaaguuguuuaaaucucuacuauagauuuuauuuuuauaaagauaauuacucccucccuuuuuguuuaauuuggcaagacucuuuuaaaaaaagagaauuacuuccuauguauuucccuaguacuucaggugucuauguuuuaaaagaaucacauuuauuauaacuacuuguuuaaacaucuguucccccaacgagacaaugaaggcugacaacagagauccuuauacaucuccagugucuacugggauaugacuacagagagguacaaguacuauuaaccccuucauuuuuagucuacuuugcuugaaaggaccugaggcaacuuuugagguucgacaugauaaucacucaguagauaucaaugaauaaaugacucaucagcuaggugaauaaagccagacauaaaagaugauauauuauuguguaaugccauuauacaaaacuuuucuaaaaaaaaaaaaauaaucugaaacuacauauugaaagacuucaauguguaacugagaauacuaacccaggagggcuaaaauguguaauaguaaauuacuggacucaaaaagauuauuuagcaucuaggcaauaucaccaaacaucuuuaaagguaaagaaaauuaguuuauuaucagacuuuuccuaaagaaaauggaauugcauauugaagauacccaaugaaagaaaauaugagccaaggauuuuauauccagcaauacuagccuuagaauauaaaaggcaaaaacuguuuucaacauaugagaacucagggaacauuguuuccaauaggccuuccagcagaauguauuagagaacaagguguggacaaacaaacaguugucuaauaugggggaagaaggggaacagggaaugcggacagcauauguaacaaaaaaaagaagaguuaacaguucucaguaaucaaauuaguauacuacagaacucugaaagaaagaccuugguuucaaaauuuauuagaaauaugaaaaacuuacuggguaaacuuuuaaccuccagcaaaguccugaaacuugaagagguggacuguaaacaggaucugcucucugacgcaaagugcuaacgaaaaagaaaaccaaccaaaucccaagaucaaaacuguugugaaauggcaacaggcaaaaagaaagaccaaccaguuucuuuguuacauacuugaaauccuagacaaauaacaaggugacugaacaggucaaaauuccacuguaaaaguuuagauaugcuuacauccugaaauaaagaaaauuuaaagauacugaaauauucagcaauaucuuuuaaguuucaggggaaaaaaaacccucaaaauugugacauuuaagggaaaaggaauguaucaccaagucucccaaaauuaauuaaugcuucaacaagcagucuucaccauuaaaaauaaaacaaaacccagaauguuucuuccucgcuucucugcaguauaaucaucuuuuaauauugaagaacaagaguacacuaaaccuuaauacgugugggaaaaaccucaaagagacuauguuuuagccacaaaaguaacccuaagaaaagacaaauuaaaugggaagagggauaaauucuguguggcuuuuuuuuuuuuugagauagaguuuuuucagacagaguuuuacucuuguugcccaggcuggagcgcaguggcacgaucucagcucacugcaaccuccaccucccgguuucaggcaauucuccugccucagccucccaaguagcugggauuacaggcgcccaccaccacgcccagcuaauuuuuguauuuuuaguagagacgggguuuaccauguuggccaggcuggucuugaacuccugaccucgaugauccacccgccuuggccucccaaagugcugggauuacaagcuuaagccaccaugcccugcccaguguggccuuauuuugauggccuuugccuauuauuuggaguuucucuccugaagaccuuauaguccuuguuuccacuuccaugcugcccucaaagacaaauugcuaagaaccuuugcauguuacgaucuucacuucugaucuuaagagaaaaaguaguaaaagcuaacaaaauuaacauacaacugacaaagccuacacauuucuuacaauaauggccccuuauccacaauucuucacuuugagcugagauaaauggaucucaauggauuucuucccagcacuuuuauuucugaggauagguaagagggggcucaucaaccucuaacuguccagccccccaccuuagucaaagcuaagugaucucucuuauuuaaaaugguuccucacuuugggcagggcaccguggcuaaugccuauaauuccagcacuuugggaggcugaggugggagaauuacuggagcccaggaguuugagaccagccuaggaaacacagugagaccccaucugugugguggcacacgcuuguagucccaguuacuugggaggcugaggugggaggauugcugcagcccaggagguugaggcugcagugagcaaugaucacgccacugcacuccagccugggugacagagcaaaacccagucucaaaauaaaaagaaaagguuccuuuucccagacuagagaagcagucagucuaaagauacaauauaauccagcacaaauuaucucuacauuucuaauaggaaacuuauucuucuaagacuucuaaagugagugacacaguucacuagauuacugucuuaccaaagaauaccuuucuggcucuuccuuauauacacauacaaaaaaaccagaauugucaaaaacucuuaccugaaauucucuaaaacaaaaguagcugaaucguaagauggcacuaauucacuaaaaaaaaaaaggcaaaaaaaauuauuuagcuuacauguuuaaaauuccauuugccuaaaaaagccaagucccucacuaguaucuuaaaaacuuuauuaaacuaaaaucuaagaaauauuuuuaaaucuuuauugaacauaacauuaaaucaaaugaauucauaaaaccaucaaguuugcaauuaaauuggagauacaaauacuuuauaaaaguuuuuuggcugggugagguggcucaccccuauaaucccagcacucugggaggccaagguggguggaucaucugaggucgggagcucaagaccagcauggccaacaugguaaaaccccaucucuguuaaaaauacacaaaaauuacccagaugugguggugugcaccugcaaucccagcuacuugggaggcugaggcacgagaaucacuugaacccuagagguggagguugcggugauucgagauugcacuaccacacaucucuauuaaaaauacgcaaaaauuacccaaaugugguggugugcgccugcaaucccagcuacuugggaggcugaggcacgagaaucgcuugaaccccagaugcggagguugcggugaaucaagauugcacuaccacacuccagcgagggcgacagagccagacucugucucagucaaccaauaaaucaauaaauaaauacuuuauaaaagcuuuuuuuccuaaaagaaaaaaaggcaacacauuauauaauuauuaaacuaaguacaagaaauacacuuuaaaaaguacucauggaaaugggaaaaagaaacugacgcuuagggugugaaucugaauuaugaaacagauauaaaacauccuuuaaaaaaugaaacaacagucagugauaacacaauuaauccccaaacuuccuacucuggaauggauuaugggaaauauuaacagaccucaaauacuuugaaacuauuuacuagcaaauaaaucuacacauuuuuauaggaugaauaccucaucaccuaaggggcaacugugauggacuagcacacucacacuuucuuggcaagucaaaacuacuucaagcaacuuuagucccauccaaucuucuucagagagaacuguauuauaaucacagaauggacuaaaagucacuuugcugcuaacuaccuuuaaucauguggaugguuuguacacuuucauuagaacaccucaaaacucauuaaaacacuauacuaugaaaaagacuaucauacgauguuuuaauaguguuauaaauuugauauauaaaauuacaaauuucccaaaacaauaaacugcaaaccauuucaccacaucuucagauauauuuucuaaaguucaauucaucauaauuuugguuauuaucaaaacaagauaaaauauacaucuauagcacugccacacuaugauagugucuaaagaaauuaguggcuugcaauacaauauagacaaauaauucuuuauuucaauguaaguacguauagcuaaauaggucacgucuuuuacacaguaagcagauguacuuugcccugugauuaacuguauagcuacuauccaaauugacuaugucaagaauuccuaugauaucccuagucaguuguuauccuucuuagaagacucacauuccucauccccauauccuuuugccugguuaacccuuacuauuucuucagauaacagauuagaagucacauacucuuggagguuugcucuaaggucuucccauuauaugaucuccuagcacucaacauacacaaacuccaauuagcaggaccaaugcaauuagugccuaggaagccuuucuggaaccauaaaccuaguaagagcucuaagggagucuucccaguauagccuucaaauuugacauguuuuugaaauuuugugcaacuuucaaucaggucucucaucaaguacagaauauccuccacaacaugcaaagacuuuaaucaauccccaguugccugcuaaucugcauauuauuucuucugccauguccaguguaauuuauuuccuguguuguuguuacuguuauuucugcucuaaguccagacuaucauuaucauauuuuauuggccauuaagggucaaaagacuucagcagaacccaaauuaaacaacaagagaugccauuuucaacucagaauggugaaguagaaagcuuccaggcuaaagagcauagguuacuaacacucaugaaccaagagaguacaguccaguuuacccuagucucacuugcuaggagaaaaugaccacauucagagcacagaaaacagguacugugauauacuuuuacauauguacauucuccuagggaaaauuuuuuggacacaaauaguauaaugacaaauuagugguauggggcagcauuaaacaggauacuuacuuccccuaucaccaguuaccacauuaauuuuauuacuguuccaauaaccuguuuuucuaaaucauaauuauaaacccaaagagcucuguauuaugcuuaaugcuagcacuuaacacaugccuaaaauauagcuggcauauauucacugaaugaauguuuauaaauacuugcuggcagauucguagaguuggaaauauuugcucaaaaauuucuuuugcgaaagaaauuacuuugcuuuuuaaauuuaaauuuuauuuauuuauuuauuuauuuauuuuuuugagacgcagucucgcucugucacacaggcuggagugcaguggcgcgaucucggcucacugauuuugcauucuuuauauguauauacaaagcuauugcuacugcuaggccaucuaauuccaccaccacaucuccauauuaugcucauucauuuagagauuaucuucaaucauacugauguuaucauucugugucugcagaugaggcacugcuuuaucuuuucauaguuuuaaaauuuucuccuccucucuuagaaguguagacugcucugguuaugaugacuggauucaucucaugauggugucagugaaucuuugucuucacagaauaugggaaacuacccucaaaccaucucuagcccaggaaucuggaagucacugaucugcaaaucuucagaccaguaaccucaucauaacuucaucaacaaagggaaaaaagggagaaccacaaguauccauuuguuucuuaaggaaauaaacugcugagcuauauaaaaacugguucuccuuaucaacuugacuauuucucccugaaacauaaaacucucuaugaacugacagcuauacuauuguaucuuuuauuuuuucuuuucugccucagccuccggaguagcugggauuauaggcaugcaccaccacacccggcuaauuuuguauuuuuaguagagaugggguuucuccauguuggucagacugcucuggaacuccugacuucaggugauccgcccgccucggccucccaaggugcugggguuacaggcaugagccaccgcgcccagcccacaguaaaauauuuaguuccucuucucccaugcagcaccuacaacaauacugggcacauagucuuuaauaaauaacacuucacugauuuagugaccuuuucuucuccauuguggcuccaucaccaauuacuaacugauagaacuaaaggcaauagaaacaccacugcuuugcauaucuaaaguuucauguguaacuuaaugucacgaaugcugaucuuucuuauuuggcccucuuuuccuguauguugcaacuaauaaaacagguuucuaauaagaauuaaauuaaaagccaaaguuuccaauaagguagugagcauuacuggagaaagagagaaggcccugaaagugauuaauuaacagacuagcgagcauuguugccugccugaugagcugcugaaagugguauaagaaugggaauuuacauacaucaaugguucccaaacuuuagugcaguauuauuacuuagagugcucaagacgcauuucugaauaccaccucuaaagauucuggggacauuggccugggaauuugcauuucagacaaaugccacacauagcccugacuuaggucauccaugcaccacacuuugaauugaaaaauacuaauuuuuauauaugacccuuaggucaaaaucuguuucauuccacaggggaugaaaugguucagaaaacaaaucuucaaaacugaaauagcugaccacaguaucaaugaagcagccuagggauuuuggugaacauucuucaaccaaaucuacuuaaugacagcaaauacauaguccuuuuaauaauauucagugcugucauucagaaaugagauuuaaacaaaaaagucagugcuuuaaaaagauaugaauauuuuaugagguuguuaaucaaaaagaaaggaagacuucuacuggucaaugagaaccacuggaguucuagcugucagaaaaacuuugcccuucuguuuauaggacuguggcaucuauaacgaguaagaagggcuuauaacagugauucucagucaggggugauuuuguccccaaggacauuuggcaaugucuggaaauauuuuugucacaacugcaagguggugggguggggagugcuacugggauacugcuaaacaucuuauaaaacacaggaaagcucaccccaccccacaaauaauuauucugcuuaaaaugucaacaaugccaagauugaaaagcccuggcuuauaugauauacucuaguacaaugaaugcggccaggcaugguggcucacaccuauaaucccagcacuuugggaggucgaggcaggcaaaucacuugaggugaggaguuugagaccagccuggccaacauggagaaaccccgucucuacuaaaaauacaaaacuuagcugggcgugguggugcaugccuauauucccagcuacccaggaggcugaggugugagaauugcuugaauccgggagguggagguugcagugagccgagaucacgccacugcauuccagccugggugacagagugagauggaguauaauaauaaauaaauaaaauaauaaauuaaaaaaauaaaaaauaaaauaguacaaugaaugcucuguggucaucagaggcaucacauauuagaggaaaaagaaaaggcagcucaacauauaaacauuuuuauaacaaagacuguuuucuaaaugugccacagcccucaccaugguaggaaaacuugauaguauuccauaagucaucucucuaagauaaagucugucacaccaaaauguuuaucugaagcaguggcuucaccccucaucauagaauaagcuaaggagauuuuaaaagaacaaacugaaaauguccaucugaacccuaugucacaggcugaauugugucuccccaaauucccauguuaaagcccuaacccccaaugugacuguaucuauagccagggccuuuaggaagauaauuaaggcuaaaugaguugauaauggugggucuaauacaauaaggcuuguguccucauaaaaagagaaagagacaccagagacugaucucucuccaagcaagaacagagaaaaggucaggugaagacacagaaagaaggcagcugucugcaagcugaggcaaaaaagugaauuuucugacacccugaucuuggaauucuuguuucucgaacugugagaaaauacauuucuguuguuuaaaggcacccaguauaugguauuuuguuauagcagcccaaguagacuaauacacacccaaagauuuucuuucaaauggccugggguaugguaugacccagcacugauuaauuuucagccaaaucccaagugauuccaacaucuagucagaaaccaccagucuaacaccacagaaugauuacaaacaugcuugaaggaauaugcuguucagaaaaauucuaagguuuagcccaagaugaaaacuaggauacuuuuugccauaauuauuuccucucucuaucuuuuaguauccggagauaacauggcgucaccuucaaauucuuuuggcauuucaucaguuucugaguuuuguguuaggagauauaguucaauucaaaagguacacugaugaagcuaauguaaucaauuauuuuuuucuauacuacggaagauggagcucuuggaaaaaaaaaugauuucuaguucauugucauuuucucuuaagagucaaaaguaucagucugugagacuuuucaggagaacuagauuuguauguauacaacagagcuugccagaccacuccauuauaaacaagaccuuaaaaagcuauggaguggccaagugugguggcucaugucuaugaucccuaguaauuuggggggucaaggugggaaaaucacuugaguccaggaguuugagaccagccugggcaacaagugagacccuaucuauaaaagaaaagagagagagagauggcauuaaaaaaaaaaacauucuuuugaaacaaguauaugcauuuccacauaaauuucaaaugaaaaugaaauuaaaaacugugucauaccugguaaagucugguggaacaggagugguaacaaaagaugccaugggcuuccgaugaacuugcugaaacaucauaaggaucucugagcucuuagauaucaacucacucuuacuacaagaccgcaacugugugaggaaaaaaauuaucugaacaaacaaaauuacuauucacugccaccucaaaauucuuaagaaauuacaaauuauucugauuauaaacugaaaaaaaugauaaaaauaacucaaagugagcuugagaauuaagaauguacaaagaaucuagguuuauuucuauaauauucuaacaguaaagucaaugaauaaguauacuuaauacuaaugcauuuuucucuccuuacauuuuaggauaaaugagguuuuaagcaaguacaaauauacuuucaggcugguacagugaaguucuuaugaauguauuaaugaacaaaccgguaaguugaaagcuuuuuuuuuuuuuuuuuuuugagacagagucuugcucuguugcccaggcuggagugcaauggcgcgaucucggcucacugcaaccuccgccuccuggguucaagcgauucuccugccucagccuccugaauagcugggauuacaggugggugccaccauacccagguaauuuuuguauuuuuuaguagagacaggguuucuccauguuggucacacuggucuugaacuccugaccucaugauccaccugccucggccuccccaagugcugggauuacaugcgugagccaccgugcccgaccaaggugaaagcuuuuaaaagcaauuucucagauuguauucuaggugacagaauacaaaacguacacacauacacccguguguacacacacacacacgcacuaucugauacuaauuugggaaacacuauuuugggaaaaaguaacaaaucuaacuucaguaacauaaccaugguagauaaaagauaagacuacuaauuuuuucuucaaaaaaaccaguuugaaguaacucccaauucugccacugacuaauuacauaacucugagucuguuuacauacaaaacuaaaauaguaauauccaccacugcuuacuucgugaaguuuguuauaaggauuaugaagcuauagugaaaaagcuuuguaaacuaucuguuaugugcugaauuuugugccccuuuccuccauaauuuauauacugcaggcucaaccuccaguaccucagucuaucuggagauaaucuuuaaagaggugauuauguuaaaaugaggccacugggguagggccuuaaucuaacaugacugguguccuuauuaagaggaagagacucuagggcugcacaaccacacagaaaaguccaugugaggacacaguaagaaggcagucaucuacaggccaaggagagagaccucagaagaaacgaaaccugccaacaccugaaucuuagacuuccagccccuagaauacugagaaaacaaauuucuauuguuuaagucucacagucauugguauuuuguuaugacaggccuagcaagcuaauauacuaucaaaugccauaugaaugauauucauaaacccaccuacaggugaguuuauaucuuuuaaauaacaguugcuuaaggcucaccaaaaauaacauaucauauggcugggcacaauagcucacaccuguaaucccaggacuuugggaggcugaggcggguggaucacuuagggugaggaguucaagaccucaugaccuggcuaguucaaggccuggccaacauggugaaaccccaucucuacuaaaaauauaacaauuagcugggcgugguggcacgugccuguagucccagcuacucaggaggcugaggcacaagaauugcuugaacccaggaggcggagguuacagugagccaagaucacgccacugcacuccagcgugggcgacaaggcaagacucugucucaaaaaaaaaaaaaaguaucauauaucauaugauauauaucaaaguuuauagucuuggguuaccaagaauaaugauaucauguuugagcuacugcaucaaccaaugacauaaugguaagugguaacagcagaaaacaacaaacagcugcauauuuugucauucauauuauuaugugucaggcauugcccaaggcauuacgguuuuuugaacaauuuauauaaaaugaucuaaaguuauuugaacuguuugcuuaagauuuuuaagguaugcuaaaaaucacuguguauauguacauacauacacacauaauacaaaaaaauuuaacuuauauuaauugaaugcuuacuguguauauccuuccuugacaccauuucuuccaaaagcaacuugcucccuucaacagaaguuuauuaucacuauacauguguuuccacaauuacuauguguguacauacauccauaaacaauguucugaauguuuucaaacuuuacauaaacacuaucaggcuauaucaccauguagccuacauuuuucaguuaauauuauuuacuuuuuuuuuuuuugagacagggucucgcucugucgcccaggcuggagugcaguggcacgaucucggcucaccgcagccucugccucccggguucaagcaauuuucaugccuuagccucccgaguggcugggacuccaagcaugugccaccucgcccagcuaaguuuuguauuuuuaguagagacgggguuucaccauguugcccaggcuggucuugaacucacucaagugaucugcccaccuuggccucugaaaguacugagaucacaggcaugagccaccacgcccggccuauuucuuuacuuuuuuaaacagaugggucuugcuauacuucccaggcgagcgccguggcuauucacagguacaaucauagcacacugaagccuugaauuccugggcugaggcaauccuuccaccucagcuuccugaguagcugggacuacagguguacaccccaucucaauacuguuuuguuaaaaacuaagacaauggccuaggccuacacauggucaggaucaucaauaucaccaccuuccaccuccacaucuugucccauugaaaggucuucacggguacuagcacauauggaucuacaaugcuaacaaugccuucuucuggaauauagucaacguuuuuuuaaaaaguaggaguaaacucuagaauauauucuagaauaaugaaugguaugguauaguaaauacauaaaccaguaacacaguuguuuauuaugcuuaucaaguauuauauaccauacauaauaauguguuauauuuuuauacaacuagcagugcaguauguguguuuacacuagcaucacaauaaacacaugauuaaugcuuugugcuacuacauuacaauggcuaugaugucauuagacaucacuacuaggcaacagaaguauuucagcuccauuuuaaucuugugggaccacugucacauaugcagucugucauugaccaaaaggucauaauuugacacauguuuguauaugggagauguguauagguuauaugagaauacuaugccauuuuauauaagggacuugaguaucugcggauuuugguauccauuaagguccuggggccaaugcccuacagauauauauguguguauguaaaaagaaaaggaaaaaagaauggggauaaugaagaaaaauaagaguauuuaguaaauauuuaugugcugaauccuacaagccaaauugucaaucaaguacaaagauaaaauaaaaauauuuucagacaaugcagucaagaaaaauguguucugacuacccuuccuggaaagcuacugagggaagugugauguuaaaacaaaacaaguaaaccaagaaaguggaaaccauaggaaucaggaaacaugagauucaauacaagaaagaugugaagggaauucccagaaugauuaagauaaaaaucucaggagacagcuguguauaaggcauagagagaaauuacaaaaagcaaauuccagacaagugaauguaucagauauuuaugcaacacuacauauuuuauuuacucauuuacuauaugcuucauauucacccacccuaaucuaaaauauaaacucuaugaggacagaauuuuaccauuuuguucacugcuguaucaccaauaucuacaaugaugccugcuaucuauuuaggacuuaauauuuccucaauaaauaaaaaugcuaaauuuuagaguaauaaucgcuacauguaaaguaacuggcaauaauaucucaaagccaccacuuaagucacaguguggggagauuuuaaccucuuauacauucagauuucuauggaaauaguucuguucuuacaaagcagaauguaguucuaaugcaguucccaaacaugaagaaaaaacuuggcaagaaucagcugauuccuaauuucauaaaaaucuccauuauaacacaaaagaucaacagaucuuuugaucucauacagauaaucucugucaaaaaaaaaacguuuauaauauacagagaaggccgggcacgguggcucacgccuguaaucccagcagcuugggaggcugaggcgggcagaucaccaggucaggagaucgagaccaucccagcuaacauggugaaaccccgucucuacugaaaauacaaaaaaauuagccgggcguaguggugggcgccuguagucccagcuacucaggaggcugaggcaggagaauggugugaacccaggaggcggaguuuacagugagccgagaucgcgccacugcacuccagccugggcgacagagagagacuccaucucaaaaaaaaaaaaaaaaaaaaacaacuacaguauacagagaaaaaaggauaaagacuauuucauuacauuuaauauuucaucaccuggugcuccaccuccugaaguaaggauuccaaaagcucuguuucuuggguuagagaugucuucugaccugaugaaaaauagugaaucaucaacacuuggguucauuauugguuuaagaaugaaauuaacuuccaaugaacauauuuaauaacaagaaauacacuucaaguaagcaaaaauucuucauuacagcuacccuaaaaauucucauucaacuuuaagaggcugaauauuauaguagccuugaaaauggaacuucagaaccaauucuaauuaguuuuagacaagauaccacugagaucaaauucaucuaagaaacgaaaugugcaaugacaauauacuuuaagcaaaaaauuuacuuuucuagauuuucauauucccuugggaagaagcaauaacaugaauuucauucaaucagcuauucugaaaucauuuuucaccaaauuuaacuguggcuuaaaagagaauacaaagugggccagauuuuuagguuaaaugucagcaaaaggucuguccugugaauauacaaggaccuguuuaaaaaaaaaaaugcccacagaggugaacagucucaaaaaguuggagacagaaaaggauaaacaaauuauuacuggccggggccauggcucaugccuguaaucccagcacuuugggaggccaaagcaagaggauaacuugagccuagguauuugagaccagccuaggcaacauggugagacccagucucuacaaaaaaguaaaaaauuagccaggagugguggugcaugccugcagcccaauuuacucaagaggcugaggcaugaggaucacuucagcccaagcggucaaggcugcaugcagucaugcaaugagccuugauugcaccacugcaguccuuccugggcaacagagugagacccugucucaaauuacaaacaaaaaaauuauaauuacagaaauuauccuuauagaaaaggaagaaagugcuuuauauguuuugaaacaaaaagaagauagguaugcuuaccaaaucaggccauuuucuuuguaaacccaaaauuugaaaaacuggaaguacauccaugaggacagcaaaaguuuuaucaaucuguaguguuauuugauaaggaaaaacauuuaauagguagaacuuuuauuuauuuuauuuauuuauuuuuugagaugggguuucacucuuguugcccaggcuagaaugcaauggcacgaacucagcucaccgcaaccuuugccucuuggguucaagugauucuccugccucagucuccugaguagcugagauuacaggcaugugccaccaugcccgguuaauuuuguauuuuuaguagagaugggguuucuccauguuggucaggcuggucucaaacucccaaccucagaugauccacccgccucggccucccaaagugcugggauuacaggcaugagccaaggcgcccggccuuuauuuauuuuuauuuauuuuuuugagacagggucucauucuguugcccaggcuggaguauaguggcgugaucucggcucacugcaaccuccaccucucaggcucaagcgauccucccaccucagccuccugaguagcugggacuacaggaacacacuaucacaccuggcuaauuuuucuuuuuuuuuuuuuuuugguagagaugggguuucaccacauugcccaggcugggcuuaagagauccaccugccucagccuagaacuuuuauuuuugaaacaaaacucagaauuucuagguugcaaaaagaguuaaaauaaaguauuagcuagaaucuaauauuaucagacauaauuucuacuauaaccacaucccacaauccuaaaacauuagccuauggacaacauuacaauacauaauuaaacuuaaaaaugaguggcagaggccgggggugguggcucacgucuguaauccuagcacuuugggaggccaaggcagacagaucacaaggucaggaguuugagaccagccuggccaauaugguaaaacccugucucuacuaaaaauacaaaaauuagcagggcgugguggcacgugccuguagucccagcuacuugggaggcugagauagaagaaucucuugaaccugggaagcagagguugcagugagccaagaucacgccacugcacuccagccugggcaacagaacgagacuccaucucaaaaaaaaaaaaaaaaaaaaauuaguggcagaggucaggugugguggcucacgccuguuaucccagcacuucgggaggcggagguggguggaucaccugaggucaggagcucaagacuagccuggccaacauggcgaaaccccaucucuacuaaaaauacaaaaaauuagcugggggugguggcacgugccuguagucccagcuacucaggaggcugaggcaggagaauugcuugaacccaggaggcggagggugcaaugagccgagauagugccacugcacuccagccugaaugacagagcgagacuccaucucaaauaauaauaauaauaauaauaaauuaguggcagauauuaugguaugaauuaaaaaucugaggcuuauaagacuauucuaaagauaaacuaacccugaaaauauccuuuuccccaccucuuauccuuagaaagaauccuauuuaaucauaaaagcuaccuuggaaaucacaaauuauaauuuuucauaaugaaaaauaauuugaaagccacaaaagcagggcaaguucaguuauuagaaagggaaguuauuucacaguuauacagguaguaaaauuaauaaacuuaagagaucuguacugugguauuauuugacuuuuaguugauucaauuaaauaaaugaagcaaugaacaaacucacucaagaaaaacaagaccacaugcaaauguuuauuuggcuacgacugaagaucacaucaacagucaagauccccucaauuuuaaaguccuaauacguaucaacauccaguacucuacauggcuuaaugaacuuaaagagaucucaaauauuaucuagaguucugaaaaacuaagaucaccuauauguaugacugcaacugaggaucuaagaacaauuacgauuuucauuuacaugaaauauauaaguggcauugugaccaguacaaucaauaccuacagguuuugucuaauugcuccacuggguggaugaacugugcuuuccaaucuaacuacuagaagaaugauuguuuaagacuauuugcuacuuggucugugggaaaaaaacuaaaaaucagauauuaaauaguauaggauuauaauagaaaagcaauucaugaaaugauauacaaauauacaaacucaaagauauuugcaucucauuuuuaaaaaguuaaaaauaaaauggauaaaaucauuauuuuggaugacacaaagacauggcuaaaaucuuggagaaucaagauagccaaaaaaaaaaaaaaaauucuuuguucacaccuuauuuaaaguauauauauuucacuuuggacuaugauaaaaaaugcaaagcugguuuuuagucagcaaaacacuggaaggacuaagaucaccaaaacaaaucaaacaaaacaaaccauagcauuggauuaaauucuuacuuaaaauuuaaguucaauaccaggcuccacaaucaaagaagaaugaaggaaucuucgaaaagcaaaaaggucagcaauaaauauaauuaagcauauguaaaaugaacccuacuagaaaucaaaagcugagacuuuaaaucucuaagaaaaugcuggcaggggaugacgccgauguuuacaaaugucaguuucuucauccccaaugaaaauggauggaaaggauauggaacauuaguagaaggaauucuguuagauuuggagaaaaagcuaccuaacaaugaugcccacuggccauuaggauuuucauccaaauggcuaugaaaacuuggauuuucauccaaauggcuaugaaaauuuuucucuccuaucauuucuaaauacaagucuaacauuuaucugucuaaauuguaacaacauggaguugccuaaaaucucaagauuccuuccuaggaugaucacccuuauucuucaaagacugaaucucaaagaagcugaaagcaccagguaccccagcagcauacauaaacacuuacccaucaguguuauaagcuuauucuucagcugugugucuaaccgugcaaucaucaucuccacugcauuccuaauuucccgaacacgcucaucuuuugcauuucuuacagcuucuacauuccuuuccuagaagauaaagagguaagaauaauuuuaauuggguaaauuuuaaaaacagaagcaccacauuauaauauugccaagaauagauaauaugaaaaagguaguuagaggaaggucaaauggaaaugacccaacuugcuuauauuucaaaauggcagacaugcaaucaaaaacacaaauuuucugcauaaagaauguuauaaaugaucacuugguucuugauuccuaaagagguaaaacaaagaagacaucugcuuuuaauuuaggauaugguccacaaacuucauuuuaaguuaggaaaugguccauaaaccucauuuaugacugucauucuaacaacuugaaacaaaauguauucuaaaaacaugcuuaguauuucauucuugggggcuuaucacauuuuuucacagaaauaacauuauaaauagcucacuaaagcuguuugaccuaaacaauaucuaaacaguaauguuaaauauugcacuuucaagucuguggaguucuaaaucaggacaucacaaauaguucauugcuuaguaaaagaaacucacccaaaagcuggggauccaaagaguguauaacuuaaugaaugacuguaaaagucaauacugauucuguuuagaaguaaauuauuggggccaggcacaguggcuuacaccuguaaucuuagcacuuugggaggccaaggcagguggaucacgacgucaggaguuugaaaccagccuggccaauauggugaaacccugucucuacuaaaaauacaaaaauuagcugggcgugguggugggcaccuguaaucccagcuacuugggagggugaggcaaaagaaucacuugagcccgggagguggagguuguagugagcugagaucgcgccauuacacuccagccugggcgacaagagugaaacuccaucucaaaaaaaagaaaaaauaaguuaauuauugacucuguaacaaacagacuuuuuaaauucacugauuuucuaauucugcauaagugguaauucucugacuccaacugcuuccuuacaagccaggggcuuuguaugcaaauuucucagauacucugaaauuuauggaauuugacuauagguacagccuaucaaauuugcaaaucuugaaaaccuugauuucaacaucugauuaacuuauauuauauaaauauauuauuauauauuacagauuaaaaacaaaauaauuauauuuuaguaguagucuuaccacuucuugaacuaagcugaucaguuccaugagacgccgacgaaguuuggcuaccucuucauucacuuuagugacguguugcucauaaauuucugccaaagguuuaaagguauguccgccaugcuauuuaaauuagaguagcuuuagaacacuuucacauaucucaucugcauuuacauuccuuuguaacacucuauggacacuaauaaacugguaaaucucucaaaugaacuuuaccuuauuagcuaauuuaauuuuguugaagcaggccagugcccgcuuaaaaucacuugguccaaguaggaacucuuucaagauuauaaauaaagggcuuuagcaaaauauucauuuaacuagaaauuaacuuauuaaaaagaaccaagaucuuuaaccacagcccaaaucaucugccacaaccuuaucagucagucacucuucucuaaggcaaacuagucuucuuccauguccucaaacuucuuuccaccaggacuuuacaaaaauuacucccucuuauuaaaaaauaauuauuagccaggggugguggcucaugccucuaaucccaguacuuugggacgcugaggagggcagaucacuugaacugaggaauucaugacuggccuggccaacacggcaaaaacacgucucuacuaaaauacaaaauguagccacgcauguuggcgcacaccuguaaucccagcuacucaagaggcugagacaugagaauugcuugaacccgggaggcagagcuuacagugagcugugaucgggccacuguacuccagccugggugacagagacucugucccccccaaaaaauaauaauuuuuuaauaauaaaaaccaaaaaaaaaaaaaaauaaaaaaaaaaaaauaauaauaauaauaauaauaaugcugggcaugguggcucacgccuguaauccuagcacugugggaggcugaggcggguggaucaccugaggucaggaguucgagaccagccuggccaacauggugaaaccccaucucuacuaaaaaacacaaaaauuagcugggcgugguggcaugcgccuguaaucccagcuacucaggaggcugaggcuggagaaccacuugaagccgggaggcggagguuggagugagcugagaucaccccacugcacuccagccugggugacagagugagacucugucucaaaaaaacaaaacaaaacaaauaauaauaauaauucuccaucuucccucucccaucuugguuugucuuaauccuacucauccuuugcacuuagcucagauuuacaggaucagcugcuauaguuaugcauccucaucagcucucuguauuuauuccuauaauuuaucaagccaauugaguauguaauuguuugauauguucaucaccaaaucccuagucuuuaccacagcugaaugaauuagaaagacacuugaagaaaaagcccaggauacaaaauuaacaaaagcaaugaacccauuuuccaucccacagaguuacuacagagacagaagacugauacaaguuagccucacaaauccaguugcauucagcucaaagaacaauuuuuauagcuaacuaccuaaaaauaauuuugauuuguaaccagaauuauuaaauuuuaauauaagaaaccuccuauaaguucuuacuagaauugucuuauuuagccaaaguaucccauuauugucuccaaaaaagauguagauuuuuacauguucacuuuaaguauagaaaaaaacauuucuacugucucuuacaaaaccuauguauuuaaaguauuaaaugugagaacuuaauuuuuucuaguuagcacauuaauauucaaauucuagcagaaagcucugaauugagcucuacucaaccaaucuggccugccacucucuccguaaaacauacugacugaugcccacagaaugaucaauucuuauagcaacucuagauaccuacccacuuccauuucacccauaacuuauuuuuccuaagaaucuauuguguuuauucucaaccuauuuaugccaauuguacuuauuauuguaaggagaucauuuaauuaaguauucagaggcugggcgcgguggcuuaccccuguaaucccagcacuuugggaggccaagucagguggaucaccugaggucagcaguucaagaccagccugaccaacauggagaaaccccgucucuacuaaaaauacaaaauuagccaggcguggugguggcacaugccuguaauccuagcuacuagggaggcugaggcaggagaaucacuugaacccgggaggcggagguugcagugagccgagaucccaccauugcacuccagccugggcaacaagagcgaaauucucaaaaaaaaaaaaaaaguauucaguaaacaacagaacacgacuuuaaaauaaaaaagcugcuucuaagaaagcuaacuucaaugcuucaggcucaauaaugguagacugucuuuaaaaacugcucuugaauucaauuggaaaaaauaaucuaaaaaauaaaaaauaauuauaagaucuagauaggcguacucauguuguuucacaagugucuaaguucgugcuccauuuuaaaggaacuaaaauuggaaauguuggccaguacaucugaucaacugaccuuuaaugaaaaaagugaccuagauccuacaacgaaaagaucugcaaaugaauagaggauauguuuuauagguguuacagauuaaaauauuuacauaagggguccaucaaaccacacaaacaagauucuucuggaauaaaaguacaauaccuuuaauaaagcguauagaaagcagaugcauuuuaacuuucauucuacgagagcauaaugacacuauuuucuaucugaauaaguauuucagugccuucuagccucuaacuuaaaaaaaauacugaauuuguucugcucaccauuccuccccaaagugcacacugauggcagauacacuucuuacaaguccagcaaaauacacuaaguuuuucauggugauuuucacaucuauacauuaugaaaagaaaaugaaguuauaaauuaaauuggaacauaaucaccuccacaaauucuuaagcuugggcaaacaggucaguuuuaaaugauuauaucucaagaaacacaguauaaaauguacuccauggcuucugaaaaggaagcuaaagaaguuuaugcggacaauuuuuuguaaaguacuguuuucauugaucuggacuuuauaaucacaugcgaaauacagauuugcuucuuaaaaacauaacacauauugcaucauuuccacacagcacuacagaugauauauucuauuguacuacuacauuuugggcaugugcuuaauaaucauauugauuaugcaucuauaccuacaugagcaugcacaaguacuuuuccuacauguggucaacgauaacaauaaucaagacacaugauuaacugcacgauuuaauacuagacccucauggaaaaugaacaacucaauuuuaaauguucuuuuaaacuggauauucacaugaaaaacaauaaaguuagacucuguuauggauuaacuauguccccccucaaauucauagguuaaagccuuaacccccagugugaauguauuugcagacagagccuuuaaggagguaauuaagguuaaguaaggaucacaagggcaggacccaaauccaacaggacugguguccucuauaaagaggaggagacaccaggcaugcacgugcacauagcaaagaucaugugaggacagagcuaggugguggccaucuauaagucaaggagaaagggaggccucacuagaaaccaacacugcuagcauuuaaucuuggacuuaacaccuaucagaacugugagaaaauaaauuucuauuguuuaagcuacucaguuagcaguauuguuaugaaagaccuagcagacuaauacagacccucacuuuauaccauauacacaaauaaacuacaggccgggugcagcgguggcucaugcccgcaaucccagcacuuuaggaggccaaggcggguggaacacuugaagccaggaguuugagacuggccuggccaauauagugaaacuccuucucuacuagaaauacaaaaaauuagcugggcgugguggugcacuccuacaaccccagcuacucagaaggcugaggcaugagaaucgcuugaacccgggaggcagagguugcagugagcugauaaucacaccacugcacuccagccugugcaacagagcaagacucugccucaaaaaaaaaagaaaagaaugaagguuuaacauccagaauauauaaauaacaccuguaacucaacaaauaaacuuuaaaaacucuaauuuaaaaaugagcaaaagaucuccaguaagcauaugaaaagaugcucauuacuacuaaucacuagagaaaugugaauccuaaccucauaccauauuaggaugguugcuaucaaaaaaacaaaaaagagcaaguguuggccaggauguggagaaacuggaacccuugugcacuacuggugggacuguaaaaugguacagucacuauggaaaacaguauggagauuccucaaaaacuuaaauuaaaaauagaauuaccacaugaucuagcaauucuacuucugauuacauaaccaaaagaacugaaagcagagucucaaagacaugaacauccauagucauagcagcauuauucacuacagccaaaagguggaagcgacaccaauuuucacugagagaugaauggacaaaaaaaaugugacauauacauacaauauaauauuauuaacccuuaaaaaggugggaaauucugacacauggaugaaccuugaggacauuaugcuaaguaaaauaaaccaguuacaaaaagagagguacuguaugguuccacuuauaugcaguaucuagaguacucaaacagauagaaacagaaaguacaaugguggcugccaggggcuggugcgaagaaggaauggggaguuguuuaauggguacaguuucagauuugcaaguuuaaaaaguucuggagauuggcugaacaugugaacaugcuuaacauaacugaacuguacauuaaaaaaugauuaagaugguaaauuuuauguauauuuuaccauaauuaaaauguuuuaaguauucucuuguuuauaaaguagacauacucuugcaauuuuuuuuuuuuuuuuugagacggagucuagcucugucauccaggcuggaaugaaguggcgcgaucuuggcccacuacaaccuccaccuucuagguucaagcaauucuugcugccucagccucccaaguagcugggauuacaggcacaugccaccacgcccagcuaauuuuuguauuuuuaauacagacaggguuucaccauguuggccaggcuggucucgaacuccugaccuuaggugauccacccaccccggccucccaaagugcugggauuacaagcaugagccacugugccuggcccacucuugcauuuuucaaaaagcauuucauugaugaaggacacugagcuuagagaaaauacuuacauaaguuuauauuuuauauuucuaauucauaaguaaucagaauauaaaaugggaaaugaauaagaguuagaauacaucagguacuguuuggaagcucauuuagcaagacuuccaaaagaccaaauuuauaauauagcuuuuacaauauagaaaauuugccaaaacuccucuuaauuaacagccuguauucacuugcagcaaggggaggccaguaggcaucaaacagcaaguaagaaagacuagcagguuagcaaauuguagcagucuauuccuuuugagaggcucuaauagaagaggcccaaaaagagguaaaaggucuuuccaaacaguaauacccaccacuucagaggaaaaacaccuaaguguucaccaaagaaaugugccauuguauagaaaagaaauuaaauaauuauuuuuggugagaccucuacaaugcuacaagugacagaauuccuuaaaaguccaguuaaacuugaauagcagguuuuugguuuuguuuuuguuuuuuugggagauggagucucgcucguuacccaggcuggaaugcaauggcacgaucucggcucacugcaacuuacgccuccugggcucaagcgauucuccugccucagccccccaaguagcugggauuauaggcguccaccacgacgcccagcuaauuuuuguauuuuuaguagagacaggguucuccauguuggccaggcuggucuugaacuccugaccucagguaauccacccaccucggcuucccaaagugcugagauuauaggcaugagccaccacacccgcccgaauaguagguuuuaauucugauuaugcauuaauguguuauacuaccauaauuaagccucuuucuuuuuuuuuuuuuuuuucuuuuuuuaagagauggguucuugcuauguuaccuaagccauccucugggcucaagagauccuccugccugagccucccaaguaucugggacuacagaugcacaccaccacacccuguucucuuauuucuaugguucuauuuccucaguauaaugaagaaacagauaaauuuuuuucuaaugaccugugagguuucaaccucuugcuuuaccauguugugacucuacagaaagugacaaggcuuuauuucuaaacauucagggguccuggaaucucaccuaauucaaguuauuuuauuauugcuggacagugaagccuuacaauuaaccauguuguagcuucuucaucuauaaaaaccaaucacugccacaucacucuuuccuuucuuuaccugcuccccauaacaacucuccagauauguucaaaauucuucaaucauggaacauaagaccauuuauucauucuugucccuuaaaugacuuaacacuguauuaucacuguguccccauuaaacaguuaacagaaaucaugucucauuuaccuuuguaugccuaucaucuagcaaaguacuuucuguguggggggaggggagggcgagagguaucuguguauacauggcaugaaauaacuguuguuaaauaaacacaauaagaauauguuacuuaacaguaacagcgcaugacugaaagaauuaaaaacaagaaauauaacacuacuuauucauaaauaacuaaaaggcaacuaccaauauagugucauuaaacaauacaaaggcaaaauccauucaauauugaacaaagaaauugaggacauacuuguccuuuucauuuucuucauguuuggugagacugcagaguugaagaguaucaagcuguuguguuacuucuucugcccaacgacaauuuacuaguucucguagcuggaguggagcacuggggagaaaauccauacacauacacuaauucaggaauuugagauuauuuuauaaaauaaauacguuucucaaaauagagagcacaauaauacucauaccauaacacuauuuuuuuuuuuuaagagaugagucucacucuaugacccaggguggaaugcagcggcaugcaugaucaugguucacuguagccuugaccuccuaggcucaagcgauccuccugccucagccuccugaguggcugggacuacagcagcacaccaucaaacccagcuaauuuuaaaauuuuuuguagagacgggaaucuugcuauauuucccaggcuggucuugaacuccuggccuccagugauccucccaaaguacuaggauuacagguaugagccacuaccuggccccauaauacuauuaaaacuaaaaaaauaaaaaauaaaaaaaaagacaaugaaaaauauuaucugugacuuauuuucaccacauuaacacgucauuuaugaaaagaaacaaaaagcuaaacaaaaacauaugauucagaauauggacugaauucucaacuucugagucuaaagcuguacuguuggcguaguggcucgcgccuguaaucccagcacuuugggaggcugaggcagguagauugcuugagcccagguguucgagaccagccugggcaacaugaugaaacccugucucuauaaaaaauuagccaagugcaauggcaugugccuacagucccagcuacccaugaagcugagguaggaggaccacaugagccagggagauugaggcugcagugagccaagaucaugccucugcacuccagccuggggaacagagugagagccugucucaaaaacaaaacaaaacaaaacacaaauccacagcugugcuguccaaaacgauagccacuagccacaugugacucuuuuaaguuaaaauuaaauaaaaauaaaauuuuggccaggugcaguggcucacaccuguaaucccagcaguuugggaggccacagcggguggaucacaaggucaggagaucaagaccauccuggccaacauggugaaacgcugucucuacuaaaaauacaaaaauuagcugggcgugguggcacgugccuguaaucccagcuacuugggaggaugaggcaggagaaucacuugaaccagggagucagagguugcagugagccaagauugcgccacugcaccccagccuggcgaaagagugagacuccaucucaaaaauaaauaaauaaguaaaauuucaucauauagccacacuagacacauuucaagugaucgacagccacacacaacuaguggcuaccauacuggacaguguagacauagaacacuuucaucauuauaaaaaguucuacuugauaaugcuggucuuauaagauaauguaagaaaggugggacgaggcacagugguucacgcugcaauccuagcacuucgggaggucaaggugguaggaucccuugagcccaggaagucgagaccaguuuggccaacacagugacaucucaucucuacaaaaaauaaacaaaauuagcuggcaugguagcacacaccaguggucccaguuaggaaggagguugagguaggaggaucaccugagcccaggaggucgaggcugcagugagcugaaaucacgccauugcacuccggccuggacgacagagcgagacucugucucaaaaaaauaaaaagaaaagugaauacaaaaagaaaaaugguuaacagauggcacuccagcauuauuuuuugaaaccaaaaguagagauaaccuaaaugucucucaauaugggcauaaauaaaucaagguauagucauaaaacugauuaucagucacuuuuuuaaaaaaugacuuauguauacauacaaucaagaaaagauaucuaccauauuuuacaugaaaaagcaaacugcaaaacaauauuauaucauugguacauuuuaagaaaaagcauaugggaaucacauacgcauauauauauauaaauauaggcacaaucauacuggauuagggcauuacaaaauacaugcacaaaaaacagucuagaagaauagauaccaaacccaacaauuucuucugaaaguauuauuaagugagaagacaggguagggaguaucagaaucagaaggcuuuuuauuuuauuuuauauuuaucucuaccaucuggauuuuuuuguuuguuuuuuguuuuuauuuuuuugagacagacucucgcucuguggcccaggcuggagugcaguggcgugaccuuggcucaagugcagcaguacgaucucagcucacuccaaccuccaccuccuagguucaagcaauucucaugcuucagccuccugaguagcugggacuauagucgcgcgccaccacgcccagcuaauuuuuguauuuuuaguagagacaagguuucacuauguuggccaggcuggugucgaauucccgaccucaggugauccagccgccuuggccucccaaagugcugggauuacagguaugagcgagccacugugcccggccaagcuaucuggauuuuuuuaaccagaaaacauuaaaauuuuuugcuuaauuauaaaagauaaauuaugcccuaacuaucuggauuuuuuaaccagaaacauuaaaaauuuguugcuuaauuauaaaagguaaauuaagaaguuauacaaugauuuucugagaggcagaguacaacauaguaaacguaauuuuaagucacaugaauuagucccugcauuucuuuuucuagucaaauugcuuauuucuacucaacuaucuucacgaagaagagaaaugggcagacugcaggaaaacugccuuuaugaaucccaaggcacauucugaucuuacuauuuucaaaauucacaaauaaucguaaggaaacacuuaccggcaaugaggacauugagcucucugcucugucagccagcgcuaagggggcaaaagauuagauaucgauuagaaaacaucauuacuauauauauauauuacuuaauauuuuauauuuauauauaauauauauaauauucuuaauauauauaauauauaaauauauaauauucauaauauauaauauauaauauauuauuauauaacauaucauauauauauaauguauaauguauaauaauguauaauauauuauacauuauauauauaauauauauaauguauaauauauuauacauuauauauauaauauauauauaauguauaauaauguauaauauauuauauaauauuuauauauauaaaauacuacaaaucuaauggguuuaacucucuagugcuuaguuuuagagauacuuauaaaaguaacaggcaaucuacuguuucccucacugucauccucauagggauaaacuuuugaagggacaaaacucaacacaaaauagcuguuaaaaggcuacucucacacaggaaaagcaaugauuucaggacuaacugauucucacagggaacgucuauauaaucuuauuauugucuuauaauaauggcacugucuccuuugcacucaaaaauaaaccacagugaugauuuauuucuaucuaguuuacuacuaaauuuauuuuuugaaaagcuaauucgaaaaaaaaaaggaagcuaauucugaguuacauacauuauagacauguaaauuaaaccgaaaaaaaugaauaagcaauacagcacaacuuuuaagucuuaaaacaguuucacagggcugggcacggugucucacgccuguaaucccagcaauuugggaggccaaggugggcagaucaccugaggucagcugauggagaccagccuggccaacauggugaaaccccgucucuacuaaaaacacaaaaauuagccaggcauggugaugguggcaggcgcccauaaucccagcuacucgggaggcugaggcaggagaauugcuugaaccaaggaggcagagguugcagugagccgagauccugccacugcacucuagccugggcaacagagcaagacucugucucaaaaaaaaaaaaacaaaaaaaacgguuucauaguucaguaauugaagcuucuagauaucuugguuuccucauaauuauaaaaagguuuuagaagagaauaaugucucuacuaaaccaaaaauuauauuaauaauuuauuaggaaacugagagcaauguuauaccacauauaaaggagauguuaagauuuucugacuaguuuucaggaaacaacagguuuauaauaaaaaaaacuuuauguuuuaauugucugauaaauagguucagagguaaauaacuaugauccuacaccaacguacucccaauaucuguuauuuguuuaucucuuucuacuuuuuaaaaugaacaugagcuuuaacuugaugccaaauaauuaacuuagaaauaaaauucccaaggaaaccuuaaaggacaguaaaagacuuaaaaugauagcaagcaagguacuucagagcaaagaaaauaaagcugaaagaaaaagcauacagagcacgccuguaaucccagcacuuugggaggcugaggcggguggaucacgaggucaggaguucgagaccagccuggccaacauagugaaaucccgucucuacuaaaaauacaaauugagccaggugugguggcaugagcauguagucccagcuacucaggaggcugaggcaggagaacugcuugaacccaggagguggaggcugcagggagccgagacagcgccacggcacuacagccuguguaacagagcaugauucugucucaaaaaauaaaauaaaaauaaaauaaaaagccuauggaaaaggauuccuccauucuuaauaaccuugaacauuauuauuaccuuggucccuaggcaaaaacgaaauuugggucagguuucuuccccugaaacaauggcaugaccaugccacucuucuguuaaagucacagcuccucuccagaacuggucucaugaacuccucuccagaacuggcccuauaacccagcaagguaaugucuuuacauguuuccucucucugccuaagauauucuucaaaaccuuucuucaucuggguuacuccuacucauuguuuagauuucaguucauaaguugcuuucuccaaaaagcuuucccugacacucugcagacuauuuuagauacaauugccaugcucuaccacagcaaccuacacuucccccuucagauacuuuauuacgacgacuuauuuguuggucuccuuugcccugcuagacuauaaaacuuauaaagacugggacuaugauagggaguaaccagaucguauuuuaaaugucucccucccucccagucaaaacaggcuuacugcugcacuauauaacacugucgauauaucugugcauuugcuuauauggucccucccuccauaucccgucucauagaaaugucacuggaucauguccauaaaauuuccugccuuucccaggcuauagugaguuuuacauucucugaauauuugugguauuuuuaucuuguauuccacaaucuaauuuauuuauuuauuuuuugagacagagucucacucccucccccaggcuugagugcaguggugcaaucucaacucacugcaaccucugccucccggguucaagcaauucucaugccucagccucucaagcagcugggauuacaggcaugcgacgccacacccagaugguuuucguauuuuuauuagagaugggguuuucccacguuggccaggcuagucuccaacucugaccucaagugaucugcccgccugggccucccaaagugcugggauuacaggcauacaggcaugaaauugcucagccuccacaaucuaauuuaauuacaaaauaaauaugacaauguuaauacuuugagaaaagcaauguuucucucaaaccaaaaccaaagaaccagugguacaauauuaaugcauaauauuaaacaaauaucuuuagagcauucccccucauucaauuaaaaaaucauaaacauaaaauaaaauuaaaauuaaaaauuauuuucucuccuucauuaaacuggaagaaucacaagcuuuagaaaguauucagaucugugucugauucccagcucuggcacuuauggaccacaugacauuggacaagugacugagcucgucuccucauaugcaacaagagaaucaacauaucuacccugcaaaaccgcucuaaggguuagagagaagcuguuagcaauauauacuaaguaucuaagauaaucuuaaaaaaaaaacaaacuggcugcuaacauuuauaguucaauuacuacuggaugugaggaaaaaggaagauuaaggugagcuagguuuuuggauaaaaaacuggguuccugacuggaaaagaaacagauuuggcauggugaaaaacaaaaacaaaaacaaaaacaaaacaaaaaaaaaccucuuauagagacgauauauuucagaugcauacuacaaguccaaaugaagguaguuagauacuggaggcagagaaaaggccaggacugaaaagauaaaguugggaaguuuaagucuagagguaguguuaaaagucauggaccagucgggugugguggcucacaccuuuaaucccagcacuuuggcaggccaaggugggaggauugcuuaaggccaggagcuccagaucagccugggucacauagcaagauaccaucucuacaauaaauuuaaaaauuagccgggcaugguggacacgccuguagucccagcuacuccucaggaggcugaggugggaggaucaacugaguccagaggucagggcugcagugagccaugaucaugccacugucucuagccuggaugacagagcaagacucggucucuuaaaaaaaaaaaauccauagaccaugaaguuacuaggaagaugguauagcuauuauggcaaagauaccaaagauaacguuucaagaaaaacagaugaaguaauuuaugcugaaugcuccgagaaggaaagauaaggccaacaaaagguucauuggauuuagcaaaacugagucuacacuuugcaggagcuaugugaguaguguggagggagcuaaagccaaguuagaauggguugaaggguaaguagauggcaagguugcagggaaauggaguggaaaacacucuuuuaaauacuuuuagcuauaagagaaaacaggcaguaaauaggaaauuuguuaacaaaggacuuuuauucccaaacagcucaaaauugcaaggaaacuaggaggccgaucauagaggaucuuagaugccuugugaaagcauacaaaauuucuuacauccccuaauguacuguuugaggcaaacuauauauacauacaaaaacaugcuaaauacuuucugggguuguuuuuguuuuugagacaagucucacucugucacucaggcaggagagcaguggcccaaacacagcucacugcagccucaaccucuucaucucaagagguccucccaccugacccucugaaguagcugaggcuacaggugugcccaccacauccagcuaauuuuuuaauuuuuuuugcagagaugggaucuugccauguugcucagccuggucuugaaguccugggcucaaacaauccuccaucuuugggccucccaacgugcugggacuacaggcaugagccacugugcccagacuaaaauaguuucuuacaaacaucuauaccacuaaacuauaacaaaaguccacuucuuaugguaugucuaccaaagaaagggaaaagcuguccuuuuguucauuuccaaaaaccuguaagaaugaguaauuaucauaaagauuguauauauuaauuaucuagcauacagaacuaaauaagccagaugguaaauaaaauuacuguuaguguaacaggagaccaaaaaaagagaguuuaaaaaaaaaacaucagccgggcacaguggcucacgccuguaaucucaauacuuugggaggccgagguggguggaucaccuggagucaggaguucgagaccagccuggccaacauggugaaaccccgccucuacuaaaaauauaaaaauuagccaggcaugguggugggugccuguaaucccagcuacucgggaggcugaggcaggagaaucgcuugaacccaggaggcagagguugcaaugagccaagaucgugccacugcacuacagccugggugacagugagacucugucucaaaaaaaaaaaaacaaaaaaaaaaaaaccaacuuuguaacagaaaacaaggucuuuaagaaacauuaauuacagcaauuauuaaaaaucuuagaucaugggcucaugauugauuaaauacuauuuccaaugccuaauccugcauuugaaauuaauuaaaaauauaaguauuuauuaaauuccuuccauuucuucagaauauaaucagagauaucauuauugacauguacugugcauccucauucauaaugcuauaugaaaaauuuuaauguauauguggucugggaguuuaagauauuuacuagagaaauugugcuagggaaauccucaacaaaaucccaauaaaacuaauucaacagacuauuuaaaaaauuauacacuguggccaagugggauuuauuccuagaauagaaagaugauucaacuacaaaaaucauucaauguaauaaaccacuucauggaaaacccccacuaugaucaucucaauugaugcagaaaaggcaucugacaaaauccaauauccuuucaugauaaaaauacucaauagaaauagaagggaacuuccucaacuugauaaaggccauauauaaaaacucauaaaaaucauagucaacgauucaaaggcuaaaaacucuuccccuuaagaucaggaaaaauuccccuuaagaucaggaaaaagacaaggaugccagcuuuuaccauuucuauuugacauaauacagguacuaaaaauuccagccagaguacuuaggcaagauaaagaaauaaaaaguauccuaauuaaaaaagaagugaaauuaucuuuuugcagaugacaugaucuuaucuguaaaaaucccuaaagaguccacaaaauauuguuaaagcuaauaaacacaacaguuacaggagacaaacacacaaaaaacacuggcauuucuauaagcuugcaaugaacaaucuaaaaacgaaauuaagaaaauaacacauuugcaacagcaucaaaaggaauaaaaugcuuagggaaaaaaaaaaccaagaauuugaaagacauacauggaggcugagugugguggcucacaccuauaaucccagcauugggaggccaagacaagagggucucuugaacccaggaaguugaggcugcagugagccaugaucgcaucacugcacuccagccugggugacagugagauccugucucaaaacaauaaaaaacaaaaagaaagacuuauacgugcaaaacuacaauacacugcucaaagaaguuaaagaaguccuaaauaaauggaaagacacccauguucaaggaucauaagauuuaauauuguuaagacagcaauauuacucaaaggcauguacagaaucaauguaaucccuacuaaaacuccaaugguacuuuuuauauugguagaaaacugcauuuaaaauucacauggaaucucaagggaugccaaauagucaaaacuaucuugaaaaaguuggaggacucacacuuccuaauuucaaaacuuacuacaaagcuacaguaaucaaaacagugugguacuaccauaagaacagaaauagagacuaauagaacagaauagagagguagaaauaaacaaaaauauuuuaugauuccauuuauaugauguacuuagaauagucaauguaaagacagaagguagaauagugguuaacaggggcuagggggaagagaauaaugagaauuuauuguuuaucaaguacagaguuucaguuugggaugaugaaaaaguacuaaagguggauaguggugauggcugcacaacaaugugaauguacuuaaugccgcuaaacaguacacuuaaaaauacaguuaaaauugcaaauuuggcugggccaaguggcucacaucuguaauccuagcacuugggaggccaaggcaggcagaucacuugagcccaggaguuugaggccagcuuuggcaacaaaguaaaacccugucucuacaaaaaauaaaaaaauuagccaggcacgauggcacacacuuguggucccagcuacucaagagugugaagcaggccaacugcuugagcccaagagauugaggcugcagugagccaugauugugucacugugcuccaacgugggcaacagagugagacacugucucauuuaaaaaaaaaaaaaaaaaaaggcuaauuuuacauuagguauauuuuaccacaauuaaaaaaaaauuaacagaauaccauaugacccagcaauuucacuucuagauauauauucaaaagaaaugaaagcaggaacucaaacagauaauuguuaacaacagaacuauuaacaauauccaauauccaaaaagugaaaacaacccaaguguccaucaagagauaaaaauggauaaauaggcuaggcgcgguggcucaacgccuguaaucccagcacuuugggaggccaaggaggguggaucaccaggucaagagaucgacaccauccuggccaacauggugaaaccccaucucuacuaaaaauacaaaaauuagcuggguguacuggcgcacaccuguagucccagcuacucgggaggcugaggcagcagacucgcuugaaccucggagguggaggguguggugagccgagaucgcacgauugcacuccagccuggcgacagagcgaggcucugucucaaaaaacaaaaaaacuuaagaaaaaggauaaacaaaaagugguauauagccaugugucacauaaagauguuucgguaaaugauggaccgcauauacuacaguagucucguaagauuagaauggagcugcccuacauagguguaccauuuuuuaucuuuuauacuguauuuuuaauauaccuuuucuauguuuacuuauguuuauuuucuuuuuucuuuuuuuuuaauggguacagacuuucuguuuggggugaugaaagauuuuggaaauagugauaugguuguauaacauuaugaauguaauuaaagacaccgaacuguacccuuaaauauggguaaaauggaaaauuuuguuauauuuauuuuagcacaaaauggggggcacugaacagaccccuuaccaaagacaacauauggaugguaaauaacuccuggaaaagaugcuaacaucauuacucaacagagaaacgcuaacuaaaacaaggagauaccuguaagaauggcuacacgucccugagaauggcuaaaauucacaaaaccgaacacaccaacuguuagcauuaauguggaggaauuggaacucucauaaacuucuggugagaauguaaaauuauaaaacuauuuccuuuuuuuucuuuuugagacagaguuucgcucuuguugcccaggcuggagugcaauggugcgaucucggcucaccacaaccuccgccuucuggauucaagugauucuccugccucaggcucccaaggagcugggauuacagacauguaccaccaggccuggcuaauuuuguauuuuugguagagacagaguucuccauguuggucaagcuggucucgaacucccgaauucaggugauccauccacuucggccucccaauccuuuuuuuaauuuaaccuucaucccucuccuccucucccucuuuugaaguccccagugucuagcauuucccccuuuauguccauguaugcucauuguuuagcucccagauacaaguauuuuagaaaauagcuuggcaauuuucaaaauguuaaacacacaucuaccacauaaucucuauccguuccauuacuaauuauuuacccaagagaaaagaaagcuucuuguacacgaauguucgcagcaauuuucacuguaauagcaaaaacuguaaacaugccauaugcccaucaacaggugaaugcauaaacaaauugugguaaauacauacaauggaauacuacuuagcaauaaaaaggaauacuacugauacauacaguauuuuugcugagugaaaaaaagccagauccguaagaguacauauuguaugauuuucauuuguauaaaauuccaaaacaugcaaacuuaucuuuuuucucuuuuuccaucccccuuaucucugaagcaaacuuaucuaucgugacagaaagcagaucaaugguugccuggggacaaggcaaguagagggaggaauuaccaagaggcacaaggaaacuuuuggggaugacagauauauucacuaacuuggaugcaaugauugucucacaagaauacauauaugucaaaacuguacacuuggccaggcucagugacucacaucuguaauccuagcacuuugggaggcugagguggguggaucaccugaggucaggaguuugagaccaaccugaccaacauggugaaacccuguuucuacuaaaaauacaaaauuagucaagcguggugaugcaugccuauaaucccagcuacuugggaggcugaggcaggagaaucacucgaacccaggagauggagguugcagugagcggagaucgcgucauugcacuccaggcugggcaacaagagcaaaacgccgucucaaaaaaaaaaaaaaaagaacaaaacaaacaaaaaaacuguacacuuuaaauauguguaguuuacugcaugucaguuauaccuaauaaaaaaugacuggcuugaaaacaaguaggcaagcaaucaauauuugcugaaugaaugaacaaaugauuagugcauucaggaaccaagacagcccuagaaagaaaggucagaaccagaucuggauggucugaacacaaggcuaacauucuuggauuuuauccuuuacauaauacauuucugaggcuucuggggaaaagaaagagauaucagugaaaaauauuaauauaguagcaggacagaaaauggacuggagauaagaaaagacucaaaccugagagaucagacagaaaguaauuaaauaaucuaagcaugagguaaccaauguucauacuucucuauuagcaugguaaugauaaaaacagaaggguaagacaaauauaagugaaacagggagauaauaacuaauugcacuuaaaaaucauugguauaggccagaggcagcggcucaugccuguaaucccagcacuuugggaggccaaggagggaagaucaguugaggucaggaguuugagaccagccugggcaacauagugaaaccccaucucuacaaaaaaaaaaaaaaaaaaaaaaauauauauauauauauauacacacacacacacacacacacacacauauauacauauacauguuuauauauauacauauauacacacacauauauacauauauauauacaaaaauagccgggcaucauggagugcgcugauacucccagcaacuugagaggcugaggcaggaaaaucucuugaaccugggaggcggaggucguagugacccaagaucacgccacugcacuuuagccugggcaacagagcaagaauccaucucaaaaaaaaauaaaaaauaaaaaauaaaaaaaucauugguauaaaguuuccaguuugagugacuagcagaacagaacaaaaagaaugaacuuagaaucgguuugagaaaauaauaugaauaaucugaucuugaacaaaguucaagaugcuagaaggacaagacauccaaaagucagugcugaaggaauagauuuaggagccauacacacagagaugauagcuaaagcugcuaaaguaaaucaaauuucccaaaguaggugaauacucccagaaaccucagaguagagaacgacagcaacaagaucuuaggaaauuaagaaauaaaugcauuuaaggggcaggaggaagaagauguaacaaugaaaaaauacagaaucaaugaggcauaagguaacaaccagagaccauaagcacaugggaccuucaucaaaagaaaugcgcccagauccagauucuaccacuuaauuaacuauaacggaguccaauuacuuaauuuaucuagcaucaguuucacuguuuauuaaaacauggguaaguguuaauguguauuaguugcuauuuuaacaauaaaauaacaccuuacaaacaaguagauauaguauuucauaauuucugaauuacuccuuagguuaucucauuuaaugccauaaccacccuguaaagcaaaucauaucugaauucuacagcugaagaaagaaggccaagaaagagugaaucucuuaguuuuagaaguaugagaacuaacaucauauuuaacugggucuucugcgcaugguacagugacaaagaacaggcuauagaguucuugaacuuaauggguucaaauccaguaccaucaauugugagcugugugacuagaaaaaaauuauuuaaguguuacggauaauacucuugacaaaggcauauguaucuuccuuaggcaagaauaaggaaacagaaauuuuuuuuuuuuuugagacgaagucucgcucugucgccaggcuggagugcaguggcaccaucucugcucacugcaaccucugccucccggguucaagugauucuccugucucagccucucgaguagcugggacuacaggagcaugccaccaugccuggcuaauuuuuguauuuuuagcagagacaggguuucaccauauuggucaggauggucucgaacuccugaccucaggugauccacacaccucagccucccaaaaugccgggauuacaggcgugagcuaccuacugcgcccagcugaaacagaaaguuugaggugaagagcaugugaccucuuugauuuucucaggaaaauaaauaauugaaggggaaugugaacaaggcaguuuucaacuaugcucuguagaugugcuauuggacucucgcauacacaaccaaaaucuuggacuuccucauuuuguuauuuuguuuuuuguuuuuuugagacagagucucgcucugucacccaggcuggagugcacuggcaugaucucggcucacugcaaccuccgccuccuggguucaagcgauucuccugccucagccuccugaguagcugggauuacaggcacacaccaccaugcccagcuaauuuuuguauuuuuaguagagaugggguuucaccauguuggucaggcuguucucgaacuccugacaccaugauccacccgccucggccucccaaagugcugggauuacaggccugggccaccgcgcucaggccaacauucaaguuuuuuuuuuuuuuuugagacggagucucacucugucgccaggcuggagugcaguggcgcucucucggcucacugcaaccucugcccucccggguucaaacaauucuccugccucagccucccaaguagcugggacacagguacaugccaccaugcccagcuaauuuuuguauuuuuaguagagacaggguuucaccauguuggccaggauggucucgaucucuugaccucgugauccaccuaccucggccucccaaagcaccaacacucaaguuuuaaagccacuagauuauauucaucucuagagugucuuguaauuguaagauuaaacacuuuuucucuaucuuacucaccaaacacauauaaaccaguccucuucugagccccacagcacuucuuuagugccuccuuaugauaccgcacauucuucaaaauaaacauucuaaacuccauucccucaauuagauuuaagcuccuucaaggcaggcaauuugucauuuaucuuaguauuccucaaccccaagcacagugcaagcaagcacuuuagggcaaaaaauguaaaauaaaaagauaagggaaaugguuaauccuuacaauauauacuauauauacuaacugcauguaaaaagaaauacaacuuacccuaauacagcugaaacaacacaguuuggagcaaugaggacacaggcgugcaucccgcaauuucuccauacaaaugaaacaucggaaaaccucagcaaugcucugaaaacaguaaaagauguaagguccaccaguuuaggcuacugaaucaagaguaaaaggcaagcucaaaacaacuugacauuuacauuuauuuugggcugaucucucaauuuuaacuauuccauaucaggauuugguuggucaagauacagaguaccucaaaacaucuggaaaauguacucccguuugguuucacgaugauucuauucuaaggaaaauauaggaaaugcaaacacagacaugcagaaaaauuuucacuaaagcaguaauuauaauggcaagaaucuagguacagcccaaauguccaaauauuaaguaaauuauggcaguuacacauagauuacagucaccagaaauacuucuucaucuaaugauauagaaaaaugcauauaauguauaacagcagggaaaaaaggcccaggcaugaugguucauuacuguaauccuagcacuuugggaggcugaggcagguggaucacucgaggucgggaguucgagaccaaccuggccaaaaugguuaaaccccgucucuacuaaaaauacaaaaauuagccaggcgugguggugugcaccuguaaucccagcuacacaggaggcuaaggcagaagaauugcuugaaccuaggaggcggagguugcagugagccaagagggugccacugcacucuagccugggugacagagugagauucugucucaaaaaaaaaaaaaaagaaaaaaggaaaaaaggcagacuauaugacugaauacacaacaugaacuuuuaacuuuuucugcaauuuccccaaaagguauaaacugauuuuauaauuuagaggaaaaagaaguuuaaaaagacacauccuaaaggcaguguacugugacccagaaaaaaaugaauucagaauccagaaaucugaauugcugcccugauguuacaacagacuagcuacuuauuugaaccugagauucugccccaauugaaaauguugacgguaguucaaagcgaucuugggaacaacaacaacaaaaauauguaaauacaagaaacaguauuauguuugcaagccucaauuuaaucaauuuaggaaguaacugaaaaguuuuuaacaagaaaaaggauacaauuaaacguauacuuauuguauuguauacuuuguuuuuauauuacugacauuuacuuucacuccauucuagaauuaaacccuccuaaaaccaagauaaguuuacaaaaccuuuauaauacuuuauaugaggaauuaaggagaaaauuacucauuaaucucaucaugacucuguagggccagaaagaaccugggagaugcagauucuguaaccugcaacgggguggacaauaagacuacugaaugacuaguuucaaguggaauauccauaacauaguuaccccuuacuaaaaagcaaggauuuccuauuucaguaucugaaagguucaaaauuugauaaugauuacacaauuauguucaauaaacaaucuuuuaaaauauauuccuagccuuuacuuacauauccuacauaucccaacuauuuuaacucacagcuuacaagaaucaguuauaaaaagaagaguuuguucuggaaacuacacaugagauaauauaugcugauucaaucuaggaaggaagggcagaagccugcaaaaugugccacugagagggaaagaugacuauccauuuggaaggagauuuagaucagcucaagaacucgcaaggacugguggcgaguggcaggguacauccaucugaugaaucugcaguuuuggucggaaaaggaugcuguuugcaaacacccgguggggaugaguaccugugccaagacauccuugaaaacuccaggauacgcaccaccugacugcggaacagugagcacaagacacccggagcgcugcagaaugggcacggcauccuugguaccgggccagcccucuccacagcggcaggggcgggguaggggugcccuacuggagggaggacaugggcacgacuccccgaauaaaaaccgcucaucgggugggggcggggacuaaccaccacccucacaacccccucaccuccacgcucuguucauccauugccuccggcucucggcggggccgcuggcgacccgcaggcuccgcagucugaccucuuaggcgccggcccgaggucgccagaucaaaucgccgauaaaagcccggcgcccacgucagggggcucugacaaccgccccaccugcgcgccccaucucuucagguccagcgccgccuacccccauuucgccauuuuuaccggcgcgcccgccccgaggcgcagaaguagggcgaacgguggccgcagcuccuuucucccggcucagccgccggccagcagccgcgccggaaccucggcccacgugacgcgggcgcgcgccuauggaacugacgguggaguucagcgaagaaggugccgcagagaauucgcaaacaccaaccguaaccagagcagcugggggcgcggcggcgagagaagcugcgaagcgcaugcgcgcaggacgcugu

SEQ ID NO: 192295 - RNA, 135379 nt, Homo sapiens
aucaguccgcauuccccgcacccacccacgucuucccgggagucguaucccgagcauggagguuacugagaccguuauuucuucauggccugccuagcuuaagcaguagcuggaaaaguaagcaacuaauguccccauuagugugucugggcuccugggguccugagaaggaggggcugggcuacacaagagcuccuuuugugguacagacuugggaagggguguucaagcagugguagugaccgccucuaaauuacagaacuucggggaggaaggcaagcaguuuagaaggugguuuaugaguuccuuccuugccuaggugaguguaacuuauuuagcaggggguaacuuauucccuaccuauuggcgauuuuuuuuuuuuuuuuuuugagacagagucucacuguguugcccaugauggagugcaguggcacgaugucggcucacugcaaccuucgccucccggguucaagugagucuccugccucagccucuugaguaccugggauuacaggcgcacgccaccaugcccggcuaauuuuuguauuauuauuagagaagggguuucaccauauuggccaggcuggucucgaacuccugaccucgugauccgccugccucggccucccaaaaugcugggaguacaggcgugagccaccgcgcccggcccuguuggcaaugauucuuagucuugacuuuucuucccagcuuagaagaacuuucuaaauauugcaaaucagagcccucuacauacuuagaucuaaaaaaggaaacaacguauguugagcacuuuagcaaaucccacacauuucaaauggccauagccaugccaaaaggaagauaaggacauggaagcucagcauauaguuuaauaucaauucugauaaaagaaaaaaagcuggccgggcgcaguggcucgugccuguaaucccagcacuuugggaggucgaggcagguggaucucuuugagcucaugaguuugagaccagccucgacaacauggcgaaacacugucuguaccaaaaguacaaaaaauuagccgggcaugguggcaugcaccggucgucccagcuacucagaagucuguggugggaggaucccuucagccugggagugagcuaugaucacgccacugcacuccagcuugggugauagagugaaacccugucucaaacaaacaaaacaccucagcacaguuuucuuaaagccaagauucaaaccuagcauccuuuuuacuaccccgagcuauuaagauuuugagucccuacuggcggggagaauacgagaagcauuuauaccccauuugguaggucaaagaaagucuuguaggacuggccaaaaugugguuggccacucaacccauugcuuaacuucuaauauggucuauauuugagcgcucaguggaugcauaaauacuaucuucagggagauuucaugcuuaugcuuauaaagcacccagauucuugggugaagaaaaaacaugguauuaccacauucaacaauaagucuucaguuaguuuggucaaacucaguggaaucagucguguuuagaauuucuuucguugacaguggaaaguucaaaacuacuuuggccuggcacaguggcuuaagccuggaauccaagcacuuugggaggccaaagagggcacaucgcuugaucucaggaguuugagaccagccugggcaacagggcaaaaccccaucucuacaaaaaauacaaaaauuagccagcauggugguacaugccucuagucccagcuacuugggaggcugaggugggagaaccaauugagcccgggagguugagguugcagugagcugagauugcguaacuccacuccaaucugggcgacagagcgagacuccaucucaaaaacaaaacaaagcaaaauaaaaaaaacaaaaaaacccccacucaacucuaucuauagcuguauaauuuaagugcuauuaauaucuucugcagaucacaaggucaggagaucgagaccauccuggcuaacaugaugaaaccccgucucuacuaaaaauacaaaaaauuagcugggugcgguggugggcgccuguagucccagcuacucgggaggcugaggcaggagaauugcaugaacccaggaggcggagcuugcagugagccuagaucacgccaccacauuccagccugggcgacagagcgagacuccaucucagaaaaaaaaaaaaaaaaaaucuucuggcccuugccuauaauaauuauuuucaucaucauucuuaagaugucuuuaaugcaauuugcucuguagucaugcuuucaaacugggauccagguuuuugaaaccacgcacuaggaacuaaacaaagcuaugggauaaauauggaaggugcaccuucuuguguaaucacuuuucucaaaaaaaaucuuucagggagggaagaguuaaaugauuuaccuaagucauuugaaaugguuuauauuaagcagacauuacaucuguguaguguggauaaaucauuaaaauuuuugaaaaagaaaauaaacuuuaauaaaacaugggguaggccgggcacgguggcucacuccuguaauccuagcacuuugggaggccaaggcggguggaucaugaggucaagagaucaagaccauccuggccaacaugacgaaacccugucucuacuaaaaacacaaaaauuagcugggcauguugaugugugccuauagucccagcuacuuaggaggcugaggcaggagaauagcuugaacccaggaggcagagguugcagugagugagaucaggccacugcacucuagccuggaaacagagagagacucccucuaaaaauaaauaaauuagcugagcgugaugucucacgccuguuucacagcacuuugggaggccgaggugggcggaucacgagaucaggagauagacuauccuggcuaacacggugaaaccccaucucuacuaaaaauacaaaaaauuagccgggugugguggcaggcaccuguagucccagcuacuugggaggcugaggcaggagaauggugugaacccgggaggcagagcuugcagugagccaagaucaugccacugcacuccagccucugugacagagcgagacuccaucucaaaaaaaaauauauguauagaaauaaaaacaaaauguggggguaaaaugcaaauauaaaaauaaaauuuaagagaaaaguaugaggucagagacacaucaggcuuaaacuggauacuucaguaaucucccaaaccccccccgggaauauguuuugguuuuucuugcaacuugagguuacuucaugaaaaaauuugagagacauugcuaugggcaaaccagcaugggcugcggagucacacagauuuggauuuguaucacaugucuggaaguuaccaacuaugugaccuucagcaaguuacucagucuccucaccugcaaguagaagauaauaucuccugggguuuuggucaagauuaaauuaacacauauacaguacuuaucacacaaaaaaguacauaauaaaucugagucuguuucucaguuuuuacagcauucuaaugcgcauauucaguuggaauaaauccuuauagaauaccuagcucagcagaaugcuaaugcugagacguuuuuuaaaaauguuuacaauuaggccagacacuguggcucacaccuguaaucccaucacuuuaggaggcugaggcuggcagaucacuugaggucaggaguucaagaccagccugggcgaugugguaaaaccccgucucuacuaaaaauacaaaauuaacugggggugguggaggguaccuauagucccagcuauuuggaaggcugaggcaggagaauugcuggaacaugggaggcagagauugcagugagccgauauuaugacacuguacuccagccugggcgacaagaggaaaacucagucucaaaaacaaaacaaaacaaaaaaagucuauaauuguaaaagugccgaaguagaguacuuuuauauauuuuauuuucuuugacuugauccacaguaauccuaugacuggggucuacauucaggauuagcacucugaagacuagaucacuaaaacaagauuaaauauugauuaaaugcuaguuaugugccagaugacaggguaaacaagauagauucucugcccucauggagcuuauaaucuaucaggaucuuuauugaguauuucugacauguugcauuucugacuuguguagcuaucuugauguaauucuaaggguaggaaggaccuauugcuguuaaugucuauaguuaaccugucagaguauuccaauaacgagacauuuucagguugacuaggcuguuucuggagacauaggagaggaauaauaugaaauuuuuguuauagcuggggagaaguuuauuuuuuuuuuagccuaagaacauagaacuuuaaaaaauggugaccacggccgggugcaguggcucacaccuguaaucccagcauuuugggaggcuuagguggguggaucacuugagaugaguucaagaccagccuggccaacauggugaaacccugucucuauuaaaaauacaaaacuuaggcagguguggguagagcacccgauucuguugcugaucagggcaccacucuguaacccgcacggaccuaugggcugaacaaaggagggcaaaugcgggaauaaaagacgagacaaaagaguauauuuggaagaaggggucaggggguaccuugccucuaguggacaagggcccugagcuuuacacagccuucuguauuuauuagguaaaagagauagugagaagggaggugggagaaggggucagcugcugaguccagaguaggcuugcaagaccgcauucucuagaugucgcaguggauaaccucagugccagggagugauugccuccagcaaaucuucugucagcaggagcagucgugaguuugcucacauccugcauucaugauuaacaguuugguguuugaucauagagccuccaguggaaugcugaguuggucacaucccaugggccuucagcucccuacaggugugguggugggcaucuguaaucccagcuacucgggagacugaggcaggagaaucuccugaaccccaaagauggagguugcugugagcugagaucccuccccugcgcucuagggugggugauugagcgagacugcaucucaaaaaaaaaaaaaaaaaaaaaaaaaaaaaaggugaccuuucauguucaaguggguuugggaauaggagaaagaagucaauguuguucagacugaggagaaaaaccucugaauaaaggcauagcuuuagaggugguuaugauaaagcuucuuuaaggccucagacauauauacuagcaguaucaauuuuacaggaccuuauacauaauagaagcccaauauguauuuguuguccacgacucuuugaaacauucucuuacuuggcuuuuuuaaugccacacuucugauuuccuuucuacauauuuggcuuuucuguuugcuuugcaagcacauccuccauaaccugggcauggcagugacucucaaauuuguauuucuagcccugacccucugccguccagaugcaaauaucuaauugccuacuggacaauucaaagucuccuccaacucagccuaacucauuaccuucaccccauucccagaaccuugcccucuuccugcauuuccugccuccaugaaccacauauccauccuuccauuugcauaagccauaaaccuagaaucauccuugacaccuccuucccuuucacucugcauaaucauaucucacugcaaccuugaacuccugggcucaagaaagagauccuucugccuuugccuccuaagaagcugagacuaacaggcacaugccaccgugccuagcuaauuuuuaaaaauuuuuguaaagacaagguguugcccagacugguuuugaacuccuggucacaaggacuccucggccucccaaaguucugggauuacaggugcgagccaccaugauccuccuggcaugaucuuuuuacaguacauuucaguuaugucacuccuuauuuugaucuuuuuuuuuuuuuuuuuuuugugagacagagucuugcccugucgcccaggcuggagugcgguggugugaucucggcucacugcaaccuccaccucccauguucaggcgauuguccugccucaaccuccugaguagcugggauuacaggugcacaccaccacacccagcuaauuuuuguauuuuuuuuaguagagaugguguuucaccauguuggccaggcugaucuugaacuccugaccucaggugauccacccaccucagccucccaaacugcugggauuacaggcaugaggcaccgcaccucgccuuauuuugcucuuaggauaaagaccaaauuucuuaauaaggcuuaaaaaaagcuugcauguuuuggccccuguuuuuccucuuuaccuucuuccuuuuccucuuucccauuugcuuccuauacuccugcuacuuuggccuuuucuuaguuccuugugugugcuagaccucaucccucaacaguguuugcauaugucuauaauauuaccucucccuccuucaccuaauuaacuacuauuuaucugucaaaucugacauucuuuuuuuuuuuuuuugacaccgagucuuacucugcugcccaggcuggagugcgguggugugaucucggcucacugcaaccuccaccucccacguucaagcgauuguccugccucagccuccugaguagcugggauuacaggugugcaccaccacacucagcuaauuuuuguauuuuuuuaguagagacgguguuucaccauguuggccaggcugaucuugaacuccugaccucaggugauccacccaccucggccucccaacgugcuucaaaacagguccuucaaaacuaggccaaaucuaauguauucaauuuuuguauucugacuuugguaacauguuuagaaggucuauacaaaauuauaaauggauuuuucauucguauuauuucuacauaugguuuagaucuacauuugaaucuuuuuuaauuuuuaauuuuauuuucuaaccauccauuccuucaacauuugacuauuuauaugauuuuuugggggacugaguuuugcucugucaccuaggcaugauuucugcuugcugcaaccucugucuugaggguucaagcaauucuuaugccacagccucuugaguagcugagauuacaggugugagacaccacgcccagcuaauuuuuguauuuuuuaguggagacaggguuuugccauauuggccaggcugaucucgaacuccugaccucaggugaucugcccaccucugccucccuauuaaucuauaugaguuuuuaaaaaauaagugguaggaggaagaaagcuuuuuauuuauuuauuuauuuauuuauuuauuuauuuauuuauuuauuuauuugagacagggucucacugucgcccaggcuggagugcaguggcacgaucuucucacugccaccacugccucccugguucaagugauucuccugccucagccuccagaguagcugggaacaggcacgugucaccaugcccggcuaauauggaagcaauuuuuuuuuuuuuugggacggaguuucgcucuuguugcccaggcuggagugcaauggugugaucucagcucacuccaaccuccgccucccguguucaagcgauucuccuguaucagccucccagauagcugggauuacaggcacccaccaccaugccucacuaauuuuuguauuuuuaguagagaugggguuucaucauauuggucaggcuggucucaugcuccugaccucaggugauccacccgccaaggccucccaaagugcugggauuauaggcucacgugagucaccaugccgggcggaagcauuuuuuuuucuuuccaguugugaccuaauuuucugagcagucuuugaaauaaucaguuccuuccccuucuauaugaaauguuaccuuuaucguauacuuuuauauauguagguccuaucgcucuguagccaggcuggagugcaguggcaccaucucggcucacugcaaccuccgucucucggguucaagcaguucuucugccucagccucccgaguagcugggaugacagggaugcaccaccacgcccagcuaauuuuuguauuuuuaguagagaugggguuucaucauguuggccaggauagucuugauaucuugaccuugugauccgcccgccucagccucccaaagugcugggauuacaggcgggaaccacuccaccugaccaagucucucuuuuuuuuuuuuugagcuggagucuugcucugucgcccaggcuggagugcaguggcgcagucucagcucacugcagaccccgccuuccggguucaagcaauucuccugccucagccucccgaguagcugggauuacgggcgugagccacuaugccuggcuaauuuuuguauuuuuaguagagacagguuuucaccauguugaccaggcuggucuugaacuccugaccucagguuauccgccugccucagccucccaaagugcugggauuacaggcguaaaccaccgcaccuggccaauucugucucuuuuuaaauaaucuacuagauucaguuuauaaagauuuuauauguuuacuuauguuaguauuuaacaaacauauauuuccuuuuuuuuuuggggggggggauggagucuugcuuugucacucaggcuggagugcaguggugugaucucagcucacugcaaccuccgccucccagguucgagcaauucuccugccucagccuccggaguagcugggauuacagacacgugccaccaugcccagcuaauuuuuguaucuuuaguagagaugggguuuugcuauguugcccaggcuggucuugaacucuugaccucaagugauucacccgccucagccucccaaacugcugggauuacaggcgugagccaccgugcucagccuuuccucauuuuugucuuuuuuuuuuuuuuuuuuuuuugagacagacucucgcacugucgcccaggcuggagugcaauggcgcgaucucgacacauugcaaccuuggccucucaaagugcugggauuguagguguuagccaccgcauccagcuccucauuuuuuucuaaucaaagaaaugaggcucuucucaaaggauauuaagguaugcaggaccucugugaggauuauaacaguaacauuuuucuuaacuugcuuagaguuacaaggcaguggaggacagacaucuuuuugccuaaggcugacucccuugaacagauauuuugauaacuaggccaauagcaaugaaauuuuugugaaacauugaaacugggacuugugaggauucaugagccacuuaagacucuguaggcugggcagccgggcaugguggcucacgccuauaaucccagcacuuugggaagcugaggugggccuguaaauuaucaacauuuuguuuugugaaauaaaacacacuuugaaaucugguuggaggaguggucgugguggcucacaccuguaaucccaguacuuugggagguugaggcagguggaucauuuggggucaggaguucgagaccagccucgccaacauggcaaaaacccaucucuacuaaaaauacaaaaacuagccgggcaugguggcaugugcuuguaauuccagcuacucaggaggcugaggcaggagaaccgcuugaaccugggaggcagauguggcagugagcugagauggcaccacugcacucuagccuggacgacagaguaagacucugucacaaaaaaaaaaaaagaaagacucuguggccugggcauggugguuccaugccucuaaucccaacugucugggaggcggagacgggucaauugcuugagcccaggaguuugagcccagccugggcaacauggugaaacucccucucuacaaaaaauacaaaaguuagccagacaugguagugugugccuguagucccagcuacucaggaggcucacuugaccccugggggucaaggcugcagugagcugugauggugccacugcacucuagccugaagaaggcacugcuagucacaaaucuucugaaacuggcauuuugguuguaagaauuguuuggugguaauggcaguauaguucacauacauuaccuuuucccuuacaugaguuguuccaccagauuucuuuuuucuuuucuuuuuuuuuguuuuuuuguuugagacaagaguuuccugcugucacccaggcuggagugcaauggcaugaucuuagcucacugcaaccucugccuuucagguucaagcgauucuccuucaucagccuccuggguagcugggauuacagaugcacaccaccagauauuuuuguauuuuuaguagagacaagguuucaccauguuugccaggcuggucucgaacuccuggccucaaaugauccaccugccucggccucccacaguacugggauuacaggugugagccacugcgaccagcccuccaaccagauuucaaaguguguuuuauuucacaaaacaaaauguugacaauuuauagagcauacauauacauauguguguauguauauauauauuacauaauacuucuuugaaaaggaaaguauauaaaaauaaaacugauagacugucagaacaucagacuugagaacaagugucugguugcaucacagaauccccuaccuccuugucccaauauucuuuuucuccccaucuaagacaccucuauguucucaguuguugcuuguuuagcaagauuuuuauuuucauuuuuauuuauuuaucauuagagauggaguuucgaucuuguugcucaggcuggagugcaauggcacagucucggcucacugcagccuggguucaggcgauucuccugucucagccucccgaguacccaggugcccaccagcaugcccggcuaauuuauuuuuaguagagaggguuucgccauguuggccaggcuggucuugaacuccugaccucaggugauccacccaccucagccucccaaagugcugggauuacaggugugagccacugcaccuggcccaagauuuuuaaaacagcauuauuucuuccuuuuguaaagauggaaaaccgugagcuugaagucagugacaaggaaaaaaaaguuauaaacucuggcuaauuuauuuuggcagaagagaagauaccagaagaguccuucuguaaaauaaaagaugugggauauuagggugguucuagugugaucuuggaaagacaauugaagaacacuguuaacucugaaacuccaauucuaauuuguuuuuuugguuuuugugggguuuuuuugagacagagucuugcucugucgcccaggcuagagugcagcggcgugaucucagcucauugcaaccuccaucuccuagguucaagagguucuccugccucuugaguagcugggauuacaggugccugccaccaugcccagcugauuuuuguauuuuuauuagagauaggguuuuaccauguuggccaggcuggucucgaauuccugaccucaagugaucugcccgcauuggccucccaaagggcugggauuacaggcaggagucacagcguccggccugcuucauucaaaauuagaauuagcguuugugcaauugaucuuucaaguaagauugaucauuugcugcauguuugaaagacagcauuuuguauguaagcaugacacuuuggacugguagguaaccuauacagagauuggauuuucagauauguagacuggauuuucagaaauaauuuuaccaaauuucauguuuucaaacuuacucagguuacguguauagcagcuuguuuaacugcgcaagaaagccgugcgcgccuguuuuugcagcugcuggggaagacugaaacaggaaaauccccugaggccagaaguucgauaacuacuguaccccagccugggcaacaaagcaagacuuugucucuggggggaaaaaaaaagaaaaaagacaccauaguggcaucauuagugccaaacccuuaaaggcaggagcuaguuuacguuauuuaccuuuuaaucuguagagcauuuuuaaguuuuauuucagucgugucaccaagcauacuaggaaaggacauacugaaugagaucauccaaagggguguggaguauguagauaagcgcagugacugcuggcuauuugcacccuaggcuuauauuucuuaagauuuugaauagccagauauuaaaaauacaggugcuggguuauuguaguuuggaaaauaucuuuauuccagaaauuagggggucuaaagagcacaugagaaaaaugauccuauauuuagagugguuugaaucuaagggugaacucucaggcagcgcuggggacucauacuuaacuggcaagggaaauaacaugaucauuaaagguggauuuuucagggugagguuugucucuugcauuguggaugugcugaccccugugguuuucuacaaaugugggaaacuuaauugcauaauuugugguaguggggacuauguugguucucuccccugaucuggcuuguuuauaaaaggcguacguuguaucuuugcuucguagguuuuccuguguuauauuguaaccuccuguuuuggaauagcgagagauugaugccuucuaauggucauuuuuuucuccacacacgcuuuuggucucacaccccucgugguugguguugucauugaguacuacagugauuugccauuacaaucagaaguacgcaguugaauaccuuuggcggcucuaagggaguguuaccuucacauuuuccuuguuuguagcccuuuccuuuucaaagcuaacaauuuagcaucuucugacuuuucuucugucuuuauaucuuuuuguggaccuccagaguccuucuguuuuuuuucuuuucuuggagacggcguuucgcucuuguagcccaggcuggaguacaauggcgcaaucucagcucacagcaaccucagccucaaggguucaagggauucuccugccucagccucuugaguagcugggauuacaggcacacgccaccacgccuugcuaauguuuguauuuuuaguagagacgggguuucaccauguuggccaggcuggucucgcacuccuaaccucaggugauuuaccugccucggccucccaaagugcugggauuacaggugugagccacggcgccuggcuccaguguccuucucuuuuauuauuauuauuauuauuauuauuauuauuauuauacuuuaaguucuaggguacaugugcacaacgugcagguuuguuacauauguauacaugugccauguugguuugcugcacccauuaacucgucauuuacauuagguaugucuccuaaugcuaucccuccccguuucccccauccuaugacagacccugguguaugauguuccccaccccguguucaaguguucucauuguucaauucccaccuaugagugagaacauacgguguuugguuuucuguccuugcaaaguuugcucagaaugaugguuuccagcuucauccaugucccuacaaaggacaugaacucauccuuuuuuauggcugcauaguguuccgugguguauaugugccacguuuucuuaauccauucuaucauugauggacauuuggguugguuccaagucuuugcuauugugaauagugcugcaauaagcauacacgugcaugugucuuuauaguagcaugauuuauaauccuuuggguauauacccaguaaugggauugcuggaucaaaugguauuucuaguucuagauccuugaggaaucgccacacugucuuccaguguccuucccuuaaggacccugugauuacauuaggcccaucuggauaagcuuuucaucuuaaaucaaucacaucuaaaaacuucccuuuuuuuucccccuugaguuggagucucgcucugucgcccaggcuggagugcaguggcaccauaucugcucacugcaaccucugccuaccagguucaagcaauucuccugccucagccucccgaauagcugggcuuacaggcacccgccaccaugccaggcuaauuuuuguauuuuuaguagagaugggguuucaccauguuggccaggcuggucuugaacuccugaccucgugaucugccugccuuggccucccaaaguguugggauuacaggcgugagccaccgugcccagccauuucuggcucuuaaacuuuggaaaagucuuuaucuuguaaguagcaggcuagaacuugugcaagaagagugacccuaugugaagaguguuuugaaucugagggugagaugucaggcaacaaccaugccuuccacuuuaccgggcagggaagauacccugaccacaaaggugguuuucccagggcaagguucacucauugcauucuguguuugcuggccccugugauuuccccaaaugugggauacucaacugcauaauuugugguagugggcgacuguguucacacuuuccccuguguuauucuuugucaaaugggaaguagccaaugugauugucuguggccguguuuggcuucuccuugcuuguuucuugugaacugugucuuuaaauuuccauggaagugagaagcuguacuacuauuuaguuugugauaguaacaggcuuccuugguguuuuuucuuggcuguguucccuuaauccagcauaaacuuuguacacaaugaguaccacauauauguuggcugagucaaaugaacuggaaaucaaacucaggaaggauuuccuuuaagcauuuuuauuuuuagagacagggucuugcucuugucucccagacuggaguacaguggugcucaaucauggcucaaagcagccuugaccuccuggacucaguccuucugccucagccuuccaaguagcuguacaggcaugugccaccacggcuggcuaauuuuuuuuuuuuuuuuuuuuuugagacggaguuucccucuuguugcccaggcuggagugcaaugguuugaucucggcucccagcacccuccaccuccugaguucaagcgauucuccugccucagccuccugaguagcugggauuacaggcacccgccacaacaccuggcuacuuuuuuguauuuuuuaguagagacgggguuucgccaugcuggccagacuggccucaggugaucugccugccucguccucccaaaguacugggauuacaggcgugagccaccccaccuggucagcuggcuaauuuuaaaagaacuuuuuguagcauagggucucgcuauguugcccaggcuggucucgaacucuuggccucaagugauccucccaccucggccucucaaggugcugggauuacaaaaaugaguaccauaccuggccccuaaaggauuuuaaccugcucuuaacaaugacuauagaauugaaauucauucauugcauucuaaaaugacuacuuugaaugaucaccuuuagguucugacauaguaguuuguugguuuuguuuuguuuuguuuucuuuuguuugagauggaguuucacucuuauugcucagucuggagugcaauggcaugaucuuggcucacugcaaccucugccucccagguucaagugauucucuugccucagccucccgaguagcugagauuacagacgccugccaccacgccuggguuuuuuuguguuuuuuuuuguuuuuuugguuuuuuuugagauggauuuucucucuuguugcccaagcuggagugcaaugcugugaucuuggcuuacugcaaccucugcccccaggguucaagugauucuccugccucaaccuccugaguagcugggauuacaggcaccugccaccacgccuggcuaauuuucuuauuuuuaguagagaugggguuucaccauuuuggccaggcugggcuugaacuccugaucucaggugaucugccugcgucagccuuccaaagugcugggaucacaggcgugagcaacugcaccuggccgacuaauuuuuauguuuuaguagagaggguuucaccauguuggucaggcuggucucgaacucgugacuucaggugauccauuaaccucagccucccaacgugcugggauauacaugugugagccacggcaccuggcccauaguaguuuuaaaaagggaaaagcuuacauacuacuaugauauaucaauuuaaaaaugcaaaaaguccagacucaguggcucgugcuuguaaucaccguaccuuuggaggcccaggcgacagaacaagaaccugucucuaaaaauuaaaaacauguuuaaaggaaauccuuuuggaaaugcuuccugaguuugauuuccaguucauucaauucagccaauauauaaugggguacuuauuguaaacaaagcuuauucugggugaggggaaugcagauacccuuggaacauaguccuugucauaaucaggagucugucuggggaagggagauggggaaaccaucuguuaauauuauaccauacaauucacccauuuaaaagauaguuugauuuuuagaaagagccagagauugucuggagacuuuuuuaugugaacauaaccccaauauuguauugucuucauuauaaaacaaaagaugacacuuagaacuggauaucauuuggcccuuucucuucucaucuccucucacuucaaaaugcuuacaucucuuaauacccagcauucucuuuguucugcaguugggcucaacacacucaaggcuuggcacaaucuucuuuguaguuuuagcuuuuuucgggaaaaucaacuaguuugcccacccauagccagauacuugucauuuugauucuagcaaucauagugagggugaagugguauuucauggugauuuugauuuguauuacccugauggcuaagaauauugaacauauuuucgugugcuuauuggcuauuugcaucuuuuuuuuuuuuuggagaugguuucccugugucauccaggcuggagugcaauggcacaaugucagcucacugcaacuuccaccucccaggcucaagugauucucaugccucagccucccaagaagcugggguuauaggcaugugcuaccaugcccagcuaauuuuuguguuuuuuguagagaugggguuucgucauguuggccaggcuggucucaaacuccuggcuucaagugaugcacccccccucagccucccacagugcugggauuacaggugugagccaccgugcccggccuaccugccuuuuuuuuuuuuuuuccaaaggccucaucgaagauaaaucuuuuuuuuuuuuuaaccacuuuauugaaggauaauugacauacuauacuugugcuuuugaugucauauguaagaaaucauucccuaauuggaggucaggaagauuuacaucuauguuuucuucuuaguguuucuauucguuuuuugagauggauucucacucugucacccaggcuggagugcaggggcaggaucucggcucacugcaaccuccgccucccagguucaagcgauucuugugccucuccgucucgaguagcugggauuacaggccugagccaccaugcucagcuaauuuuuguauuuuuaguagagacgggguuucgccacguuggccaggcugguugugaacuccugaccucaagugaucuguccaccuuggccuccuguagugcuaggauuacaggcgugagccacugcgccuggccggacuuucaucauaaauaaguuauucucacuccugugaaaaggauguggguucaauaggauuaguuugugguucucaauucugucaaaucaaggguuuccuuuuuuuuuuuugagacagagucuugcucugucgcccaggcuggagugcaguggugcgaucucggcucacugcaaccuccaccucccugguucaagcaauuccccugccuuagccucccgaguagcugggauuauaggcgcaugccaccacacccagcuaaauuuuuuguaguuuuaguagagaugggguuucaccauguuggccagacuggucuugaacuccugaucucaggcaaucugcccgccuuggccucccaaagugccaggauuacaggugggagacaccgcacccggcccaggguuuccuuuuauaagaacuaguaacauuccauuuacuaccuugaagauguuuguagaaaauauaaacuacauauaguuaccccacagauaauauguccuaacuauaauaugaaggagagaagccacgugggguggcucacgucuauaaucccaggacuuugggagggugggaggaucgccugagccaagaaguuugagaccaagcugggcaacauggcuuaaccccaacuguagaaaaacaaaaaaaagauugaaaaaauuagcugggcaugguggugcaugccuguggucccagcuacucgggagggugaggugggaggaucaccugagcccaagagguugaggaugcagugagcugaaauugcgugacugcauuccaaccagccuggguuacagaacaagacccugucucaaaaacaaaacaauacaaauauaaaggagagagaaaaauaaguuacaauacaauuauuuauuuauuuauuuauuuauuuauuuauuuauuuuugagauggagucucacucugucguguaggcuggagugcaguggcgugaucucggcucacugcaaccuuugccuccuggguucaaccgauuuuccugccucagccuccugaguagcugggacuacaggugugcaccacuacgccuggcuaauuuuuuauauuuguuauuuuuuuuuuaugguuucgccauauuggccaggcuggucuugaacuccugaccuuauaauccacccaccucggccuuccaaagugcugggaauacaggcauaagcuaccgcgcccugcccuacaauacaauauuuuaauauguaaaggcuuggcaugacuacccagggaaacaaaaacauccccucagaguuucaaaauuucccuuugggaguggcuccacugucauggagaaccacucaauuguaagaaauuuuuuuuaaaaaaaguauguauaaaaggaaugccggcugagcgugguggcucaugccuguaaucccagcacuuugggaguucgaggcuagcagaucacuugaggucaggaguucaagaccagccuggccaacauggagaaaccccaucucuacuaaaaauacaaaaauuagucaggcaugguggcacgcaucuguaaucccagcuacucaggaggcugaagcaggagaaucgcuugaacccaggaggcaaagguugcaguaagccgagaucacaccauugcacuccagcccgggugacagagcgagacuccaucucaaaacaaacaaagaaaaaaaggaaugccgacuggguaugguggcucacaguuguaaucccagcacuuuggguggccaaggaguucgaggccagccuggccaacauggugaaaccccgucucuacuaaaaauacaaaaaauaaaaaaacauuagcugggccugguggcgcgugccuauaaucccagcuacucgggaggcugaggcaagagaaucauuugaaccugggaggcagagguugcagcaagcugagauugcaccucugcacugcagccugggugauagagcgagacucugucucaaaaaaaggaaugccaaguagcagugaggauguaguugcaguuugcauaaauuuggaguauuuggaguaagagugcuggaagauucugcaacuuuuuuucuccagcagugcuggggaaaugggaguagaggagaugacuguugauuggcucuaggaccaguuagagcaggggauuccaacccccuggaaggagcaugguaccaguugguggccuguuaggaacuaggccgcacagcaggaggugaugucauuacugccugagcaccuccuccuguuagaucagcagccacauuagauucucauaggagcgugaaaccuauugugaacugagcaugccagggaucuagguugcacacuccuuaugagaaccuaacuaaugccugaugagcugagguggaacaguuucauccugaaaccauucccacccacccccuguuauccguggagaaauggaaaauugucuuccaugaaacuggucccuggugccaaaaaguuugggagccucuaagauagaggaaauacgcugugcugcagcaugaaguaggugagagauggggcuaggggccuagugagugaaauggcguggaaagucuaaaggauuagaugaauugagggaugagcuucucuggcagugaguagaccugagguccagggaaggcuuuuguaagcucaaaacauguaaaauggugagaaaauagaacaagaaaacgaguuuuuaaaauauauuucugaucuagcaaaaagagaaauccacagagacccagagaaagaaacaaauccagaaaggaaaggcagggauggacccugucuauuuccuaaggacauuggccauccuuagaagcucuggggcuggcuuuuaauggaccacaggcaggagacaaagcuuggggccugagcugggugggaggucugacuagagagucccuccucauucuauaaagcugcgaccccaggagaagaacacucucaguucugaggaaugcccccuccccaagagaaagauguuagagauaugugcuggucucagccucagccugagaaugggaaggggcagagaaaucuucaccacuaucucacauucacagucccucaaaaugggccagaauucauacugcuauguguauauguuaggggauggcacaaaaaguuacuuuagccuggcuuggugaugucccccagcaccaggcagaaacaaaagaaacccucucuagucuauucauuucucaaaaugaaacuacaauaauugaaauaauaaucuuagugaauggguuaagcagcagacacugccaaagacagaauuagugaagacagaucugaaaaauuacccaggauguagcucaaagaaauauagagaugggaaaaugcaagaaaguuucaaagagauagagaauagaaugagagggucaagauaaaugcaaugagaguuccagaagguggaguggaagcaauauuuggacauguaaugguaaucagugucccaauuguauauauuuauuguguacacguuguuuugaaguauuauacauuguggaauggcuacagggagcuaauuaauauaugcauuacuguauguacuucuaucauuuuauugugguaaagaugcuuaacauaugcuuucaggaauuuucaagaauauauuaaguauagucacuuuuuuuuuuuuuuuuuuuuuuuuuuuuaagagggagucucacucugucgcccaggcuggaguguaguggcgcaaucuugacucacugcaaccuccaccucccggguucaagcaauuauccugccucagccucucaaguagcugggauuacaggugccugccaccacacccagcuaauuuuuguauuuuuaguagagauggguuucuccauauuggccaggcuggucucaaacaccugaccucaagugaucuacccacuucagccucccaaagugcugggauuacaagcgugagccacggcuccuggcugaauuuaguuucuuggucccugauccuuauucuuaccuucccaaagcuguuuguuguuuuuuuuuuuaaucuucccaaaguuuauuuaggcuucucacacuccuuuucuaucacauuucuuagcuuucuaaucauuacacacacacauccuauagauagauggauagauaggcagaaaucuccaugccagguacuuugcuagccugagacuccagcagugacagaugaaaacucucagguccuucgacagucuguagucuagcccaggaaacugacugauaaucacacaguggaauaaugaauggacugaagauaaagacuaaaagagaaauuaaaggacucuuacuaugauaacagagggagcucagcgugggaagagaaguuagauuugucaggagaggcaggguaaaaacauuuuaagcaaggggaacuacacaggcaaaggcucugaggcuggaaagaggcugcggcuguagcuguggcugccacggcgguaugguggacaguacaggcaggcuggaaaagcuauggagccagcccaugcagagccucaaggagcgugggauggaguuggugcuuuauccagagggcaguaaggaguauugaagggcuuugggcaagggaguaacauuagauuagagcagcaccaaugcuccuuccugacauuuuguuaacauguauucacaugagggugcuucuugcuaaaccucaaugaagucucaagcuguugcuggcuuuuuuuuuuuuuuuuuuuuuuugagacggagucucucucuguugcccagucuagagugcaguggcgugaucucagcucccugcaaccucugccucccagguucaagugauucaccugccucagccuccugaguagcugggauuacaggcaugcgccaccacaccuggcuaauuuuuguauuuuuaguagacaugggguuucaccauuuuggucaggcugguuucgaacuccugaccucaaaugauccacuuaaccucggccuccgaaagugucaggauuacaggcgugagccaccacgcccagcagcuggcuuguuacauucuuuagccaucgucuggugacuuucagcaaauaugacaaacuccucuccacacccccuccuguuuuuuuuuuuguuuguuuuugagacagagugucgcucuuucgcccaggcuggagugcaguggcaugaucucggcucacugcaaccucugccuccuggguucaagccauucuucugccucagccuccugaguagcuggaauuagaggcguguaccaccauaccuggcuaauuuuuguauuuuuaguagagaugggguuucaccauguuggccaggcuggucuugaacuccugaccucaggugaucugcccaccucacccucccaaagugcugggauuauaggcaugagccacugugccuggcauugucucccccuuuuuuacacaauacagauguaucccuaauccuccauucauacaguguugauaauugccagguuccauuuuuuaugccuaccuagaacagugguucucagccuuuuuuucuaauuugauauauacccggaacaaaugacacucacuugccagaaugucuccacccuacagcuucucaaacugugugauguaauauauugaccccccaguccucagggccuuuggguaggauguuagggugggugacuagagcccuugggccaguuaccucgcauagcaguucaccuaggaugccacaugcuuucugggugauccagauuauuuucuguagaugucacccuugucugugugugcauaaaaauaaaaaaaagaaguccucucuggggaugacuacauggauuuuaauuccuucucuaccacuugggcacauuucagccucccuuggccucaguuuucucauaugcaaaauggagauauuguguacucuguagaauuguugaguggauuaaaugaguuaaggugugugaaguucuucucccugugcugggagcacccugagccuucagugggcauuggcuaagaugauucaguagacagucaugacuggacccaggcuccaguuacuuccuccacauuugcagggguuuauaguuacugcagcuccuccaggcacaucaguagaagaggcuuugguagcugggagaggugcacuuuuuugcuguaaggaugacuuuguucaggaccaucaggauagguauagagaccgcugcaauggggucuuguaguggaggagaaagacugggcacaaguccaaaguacagcaugggcaaaugggaauuuguagccaaggagcaguguggaggucagugguuagaaaauuaccaagaggaaacaucagggguaagaggaauucuggcuaaacugaucuaacaggauucuugcugaagacaggcuggggugaucagauaucaccugggggguggugcaggaugaggaaccugaucagauuuggagaauuuggguuucagcuaaauugacuuagcaggguuccuuuacuaaaacuggauuuuacaagaacaugcacagacuggccuaugagaagguucagaagccugaauaagguuuggccaagcaaacaagaaaagaaucuuuuuuuuuuuuuuuuuuuagccagagucucacucugucgcccaggcuggagugcgguggcaugaucacggcucauugccucacugcaaccuucgccucccggguucaagcaguucuccugccucagccucccaaguagcugggauuacaggcacuugccaccaugcccggcuaauuuuuguauuuuuaguagagacaggguuucaccauguuggccaggcuggucucgaacuccugaccucaagugauucgcccaccucagccucccaaaguguugggauuacaggcgugagccacugcacccggccagcaaagaaucuuugucaugccucagguucuuuauccaugaaauggggaugauuccauuuccuaccucaacguugugaggauuaaccauaaaguccagaugcaugguaaacaguagauguuagcuguuaguauuucuugguuugcuuuaggguuuuuauuggguugccugacucacauguuauaauuaugcuuuaagguuuaagcuguucguuaauguauuuguuuuagucuucacaaaaacuccuccaaggacaguaaugcagguuuuacaaacugaggaacaaguugaggccauaagcucaucgaaagucuugcauugugaacgcuauauugcaguccagaucuuggauuccaaaacccuccacucugcaguacagccugcuagcaugcccuguuccccuucuuggaauaagaggaaaugaugccggggugguucacagcguggguaucccgugacuaaaaguucauucacgucuguuagcucaaggaaacucuccauacagggagauccgaaggccuuaggcuacgccaaaaguagugagguggugcguuuuugucaggaaaauggccugacagacgucacuugcauugacgcgagcaggagaaggaacugcugguuggaagcgggccgagaugagaacgcaguugcgcucucugaccagccaggccuaugcaugacgucacgccgggagguggaguauguagauuaaagacugcauuuuggaaacgcguuccuuggaaggauuugcacaacucuguuaccaacaccaagauauaguauaaaaaaucuguuuauuuuguucacuauauguggauaaaguccaauuagagucauuucaggaguuacccgcacuugcaaugaugugggcggcaccggggauugcuggggucacgcaaguaccucauaauuaccugucaggagaaauacugugauuauggaggugguuuuucccuguguguggcuuauucguugcacuuugugcugaucccuacgauuuccccaaauguggguaacuacaguguauaauuugugguagcgggagauugcguucgcacuugcugcugguugugguaguugaaaugcaaguuuuguuaguuguguauuagcuuuugcuuuuuuuuuuuuuuuuuuuuuuuuuuuuugccguggaagguuuguuucacuuuguuuaucuaggcuggagugcaguggcauccgaauucaugcgcucagccuucuuugguuguuuuagguuuugccuuauuuauuuuuuugggacacagucuugcucuauuuuccaggcuggagugcaguggagcaaucucggcucaccgcagccuccaccucccgaguucgagcuauucucgugucucagcuucccuagaaacugggauuacauuacaggcaugcaccaccaugccuggcuaauuuuugcauuuuuaguagagauggcgucuuaccauguuggcaaggcuggucucgaacucuuguccucaagugauccacaccuucagccuccuaaaaugcuggaauuacaggcgugagccauggcacccaauuuuuuuuuuuuuuuuugagacagagucucgccgucucccaggcuggaguugaguggcacaaucucggcucacugcaaccuccgccuccuagguugaagcgauucuccugccucagccuccugaguagagcugggaauacaggcacccgccaccacgcguggcuaguuuuuuguauuuuuaguagagacgaguuuucacuacguuggucaggccggucuugaacuccugaccucaugugauccacccuccucggccucccaaagugcugggauuauaggcgugagccaccgcgcccagccuuauuuuuuuuuuucauuguuucuuuugguucuuaagaaugcuuugggguugcaggguuguuaccguugcuuacuguuuaaagcuguaccuugcuaucauuuaaugcuuaggaacuuuagugagguaaacgcaaugaguuguggguuuuuuuguuuuuuguuuuuuaugagacagagucucacccuguugccuaggcuggagugcaguggcgcgaucucggcucacugcaaccuccgccucccagguucaagcaauucucaugccucagccucagaguagcuggacuacagccacgcaugaccacaauaagcuaacuguauuuuuaguagaggcaggguuuaggcaaguuggucaggcugaucuucaacugcuggccucaagccauccugccucagccucccaaagugcugggauuucaggcaugagucauugcacccaggcaaaacaugauaauaaaguuaauuucaugugggccgggccugaugacucaugcuuguaaucccaguacuuugggaggcugaggcaggaggauggcuugagaccaggagcucaagaccagacugggcagcauagcgagacccuaucucuauaaauauaaaauaauaaaaauaauaauauagcuacuaaaaauguucaacugaauaugucgaauguugcccacaucauauuccacuggacaagcagugcucuaacuuaaucuguuuccuuauuuuaaaguuuccagagagccuugcuguauuacuuccacaaacuuacaugccugcucuuccuggaaugcacuucccugcccugcccuucuucaucuaccuggaaaacuuauacuucagcccuuccaaacugccugggauccacucagugccacugaacccaggguggccuuaucuguuacguaccacaggcacacugccuaggggcacuucuuuuaaaaaucagaagaaaaaaaugaauuuuuagguggaagaaaaugucauauauaauaauauauucaucuuuuaaucaaugcagucauaagauagcauuuuuaacauauauuuuaauggaaauguauauauuuuaucagaggaggcaggcacacaaaggcaaaaguaugggcccuucaaaaucguaauguggcccugcugaacuuuuuauaggucuggcaagucuguuuucccuacagacuaugaucuuauuuauugcaggcagacucagucucugcauuauuccucuuaguauccccaguggcuaggccagcggacuggaccuugaacauuuaaguggcugucaguaaaugagaaguaugugcuacauguaaguaaugacuugagaacagguguuuuucaucauuagcagcaaagaaauucaagaauaugaauggcaaaaauacuggaguagacaauguggucaucagaaauggaguucucccagcauaggaaaaagggucuguuaguaccugugauaucagagccaugagggggcacaaauaaucauagaggccucagagcuguggucagccuggcauucauggauaccauugaaagccaaaguauuacuuuccucaugugaaaucaaaccuucuggaauaaaauuaggaagguaguucaauaaugagauuauauaguauaaccgaggugggcugggucacacuuuguggaugaagguaauccagcaauuguccuaaaucagcaauuguacuaaauaguguggaguuggguuuuugcuguuguuuuuuuguuguugcugggggagcgguuaagacagggucucacucucacuaggcuggagugcaguggcacaacacagccuccaccuucccaaacucaggugauaucagcaccucggccucccaaagugaugggauugcaggcaugagccacugccccuggccuaaauagaguuaguaugguuuuuauugcagagcuuuguggcugagaaaugcagcuucagggccaguguguuucaggagugaauggauuuggcuccccacaacucaggguguugaguaagacauuuaguggccuggcacauuggcucaugccuguaaucccagcacuucgggaggucaaggcaggcagaucaccugaggucaggaguucaagaccagccuggccaacauggugaaaccccaucucuaccaaaaacacaaaaaauuagccaggcgugguggugcaucccuguagucccaguuacucaggaagcugaggcaggagaauugcuugaacccaagagauggagguugccgugagccaagaucaugucacuacacucuagccugagugacagagugagacucugucuuaaaaaaaaaaaaaauuuagauucaguuacauuggcauuaaugacuuuuuuuuuuuuuuuuuugagacggaguuuugcucuuguugcccaggcuggagugcaguggugugaucucggcuuacugcaaccuccgccucccacguucaagcaauucuccugccucagccucccaaguagcugggauuacaggcaugcaccgccacaaccggcuaauuuuguauuuuuaguagagacaggguuucuccauguuagucaggauggucuugaacucccgaccucaggugauccaucugccuuggcuuccaaaagugcugggauuacaggugugagccaccaugccuggccaacauuaaugacuuuucuuuuuuuuuuuuuuugagacggagucucacucugucacccaggcuggagugcaguggugccaucucggcucacugcaaccucugccucccggguucacaccguucuccugccucagccucuccgaguggcugggacuacaggugcccaccaccacgcccggcuaauuuuuuugugcuuuuaguagagacgggguuucaccauggucucgaucuccugaccuugugauccacccgucucagccuuccaaagugcugggauuacaagcgugagccaccgcgcccggucacauuaaugacauuuuaacagucacaacugcuuugugaacuuauguaacaaaacucagcuuuuaaaaauuauugaguauauaugucacucucauauuucugagcaucaacccuuccuuccuugacucccaugaggcaaagugaugguuggaaauucagagaugaggugagacucacaaacugaggggcaugucuuaggacagcacaccugaguuggcaggaacagccaugaucugagauuaauaguugugccuguugcugcccuuccccacacguaagggaacucuccaaauaacauucuguacugaggggcuguguuucuccaucucaacuuauuuggggucuuugauuuagucauaauuuggucauguaguugguuugauucugugugugugugugugugugugugugugugugugugugagauaugugugcuauauaucuguacacacauaauauguauuauguacaagcaauucuccugccucagccuccugaguagcugggauuacaggcacccgccaccacgcccagcuaauuuuuuguauuucuaguagagaugggguuucaccguguuagccaggauggucucggucuccugaccuccuaguccgcccaccucggccucccaaagugggggauuacaggagugagccaccgcgccuggccacucaguaauuuuugaaaacugaguuuuaggccaggcgugguggcucacgccuguaaucccaguacuuuuuacaucauacauacacagauauagacauacaggaacacucgguuuguuaccaaauccgggccugaugcuacuucccuguguggcaggaacugcagauacuugaaucuuggcaaagucacuuugggggucccaaaguacagggggcagcagucgaggggcagaauagccuggguuggggguagcugcauuuuuacaugcauucucuuauucaguccucacagaaaucuugugagccaggaaggcaguauuauucccacuuuacaauuuuaggaaacggaaacagagagacaaaguuugacgaagacccggaguggagcagcgauucagacccggcacaaccgacuccguugccuuccccuaugccgcccccaacgccaccgccucccugacugcccugccgugcagcgcccgauucagacugguuguuagaaaucuacgccagaaucuuuacguguguccagaaaggaaaggaaucaacauuucgcaucagccuucccaagauggcagcugcugaagacgaguuccugccgccgccgcggcuccccgagcuguucgauuccagcaaacagcuucuggacgaagucgaaggagcgacugaacccaccgguucccgaauaguccaggaaaagguguucaagggccucgaccuccuugacaagguugccaaaauguuaucgcagcuugacuuguucagccgaaaugaagauuuggaggagauuacuuccaccgaccugaaguaccugauggugccagcguuucaaggagcccucaccaugaaacaagucaacccccguaagcgucuagaucauuugcagcaggcucgcgaacacuuuauaaaauacuuaacucagugccauuacuaucguguggccgaguuugagcugccccaaaccaagaccaacucagcugaaaaucacggugcuauuaccuccacggcuuauccuagccucguugcuauggcaucucaaagacaggcuaaaauagagcgauacaagcagaagaagguguuggagcauaaguugucuacaaugaaaucugcuguggaaaguggucaagcagauaaugagcguguucgugaauauuaucuucuucaccuucagagguggauugauaucagcuuagaagagauugagagcauugaucaggaaauaaagauccugggagagaaagacucuucaagagaggcauccacuucuaacucaugucaccagaagaggccuccaaugaaacccuucauucucacucggaacauggcgcaagccaaaguauuuggcgcuggcuauccaagucuggcuuccaugacagugagugacugguaugaucaacaucagaaacauggaguguuaccagaucagggaauagccaaggcaacaccagaagaauucagaaaagccacucagcaacaggaagaucaagaaaaggaggaagaggaugaugaacaaacacuccaaagagcucgagagugggaugacuggaaggacacccacccuaggggcuacggcaaccgacagaacaugggcuaaucuucccacaacaccgcaggacugcagggugcacaccuuccccgccaaggaaaaccaugcagccuuccccucccugagcuccccuacagcuguguaaaacgaaggcaaagaugcuuaauguugcuuugaguucaauaaaguguuaaauuauuauuauuauuuuauuuauuuuuuugagauggaguuuuuuacuugucgcccagguuagagugcaauggcgcgaucucggcucacugcaaccuccaccuccuggauucaagagauucuccugccucagccucccgaguagcugggauuacaggcgcccgccaccacgcccagcuaauauuuuguauuuugagaugagguuucaccauguuggucaggcuggucuugagcuccugaccucaggugaucuacccgccucggccucccaaagugcugggauuacagacgugagccaccgcgccuggccuaaaguguuaaauuauuaagcguguauuuguacccuagaugaugugagccaucaaucuaguuuuggcaucaucauccucauccugguguguuccaauuucuuaaguggaaugaaaagagcacugagggccaggcgcgguggcuuaugucuguaaucccagcacuuugggaggccgaggugggcggaucaccugaggucaggaguucaagaccagccugaccaccauggugaaaccccaucuuuacuaaaacuacaaaaauuagccaggugugguggcaggcgcuuguaaucccagcuacucgggaggcugaggcagaagaauugcuugaaccugggaggcggagguugcaguaagccgagaucacgccauugaaaagcacugagaaauagguuuggauaauuaauggcuguaugaauucucugaaaaaauaacaaaaguuacuucuauuauaugagccugugcagaaaaaagaaaaaaaauuucuuaucacacaaugcgauuucuuuugaauccuugggagcggcagcuagagcgaaccgauccguaagggaguucagucagaucguacagaagcagguggugacguuacuauaagaggcgggcauauguagauaggggcgcagugauugccgguucuagugcguucuucgcgggagaaauuuucuagcgaauaccaaagaagguguagucugagaugugucauacgaagaagcgguaguuucgaagcgaugccuaaaaacaacucauaauacaauuugccaugaguauguuguguguugaggacgaugguaagguauuagcaauauuaaguaaauaaugucuuuguggcgggggagagacgcuguugguccugauaaaguguuuuucuugggggaggguuuuuacuauguguuugcucccgcgauuuccccgaaugagaaaacucggcugcauaacuugugguagugggggacugcuuuugcgcuuuucuguccugugauugaacuaguuuaaaagacggcuuguguguuguugcguguguuuauuuucagaguuguuguaguggcgcgcguuugguuuuggaguugugguuaugaccuuacgucuucuuagguuacggucuguuuuaauuagaugcucgcuaaguauuuuauaccguuucuaggaaggguggaaaaauaagccagacugaugugguacgcaccugugcuagcuacucgggagacugaggugggaaaaucauuugaucccagauggagacuuaaugagccaauauugugccacugcacuccugucugagcgauagagacccuaucucaaugaagaaaaguaaaaaaaaaaaauuccugggucuucaggugggaaguuaaguaccucaucccuuguaguucaguuuuucugugcagauaaauuuaccaguuugcuauguuagccuuuuguucuggugggaugaauugcugaggguggcuaaagccuguaaacccagcacuuugggaggccgagguggguggaucacuugaagucaggaguuugagaccagccuggccaacaugaugaaacccugucucuacuaaaauacaaaaaaauuagccaggcaugguggcgcacaucuguaaucccagcuacuuuggaggcugaagcaggagaaucgcuugaacccaggaggcagagguugcagugagccgagaucacaccacuguacucuagcccgggugacacagugagacugucucaaaaaaaaaaaaaaaaaaaaaagccggugcacaggugguacacacugguacagguggugcaugccuguaaucccagcuacuugggaggcugaggcaugagaauaguguaaccacccaagggguucaccuugccugcugccuagacagagccaauucaucaagacaggggaauugcaauagagaaagaguaauucacgcagagccagcugugcaggagaccggaguuuuauuguuacucaaaucagucucguggagcauucgaggaacugaguuguuaaggauaacuuggugaguaaagggaagccagugagccaggagugcuaauuggucagggaagaaaucacagggagucaaagcugucuucuugugcugagucaguuccuggguggggaccacaagaucagaugagccaguuuauugaucuggguggugccagcugaucuaucaagugcaaggucugcaaaauaugucaagcacugaucuuaggagcaguuuaggaagggucagaaucuuguagcauccagcugcaugacuccuaaaccauaauuucuaaucuuguggcuaauguuaguccuacaaaggcaaucuaguccccagacaagaaggaagucugcuuugggaaaaggcuguuaccaucuuuguuuaaauuauaaacuaaguuucucccaaaguuaguucagccuacacccgggaaugaacaaggacagcuuggaaguuagaagcaagauggaguaaguuaaguuagaucucuuucacugucucagucauaauuuugcaaaggcuguuucaauuguuugaaccccggaggcagaggcugcagugagccgagauuccacaacugcacucuaacuugggugacagagcaagacucugucucaaaaaaaaaaaaaaaaaaaaaaaaaaaaaagcauuucccguauugcccagacaaaauuauaauauacacaugacaaagacacaaacaccaguuauuccccucaauaucugaguuuuaaccugguaaaacagacaagagguucccucugagugaggccuguugagcuucugcuagugauuccuucaggauuccacccccugacacacagacaagacaagaacaggcacaagcccucacaaaucagaauucuaaaaccagauuugggcccagcgugguggcucaugccuguaauucuagcacuuugggaggcugagguaggaggaucacuugagcccaggaguucgagaucagccugggcaacauagugagaccucaucucuauuuuuuaaaaauaauaauaaauaaauaaaaauaaaaccagauuuggccagcaugguggcucacaccuauaaucccaaaacuuugggagccugaggcaggaggauuguuugaggccaggaguugaagaccagccugggcaauguagcaagaucccaccucuaaaaacauuaaaauaaauaaauaaaacccaauuuucuuuuucuuuuuuuuuuuuuuuuuuuuuuuugugagaugggaguuuugcucagucacccacgcuggagugcaauggcaugaucucggcucacugcaaccuccaccucccagguucaagugauucuugugccucagccucuugaguagcugggacuacaggugcuugccaccacgccuggccaauuuuuuucuuuuuuuuuuuuuugagacagagucccuguguugccuaggcuggagcgcaguggugcgaucuuggcucacugcaaccucugccucccagguucaagcgauucuccugccucagccuccugaguagcugggauuacaggugcccaccaccacacauggcuaauuuuuguaguuuuaguagagaugggguuucaccauguuggucaggcuggucucgaacucccgaccucaugauccaccugccucacccucccaaauuguugggauuacaggcaugagccacugugcccagccuuuugguuuuuguuuuguuuuguuuuuuugagacagagucuugcucuguugcccaggcuggagugcaguggcaugaucucggcucacugcaaccuccaccucccagguucaagcaguuguccugucucagccuccugaguagcugggacuacaggcgcccgccaccacauccggcuaauuuuuguauuuuuaguacagauggggguuucaccguaucagucaagcuggucuugaacuccugaccucaugugauccacccgccuuggccucccaaagcguugggauuacaggcguaagccacugugcccggcugcccagcuaauuuucguacuuuuuguagagacagcauuucgccguguugcccaggcuggucucaaacucgugaccucagaugauccacccacuucggccucucaaagugcuaggauuacaggugugagccaucgcgcccaaccaaaaccagguuucugaacugagacccaaagggcccaggaguacuuccccaaaacagugcccuuuaacaggacccucaaagaguuuacagggccucugaggaggccaacagaucaggagaagggaaagggaauauggauuaugcuugggaauaaucaucagagacaucuuccggaaucagaaaccauuucucugcugcaagccagcuuaugcgccuaagguuggcaaugccccugccuacaagggaggugccagacauggccccuggcuuaaaggagggcucgucucggggugccgaaaugucaggguucugacauucuguuccaggacagaaugagguccagcuuuuuguucucacaguccaauaaugagauccagacugggaaagaagggaguuuauuggccaggugcgguggcucacuucuguaaucccagcacuuugggaggccaaggcaggcggaucaccugaggucaggaguuugagaccagcuuggccaacauuaugaaaccccaucucuacuaaaaauacaaacauuagucgccgggugcgguggcuucugccuguaaucccagcacuuugggaggcagaggcgggugcaucaugaggucaauagaucgagaccauccuggccaacauggugagaacccaucuuuacuaaaaaugcaaaaauuagcugggcauuguggugcgugccuguaggccuagcuacucgggaggcugaggcaggagaaucgcuugaacccgggaggcggagguuguggugagcugagauugcgccccugcacuccagcccagccuggugacagagugagauuccucaaaaagaaaaaaaagaaaaaauuagcuggaugugguggcaggcgccuguaaucccagcuacccaggaagcggaggcaggagaauggcugcacuucagccauucucaccacugcacuucagccugggcaacagagcaagacucugucucaggaaaaaaaaaaaaaaaaaagaagggaguuuauuucugcaacugguuacagggagaagguuggaguaacucagcagaccaacuaaaaaaguuaaaaguuuuggccaggcgcggugacucacgccuauaaucccagcacauuuuggggugccgaaaugucaggguguucuaggacagaaugagguccagcuucuuguucucacaguccaauaaugagauccagacugggaaagaagggaguuuauuggccaggugcgguggcucacuucuguaaucccagcacuuugggaggccaaggugggcagaucaccugaggucagaaguuugagaccacccuggccaacauggugaaacuccaacucuauuaaaaauacaaaaauuagcugguaaugauggugggcaccuguaaucccaacuacuugggagccugaggucugagaaucguuugaacccaggagguggagauugcagugagcugagaucgugccacuacacugcagccugggcaacaaagcaagacucugucuccaaaaaaaaaaaaaaaaaaguuacaaguuguuuuuuuuuuuccaaagcuucuauacauucaagguccaugccuauaagcgggagugcaccuacaagguggaguguuucauucaaucuauaucuaaucuuuaacuaggaucuagggucuggaaagcuuucucuagagucuuggaaaguuucuuaagugguccuugguacaagguguauguguaaaaaugcuauuauuauuugaucagacuuuagggccugagaaaggccagguggugucuuaauggguuuguuuuugcauuccagcccuuguaguacucaggcaccaguuucuccaauucuuuuuauuuuuuauuuuugagauggagucuugcucugucgcccaggcuggagugcaguggugcaaucucagcucacugcaagcuccaccucccggguucacgccauucucccgccucagucucccgaguagcugggacuacaggcgcccgccaccaugcccggcuaauuuuuuguauuuuuaguaaagaugggguuucacuauucacaggauggucucaaucuccugaccuugugauccgcccgccucggccucccaaagugcugggauuacaggcaugagccaccaugcccggcccaguuucuccaauucuuuaauguuuaacauaugcauucaucaaaauuauaguaaaggguuaguggaaccagauuguucuggcugcugauggaaaccuggacugccacaaagggggcacugagccaugguuaaaugcccacaaggggcaucuuuucauaggaucacugcuaaauuguaaucccacguggcaagucaguauagugagacacuggguugcagcagagaaagagguuuaaucauagggcugcagaauaaggagauggaaagagaccucaaacgucucccaaacacauccuuuuauaaggaacccacuccugccauaacgaccuacuuccuuuauaaugacaauagcacuaauccauucaugagaguggugcccccgugaccuaaacacaucuuaaagguucuaccucccaacaccuccauauuggggaucgaguuuuuaacauauaaauuuugggggacacauucaaaccauagcaguagguacaccacagacacuugauuguaagaaugauggucagguguggcugucacauuuggaaaguuaaaauuucucugcauaguucuuaugcacaguaacagcuaacaacuacagugaacuuguuuggugccagguacuaugcuaagcacuguacacaaauuaguuccuuugaaacucucagaccaggcgccguggcucacgccuguaaucccagcacuuugggaggcugaggcaggcggaucacaagggcaagagaucaagaccauucuguccaacauggugaaaccucgucucuacuaaaaauacaaaaaauuagcugggcaugguggugugcgccuguagucccaacuacucgggaggcugaggcaggaggaucgcuugaacccaggaggcagagguugcagugagcugagaucgcgccacugcacuccagccugaugacagaguaagacuccgucacauacacaaaaaaagaaacucucagcaacccucugcuuauuauuauccccauguuacagaugaagaaauugaggccuaucaauguuaaauaauuucuccaaggucacacagggaggugacagagccaagacaguuucagagucugaacugugaaccuaaaccacuauguuauacuaucuagcuuuacauaaugacugcauuuguguucuaaccuuucaaagucaauacucuccaaguuaucuuaaugacacaauaaacguguauuuagaauuuuacuuccuagaaguccucacuuuuucaguccugggaauuagugacaaauauuguauuagucuguucuugugcugcuaauaaagacaugccggagacuugguaauuuauaaaggaaagagguguaauugacucauaguucugcagugcuggggaggccucagggaacuuaaaaucauggcagaugggaagcaaacacguccuucuucacgugauggcaggaaggagaaguacugagcaaaagaaagaaaagccccuuauaaaaccaucagaucucaugagaauucacucacuggucacaagaacagcaugaggguaaccgccaccaugauuaaauuaccucccacuaggucccucccaugacguuguggggauuaugggaacuacaauucaaggugagauuuggguagggacauggagccaaaccauaucaaauauauucaaauauauauauuuuuuacuugucucuucucaccauucuauauucaacaguauauucaaguucuuuaauuucagcgauaacacugaggaaaaacauuaaucucauagaguuucaauaauuauuccccuaaucuucauuauuaaugaagguggcuggacagguuucuaaauguaaaagaauuaaguuguuuccuugcauuucugguucaguuaaaauaagcauauugcucucuuuuggaacaggaugucucgggcuguucgucuuccaguccccuguccuguucaacuugguaccuuaagaaaugacucccuggaagcucagcuucaugaguaugucaaacaagggaacuaugugaaagugaagaaaauucuuaagaaagguaagcaccauguugagauggcagaugcaccuugguacacauuucugaauagcguucagaggaaaaggaaugucauaaagguaugaaugaguccuuggggaaauccagaaauuaaauguagaaauuagauguucucuagcagugcagucaagagagguguuaaauccucauuuugaggauguuuuguuuuguuuuguuuuguguuggggaaccacaagcgcauccaacugcuacugcuaggcuccuaugguuucucugaagucacccaccuuugauucugccugauuucuuuccuugaaaucugcuccauccauuaaguucucugacacccgugguugacuaaggaggccaguguucacagcuguccccuuccuugcuccuuauuuccacuuggugccuuuuuucugggguuuucuagcugaaggauacaggcagacauggcucaauggcugaagcagucuucaaaagaaccaacaaacaugucaugugaauuuggucugagaaaacaaaccaaagaaccaacaaacaaaaacccauauacaaacaaccuuuucugguguuuggcuccuguuuuuuuucuuuuucuuuuggagacagagucucacucuguugccaaaugcagugcaguagcaugaucacagcucacugcagccucaaccuccacgggcucaggugauucuccugccucagcuucccaaauaacugggacuauaggcguaagccaccaugccuggcuaauuuauguguuuuuuguuuguuuuuuguagagaugcuuucgccauguugcucaggcuggucuagaacuucugggcucaagugaucugcccaccucagccucucaaagugcuaggauuacaggagugaacccagaccugcuauuuucaguguaagcagagguccugcuugauccccugucucuuuucuuaguauugaaggggaggcuucugaaacuuuucuuugcugauuuguggaauagucagggugaccugguuuuucuccacuugcuucaauagcauuccugaagacguccagaaagguaaccccaauuuuccaccuaucccacugaauaguucucucauaaaguucucauggcuggcacaguggaucccaccuaucuguaaaccgagcacuuugggaggcugaggcaagagaauugcuugaagccaggaguucaagaccagucugagaccagccugggcaacacugugagacccugucucuacaaaaaauaaaaaauaaagaaaucacuaguuggcacuacacgcaugguagcgcaugccuauaguccaccacaccaggaggcugaggugagaucccaucucaacagcaaaaaaauaaguuaucaaaccuuuccauguacuaccccuaggguccauaggugaaguagcucacacugagcucaaucauuuaugugaaagguccuggguuuuuuuuuccccucaaaauuuugcauuuuacuccauaacauauccacauauguuuuaaaauaaaacguuguaaaacucugcuucuugggccaggcauggugacucacaccuguaaucccagcacuuugggaggccaaggaggguggaucaucugaggucaggauucgagaccugccuggccaacauggugaaaccccgucucuacuaaaaauaauuagccgggugugguggcaggcgccuguaaucccagcuacuugggaggcugaggcaggagaaucgcuugaacucaggaggcagagguugcagugagccuagaucacaccauugcacuccagccugggcaacaaaagugagacucugucucagaaaaacaaaaacaaaaacaaaaauaaaacucugggcugggcgcaguggcacacgccuguaaucccagcacuuugggaugccgaggaggguggaucaccugaggucaggaguucgagaccagccuggccaacauagugaaaccccauuucuacuaaaaauacaaaaauuagccaggcaugguggugggcaccuguagucccagcuacuggggaggccgaggcaggagaaucacuugaaccugggagguggagguugcggugagcugagaucgcgccacugcacuccagccugggggacagagugagacuacucugccuaaaaaauaaauaaauaaaaaauaaauaaaacucuguuucucacagugaaugguguggauagacagucacuagaagucauagcauaccuauauugaacaucacuuuuuuuuagugaacaucagaguauuaugacauuuauuaucuccuagacaucuccugaauauucugcaucuucaaaugcuugauauucaguuagaguaagggaugggguuaacauguguaccuggauauagaacaggacuucaucugugucugggaauucuaucugaagccucagagugcagaauaaggggcgauaaauucucccacagucuaauagagggcuuguuaggauaucauuuaaaugauccuuagauucuuuaaaaaguauucacagggccaggugugaugacucaugccuguaaucccagcacuuugggaggcugagguggguggaucaccugaggucaggaguuugagaccagccuggccaacauggugaaacccagucucuacuaaaaauauaaaaauuagcugggcgugguggugggugccuguaaucucagcuacuugggaggcugaggcaggagaaucacuugaaccugggaggcggagguugccgugagccgagauugcgccauugcacuccagccugagcaacaagagcaaaacuccaucucaaagaaaaaaaaaaaaaagaggccgggcgugguggcucacgccuguaaucccagcacuuugggagaccgaggcgagcggaucacgaggucaggagaucgagaccacggugaaaccccgucucuacuaaaaaaacaaaaauuuagcugggcgcaguggcgggugccuguagucccagcuacuugggaggcugaggcaggagaauggcaugaacccgggaggcggagcuugcagugauccgagaucacgccacugcacuccagccugggcaacagagcgagacucugucucaaaaaaaaaaaaaaaaaaaaagaaaaaaaaagaaauucacaggauuagaaggcuguggcuuuccccauccuugccagucucaagacaagaggcccuucaggcaaaccucagagagaacuguggugcuugcaggcaagagagaugagaccugagucccagccugcuguacaguugaaauaugucagccuaccccaagcugccaccagagugacacaccaagaagcugcaguguucccuggaguugaggaggcaagaagacugcuaucugucuccuacuuggagcaguccuugaugggugggugagcauaggaggcuaacaguaauuagucacacuugcaccaguuggugagcauaggaggcuagcaguaauuagucacacuugcacaaguagacuccacaguggguagcugagccaucuaaggggauucuaccugugaaggaagaaaggaucccaaccagagaggcugcagguagggcuuuagagggagggagcugaguggugggcaagaagucagcagaagagagcacuggccugugugggguucugcacagugugguggaggcacuugaaggacccacuagcaccuuccacaaaaggacaggcuuuaggauaaagccagaagcuacacggggcaucagcugaguaugaaggccauugccucuuuuugucuuauugguucucccccuugccucagcucuggaguugccacaaacagcguugagaucagaggaagaguggagaagcaaggaggagaauuaacagagcauugcugcauccugcagugcggaggagggaagaaauuggaaucggccuggguacgguggcucacgcguguaaucccagcacuuugggaggccuagguggguggaucacuugagcucaggaguuugagaacagccuggccaacauggugaaaccgcgucucuacuaaaaguacaaaaauuagcuggacuugguggcacaugccuguagucccagcuacuugggaggcugaggcaggaggagaaucgcuugaacuucggagguggaaguugcagugagccaagguugcaccacugcacucuagccugggcgacagaggaagacucugucucaaaaaacaaaaaacaaaaagaaagaaagaaagaaauuggaauuuguugaaagauugagauuuugauuuugguggaacaaauuuuuuuuuuuuuuuuuugccugaccucaagcacacucuugguuggcucuuccuuccccuccuugagaggcaucucaggcagaauccacuuuuuuuucuuugagacggagucucgcucagucgcccaggcuggagugcagugacgcgaucucagcucacugcaagcuccgccucccggguucacgccauucuccugccucagccucccgaguagcugggacuacaggcacccgccacuacacccagcuaauuuuuuuguauuuuuaguagagaugggguuucaccguguuagccagcauggucucgaucuccugaccuugugaucugcccaccucggccucccaaagugcugggauuacagggauuacaggagugagccaccgcgcugggcugcagaauccauuuuuucugucacuuuaauugugccguuccaggcugggcgcgguggcucaagucuguaaucccagcacuuugggaggcagagguggguggauuaccugaggucaggaguuccagaccauccuggccaacauggugaaaccccaucucuacuaaaaacauaaaauaggcaugguggcguauaccuguaaucccagcuacucgggaggcugaggcaggagaaucgcuugaacucuggagguggaggaugcagugagccgagauggugccaucgcacuccagccugggaaacaagagcgaaacucugucuaaaaaaaaaaaaaaagagugugcuugaggggaaaguugucuccugauuguauccuacucaguuuagcucauucagaaaaccgauuguuacagauuaugacugugcccuuugggaccauaaucuaacagaagaaacagacauaaguugggagcugaaguguacugagaagggcaggaagugaagucagcacacaagauucaucugagccuccuugucuaugggguaaucaagagaaacuucucagaagaaguguugcuuaggccaggaccucaaggaagaagaggaguugaccaagccgggugccauggcacacaccuguaguccuagcuacuugcagacugaggugggagaaucacuugaccccaggaguccaaccugggcaacauagugagauuccaucucugaaaaaaaugaaaagaaaaagaaaaggaguugaugaggcaggaguugugcucugaggauggagaggagcuagaaaagaaaagggucugguugacaugaguugacgggaaaaccagugggguggagagagaugugagaugaaacuggcaagggaggccugggcuggaccagucagagccuugugggcuauuggaaggauuuugguucgauguaaaaacucccauuuuauauuguuuuguguuuuacccucuguuuuucguuucuucucuuuccugccuucuuuuguguuaaugaaauauguuuuagaauuccauuuuaacuuauaauagcgauuggcuuuuaagcuauaccucuuuacauuguuuuuucagugguugcucuaguuauuucaauacaguugacacugcuuaucuguggguuccacauuuguggauucaaccaaccaaguaucaaaaauauuaggaaaaaggaaacaauuaaaaaauaacacuacaauaaaaaauacaaacaaaaaugaagacuaacaacuauuaacauaguauuuacauuguacuagauauuauaaauaaucuagagaugauuuaaaauauacaggaagauuagauggguagguagguggauagauacauagauagauuauaugcaaauacuauguuauuuuauauaagggacuugagcaucuuuggauuuuacugguaugggaggguccugaaaccaguuccccauggguaccgagggaugacugucuauaucuuuaacuucuaacaguuuacuuacaguuaaugauguaccacuucacauaaaagaugcaaccuuauagguucauuucuccccuucucuuauccuuuauauuauagaagccauaggccgggcagguggcucaugccuguaaucccagcacuuugggaggcugaggcgggcggaucacgaggucaggagaucaagaccaucccggguaacauggugaaacccugucucuacuaaaaauacaaaaaauuagucgggcgcgguggcgggcgccuauagucccagcuacucgggaggccaaggcaggagaauggcgugaacccgggaggcggagcuugcagugagccgagaucgcgccacugcacuccagccugggcagcagagugagacuccgucucaaaaaaaaaaaauuauagaagccauaauauaucuaugaguuaugaauccuacaauauaauuuuauaauuuuguuguaaagacuaauauaggcugggcaugguggcucacgccuguaaucccagcaguuugggaggucaagguggguggaucacuugaggucaggaguuggagaacaucuuggucaacauggugaaaucucgucucuacuaaaaauacaaaaaaauuagcuggauaugguggcgugggccuguaguccuagcuacucuggaggcugaggcaagagaaucacuugaaccugggaggcggagguugcagugagcugagaucacgccacugcacuccagccugggugacagagcgagacuccaucucaaaaaaaaaaaaaaguuaagaaaaaaaaaagaauacaacucaagaacagccaaggcuaggcgcaguggcucacgccuguaauccuagcacuuugggaggccgagguggguggaucaccugaggucaggaguucgagaccagccuggccaacauggugaaacccugucucuacuaaaaauucaaacauuagccaggcgugguggcgggcgccuauaaucccauaaucccaacuacuugggaggcugaggcaggagaaucgcuugaaccagggggggcggagguugcagugagccgagaucuugccacucuagccugggcaaaagagcgaaacuccgucagaaaaaaaaaaaaaaaaaaaaaaaaaagccaggugcgguggcuuacaccuauaaucccagcacuuugagaggccgagguggguggaucacuugaggucaggaguucaagaccagguugacagcuugaccaacauggugaaaccccaucucuacaaaaauacaaaaacuagcuaggcgugguggcaugcaccuguaaucccagcuacuugggaggcccagguggaagaagugcuugaaccuggaaggcugauuuugcagugagccgagaucaugccauugcacuccagccugggugacagagcgagacuccgucucaaaaaaaacaaaaacaaaaacagccaaaaguaagagauacccaggguuuuauguagguguagggggaggggcuuccauuccuucugguggcauuccacccucccaguucuucaguguguucaccaucccagaagcucuccaaacccuauuuauggauuuuuauggaggucucauuauguaggcaugauugauuaaaucauuggucauuggugauuaaacucagucuccagccccucuccucucccuagagguuaaugguaggguaagguauuaaagggcccaaaccucuaucauagcuuggucuuuuugguaaccuaccuccgucauguaacacaggugugaauagauuugcauuuucaaauggcugcucuggcugcaggaggcuaugagguauuuggggggggcgggggagaaaacagagaaaacaguaagaugacuuaggcuucuuuuuuuuuuuuuuuuuuuuuuuuuuuuuugagacagagucuugcucuguugcccaggcugguggagugaaguggcgcaaucucggcucacugcaaccuccaccuccuggguucaagcgauucuccugccucagccucccuauuagcuggguuuacagucgugcaucaccacaccuggcuaauuuuuguguuuuuuuaguagaaaugggguuucaccaguuuggccaggcuggucucaaacuccugaccucaggggaucugccugccucggccucccaaagugcugggauuacaguuguaagccacugugcccagcccuagguuacuuuuuuuuuucauuuuugagacagggucucacuauguugccccauaguccucccauagaugggaggacagacucacaugccacugcagcuauaagcuagguuuuuguuuugagcaacgugguugaaagugauauuauucccuaaaagagaaauacguuugggaggaagcugaucuaagucagcuuggguaggcuguauuugagauaucugugauucaccuaaaugcaaugucaaguagaagcuggauaucugagccagaagcucagaggagugaucugacugcacagacauauuuugaaaccaaggauaggcaagaaaagaccaggaacccugcugacagguaccucacugucuuaacauacaggccagcuuuauugggggaggaguagaauaagaaggaagggaaaaccagguuguucccaacaggucaguagcagggcuugagggaaggaacaauacauucaugaauucaucauucauucaguuagucagcauuuacugggcaucuacugugccaggcaaugugcuggagauacagagauaaauaagacauguuucugcuuuuaaagagcucacaguuuaguaaggggaaguaaauguauuuggaacagagugagcuauguagaggcccauacaaggaugauuagggacacaaaacucauaguggucaguguuauuuauggaggucaaggaaggcuucaagaagaggugacaugaacuaagugagaauguacuggagugauagucacacccaugugaaguuggagaaacugcucagaggaggccaagggauggauggugagagguuuccagaaagauuggaggacuagagaauggaagacagauauagaagggcccagaccagagauaggacccuuggaugaaagugaccagaaaguacuuuauaaauucaaaauauacuaggugggaggcugaggcaggagaaucacuugaacccgggaggcagaaguugcagugagcccagaucgugccauuacauuccagccuggucaacaagagcgaaacuccauaaaaaaaaaaauaaauaaaauaaaauaaaauguauauauauauggaacugcucugaacccaaaagauaugucccagaccuggccagauugccccaacgcugucccuuuuucugaaaaaaauuaaguacggagcauuuggcugucucuaaagagagcugucugugaggagauucuauuaggagaggcgguugaauaagacugacugcuaagcaucuuuacaaccugauggucacauuugugaugcugcuauaaugcaauuaaaagugugguugauuagaacacugugccaugugaauguccaugugacccugugcuuccugguaggaaauuuacagcaggaaguuaagugacuaaaacaauugcacaucaucauaucugagauguguuaauugaggugaaauuggugcuaacuuuuccuagaaguaaauggguaggcuuccucagggauuuagaagccaggaagaugagucauucagacugaacuuugagagaugauguauuuaaugcuucauuagagaaaugaauugauuggagacuagacuucugaagaagaccccuucggcuuaccagaaagaacagggacuugauuuagugccagacaggcuuagguuccaacugugguuccuucagcagugugacagaugcuauacccagcaucuaugaaaggagaaauaaucaacuauucuccuucaguuguuuaaaggauuaaaugagauaauggauuaaaacaucuaucacuuggcugggcgcaguggcuuacgccuguaaucccagcacuuugggaggaggccgaggcaggcagaucacaaggucaggagauagagaccagguuggccaacauggagaaacccugucucuacuaaaaauacaaaaauuagcugagugugguggugcauaccuauaaucccagcuguuagggaggccgaggcaggagaaucacuugaaccugaaccugggagugggagguugcaguaagcagagaucaagcugcugcacuccagucuggagagaaugagacuccaucucaaauaauaauaauaauaauaauaauaauaauaaauaaaagagaaagaaagaaaagaauggcuacuccauaggcacagcagccugguuggcuacuuuuuuuuuguuuuguuuuguuuuguuuuaagagucuuguugcccaggcuggagugcaguggccaaucuuggcucaucgcaaccuccuccucccagauucaagugauucuccugccucagccucccgaguagcugggauuacaggcaugugccaccacgcccagcuaauuuuguauuuuuaguagagacgggguuucuccauauuggucaggcugaucucaaacuccccaccucaggugauccuccagccucggccucccaaagugcuaggauuauaggcgugagcuaccgcucucagccaccugauuggcuacuuuuuaaucauucaagucuuggcuuaaauaaccuuugagugguuagggaaacccucuccuucccuaaccucugaaaucuaaaguaaccacugaugggcaggguaugguggcucaugccuauaaucccagcacuuugggagguugaggcugguggaucaguugagcugagaaggucgagacaagccugggcaacgcggugaaaacuugucucuacaaaaagcaaaaaaauuauccagacuugguggcucgcaccuguagccccagcuacucgagaggcugaggugggaggauggcuugaucccaggaggcagagguugcacugagcugagauugcaccacuuguacagccugggugucagagcaagaccgucucaauaaauaaguaaauaaauagccaccacgucucucuguuucaacaauguuauaauucucuacaugccucauuauuuaucauucucucucucucucucacacacacacacacacacacacacacacacacuagaagguaagcucugcaugugaguaggagccuuuauuuacuuuauucuguugcuauaugcccaauucuuagaaauagugcuuagcacguagaaaaacuggauagugguuaagauaauaagcucuggcaccugaccuaccagcucuguuucaaaacugugugaccuuaggcaaguuaccuaaucuuucugugugucaguuuauccaucuauaaagcugggaugauuacuaauaguacuuaucucaugugacgcugggaacauggcaagaccucaguaaauaguagcuaauaccuuuuuuuuuuuuuugggacagagucucgcugugucacccagccuggaguggcucagucugggcucauugcaaccucagucuccuggguucaaguguuucucgugccucagccucccuaguagcugggacuacaggcaagugccaucacaccuggcuaauuuuuguauuuuuaguagagacaggguuucaccauguuggccaggcuggucucaaacuccugaccucaggugauccacccaccuuggccuaccaaagugcugggauuacaggacugagccaccgugauuggccaguagcuauuaccauuauguauaccagcauucaaauauuuguucagggaagaaaugacgucaaauucaccaaacaucuuuaucuuaaaaauuuaagaagugugaacugguagugcaaacauguggcauaagaaccagaguucuuuuucuuaaaugcugggucucagucacccuguucccuuuccugccacggucauggugaccugacccuagcguucgaaagucaaacccuuaggauaguugugagcaacugcugagauuaaucaauuaccggauccagccugauucuagcagagucaaaggcccacccuuuccuuaaacugucugggaccaggcaccuuuaccagaaccguggagccuagcucauacugucuuaugaggggcucacggcaacauccgccucccggguucaagcgauucuccugccucagccucccaaguagcugggauuacagguaugugccaccacgcccggcuaauuuuguauuuuuaguagagacgugguuucucuauguuggucaggcuagucuugaacuccugaccucaggugauccucccgccuuggccucccaaagugcugcaauuacaggcgugagccaccgcgcccggccaacaugaguaaguucuuuaguggugacuugugagauuuugguacacccaucacccaaccaguauacacuacuggcaccuuauuuguagucuuuuaucucuugcccaccucccacccuuccccucaacuccccaagcaagaucauuguaucauugucaugccuuugcguccucauagcuuagcucccacauaucagugaaaacauacaauguuugauuuuccauuccugaguuacuucaauuagaauaauagucuugcugggcgcgguggcucacgccuguaaucccagcacuuugagaggccgagguggguggaucacgaggucaggagaucaagaccauccuggcuaacacggugaaaccccgucucuacuaaauauaaaaaaaaaauuagccaggcgugguggcaggcgccuguagucccagcuacucaggaggcugaggcaggagaauggcgugaaccugggagguggagcuugcagugagccgagaucacgccacugcacuccagccugggcaacagagcaagacuccgucuccccaaaaaaaaaaaaaaaaaaaaaaaagaauaauagucuccaggccggucgcaguggcucaugccuguaaucccagugcuuugggaggccggggcaggaggaucaccugaggucaggaguucaagaccagccugaccaacauggagaaacccugucccuacuaaaaauacaaaaaauuaggcaggcgucguggcauaugccuguaaucccagccacucgggagguugaggcaggagaacugcuugaaccugggagguggagguugugguaagccgagauugcaccacugcacuccagccuggguaacaagagugaaacuccgucucagaaaaaaaagaauuauagucuccaaucucauccagguugcugcaaaugccguuaauucauuuuuaugggugaguaguauuccaauguauaaauacaccacaguuucuuuauccacuuguugauugaugggcauuuggguuuguuccacgauuuugcaauugcaaauugugcuauuucugcauuaaauuuuuuuuuuuuaauuuauuguaguagagacaaggucucgcuguguugcgcagacuggucuugaacuacugggcucaagcaagugucccggguuggccucccaaagugcugggauuauaaguaugagauaccacguccagccuauuuuugcaguuuuuaaucaucagaaacaaugcuuugauaaaauaccuuguaauauaucuuuacaggccaggcgcaguggcucacaccuguaaucccagcacuucugggaggcugaggcagguggaucaugaggucaggaguucgagaucagccugaccaacauagugaaaccccaucuguacuaaaaauacaaaaauuagccggguguggugguaggcaccuguaaucccagccacucaggaggcugaggcaggagaauugcuugaaccugggaggcagagguugcagugagccgagaucgcaccacugcacuccagccugggugacagagcaagacuccaucucaaaaggaaaaaaaaaaaaaaaaaggcaguagguuguaaaccuauacuucuuaugauugacuguacaucagguguucccacaacccacuccccagauuugauuaauuugcuagaguggcucauagaacucagggaaacacuuuacuuagguuuacccauuuauuguaaagauaucacaaaauauacagaugagcaacugaauggaagagaugucuagggcaaggcaugugggaaaaagcuuggugauuccaugcccucccuggcccauccuccaggaaccucuccauguucagcuauucagaagcuucccaacccaguccuuuuggguuuuuauggaaacuucauuacguagguaugguagauuaaaucacuagccauuggugaucaauuuaaccuucagccccucuccccuccccggagguuggggagcagggcuaagagucccaacccucucaucaugcuucggucuuuccagugaccagcugucauccugaugcuuucuggguggccccagccacuagcuacagucagcaucagcauacaaaagauacuuaucauuccagagguucaaagaguuuuagaagcucuacgucagggaacaggcaugaagaccaaauauauauuucuuguuuuuuuguuguuuuuuuguuuuuuguuuuugagacagagucucguucugucacccaggcuggagugcaauggcacgcucacugcaaucucugccuccugagcuucaagcaauucucguggcucagccucccaaguagcugggauuacaggcgcccaccaucaugcccaacuaauuuucguauuuuuaguagaaacgggguuucaccguguucgccagacuggucuugaacugcugaccucaagugauucacccgcuucugccucccaaaaugcugggauuacaggcgugagccaccaugcccagccccaaauaaaucuuucuuucuucuuuuuuuuuugagacagagucucacucugucgcccaggcuggaguguaguggcgcgaucucagcucacugcaaccucugccucccgaguucaagaaauucuccugccucagccucccaaguagcugggacuacagguacaugccaccaugccccgcuaauuuguguaauuuuaguagagacaggguuucaccauauuggucaggcuggucuugaacuccugaccucgggugccucccaaagugcugggaugacaggcaugagccaccacccccggccccaaauacauauuucacaauaucacagagacagugguauagugcguggacuuuagaaccagacugguuugugaccucuggcaaauugaucucucuccauuucuucaucuacaaaacagugauaauaauaguuucuucuucuuguacaguugugaggauuaagugaauuaaaagaauagugccuggcacacauuauuguuaauaucagauauuaccuccuaggaggcucacagguuaggugacugacccaucuggaggcccugggcuuaugagggugguauuaggaugucaacauuugaauccaggucuuuuaaccuuuucggccagucuuuguaccaugucauagcugccucuggucacuucuugugggacuguuuuuaguuaccuuuauagcagccacaacauggguacaaugcuggccuaaaauaauuauuuguugaaugaauaaauguuauuuuuuauuaggaagucuccaaaggucauguuugcuuaaguuguagggacagagguuuucaccuauuuuucuuuccugccaccuguauccccucaagauuuguugcucugugccuuccccuaagugguuucugauccuuagagaagcccuugggacgcgguggcucacgccuguaauccuaacacuuugggaggcugagguggguggaucaccugaggucgggaguucaagaccagccugggcaacauggugaaaccugucucuacuaaaaauacaaaaauuagccaggcguaguggcggcugccugugaucccagcuacuggggaggcugaggcaggagaaucgcuugaacccgcuggagguuauggugaggcuggagguuguggugagccaagaucgcaccacugcacuccagccuaggcgacagagacucugucucaaaaaaaaagagaagcccuuggugggcugggcgcaguggcucaugccuguaaucccagcacuuuuggaggccgaggcagguggaucacuugaggucaggaguuugagaccagccuggccaacauggugaaacccuguaucuauuaacaauacaaaaauuagcugggcaugguugugcgugccuguaauugcagcuacucaggaggcugaggccggagaaucacuugaaccugggaggcagaggaugcagugggccaagaucaugccacuguacuccagcaugggcuacggagugagacucugucucaaaaaaaaaaaaaaaaaaagagagaagcccuuggaggccuugguugauuuaauuuuuugccuccugagcccugggaggggcuucccuugacuguaauuucuucuugucaauaacuauaauuucuugucagccugcuucccuugacuguaauuucuucuugucaauaacuauaaauaguuugagauuugauaaauuagacugcuacauguguauggaugagauucuuggggucauagaugaaugaugguuuauuacucauagcaacagcaguagccagaauaucagcauuuuuuccuuuuaacuuuuuuuuuuuuugagacagaguuucgcuuugucaacccgggcuggagugcaauguugagaucucagcucacugcaacuuccaccuuccggguuccagcaauucuccucccucagccuccugaguagcuaguauuacaggcgcccgccaccacgccuggcuacuuuuuguaguuuuaguaaagguggaguuuuaccauguuggccaggcuggucuugaacuccugaccucagguaauccgccugccucggccucccaaagugcugggauuacaggcgugagccaccaugccuggcuggagacauuauuuuuauuauacuggaugguaagcauguauucacuuugcugugaauguagauacuaucugccuuccaaacuucauuauacaaauaucuucaaagaggugcccugaacagguuagugccuugcccccaugacaugcguaacucugagagauccaugcagaauuguccuuuuacuguucucugcugcucuucucuacucuuaggcuggcuuguguugggcagauaagugaacaaggcacugaagauaggggagauacauugggcaguuccuaccuucuaguguaggagagacagucugguagaggacauagacauaccacaaauauuuguaacacagcaagcccugagcaguaagacaugugaaccccucuaguacugcucucaccaugaacacuguuucuuuuucuuucuuucuuuguuuuuuaauuugagacagagucucacucuguugcccaaguuggagugcaguggcacaaucucagcucacugcaaccucuaccucucggguucaagcaaaccuccugccucggccuccugaguagcuggcauuacaggcaugugccaccaagcccggcuaauuuuuguauuuuuaguagagacaggguuucaccauguuggccaagcuggucuugaacucuuggccucaagugauccacccaccucagcuucccaaagugcugggauuacaggcgugagcccccacacccagcccaauuucuucuuacuagaugucucaggcuuugauacuguugacugauccuucuuuuugaaacuuuuaaccuuccuugucacugugacccauuucuuccagguuuuccucuaaucucugccuacuuuuuggcuucuuuccuuauuugcuuuuuuuuuuuuuuucggagacagagucuugcucugucaccaggcuggagugcaguggcgugaucucggcucacugcaaccucugccucccggguucaagugauucuccugccucagccuccugaguagcugggacuacaggcgugugccaccaugcccagcuaauuuuuguacuuuuuaguagagacgagguuucaccauguuggccaggcaggucucgagcuccugaccuugugauucaccugccuuggccucucaaagugcugggauuacaggcgugagccacugcgcccggcccccggcuaauuuuuguguuuuuauaguagagaugggguuuguccacauuggccaggcuggucucaaacuccugaccucaagugaucugcccagccucccaaagugcugggauuacagccgugagccaccauccccagcccuagcuuaccucaagaugguagugggccucaggguuccagcuuuaacccucugcuguuuggguaguauguuugacuuauuuuccccuauggcuuacaauuggccauuguuaauguccuuuaucuucugcaguucuguucacuggacaucuuuacuuggauuuauucauuauuaggugcuugggauauuguggguacccaaagccauucauguagucugaaacuuaaagucucaugcagguggcaggcauuaaucaaaugaucacauagaagagguguuugaucugcuaaaggaggucagggaaauauuuccugagacaaugacauuuggaccaaugucugaaugaugaagauaaguugggauuagagguugagaggagaaucccugucagggagaacagccuguccaaaggcccuguggcagaaaggagcauggcgaguaugaggaacuguaaggccagaguguggcuggagugagggagaaugagacuugagagauggacucgagagaggggccagaccauacagggccuuuuaagugcgagaaauacacuuaccuuuccaaacccaaagaaugggcuuagaggcacgaagaacagcggaagugagacuuuuaauaggggucuugcaagauugggugucugguauaauuuaucuccuagcauccaagucccucccccaguuccucauuggucgaguacuaugagguuacaaucuuuccggaugucgccuaaguuucauuaucccccuuauaagguuauauacccucuccccuucccugcuuuaauuuucgauucccaguaaagaaacuuucuucccuuuuaugggcugaccccuccucuacauucuguucgcuuaucgugaccuaggugcgugagcugugcgguuacguuugcaggccggcugccaguacuuagauuuauuaugccuugaaaauggaccauuuaaaguauuuucucacauaaguauguagaguuuugucuguaccuuaacaaaugggaagcuacugaagcuuaaaccaggggaauauguuguccugcuuguuuaaacacagcaauggccgggugugacggcucacgccuguaaucccagcauuuuggaaggcugaggugggaagaucgcuugagcccaggaguucaaggccacccugggcaacagugcgaaaaccagaaaaaaauaaacacagcaaugccauguagaauaaaaacucccugguuuuuggggaagaaauacaaaauauuuaaguguguggaauuuugaucacaguauaaaauauaauagggcgcgcuaugcaaauaucacaaucuuuggcuuugaauuaucgcuuucccuucacucuuugguuauucucgaagggccuucuugcuuccgaucaucaguccaaaccgggcaguuucccugacgguuucuggcgcuccggcgcgcuuuauagucgucagcguuacgcguggaggaaaauggggcgggguuagaaaggagcucugagugauuugcaugcuuugcuaccauauguuaauuacagugauugccuaaaguaucuucgaaauuuugagcuuauuuuaaaugcuuuuucgaacuuugguaguggaaagaucguuuuuggaaaaaacacauaguaauauuuucgagaggaaaaugugcucacgaaauacucaccaucagcauaauaugugugaguuucuuucgcauguggaaggcacauaaauggacauuaagacuauauuuugagggauaauuucuauaguguguuucucgaggaguauaucugaacguguagaacgcuggaaaccgcgagagggagauauuuguguucucucacgagugggauagcaguguuugguguugcguuauucuaacugcuguuugcuguuggugaccguucuucucuagagaaggcagucugaguaguucuggguuuuuuuuuuuuucagauguuaauaguaguugguuuccucauguuuuuaauuuuugaguauaagguuaugccagauguguguuuugagagauguguuguguauauaugcauauauuuuaacuuaggauugugcagagugcuuuuuguguguuuugagagaugugagauaugugcauuuuuauuuuugagcuggggcuuuuuucugugguccuggagugcaauggcacaauuucggcucauugcagccucugccacuuaagcaguccucaugcuucaguuucucaaguagcugggacuauagguacgcagccagccccgcuaguuuuuguauauuuaguagagaggagauuucgccuuguuggccagguuggucucgagcucuuggccucaagugaucuacccgccucggcuucccaaagagcuggcauuacaggcgugagccacugcgccuccaggcuugugggauuucaauuuuuguauuucuugguguuuuuuggucuucuggaggacuaaauuuuuuucuugguagguaaggcauauuuuccuuuuuuauuuauuuuccuggucauguuacuacuuuggccuuuuuuuucagucccuuuuaauuauucacagacucauuguuugauaguacuggaaauuggucuguuuuauguguuuuguuuucccuugucgaauuagucuuuacacuuuaguaagaucuuuuaggugaggacuuguauuccauugagcucuuuuuauguuauagccuuccucccaacacacagaguaucuuuagucccucccucauccuuucccaugauugagaaccauuuuaauccauuuuauaauaugccaguguggugaacuaaaugcuucaaugcaacuuucugcaaauauuuuugaugaauaaacacugaguuugccuuccaguauaucuaugugcuacuaaugaagaccuucuuuguacuuuuuuuaaaaaaaagcucacagcaauauaugaaaguacacuauaaaaauauguaauucccccacccccuacccaguuccuucucaggaaauuuucugauauuugcauugauucugauauuuccuuugcaggaauuuauguugaugcaguuaacuccuugggccaaacagcacuuuuuguugcggcguuauugggccuuaggaaauucguugauguucugguggauuauggaucagauccaaaucaguaaguacaauaauauugaugucuagaaaauagggguugugcuguuaagaugaguuuguuuagaaacuaauuagaaaaacguuuggccgggugcggugucucauaccuauaaucccagcacuuugggaggccaaggcgggcagaucacgaggucaggaguuagagacuagccucaccaacauggugaaacccugccucuacuaaaaauacaaaaaauuagccaggcgugguggcgcaugccuguaaucccagcuacuugggaggcugagacaggagaaucauuugaacccgggagguggagguugcagugagccgagaucgcgccauuguaccccagccugggcaacaagagcgagacucagucucaaaauaaaaaaaaaagggugaauuuugccugacucuuauggcugugguuuaaaagaaucagaguuuaggccgggcaugguggcucacgccuguaaucccagcacuuugggaggccgaggugggaagagcaaaacuccgucaaaaaaaaaaaaaaaggaaaaaaaaaaaacacgaaacacgaaaagaaucggaguuuaauaguuggucuaaauuuuauuuauuuauuuuuuuuuuuuuuucagacggagucuagcucugucgcccaggcuggagugcaguggugcgaucucggcucacugcaagcucugccucccgaguucacgccauucuccugccucagccuccugaggagcugggacuacaggcaccugccaccacgccgggcuaauuuuuuguauuuuuaguagagacgggguuucaugaugcuagccagguuggucucaggauggucucaaucuccugaccucgugaucugcccgccuuggccucccaaagugcugggauuacaggcgugagccaccgugcccggccaauaguuggucuaaauuuuaauaugaaacaguaacacagugaaucagugacaggugaacaucuacuuuuuuuuuuuuuuuuuuuuuccugacacauggucugccucugucgcccaggcuggagugcaguggcaggaucuuggcucacugcagccucugccacccggcugcaagcaauucuccugccucagccucccuaguagcugggauuacaagugggcaccaccaggccuggcuaauuuuuuguauuuuuaguagagacaggguguugccauguuggccaggcuggucucgaacuccuggccuccauccaccuuggccucccacagugcugggauuacaggugugagccacuguacuuggccgaacaucucuuuuugugaagcacuucggcuuuugcuagggccuucucaaauauuagcuuauuugacaccuucuugacagagaagggagagugggugguggauauuuuucaguucccauuaaacagaaccagaaacugggguuuugggcacuuaagugauucaagcugauuuucacaggaaugcuagaauaugaacaaucauaaagucuuucccaucuuacuuaaggaggcucuguuuaauguaccugcuuaaauuauugauauuggaagcuuuuguacuuuuuuuuuuuuucuugugauggagucuugcucugucacccaggcuggagugcaguggcgcuacuacggcucacugcaaccuccgccucccguguucaagugauucuucugccucagccuuccaaguagcugggauuacaggcacgugccaccacacccagcuaauuuuuguagucuuuuuuuuuuuuugagacagagucucacucuguugcccaggcuggagugcaguggcgcaaucucggcucauugcaaucugugccuccgagguucaagugauucuccugccucagucucccuaguagcugggacuacaagcgcgugccaccacacccagcuaauguuuuauauuuuuaguagagaugggguuucaccguguuagcuaggauggucuccaucuccugaccucaugauccgcccgccuuagccucccaaagugcugggauuacaggcaugagccacugcgcccggccuaauuuuuguauucuuaguagaggcaggguuucacuauguuggucaggcuggucucgaacucuugaccucaugguccgcccgccucagucucccaaagugcugggauuacagaugugagccaccgugccgagcagcuuuuguauuuuauguauguguguuguggagggauugguuauaaaauugcuuaggggaagaaaacuuggaagcuuagaaaagcacaaagaaaaaagccaaucaguaugagaauuaaguaaccagagguaacuuaaaacaaugaacauuuuguuguguuuccuugcagaauuuuucuagacucacacacgcucuacuggcucuaccguauuguuuaauuucaaagcccggagagaaaggggucagccagaugcaguagcucacaccuguaaucccagcaauuugggaggugaggugggaggauugcucgagcccaggaguuugagacuagccugggcaacagagacccugucuauacccaaaaaaaaaaaaaaaaaaaaaaaagguggcaugggggcuggcucaccugauguuugcauauacccguguuguagggaggccauauugggacagucugcaguucuucagcaaaaaugcaacauuuucuuuuuucuucaguuuuucccacuuuuuuuuuuuuuuuuuuuugagauagagucuugcucugucacccaggcuggagugcaguggcaugaucuuggcucacugcaacuucugccucccaggugcaagcgauucuccugccucauccucccgaguagcugggauuacaggugcccaccaccacagcuggcuaauuuuguauuuuuaguagagaugcgguuucaccuuguuggccaggcugaucucaaacuccugaccucaggugauccaccagccuccgccuuccaaagugcugagauuacaggcaugagccaccaugcccggccauuucccacuucuuuuaguuacugaaacaagguguauaaacaucgccuugagugauauagucaugaccaucaucacuuucauauucuguaugacaguauaauucuguucaguaaacauaaaccauuuuuuaaaagccuguauaaaaaaauacagauaaaaauugaaacauuuuauagucaucugcauuuacaacugcuuuguccaggcuuaaagcugauuucuuuaaagaucaaaccauucaaaccuuuaauuuucaagaucagggaauugagacuagcccauaauaugguacauaguauuaaugacacagcugagaucaggaaggagcccagcuucugaagaccucagaguuuaaagaaguucccuuuuucaaguguccaggaaggacacuuguaaugccaggcaaugccaggaaggaaguggaaagggacaauaacaagagaggauggcaaaccccuauggcuuuguauuuucugguugggaacauuuucaugugacuuaaaaaauaucugaugauuggcugcauagagguaccgggaaaaaaaguuuuuaaaaaauuuuuaucugaucaaggugaaggggaauuucugggaggaggcuuuauuccuuuuuuuguuuuugaugaagucucacucuguuuuccagguggagugcaguggugcgaucuuggcucacugcaaccucugcuuccuggguucaagcgauucuccugccucacccucccgaguaccugggacuacaggcgcgugccaccacaccugacuaauuuuuguauuuuuaguuuugccauguuguccaggcuggucuugaauuccugaccucaggugauccaucugccucagccucucaaagugcugggauuuuaggugugagcuaccacacccagccaggaggcuuuuuuuuuuuuuuuuuuuuuuugagauggagucucacccugucgcccaggcuguagugcaguggcacggucuuggcucacugcagccucugccuacaggguuccagcaauucuccugccucagccuuccagguagcugggauuacaggcacacgccacuaugcccggcuaauuuuuguuuguauuuuuaguagagacgggguuucaccauguuggcuaagcuggucucgaacuccugaccucagaugauccacccgccucggccucccgaugugcuaggauuacaggcaugagccaccgcacccagccaggaggcuuuauuccuauacgcucaguggaaacgcugugauggacuggaccuauugaagucacaaaucagaugccuacuggaccaaguaacuggguuuagguuuucucugaggagggucagggaucuauugcuguugggcaggaaaggggggcaggaaagggagccaggaaagccagaucuuccgaauuuccaagagccggaaaucccaguuuuuaauuugaaaucucccaaauguugccgggcacaguggcucacgccuguaaucccagcacuuuggaaguccaggguggguggaucaugaggucaggagaucgagaccauccuugucaacauggugaaaccccgucucuacuaaaaauuaaaaaaaaaaaaaaauuagccagccaugguggcgggcgccuguagucccagcuacucaggaggcucaggcaggagaauaucuucaacccaggaggcggagguugcagugagccaagauugugccacugcacuccagccuggguggcagacagagacucugucucaaaauaaauaaacaaauaaaugaaagcucccaaauguuaaauauugccaacuauuucaauuuuuuugaacacuguguguaccaaauaaaauaaacuucugaguuggcuaggcagagacuccaguuuuuaggcuuuacaauaaauaaauaugauaguacacauuuugauaccagguggaccuggauccucuuguaagcuuagcuggguauaaaucauuauuccuuuccuccuuagcauucaugagaaaugagaaauaauaucaucuguguccuaacccagcuuucuuacuguuugugggaggaaugauuagaagaugguaagacaggcugggcacaguggcucaugccuguaaucccagcacuuugggaggaugaggcgggcagaucaccugaggucaggaauuugagaccagccuggccaacaugaugaaacuucgucucuacuaaaaauacaaaaguuaccugagcgcaugguggcaggugccuguaauuccagcuacucgggaggcugaggcaggagaaucucuugaacacgagaggcagagguugcagugagucgagauugcaccauuguacugcagccugggggacaagagcgagacuucgucucaaaaaaagaaaaaaaaaaaacccaaaaaacaaaaaagaagaugguaagacauuauacaaagcuguuuuugcagcaaggaggauauugugauucccacgaugcagugugcuggacugcuucucugcccagcagugggagagagccuacagugagaaccaaugggaucagugguuccuauaagccugugugcaggccagccucuuuaguaucaccaggggaauuugaaaaacaaaaccaaaccaaaccacauuccuggguccugugcuugcagauuuuguuucagucaguguaagguguagucugagaaucugugcuuuugacagauaucccaguggauuauuaacuaaauuaugauacacccauucauuggcauacuauguagcuguuaaaaagaauggagauggcuuguaguuucucacuugaucuuagccaaaaggccaagaagcgauggcuuguaguuucucauauggaaauuucuccaagauagauucuuaaaugaaaauaugaaggcugggcgcgguggcucacucuuguaaucccagcacuuugggaggcugagguggguagaucaccggaggucaggaguucgagaccagccuggccaacauggugaaacccugucuccacuaaaaauacaaaaauuaacugggcauggguggcgggcaccuauaaucccagcuacucaggaggcugaggcagaagaaccacuugagccuaggaggcggagguugcagugagccgagaucacaccauugcacucuagccugggugacaagagcaaaacuccgucucaaaaaaaaaaaaaaaagaaaagaaaagaaaagaaaauauguagauacagaagaguuuguauaguguauucagagucucgcucugucucccaggcuggagugcaguggcaugaucucggcucacugcaagcucugccucccggguuuuaugccauuacgccauucuuagccucagccucccgaguagcugggacuacagguaugcaccaccuacgcccggcuaauuuuuuuguauuuuuaguagacacaggguuucaccgcguuagccaggauggccucgaucuccugaccucgugaucugcccgccucggccucccaaagugcugggauuacaggcgugagccaccacacccggccuguuuaguguauucuuauuuauacuuguauauacauagaacauuuccagaaggauacaaaaacuuguaauaguaauugcaucuugguaagagaacugggugucuggaguuggaugacuuuuuucuuaucuucucuucaucauccuuuucuuucuccuccuccuccucugccucccccuccccuucccucccccuccuccucuucuucaucuucuccuucuucuccuccuccuccuucuucuccuucuuucuucuucuuuuuuuucccuuccuccuccuccuauuuguguuucuuuuucaguuaaagagagaaaguucccuggugauucugauguguagccagguuaggaaacuaaggcuauacaucauauccucaccauauccuggacacauuaaaggcugucccuucaugucucagacaguuuacuggcuuuguugaaauuuuucugaggugaaauuuuucugagguguagauccuugacugcauugcugaugccaagguuuugugcucuaccacaggauuuucuuggggggcuguggggagacauucucaaacgagagagguggcgccuuguuaggcugugcuugacuagccugaucccaggacacugcaggugugaagacauuguuucugggcagccaauaucagagugcuggggaaagaaaauuggauuuggaaccagaucuaugccugggaaugaaccucagcuuugccguuuuguuuccucaucuguaaauugggaaaugauacuuccuugaaggguugagugaaggagggaaaaaaagggauuguguguguguguguguguguguguguguguacagaaaguuccugugggcacagacaggggccucacaaaugauguuguuauauuccucgucaccaacguugccuuguagaaugggagcccuguguugcacgcugagccccgcuccauggaaugcaggagcauugccauggacaucaauuguacucaucucccuccccagccgcugcuuugaugggagcaccccuguccaugcagcagcauuuucgggcaaucaguggauccuuagcaaacugcuggaugcaggaggugaccugcgacuccacgaugagaggggucaaaacccgaagacuugggcuuugacagcaggaaaggagcguagcacccagguaagggugggucccacucuguagccaugcccacuagaagaguacugggcugagagucaggcucccaguggucagcacagagcguacaguggccuuaguauugguacuggagucucaggcuuggaucgaagcaaauuagccagcugcgaaacuuccggcaggucuagugaaccuuucuacucaucguauucgaugggaaaggcaaacaacuguaauuuugucugacccauuuaacuagcacuuaccaugacucagauguuguuuuaaauguuuuuuauauauuaacucaaucuucacaacaaccucucagguaaguacuauuaauguccuuauuguacagguggggaaacugaggcccacugacauuaaguaacuuuguuuggcaggugggaauuuuuuuuuuuuuuuugggaaggagucuugcccaggcuggagugcaguggcgcgagcucagcucacugcaaccuccgccuccuggguucaagcaauucuccugccucagccuccugaguagcucggauuacaagcaugcaccaccacacucagcuaacuuuuguauuuugaguaaagacgggguuucuccauguuggccaggcuggucucgaacuccugacucaggugauucgcccaccuuggccucccaaagugcuggaauuacaggcaugagccacugcacccagcuggugugauguguuuuaaugaagacuaaauaacauaaauguaaaacucaaagggcagguacagugccaggccccucugugugcagucuccuuucuggggcuccugcuuauuaaagcuguugggccuuggaccagcaaauuuuacucgucuuggccuugguuuccucaucuguugaaggagggaguuggaggaaauuguuucccuaaagccucucccugaaaacauuccauaccuuuagaaaaucaccugggcccuuuccuuuugagagguuuuucuguugggggcucucagcuccucggaccacuuaucuucauacccaagcuuccauuccauugagaacuggugcgcccgcacugggcaucucugcgauguuuugcagauaguggaguucaugcagcgcugugccucacacaugcaggccaucauccagggcuucucuuacgaccuccugaagaagauagacuccccgcagcggcuugucuacagcccguccuggugugggggccucgugcaggggugaguacugccuugagcagagugggauagucuccaucacccagccuuccucgugggagcccugcagcauggguugccucagcuccuccacaucagugcccucuggcaucuggcccauccaaaggggugugcuuggaaagaaaaggcuuggccuugaugaaggaaggccagaggaucaccuuucgcccucucucuccucucccugagaaggugugagaggaaugagugugggcucugauggaaaccacccugugguuagcagaaggagaacaucucaggucugaggagcccagcagaaaacccuuacccagcaggacaccuggcuggcuuuuuugucaucuccugaaccacagaaagaguguuccuuuauuacuaagguugcaaaagaccacaaaugcuuaacuuacgguuucuugggcuauuuucagcugauacgagagacuugcugccagcuggaugggcagcccccucuucucccaucacagcugcaggaggugggcuccaugcuuuucuccaugcucaggguuaagcuuggaagggaggagugucauuuuaacuucucugggauugguugacuuaggguuuguauguagagaauccuucccauuuggcuuuccucugauggcaucucuuucuguaagcaggguagcugggcucaccacacuuuugcaggcuuccuuguccugucauucaugcacuuugaguccuggcuuuccucugaugauuggaugcugcuggcuucucaggcgagaugaguucaugauuccguuaacuccuaacggcugugcugcgugccacucuggccaguuuuggcucuuugcucagcauccagaaugaccuuuuaaaaauggaaaucagguggcuggguacaguggcucacaccuguaaucacuuuuggagguugagguggguggaucaccugaggucaggaguucgagaccagccuggccaacauggugaaacccccgucucuacuaaaaauacaaaaauuagccgggugugguggcaugcaccuguaaucccagcuacucaggaggcugaggcaggcgaaucacuugaacccaggaggcggagguugcagugagccgagaucgcaccacugcacuccagccugggugacagagcaacacacugucucaaaaaaaaaaaauauuagccgaguguguuggugugcuccucauaguuccagcuacucuggaggcugaggugagaggaucacuugaaucugggagguggagguugcagcaagccaagaucaugcaacugcacuccaaacugggugacagagcgagauccugucucaaaaaauaaaguaaucaaauaaaacuaaaauaauggaaaucagguuguaccacucugcuaaaacuccuuaaggaccuuccccauggcuauuaggauagguuuagaaaucccuuauccggccuuggagacccugccucauccaagcccucccccuucaucuccugccucugccccuggcgcuuguauggagacccguccuucagaguuuagagaauugucauaguuugcaauuauuuuauuuguauauguucuucuccaguuuuccaauuaaauugugaauuccaagagcucaggggcugugucuauccuauucauugcuacuaacccuuagcugcuuggugcaugguagggcucuguacaaggagaggaggcucaugagugagccugaaaggaaaacccaaguguaaauguggaugagcuuuuacaaucuuaguuacucaucuagauacagcauuuaguuuagaauuagaggaaacauucuuacgggguuaauggaaugcuuacauggaaauacacuccucuucccccaccuuuuuuuuuuuuuuuuuuuugagacugagucuucucugucgcccaggcaggaguccgugcaaucucggcucaccacaaccucugucuccuggguucaagcaauucuccugccucagccuccuuaguagcugggauuacuauaaaauuagcacaccuggcuaauuuuauauuuuuaguagagaugggguuucaccguggccaggcuagucuggaauuccugaccucaggugauccgccugccucugccuccugaaaugcugggauuacaggcgugagccaccgugcccgcccccccuccucuuaauguaaaaaaccacacaaauucuugaaauuagaguuagccucuaagauuugugaguggugccgugucagauaagauuccucacacguguguuugcacagagcuuggacuggggaaagaagaaaagcacugaguugaggacagauggcuguagaugacuagaguuaguuuuuuucuccccuuaacccagccgaguuauauagaugugugcugagaaauuuagguaagagagcaggaaauguuggucugaacugcaguuguccaggucacuguuugagaacacucggcucuuuugcuuagaaagaacucuccccuccaaagagccauguacugcccagaggccccagaguggaaggcaggaggccucgucacugguaacccccaguuccacugcugcuagaggcugacacccucacugucagcacaaggucuguuccccugggcaagaaacgguccacugucuccuagaucuuuugaggccuaagcacauaagccuuauuuuaagaagagacugaugauuugguguugaaaaguggccuuuuucuuauggucuguuuacucaagugagagugaccauauagcugauuaucuguuggcuguuucgagagugaaagggaaacuaucaauaauggugcuaagauaccagguguaaauugggaugcucaguuuaucucagucuaaacaucagagucuucuccucaauagcauagcagcuuaaagcagagacgggacagcuuggcacugaugaguugcugaggaaauagaaaagaaguaaagcacuuacaucuguucucuaauaguggcauguggggccucacagaccugagguagggcuggcccugaguaugcaccgucucccagcuccuuugccauuugccaagaaaaggaaagugccucugguggcaguaggaucuuuuuuccuucagucugagcugaaaguacucaacuggcaagcauuaacugagcaccuacugcauggcaccaugccagguucugggagccaaagaaauacgaggcaucaccccuucuuccaagacaccuucagugaagggggacccugaugcacaagugguaguuugaguguggaaugugggaagaacaguggcuggaaugagcaacaucagugucuggucacugcugcauuuuaugaccucaggccagcaaguuuccuuuuccugggcuucauuuuuuugccuauauaaugaaaaaacuggacaagaugugcuuaugguuauuuccaacucugaccaucuguauuuguuaucuauugcugcauaaugaaucaccccccaaacuuagcagccucaaacaauaaaauuuuuaucucacacaauuucugugggucaggaaucagggaaugguuuaacuagguuguucuggcucagaguuucuaaugaaguugcaguuaagauguuaguuagggcuguauucaucugaaggcuugacugaagauggacaauucaguuccaagauggcucgcuuacguggcuggcaaauuggugcugggcauugagccucccccagggcugcuugaauguccucauaucauggcagcuggcagagcaaaugauccaagagagaucagggcugacgccuugguagauuuagccucaaagugagagacuaucacuguuuugcacuguuaacagucaaaaaugaguuaacaggucagccccaugugaccugugaggggcuacacaagguuaugcauaccgguaagugagaaucauagaggcccucucagaggcuggcuguuacaucaucucuaguuuuguaacagaaagucuagcaguaaagacaaagucaacuacaccuucugaaaacuugguucagcauuauuauucuggauaugagugguuaauucugagguuuuuuuccuguuuuaaauauuucuagaaacccuaauggcucuccuaaccgacugcuuaaagcuggagucauuucugcucaaaauaucuacagcuuugguuuugggaagguaagagguugccacugacagccaguguuugcaggacuaacuggagaaucaucgggccccaucucccaccuuuguccaacuccugccuccuuauccucaccaaaguguuguucuuuucuuuuuugccccuauugagggaaagguaucucuuaguguuccugucuuacuaacaaauuugugaaaaccccagagaauucccuuggaugacccugggcuacacuugaguuuagaaaaugaucuuuucauuaauuaauuuuuaguuuuuaauuuuuaauuauuauuuuuuugagacagagucuggcucuguugcccaggcuggagugcaguggcgcgaucuuggcucacugcugcaaccucugccuacuggguucaagcaauucugaugccucagccuuccaaguagcugggaucacaggugugugccaccaugccugguuacuuguauuuuuaguagagaugggauuucgccauguugcccaggcuggucuccaucuucuggacucaaucgguccacccgccuugaccucucaaagugcugggauuacaggcgugagccaacucgcccagcccuacuccccguucuguuuguuguguugaggcagccugguggggagggagaggaggaauaucagauuuggccgcacacaauccugggugcuguggggaccacaaugggcuucucagucccagcaauggcacuugaggcaucugacuucuuuccaugagccucaguuucuucagggaaaagaacaaaagggaaauaauaaaaccuugaaagguuuuuagaaagauuaaagauaauauaaagaguuguggugaggccugguggcucacgccuauaaucuuagcacuuugggagaccaagguggguggaucacuugagcccaggacuuugacaccagccaacauggcaaaagcccgucucuauuuaaaaaaaaaauuagccaggugugguggugcaugcuuguaaucccagcuacuugggaggguggagugggaggaucgcuugagcccaggagguccaggcugcagugagccaagaucaugucauaugcuccagccugagugacagugauacccugucucaaaaaaaaaaaaaggcccagugcauagggguauucagaaaguugauaaauagcagcucucauucuuuuagcuggcugauaagauucuggauguauucugcuuuuccccccuucuccccauaauuugaggcuaugccuugguuucaguuuuaucuuacuggggcgacacagauggccuaucuaggaucucuuccggucauuggagaaaaggaagugauucaagcugaugaugagcccaccuucucuuucuucagcggccccuacauggucaugaccaaguaagugggggcuggccaguuugaggucugauucaguuucaggggaagagugggcugcaugugacuuccuuauguguggggaguuucuacucaaacacagggaacaccuaagaacaucugucuaaaucaggguuucucagccaggacacuauuaccauuuuuggccagaugauccuuuguuguugggaguaguccugugcauuguagaauguuuagaagucccuggucucuacccacuagugccaguugcagucccuuacagcccccacagcugugacaaccaaacugucuuacagacauugccauagguuucugggggagaaccacugcucugaaagauuacucauuacaauacuuuaaugucucugcucucugaagaauuagaggcagcuugguagugacugucuugccucugauacaggucaaggguaaugaggccccuauagaagcuguuuuauugcugcugccuuugcccaagucuucaccaucccucaccugggguggucuccuaacuggcuucccauucucuggaccaccccuccccuacccauuccccacauugccgguaacguuguguuuuugaauacaaaccugaucaagucacucucucccuugcauucagugacuucccaccaccuauaccuaaguucuccagggugcuuuaguaccuggggguggguagugggagagaggacccaguagugcccagugggcauugcagguucuguguggagaccauuucucugguccuugcuuaggaaagcuuauucauugaaggaguaaguggcugcucacuccuuucugcugaaacucuuuccuguccuuguagccuaguguggaaugggagcagggucacagugaaagagcugaaucuccccacccacccacacugcagcaggcugcggcuggccgacuuguuaauugccgagcaggaacacagcaggugagaaggaagcccaaggccccuuauagguccaggucucucuacagacucagguucugggcuauucagcucugugccugggauagggagcuccagcugcucucagucucagcauuuccugacuguugaaauugauugacuugacuucgaagggcugccaggaaagaggaagagaaguuaacgaguagccugagcaguggggacagugguggugaggggcucugucagcugucagccgcccuguaacccaugucucugaaugcugcagccuccaugcaggcccuucugauucucaugcuacaaucccugaguccacccacuuugggcccugugcccaucaggacggcauguggcuauccuguuuucauagagcauggcuugcuuaagauccagaugucugaggacaugucugugccauugaggacaggcucauggaucuccagaccuuaggguuccuauggcuccagaguuaaguccuucugcucuugcuaggacagguucuugauucauucauucaguggacccaggcuuaucgagcucucuccuaagaaggcuccucaacuucugcaggaggcauguagagaggccacauucuucuuuuuguggaagucggcuugaagggaccaaaggaagcugaaagaaggagccugggcaacauagacuuugacaugagacugaguugggcaugcaaccuuaggugaauuccugacauauuucuuccuauuuuuuuugcggggaggguaggauugagucucgcucuguugcccaggcuggagugcaguggcaccaucuaggcucacugcaaccuccaccuccugggcucaagcgauucccaggccucagccuccugaguagcugggacuacuggcgugcgccacuacaccuggcuaacuuuuguauuuucaguagagacaggguuucaucaucuuggccaggcuggccucaaacuccugauuucaagugaucugcccaccuuggccucccaaagugcugggauuacagacgugagccacugcaccaggcccugacauuuccuugauguuggucuccucaucuauaaaaugaguauaaugauacauuucuugcaggugguuguuaggaucugagacgauguaugcaaagaauacaggagcucuuggccacauugucauuguugucauugauggcucuaagcucucaaggucucaucaguuagggccacagauuccaacagaaacccucaccaacaccucauccuguuuucuuagaaaacauuguauacaaaaggccacgcccaauggcucacgccuguaaucccagcacuuugggaggccaaggcggguggaucaccugaggucaggaauucaagaccagccuggccaacauggugaaaccccaucucuacuagaaauacaaaaauuagcugcaagugguggugggcauccguaaucccagcuacuuggaagccugaggcaguagaaucgcuucaacccaggaggcggagguugcagugagccagccgagagaucaccccacugcacuccagacugggcaauacagugagacucugugucaaaaaaaaaagaaaagaaaagaaaacaucguauacaaaugguauuuguuuagaauguguucaaaaggccuacgcucauuuuuucaucauauccuccucucaccugccuuaucugaagcuucuuuucuuuugcagcaagcugcggcaccccuacuugcuacaguugauggcugugugucucucccaggaccuagagaaaacccgccuuguguacgagcgcaucacuaucggcacauuguucaguguccuucaugaacgaguaaacugcuguuuccguggauuuuccauugcugaccucccaguuucuucccuccucacccucuugccccagcuguggugaucccauuucugcaugcauggaagauaaauaucuuuauucuuuugcuuuauaggggcuguauaacaugcuauuuaaggcugauaagcacauggucagaauuaguacgguuuuauuauugucaguucugcuuuuuuuuuuuugagacagagucccucuguugccuaggcuggagugcaguggcgcgaucuuggcuuacugcaaccucuaccuccuggauucaagugauucuccugccucagccucccgaguagcuggaacuacaggcgccugccacuaugccuggcuaauuuuuguauuuuuaguagagaugagguuucaccguguuggccaggcuguucucaaacuccugaccucagaugauccacccaccuuggccucccagagugcugggauugcaggcgugagccacugcacccggccuguccugcuuuuuuugagacagggucuugcucuauugcccaggcuggaguacaguagugagaucauagcucacuguaaccuccaacuccugggcucaaaugauccugcaucagccuccaauguagcugagacuacaggugcaugccaccaugcccagcuaauuuuuuuuuuuuuuuuuuuuuuugagacaagagucuccuucugucacccaggcuggaguacaguggcacgaucucugcucacugcaacuucugccucccugguucaaacgauucucaugccucagccucccaaguagcugggauuacaggcaccccccaccacacccagccaauuuuuguauuuuuaguagagacgggguuucaccauguuggccaggaucaucucgaacuccugaccucaggcgauucaccugucucagccuccuaaagugcugggauuucaggcuugagccacugcacccagcccccacccagcuaauuuuuaaaauuuuaauagaaucauggucccacuauguugcccaggcuggucuugaacuccuggcuucaagugauccuccugccuuagcuucccaaacuguugggauuauagguacgagccacugcagccagccuaguccugcuucuugaucagacaucuaagagcgcaguggacccagaaaauacagacaccuuugacuaacuauaauccagcagccacuggcuuuauuuuccuacauuuucauuugugcucucucccaguuuuuucuauagaggccuguaucacuccccucucaccucucaaauuuccuugggguugggagacaucuuuccuggcuuguauagagucccuggaaagggugcuuuggccugagauguagguuuagagagcucuuggaguauuuagguuuuuuuccuccaugacuuuguucuaaauacuuuggauagaaguaaggagaccccaagaagggcucuucccccaaauggcuugccauuccuucugccugaggaccuccuauucuguuuuuuucuguuuuucccccuugagugaggguauuaccuuaaagaccauuucucugggggagagacccauuaagacuuuagucagccaggugcauugaugugagugaauuucuguccccuuaggaggcacuuucugucucaucugacugggguaggacugaauugguuaucugcauucugcaggguccuuugagcuuccagguucuccccagcagcuugggcuuggacagggaggcgacagggcagguuuacuggugguauggggggaccuccccugucaguuuuccccaagccaauccuggaugcacauaccagacuuugagaacuuucuuuucauuuuuugugguaugaagcagcucagcugagggaaaggaauccagguuuggauccagggggccugagucauugggacgucaggccauucacuuagccucacugagcuuuagguucuccaucuguaaaauggggauccuugguaaccaugaggaucauauggaaagacuggaaaucacaaaaugcucuacagugucagggccccaguccuuuuuuuuuucguggcauuucaucucuugcuugcagcggucccaguucccagugcugcacauggaggugauugugcaccugcugcuccagauaucugaugcccugagauaccugcauuuccagggguuuauccaccgcucccucagcuccuaugcuguccauaucaucuccccaggugaagcgaggcugaccaaccuggaguacauguuggaaaggugggcauaacauggagugggacuuucuccugaaguugaucucccuuggggacccuuccuauagagacagaaucugaucugggugggacuccucauuggugagaugaaccuguucaucaguugcugaaccugucccaaaugccuuacccugucugccaaggcuagaggaauuuggagacauuuuaauaaacauuuaacaaguaagagcucguauuagccaaugugcauaaaugcuauaauuauccauuccaaaauuuucagcggcuuuuuuuuuuuugacggagucuugcccucuugcccaggcuggaaugcaguggcacaaucucggcucacugcaaccuccgccuccuggguucaagcgauucucuugccucagccuccugaguagcugggguuacaggugcucaccaccacgccuggcuaauuuuuguguuuuuaguagagaugcaguuucaccauguuggccaggcuggucucaaacucccgaccucaggugauccgcccacuucggccucccaaagugcuaggauuacaggugugauccacugcgccuggcccuuugagcagcuuuuaacacaacaagguguauuucucgcucacauugcaauccaaucuguguuggaggcagggacaguguucccugucacuccaaucuguagcuucaccaccuuucaggccuugaucccccacugcauucuuugcacugccagucagcaagcaagaaagaacauggaggggacacagugggguuuggggccagucugaaauggguauguuacugccucccacauugcaguggccagagcccaguuaccuucuacuggagggaagcugagcugugccuuaccugugcauccuggaaggagagaaggugaugggugcugaugagccuaauggccugucacaccuccuacaucugggccaggcacuggccuggauagauauggagggcauucucugcccucaaggggcucagcacagugagagaggcagucaaaauucaggaguugguaagugggcuuuguuuccuguuggcaagagucaaagucuuccugagagcccccaagcuuugagaggcagaggcucuccccugcgcuuccuuacugccauccacagcucugagccuuugggccaguauugguucugcucuucugugaggccucagccacugggcagaccccuugccuagacccaccuacuuccucuuacccuugucugccaccuacccaucacugaugcuuuguuucuggucucucaccagaucuuuguuugucacauacucuguaacuucucucaaagaugaaaagcuacaugaggcagggauuucuguuuuauuuacugcuauaucucaaaugcccagaacaggccuuugcguaugugcacucagcauauguuuuuugaacaaaugauauaaaaaggcucucacuuccccagaccuggagugccuuuugucccucugcauggagaggaggcagaggucagguugugcuuggccuugugggcccuggugaggagucugaauuuuaucuuaagaacacugggaugcuguguucuuaggauaggcauuuuugaacaguauagggucauggaugauuuuuagguuaagauccuuccucuaggcugggcaugguggcucaugccuauaauuccagcacuuuaggaagcugaggcaugcggaucaccugagguugggaguucaauaccagccugaccaacauugagaaaccccaucucuacuaaaaauacaaaauuagccaggcgugguggcgcaugccuguaaucccagcacuuugggaggccgagacggguggaucaugaggucaggaaaucgagaccauccuggcuaacacggugaaaccccgucucuacuaaaaauacaaaaaauuagccgggcgugguggcaggcgccuguagucccggcuacucgggaggcugaggcaggagaauggcgugaaccugggagguggagcuugcagugagccaagaucacgccacugcacuccagccugggcgacagagcgagacucugucucaagaaaaaaagcaggggagccguuaggguaugaccggagccaugacacuuuucuagaugggaacaggcagaggccagauaacugucacuaguugaacugcucacuuucucaucugguccauuuuuaaucugaguuaaaagcuuucagggucuccuuauugccugcaagauuaaguccagacccauuuucagggagcagaagccucccuaagugaggcuccacuuguagugucaaucuccuaacugcccugcucccuccugaccauuugaaggcacuuuuacuacacugcucucugcaucuggaauaccuggcacacgccaauuuagccuuuuaaagucacuucagacacagucucccaacacucucugugaagucuauacugaugcucucauacccugaggcacuuugcauauuccucuucucacaugcgucacgcaaauguaccacagucauuuuuauacaagugugucugugccaccagauggggaguucaucaccagcucugggccugccacuuaugguaagugcucaguaaauauuuuuuauuuuuuugagacaagaucuugcucugucgcccaggcuggagugcaguggcacgaucucggcucacugcaaccucccagcgucaagcgaucuuccuaccucagcuuccugaguagcugggacuacaggcacaugccaccacauccagcuaauuuuuuuuuuuuuuuugagauggagucucgcucuguugcccaggcuggagugcaguggcacgaucucggcucacuacaagcuccgccuccuggguucucgccauucuccugccucagccucccaaguagccaggacuacaggcacccgccaccauacccggcuaauuuuuuguauuuuuaguagagaugggguuucaccauguuggccaggauggucuugaacuccugaccuugugauccacccgccucagccucccaaagugcugggaauacaggcgugagccccugcgcccagccaauuuuuguauuuuuuauagagauaaggucacgccauguugcccaggcuggacuugaacuccuggacucaugcgaucugcccgaccuggccucccaaagugcuuggauuacaagugugagccaccacacccagccuucuuuucugugggugggggacacaggaucucucucuuuugcccaggccauaguacaguggcucacuacaaucucaaucuccugggcucaggcaguccuccugccuuggccucccaaaguacugggauuacaggcaugagccacuacggcuggccgguaaauguuucuuaaaugauuggaugaucuaguugaaggaaaaacuuaaaaugguucagagcaggguugaccucucuggcuauguguucaggagcaguggacgcuaaagggugugcacuuuugucagugauggaucgccaucugcuauugagagaaagguaccacaguuucuucuccuuuugcucaccaauagaaaugugaauccuagcccgaaauggagcuuuggagauggcccagcccaaugcuguccuuauauaguugaggaaacugaggcacccaggggugaagcaauggugugaaguuacccaauugauugguuagagacacagauggggcuaaacagauaguagaggaugucuccaggauacaggggcaggauggauuggagguugacaggaacaccagccaugagaccaugagacagggccuaguggugaccaugaagccaaaaugggagggaauaaagugaaaugcauggaguugcuggggucaacaacuggccaagugaggggguaggagguaaccaagggucugugaaugucuaggaaugaccucaggauggaaccucagguagaagugucagaaauguuagacagcaagccguugcagguguaacaacauacccuucuuugaaagcugguaacaugaguugauuauucaccaacccaaaguagccuucaaucccacauuuauuuuugguaacacucuacuagggcauaucaguuuguugaaugucauugucaaggauagcauuccaucucuugguauaaaagugauacagcaguuucuccuaccuucagcuccuuccuuuuuuuuuuuuuuuuuuuuuuuugagacaguagcccagucuggaaugcaguggugcgaucucggcucacagcaaccucugccucccggauucaagcaauucugccucagccuccugaguagcuggcauuacaggcacgugccaccaugcccagcuaauuuuuguguuuuuaguagagaugggguuucaccauguuggccaggcuggucuugaauuccugaccucaagugauccacccgccucggccuccuaaagugcugggauuacaggcaugagccacugcuccuggcccuuuuuuuuuuuaagauggagucucacucuguuacccaggcuggagugcaguggcucagucuuggcgcacugcaaccucugccuccuggguucaauauauaauuauguauuaaauuuguaugcauauccacacuguucacacuauacuaggccauaggugacuuuucagcaauauaacuaaagucaauacuagcuuuuucaccuucaugacuucaugaacucacugcccucuauccaaagauuugcuggaagaaacuuuauuuagggaaguuugcucaaagucugagaagcccaucucaucgucuaaaaucuauccuuuuuccagaccaacaaaaaacuugcugucacuugcuuuuuaaaaacuuaauucuuaauuaucaacugccagucauuaagucuugacugaaugccucccauaauauucauacuaauucuuuacaugaaagagcgcuuuauggcucaccgaguguuucuacauccaugaucucauuugacugucaugacagcugugggcacaagucagugcugaguuuacccugaggacucuugcugggccagaagacauuuaggaugcucugacuuagcucuuaaggagucugguugggaagaguuauuuaagcauaugagugaacccuugagugcuaaacugagaggacacauucccaaaagggcaggaguucagaaaagaaauaaucaugaggaguuggggaagucccagauggcuuugauaaagcagauggggguugagagggcucuugaaagaguuuacguucauuuauucaacagcaagcaucaaggcccugguguaagcccagaaguacagugauauaaaagcagaugaguugccuacucucauggagcugacucucuagaauggaggggagacagauaaacuaaaugaacacaaauucagauaauaagugcucugaaaccaauaaaacaggacuacuuuagauuaggcagucagggagggccuccuugaggaagugacuuucagacaaauaucucagucacaaaaaguagcuagucauucuaggaucugugggcagagcaugccuggcagaagcugccagugcaaagacuugaagaacaugagguauguuggaggaacugaaagaaggucccugugacuugaguggagugggugagcaguagaguugccagaugaagugguggagagggcccggguggaauaguaaggaauugcagguauuggaacagcucugaagcaguguggacuagcucauugucuagcuagguuuccaggaacucaaagagguugucagccuucagaggcaaaguuuucacaaauguaguauguugauuaaaagacccacgagccuggccaacauggcaaaaccucgucucuacuaaaauacaaaaauuagccgggccuggugacacacaccuguaauccuagcuacuugggaggcugaggcaggagaaucgcuugaacccgggagguggcagagguugcagugagcugagaucacgcugcugcuuuccagccugggugacagggcaagacucugaaugaaugaaagaaugaaugaaugaaugaaugaauaaaagacccuuuaaggcaugagcgcugacuugugaguuuccuuccguagcgaggacagagguguacagagggaccugacucgagugccccuuccuacgcagcuauacaacugggccgcaccagaagugaucuuacagaaggcagccacagugaaaucagacaucuacagcuuuucuaugaucaugcaggagauuuuaacagguagaucaagaucauuaaugguugaccaaagucccuauucuuagguugcauuuuucuccccccacaggaguuacugacuuuuaugaaaauagaagacuuauuaaaaagagacuucuuggcugggagcaguggcucacgccuguaaucccagcacuuugggaggcugaggcggguggaucaccugaagucaggaguucaagacgagccuggccaaaauggugaaacccugucucuacuaaaaauacaaaaauuagcugggcgugguggcacgugccuguagucccagcuacuugggaggcugaggcaggaaaaucacuugaaccugggaggcagagguugcagugagcugagauagcgccacugcacuccagccugggugacagagugagacucugucucaaaagaaaaaaaaaagacucagcaaagcccauccaucugcuugucagugaugaugcauuuaauccacacuaaaaaaauuuauuuuuauuuuuauuuuuuauuuuuuuugagacagagucuugcucugacacccaggcuggagugcaguggcucgaucucgguuuacugcaaccucugccucccggguccaagcgauucuucugccucagccucccgaguagcugggacuacaggugcacaccaccacgcccaacugauuuuugcauuuuuaguagagacgggguuuuaccauauuggccaggcuggucucgaucgcuugaccuugugaucuacccaccucggccuccugaagugcugagauuacaggugugagccaccacgcccggccgaagcaaacuuuuuaaccugaauauugguaucaguacuuaugaucuaugugugguaucccuugagaacuuguaaauuagggggaaagacuagccucugagaaguaaacuaugaaacacacccuguguccauuagauguauaaacagugucacuugaaagaaauggauguacuuccaaauccacugcucugauguggagaaaguagucacauaucugaagauggaaggaauccuucaaaagaaagacacacacacacacacacacacacacacacacacacacacacacacacacacacacacaguaaaaucacauuaagggcugcuuuuuuuuuuuuuugacagagucucacucuguugcccaggcugaagugcaguggcgggaucuuggcucacugcaacuucugccucccggguucaagcgauucuccugccucagccucccaaguaacugggacuacaggcgcgugccaccaugcccggcuaauuuuuucuauuuuuaguacagacgggguuucaccguauuagccaggauggucuggaucuccugaccucgugauccgcccaccucagccuccuaaagugcugggauuacaggcgugagccaacgugcaaggcuuuuuuuuuuuuuuuuuuuaagauggagucuuacucuguugcccaggcuggagugcaguggcgcgaucucagcucacugcaaccuccaccuccuggguucaagugauucuccugccucggccucccagaguagcugagauuacaugugcucgccaccacacccagcuaauuuuuguauuuuuaguagggaugggauuucacuguguuggccaggcugguuucaaccucugaccucaggugauccacccaccucggccucccaaagugcuaggauuacaggcgugagccaccacgcccggccaagggcugcuuuuuuaugguguuugcagucccagaggcaaaaugacaauauacaugagaugaauauugggcuccccugccagcggggagcccauguguacauguugcugacacuauuguuuccuaucucuguggcggugaucucucugguaaaugaguaaaguggcuucucacuuaugaauuggccuuccagguaguuuuuuuuuguuuuuuuguuuucuguuuuuguugcuaggcuggagugcaguggcgcaaucucagcucacuacaaccucugccucccggguucaagcgauucuccugccuuagccuccugaguggcugggauugcaggugugcgccaccacgccuggcuaauuuuuguauuuuuaguagagaggggauuucaccauguuggccaggacggucucgaucucuugaccuugugauccacccgccucggccucccaaagugcugggauuacagguguaagccaccacgcccggccccucuggguaguuuuucuacagagagaaauuaauauauaaggaaaugaauuguuucuaaaguacaguggauuagaaaaaaaaauaaagaaguuaagugacuugccuaagguuacccagcuucaucugauuucuuuuccccccacuccacucuuugguuuccuaauuuacucuuuuguaugacuuuuuccuuacagaugacauacccuggaagggcuuagauggcucaguuguuaaaaaagccguagucucggggaauuauuuagaagcugaugucaggcuuccgaaaccuuacuaugauauuguuaagucaggcauccacgucaagcagaaagaccgaacuaugaaccuucaagauauccgguauauucugaagaaugacuuaaaggcaagcccugaaguuguugggaguuuauuucugcuuaccuaacucaggagaauagggaguuagagacaagaugaagcuagagaccaaguuguaagaaauuuuggaaauccucauuuuauuacaccauuucuguguucuugauaauagccuaacugcuuaacuuggugaaagcagcauggaauugaggaggggagcuagggagguucaacacauaugcauaguaggggcacccuguaggcacuuaguggagauucagugaaugguagcuauuauuauugcuuuuaagguauuggcaauaacaauaaacuaguuaauuaggacuaaagucagucuacccaacaggaauaagagggaguuuaucagauacuuagaugguuucuaaagcaccagugacauucaggaugacugagacuauguccuugacaauauuuccuguguuacaggauuuuacuggagcccagagaacucaaccaaccgagagccccagagugcagagauacggacuccaucccgaugucaaugucuaucuaggacugacuucagaacaccccagagagacaccugacauggaaaucauagaacuaaaggaaauggguauggccuuaauucacagguuguguuaguuugacacaaauguguucugagagucacaugagcugcaacuaauugacuccucuaaacuguagauguaacuuguuuguuuugugagauaaagucuagcucuauugcccagacuggaguacaguggcaugcucucagcucacugcaaccuccacuuccuggguucaagugauucucaugccucagccuccugaguagcugggauuacaggcaugugccaccaugcugggcuaauuuuuuucuuuuuuuuuuuuuuugagauggaaucuugcucuguugcccaggcuggagugcaaugguggggucucggcucauugcaaccuccgccucccggguucaagcaauucuccugccucagccuccugaguagcugggauuacaggcacgcacaaccaugcccagcuaauuuuuuguauuuuuaguagagacgggguuucaccauguuggccaggauggucucgauuuccugaccucgugauccacccgccuuggccucccaaagugcugggauuacaggugugagccacugcgcccagccuuacuuuuuaaauuuuuaguagagacaaggucucacgauguugcccaggcuggucuugaacuccugaacucaagcaauccucccaccugguccucccaaagugcugggauugcaggcaugagccaccacaccuggccuaaaaaaguuuuuuuuuuuuagagaugaggucucauuauguugcucagguuggucuugaacuccuggccucaagcaguccucccacuuucgccucccaaagcacuuggauuacagguauaagccacuuugcccaaccaauuuuacuacauuuuaguacauuugaaaaccuuagaauuuagaacuggaaaggaccuugcagucaucaggcuuaaugccuucauauuacagaugagaaaacuaagguucagagagguuguaaccugcucaggaucacagagaacuuguuauagaacuggaacccaggccuuccaauuccagccaaaugaccauucacucugacucuccuucagcagugcuggaggccuccagaguggcccuguaaccucauuacuuugacagcuuagucccauucucuguaagcuguacaccuguaaaccaggggugguggguggucaauccuagcauaaauuuuuuaguuuuuucauuacucccauaauguaauggcuccuugggugguaucuaggcuacuuuuuuuuuuuuuuugagacaguuucacucuuuuugcccagacuggagugcaauggcgcaaucucgguuuacugcaaccucugucucccagguucaagcgauucuccugccucagccucccaaguagcugagacuacaggcaugcaccaccaugccuggcuaauuuuuuguauuuaguagagaugggguuucaccauguuggucaggccaugguggucaccauguuggucaccauguugguuugagaccacucgaacuccugaccucaagugauccacccgcccuggccucccaaaguguugggauuacaggcgugaaccaccacgccuggcccuaggcuacuguuaucagaugcucaccaagagcauaacuuuaacugagaaauagucaaacucuuuugugugaaaagaaggcuaugaacgugguccuuaagauucaggggagcugggcacgguggcucacaccuguaaucccagcacuuugggagagugagacgggaggaucacuuaaagccaggaguuugagagcaaccugggcaacacagcaagaccccaucucuauaaaacaaaagaaaacaagauucaggggccucuaauuugcauguccugacaguuaugcauguuuggacacacaauaaagcuuagaauauuuccuccauggcuagaccccugcccugacaacaauuucugccucauuccaugucaaaauaggagcuuuccccuaggggacacauacucccucacccuuugugaguguauccaguagucuuccacaacugggaagggggugggaaaauaaaaaacuuuuuuuuuuuuuuugacagucuuugccucuugaacaagccaaggcugcuuagcugccaaauauguucauuuuaaugaguugcauuuugcuguuuuuuucaauaggcagucaaccucauucaccaaggguucacucuuuauucacugaggggacacuagauccucaggccccagauccaugucugauggccagggagacucagaaucaagaugcuccuugcccugcuccauuuauggcagaagaggccagcagccccagcacaggucagccaagccucugcaguuucgaaaucaacgagaucuacucaggcugcuugauuuuggaagaugacauagaagagccuccaggagcugcuucaucuuuggaggcagacggaccuaaccagguagaugaacugaaauccauggaagaagagcuggauaagauggagagagaggcguguuguuuuggcagugaggaugagagcucuucaaaagcugagacagaguacucuuuugaugacugggacuggcaaaacgguucacucaguucacucagccuuccugagucaaccagagaagccaagagcaauuugaacaacauguccacgacugaggaguaucucaucaguaagugugugcuggaucuaaagauuaugcagacaauaaugcacgagaaugaugauaggcugaggaauaucgagcagauauuagaugaagucgagaugaaacagaaggaacaggaagagcgcaugucuuuaugggccacuucaagagaguuuacaaaugccuacaaguuaccucuggccgugggcccuccaucuuuaaacuauauuccuccuguccuacagcuuucagggggucagaagccagacaccaguggcaacuacccaacccuaccaagauuuccaagaaugguaagagacuuucaagggggacauuuuggcaaaagauccaggaaaagaaaugguuguggcuggaaaccuuucacccaagucuccaaaguaaacacuggggaucagucagagauaagccaucagguaaccugagugggaggaaggggcauccuaagcaggaccccagggcuggguuugacguugccccuaaccuauguggagggacugacauauauaugcaacugacucauagcaaggugcucuuagcuuugggaaaucaguccuccaugguggaauuccaacguagauacucucugucucccaguucagacccaacacacagcccauuguccuucucuguaaauucguauguaucaaauugaaccauauuaaauuucuguuuuauuaguuaaaauggucaaguauuggcaauuuugcauggcucaacuuauugaauaaaguaucuuggauagguauuaaucuccauucuaagcugcuauucauucauucacucauucaacaaacagcuauagagccagaggcuaucuagacucuggguuuuuucuuuuuuuuuuuuuuuuggagacagaguuuuguuccuguugcccaggcuggagugcaguggcgugaucuuggcucaccacaaccuccaccugugggguucaagugauucuccugccucagccucccuagcaggugggauuacagucaugcgccaccaugccuggcuaauuuuguauuuuuaauagagaugggguuucuucauguuggucaccgcuggucucgaacuccugaccucaggugaucugcccaccucggccucccaaaguguugggauuacaggcaugagccaccuugccuggccuagacucuggguucugaugaugaauaagccacaaacucugcccauaaguagcucagauaacagcuggggacugagggaccugguggaucaaagaaaaccccucagaggaggugagcagacaccaugggagcuggcuaggagguauagcuugcagagaggcuccuccgugaguuuccuuaaggacagggccaacaucugacuccuccugugucccagcaccuagcauggugaccaguacauagaaggaacucaguaaauagucagugaaggaaugaggggaugaaugaauuaaugaauuugaacaaguucacacucagagagcuggcugccucuugaauuuuauaauuuuagaguuggaagaucccuuagacauggauuagcccugucaauuuacagagugugaagcucaagcccagugauauaaacuuccugaggcccagagaugucaagaugcggguggggugggagaggucugccucauuggaaggcggauguuauuacugauauuauuuagaauagcuggcccauggugauaaaaagcaggccaacuuuuacuggguuuuguuacuguuuuagaauucuccgcuuaagaguuauccucuuuuuuauuuuuuauuuuauuuuauuuauuuugagauagggucucacucuguugcccaggccggaguacaguggcacgaucucugcucacugcaaacucugccucccagguucaagcgauucuccugccucagccucccgaguagcugggacuacagucacgugccaccaugccuggcuaauuuuuuguauuuuuaguagagacagguuuucaccauguuggcccagcuggucuugaacuccugaccauaggugauccaccugccucagccucccaaagugcuaggauuacaggcaugagccaccgugccuggccauaucacccuuuuauugccuauacagggaagauagcucucccugccaccucucaacuugcugugcuacaaccaagggccaaguugguuaggggcaggucuccugacuccuggucuguuguucuuucauuguacaauacugaaucuuagugaggcuucaguccucacuuagaacauuuggaaaagcauuggcauuuauuuuugcuggagugaaguggcacugucauggcucacugcagccucaaucuucuggacucaagcgauccucccgccucagaccccugaguaggugggacuacaggcuguaucagcacaccuggcuaauuuugugaauuguagagauggggucucagcacgcccggcugguauuuauuucuuuaucuuuuuuuuuuuuuccauagagaugggguuucacuauguugcccaggcugcucucaaacucuugagcucaagcaauccacccgccuuggccuccaaaagugugggauuacaggcaagagccaccaugcccagcugucauuuguuuuuauauaaagagaagacacagccaggugcagugguuuauuccagcacuuugggaggccaaggcagguuaaucgcuugagcccaggaguucaagaccagccugggcaacauaacgaaacccuguuucuacaaaagauaucaaaauuagcugggcaugguggcgugugccuguagucccagcuacuugggaggcugaagugggaggaucaccugagcucaggaaguugagauuacagugagcugaaaucaugugacagcacucuagcacaggcaacagagugagacccugucucaaaaacaaacaaaaaaggcacaaagaauuuacuuauauccuaauauuucuguuuccauagaaaauuagaguuugcuagaaaacuguuagaaaucacuuuuuuuuuuuuaaauuuuuaaagacagaaucuugcucugucacccaggguggagugcaguggcaccaucucagcucacugcaacuuccaccucccggguucaagcgauucuucugccucagccucccgaguagcugggacuacaggugcgcaccaccaugcccggcuaauuuuuguauuuuuaguagagaggggguuuuaccauauuggccaggcuggucucaaacuccugaccuugugauccgcccaccuuggccucccaaaguguugggauuacaggugugagcgaccgcgcccggccugaaauaacuuuuauauauuauauuuuguuaucuauugcugcguagcaacaacaacaaagcccaaaaccuaauggcuuaaaauaacaauaguuuauuauuucucacaauucugugggucaggaauuugacagguucaccugaguggaucuucuguuccacauggccauuggcuagcaucacucaguuguuugcagucagcuggagguuggacugggcaagaagguccaagaagccucuacuuacaugucugguaccuugagcuccuccagguggccucucuuugcacuugacuugucauucaauaaauagucucacccaagcuucucuacagcauagcagcugacuuugcaagugaaagcuaaaaccaccagaccucuuaaaaguuaguccugacccuaggauuguaucacuuucgcugcuuucuguugaucgaagaaauucacgaggccagcccagauucacuggguggggaaauagacucuagcuccuuauaggaggcguggcaggguggacaggagggaauugauggcggccacugcuggaaacaaucuacuaguacauaggauauaaaacaaugauaccauauuuauuuuuuccuuaaaaacaucacccucuuuuucuagcaucagggaaaaagccaucuccaucuaaaugcauuuuucagacaauugaaguuuauuucuuuaauuucuuaguucuuaaaauuuuaauuauauugaaugaaaacguuacaaacuucaugauauucuaaauaucuauuuugauuauauucuaaacauauucuaaccuuuucuuggugacagugguauuuuucugaacaccuguuauggugaagcaucaugauauagggcugucuuaagcuucugcuaaggaguguuugcccauacaaaggccucuggaucuuauacuucagggagcauguaguaauuuuuugugccuccuucucacuuuuacacaucuugcucccaucucaaacuccauauuuguugccuuaauuugcuguaggcuaggaaauauaauuaacuaaguuuguuaaaauuauguuaaaauugggauaaguagagcuaauagucucuugaauaaagagcacagacuuucauuuguuuuacuuuugcuguuuccuaaguauuguaaccuuuauuguauucuguuuuauuuucauagcauccccagugguagguauuaucauucuuauuuuauggauaaguacaaggucuuacuuuauggauaaguacaagauucucuuagugucagggugcggugucucacgccuguaaucccuguacuuugggaggucaaggaggguggaucauuugaggucagggguucgugaccagccuggccaacauggugaaaccacgucucuacuagaaauauaaaaaauuagcugagugguaguggcgcgcaccuguaaucccagcuacucaggaggcugagucaugagaaucucuugagccugggaaucagagguugcagugagccgagaccaggcuacugcacuccagucugggcaacagagugaggccaucucaaaaaaaaaaaaaagaaaaagauucucuuauguuagucugaauaacacuuagacuagaacccaagggccuuuacuccugccacaaagaucugcugucuucauauucauauaggagggggaaaaugcucaggaaaguggauuuuuuuuuuauuucuaucuugucugcuuauucuccacuuguauccugucugggcuagguuccuggagaccaacauuucuggguaaagaccuccagauaagcugggcacaguggcucacgccuguaaucccagcacuuugggaggccgagguggguggaucacaaagucaagauaucgagaccauccuggccaacauggugaaacccugucucuacuaacaauacaaaaauuagcugggugugguggugugcgccuguagucccagcuacucgggagacugaggcaggagaaucucuugaaccugagaggcggagguugcagugagccaggaucuugccacugcacuccagccuggugacagagccagacuccgucucaaaauaaaagcaaaacaaaaaaagaccuccagauaagagauggguuagcagauaggaaacaugcaaaggaaaauccugguaggucugguuauuucuauacauuuagcaagaauggcuuugaaaauagugugacagugaagagagugggaauucucucaucaaagcccugaaacauguuuauugcuuuuuaagcugccgacucuuugugacccuggaaaacagaacacagaugaacaauuucagugcacucaaggagccaaggacaguuuggaaacaagcaggauccaaaauaccaguaggugggucaacauuuuguuguucuuaaugucacuaugccuuuagacuucugugugucucugaggccacucagugaucuucuuaugucuagugacaaaaggacugugagugaugaagaagaguaaugcagauuggcagguucucccacugagugaguaggaagagcagugucaugggaacuugaggagacaucaaagcccaaguggcuggcagguuaaucagacagaacucaucaguuguuagaagcaaagcaucuugccuuuccgcaacugcccagauaguuuuucuuauaaaaacaaacaccagguauuccauuuaccagugcuccagaaacuaaacuaauuggaaaccaggguuguuuaaaguaagugucacugacuccagagagaguugaacaacaucacuaugacccuggggugugugauuuccagccagacgaaugaaaugaauugacuuuagcacaaauuacuggaagaagaguguguguguguuuguauauauguucauacacauauauguauauauaauauauucauacacauauacguauauauaauauauucauacauauauguauauguauucaugcacacauagguauauauguauucaugcauauauaugcauauacacauauauucgugcauguguauacauacauacauauauucauacauacacacacacaugcugaguuuuaaagaacuuaaguaaaacaggccgaguguggugggucacgccuguaauccuagcacuuugggaggccaaggugggcggaucacuugaggucaggaguucgagagcagccuggccaacauggugaaaccccgucucuacuaaaaauacauaaauuagccgggcgugguggcgggcaccuguaaucccagcuacuugggagguggaagcucaauaauagcuugaacagcugggugcgguggcucacaccuguaaucccagcgcuuugggaggccaaggcaggcagaucacgaggucaggagaucgagaccauccuggcuaacauggugacaccccgucucuacuaaaaauacaaaaaauuagccgggcgugguggcgggcgccuauagucccagcuacucgggaggcugaggcaggaaaauggcgugaacccaggaagcagagcuugcagugagaggagaucgcgccacugcaguccagccugggcgauagagcaagacuccgucucaaaaaaaaaaaaaaagaaucacucgaacccaggaggcagaaguugcagugagcugagauggcaccacugcacuccagccuuggcaacagagugagauucugacucaaaaaaaaaaauuaaauaaauaaagaacgaacuuaaguaaaacaaauuuauuuggugugugggaauuuuuuuucaauuuuuaaaaaauugauuaaaauuuuuuuugguuuaaauuuaguuagguauuauaaguaagggaauuacuaaaagggcaauaauuuuuuuuucuuucuuuuuuuuuuuugagauggaguuucacucuuguugcccaggcuagauagagugcaguggcgugaucucgacucacugcaaacuccaccuccuggguucaagcgauccuccugucucagccuccugaguagcugggauuacaggugcccaccaccaugcccagcuaauuuuuuauauuuuuaguagagaugggguuucaccauguuggccaggcuggucuugaacuccugaccucaggucauccacccaccucagccucccaaaguacugggauuauagguguaagucaccacucccagccaauauauguuuuucacgacagacuaguauaucaguuuuaguuuuuuuuuguuuuuuuuuuuuccuguggauaaaugguagcacuaauccacaacuuugaagucaguucuccuggaaaaaaaaacuuuuuauuccucgcccuaguggugauugagacuaaugacgaguuugcuguuuguuucauguuggcaaauauguauguaagggaaaaugaaggaaaauguccagacauuuuauuuauuuauuuuuuauauuuuugaaauggaguuucgcccuuguuccccaggcuggagugcaauggcgcgauauuggcucacugcaaccuccaccucccagguucaagcgauucuccugccucauccucccaaguagcugggauuacagacaugcaccaccaggccugguuaauuuuguauuuuuuaguagagauggaguuucuccauguuggucaggcuggucucaaacuccugaccucaggugauccacccaccuuggccucccaaaguguugggauuacaggcgugagccaccgcgcccagccagacauuuuagaucaguggauuuuauuccuaugaagggaauaaugaagaacuaccuagcuggcaucagaguguuuggcacucacaccacugauagaagcaaaugggaugacauagccauuagaugacaaagaaaaacccauaguuguuguggccuccccugcucggcacccucuucccucagaaguacaaagaacagaccaaaaaaaaguuugacauuuuuccaccuguuccucuagucuuuuugugugcuuaaaaaaaaagugacaauuacgauauguguaagcaauuuuaugucaugauuuucacuuuacauuagaauguaaacauuacucuauguuauuaaaaaaaaaaaacccuguaaacuuauuuugaaauuguugggcugggcaagguggcucccaccuguaaucccagcacuuucggaagccaagacaggcagaucacuugagcccaggaauuggagacuacccugggaaacauggcaaaacaccaucucuacaaaaaauuagccaggcaugguggugugcggcuguagacccacacccucuccuacuugggaggcugaggugggaggaucaccugauccuggggaggucaaggcugcagugccaugauuaugccacugcauuccaguuugggcgacagaauaagacccugucucaaacaacaacaacaacaacaacaacaacaacaacaacaaaaauaguuggauuucaccuauuguugaauuuuagguugcuucauucuuuauucuguuaugaauagggacacaguuacuuguaaauaaugcuuuguuuuugcauuuuggauuauuuccucaggauggauucucagaagcagaauuacuuggucaaaggguuugaagauuuuaaggauucuuuuccccuccuuuuuaagacagggucucgcucugucgcccaggcuuccuugcaguggcgcaaucucaguucaugguuuuuuuuuuuuuuuuuuuuugacacagagucuugcuaugucgccaggcuggagugcaguggcgcaaacucggcucacugcaaccuccgccuccuggguucaagcgauucuccugucucagacuccugaguagcugggauuacaggcgugcaccaccacacccggcuaauuuuuguauuuuuaguagagacaagauuucaccauguuguccaggauggucuccaucucuugacuuugugaucugcccgccauggccucccaaagugcugggauuacaggcgugagccaccacgccuggccaaucucaguucacuuuauggggccaaugugugagggucgcuugaagucugggaguuugagaccacgcugggcaacaaacauugugugacuucaucccuaccaaaaauacaaaaacuagcuggcugugguggcaggugccuguggucccagcuacuugggaggcugaggugggaggaucgcuggagccugggaaguugagccugcaguaaucugugauugugccacuguacuccagccuagugacagagucagacccuaucuccaaaagaauuuuauuuuuuuaaaaaggaagcugaucagaucuacccucucugauucagcagucucucugcuuucugguccagcuggagaguagggcauucuagauaacagggaauucauaucugugccacagagcacacacuuuuuuuuuuuuuuuuuuuugagacggagucucgcacuguugcccaagcuggagcgcaguggaucuuggcucacugcaaccucugccucccggguucaagagauucuccugccucagccucccaaguagcugggauuacaggcgcccgccaccaugcccagcuaauuuuuuguauuuuuaggagauacgggguuucaccauguuggccaggcuggucuugaacuccugaccucaugauucaccugccccggucucccaaagugcugggauuacaggcaugaaccacugcacccagccuacacuuuuuuuucuuuggaaauagagucucgcucugucacccaggcuggagugcaguggugugaucucagcucacugcaaccuccgccucccggguucaagcaauucucaugccucagccaccugaguaguugguauuacaggcaugcaccaccaugcccagcuaauuuuuuguuuuuuuaguauagaguuuucaccauguuggccaggcucaccucaacuccuggccuccgccugcccuggccucccaaagugcugggauuacaggugugagcuaccgugcccagccaguucaugcguuuuugaaaaguuaauugaauagaugauaaaauguacauguucaugagauauuuauaaacuuuauuuguuuauuuuuuuucuggagacagaguuucacuauguuguacaagcuggccuugaccuccugagcucaaguaauccuccugccuuagccucccaaguagcugagacuacagaccugagccaccauccuggcuaguuaugggauauuuagaggaaaaaaagacgccuuuauguugcaaaugaggaagccuuggccuagagagauugauguuugccaaagucagauaguaaccuagugguaggucagggucuagaauucagugggacuagauugaaggucucugaauguucuucaggaucucugaugccuuaagacuguuuuuacaaacguuaggccgggcaugguggcucacaccuguaauccuagcacuuugggaggccgagguggguggaucacucgagauaaggaguucaagaccagcuugggcaacauaauuuucuacuaaaaauacaaaaacuagccgggcaugguggcgugcauguguaaucccagcuacuugggaagcugaggcaugagaauugcuugaacccaggaggcggagguugcagugagcugaggucguaccacugcacuccugggugacagacugagacucugucucaacaacuacaaauguuauugugcugucacugauaugaaggugggccuguuaccagagaauucugauggacgggcaggagcagaacccucaccugaaccaucaccugugauuuguggcauuugcaggggaggcucugcaacagcccagggauugugucuugugaaacugcgcuucaacugcggguuucuucuaccucugaaaaucucccaagagcacuuuuauaaucaugaaaucuaaacuuagaaacuaaaaauacucuuagagaucuuauagcucaguccuuucauuucuuagccagggaagaccuagagaguccacugcccaagccaaagccacacaguuuaauagugcacucuucacucugucaagccaccggcagggaccuucugcaucacccagcugucacugggacucuaccagguaaggauccuugugggcuggaaacuggugguggagcggggguggggguggguucuggcacccucugcuggugcaaaggggucagugcaacucuaggaauggcuuagggaguagggaacagguccucuggaugggcuggugggcuuuugguucugucaagaacuugagcaaacugauguguuuguguccaccccgcucccccuaccuccaaaaaacccgugcaauucaggaugaguguggaaccuguuucuucugaaaucuauaaugcagaguccagaaauaaagaugauggaaagguacacuuaaaauggaaaagugaguauaaagucauggguuuuauuagacaaaaugaaauuuaaaguauauuucuaaugugguugauauuucuaaguacacaaccuguguugcacauuuagaaccauagcaauguccuucugaauuuuuuucuuuuauuauauuucauuuuaaaagcagggcccuucugacuacagacuucagaagggaaaugcuuuuuuuuuaauuucuagacuuuauaggaaauauuucuaauauauaaauguauauuguauaagaaauguaacaaaacagugcacaauacaauaaguccucaccuuauucuguuaauaggaaaugacaaugacuuuaagcaaacuacgacuuuaagcaaaacgauguauaacaaaaccaauuuuaccaugggcuaauugauguaagcaagaguuaaguuccuauagcauauuucuggucacaaauacaucaccauacuucuaaauaaagaccaagacacuucuaauauuaaacauugaaauaaaugugagcuauguacacauuuaagagagauuaauaaaaacaaguaagauaaguaauuaccuguuuauucuaguucagggucacagguggcuggaaccuauccuggcaacucaggguacaaggagggaaccagcccuagacagacaccauuccauugcagaguguacucacacacucccacucacacagacuggggcaacuucaacacacuaguucaccuaacgugcacauauuuaggaugugggaggaaaccggacuaccuggaaaaaacccaugcagaugcggggagaacaugcaagugccacacagacaguggccccagcugggaauugauuguuuuuuuuuuuucucaucagaguuacaaugaaacaauguugaauaaaaugacauuauuugaggaacugcuacauagauauuuacuauauaacauuauaaaaguggagaguaugcagugucacucucauauccugugggcauuauucuuuguaucaguuuucucuuacaggcuuaaaggauauaaugucuauuuuuaauacuagucguaagugacauuagcagaaguguuugacaacauuugaaaugaaaacaugcauauauguaugcauuccaaaaauaugagcucaguguagucuggaaagacuagacaaacucaaauagaauacuuucuauuauuacacacuaagaacuauagaugucauuuuuccuguuaaaacuucacaggaagagggucuaucuguaaguuguuugcugccuuucacccuggaaguaagcaacaagggcuguuguuugggauaacugacugaaauucccuucucucucucugucaucaauucuccccugaccucccauucaagccaaacagggcaagcuaaggaugaugcaacuguaaaaaggcaauuguuacacuaugaguuauaauaguauuauguauuucuuuuagaugaaagccuguguuuccaguguuuacagugauguuuuaaaugcugcuuucucuuaugcacaguggaggugaaagaaauggcaaagaaagcagcuacuggacagcucacaguaccuccuuggcauccucagaguagucugacuuuagagagcgaggcugaaaaugagcccgacgcccugcugcagccccccauuaggagcccagaaaacacggauuggcagcgaguuauugaguaucauagggaaaaugaugagcccagaggaaauggcaaguuugacaagacgggcaacaaugacugugacagugaccagcauggcagacagcccaggcuuggaagcuucaccaguaaguucacuugcgggaaucaggauaggugaacucaaucaaguaucagucgggcgagguggcucagccuguaauuccagcacuuugggaggugaggcgagcggaucaccugagcccaggaauuugggaccagccuggucaacaugaugaaaccuggucucuacaaaaaaaaaaaaaaaaaaaaaaaaaacauuagcugggcgugguggcacacgccucuaguuccagguacccaggaggcugaggugggaggaucacuuggaccugagagguggagguugcagugagcugugaucaugaaacugcacuccagcuugggugacagugagacccugucucaaaauaaaaauaaaaguaaaaaaaaguuaucagcucucaaaaaaguaaacuuuccagcauauuuuuuuugguuugguccucucuccuuuccuacuuuucuggaaaccuugaauuccaggggaagacaguauagcccuauaucucauugcauuucccacaggcaaacagauccagacacugaucaguuuuuauauuacugaaacaggucccuuuguccaaaggaaguaaaauaaucaaauacugacccugguuuuggcgaggaaucgauccuucuuuaccuggggauagagguaggccaucacugccuacugcccaugucucugcauuguauucuaagcugaaauuaaauucucccagaauuuauuuagaauguauucuaagcuggcauuaaauuuuuccagagagucuaugcuggaggaaccuagagacacaugacauuuauugucaucgguuuauagauuuacagguuaaaaaaaaugaaggcuguauauuuucaguugauaauuugcuuauaaucagggcauggauauuguuucacaguuguuuauaaguuaaagaaagauacaucuaaacuugucauuugucuuaggcagaaaaucuauuggcuuggguauuauuuguauuuagaaucuguuucuugucaagcaucacucucgaaugggugggcagaugauccagggcugcauuuuggggucaggcuaaacuaacagucucuacucucuggacugaaccuaacguaugggacauggccacucuuggcagaauauguauacaucucuucuuucaugccaccuuuauccucuuccauguugucugaauaucacugaaugacuuugacccugacuguguuacaaucauuagguaucaggcacccaucucccagacaaaaggagcaaccagagcauagugaagccuuccaagcaaguucugacacauugguggcuguagagaaaucuuacaguguaaguaauacugccuggaaagccaaguugaacccaaagaucuaauaagauagaacugaguuauuguuauguguuaugacaccaaaauaauagcuauaguaguucuuuuuggcuggagcaugugccuucaugucacugacaugaauaaaauaaucuuuccuccugucugauacuuuuuaaaaagucaguucaacucaaugaauuguguauccuggagauugggagaguacagaaaagugucagauucagcuuuggcacaugaguuucuggcauaguuugcuaaacaaaacuagggcaaagcuccuuccccagcaggcgacugaggucaguuaggaguaggaaaagcaagggcaggguugcuaugagaguaucuucaccuggaauauccucuaagggccaaacucagcacccagcucaguggaagugauguguuugugccugacaacugcaccucagcaggaucuauaugcguuuccacugcaguuacagccuugcuucagggcuuuaacacacucuaggccauagcgcagccagacuaagaaaccaaaauuuuuuuauugucauugacaugggauugcaaucauuuaaagaauauagacagcaauugagaaugauacaauauaugaauacaauagugauaaaauguaaggucuuuugaccuauuguauuuaaucauggcauaugaaccauucauaagaucaacuuauucuuucucggacuugagggcuggaagaacagucauauuaaccauacuggcugagcuggagaagcaggccuaggcaggaaaguggggaaugucugccggaggccaggacgaauucaguuugaugagagguaaagaggagcagcuguuaagugcacaggaagggaaguguguggcaaaaagcaguguccgaggaaauuagucacaaaaucucugccaagagaucacugaagguuggguguaguggcucacaccuauaauuccaguacauugggaggcugaagcuggaggaucgcuuaaagccaggaguucaagaccaggcugggcaccauaguaugacccugccuacaaaaaaauguaaaaaucagcugagugcaguggcucacuccuguaaucccagcccuuugggaggccaaggugggcagauugcuugaguccaggaguuugagaccagccuuggcaacauggcaagaccccaucucuacaaaagauacaaaaguuagcuggauaugcugcaugccucuagucccagcuacuugggaggcugaagugggaggaucaccugagucuggggagguugaggcugcagugagccaugaucaggccacugcacuccagccugggggacagagugagacccugucuaaaaaaaauaaaaauuagucaggcaugauagugugcaccuguagucucagcuauucgggaggcugaggcaggaggaucgcuugagcccagcaguucaaggcugcagugagcugucauugcgccacuguacucuagccuggguggacugaaugaaaccaugucucaaaaaaaaaaaaaaaaagacugaagugagccauuuguuuggccacauaguaaucagguccugaauauugugaaauaagcaggaaaaaagggguggagcagagaugcuaaagaaauaaauuugcaggccggucgcgguggcucacaccuauaaucccagcacuuugggaggccgaggugggaggaucacuugaggucaggaguuugagaccagccaugccaacauggugaaaccccaucucuacuaaaaauacaaaaaguagacaggugugguggcacacaccugugaucccagcuacuugggaagcugaggcaggagaaucacugggaccccagaggcggaggcugcagugagccgagaucaugccacugcacgccagccugggugacagaggaagacucugucucaaaaaaaaaaaaaaagaaauuugcaggccgggugugguggcucaugucuguaaucccagcacuuugggaggcagaggcaggcagaucacgaagucaggaguucaagaccaguuuggccaccauagugaaaccccucucuacuaaaaauacaaaaauuagcugggcaugguggcacaugccuauagucccagcuacucaggaggcugaggcaggagaaucacuugaaccugggagguggagguugcagugagccaagaucgcaccucugcacuccagucugagugacagagagagacucugucucagaaaaauaaauaaguaaauauaaauuugcugcuuuuuacuauuuuauuuuuauuauugagacuacauugcuguuuuuaaaaugcuucuucauuugccuuuaaccuauaauacucaagggacucacagguucugaguagccgcagccuccucaucuguaagaugaugccaacacaugggcuaugucucugccugugagggauuaguguguuuaaauucaguccucaacuugaguugacuagggccuuucuccuuauuuagaauauuagaauaggacggucaccucaucuccacccauucugcagaugaugaugcugaggcucaggauuagcauuccuucaugcuauuccagucaguuaacagcugcuuuuccccaccaggaagggaaggcagaggcacaugcacaaagagguagggagagucagcucagugucacacugacugcuggguaguguuagauaaccccguuguuaacacugcauccaacuauaaagggauuucguuacaaugaacagcaacuuaaaagugauuuccuacauuauuaauagcaucaguccaugcaaucaacuuguucaccagagucuucugaggauauaacagaugaauuuuuaacuccagacggugaauauuuuuacuccucgacugcucaagaaaacuuagcucuagagguaaaaaacgcaguucaggguaaaguaccuuuucaccuuucuccauugccuuauuucuuuuauugagaaaaauagcuuacauaucaaaguauguaaugucuaccaggauuuuuuauaccuuuuuuggugucaggagugugauaugaacccaugcauucauacguguuuugaaaaacaucugaaaauuuuuuuauuuuugaggaugggaagucaugugcaguuucucccaaaauugugguuacugcauuuauacagcacuuuguacuuuuuuuucaaaacuuuuuuuuuuuuuuaauuuuugagauagagucucgcucugucacccaggcuggagugcaguggugugaucucggcucaccgcauccucugccucccggguucaagcgauucuccugccucagccuccugaguagcuggaauuacaggcgugugccaucacacccagcuaauuuuuguauuuuuaguagagaugggguuucaccauguuggucgggcuggucucaaacuccugaacucgugauccgcccgccucggccucccaaaaugcugggauuacaggcgugagccaccaugccuggcucaaaauguuuuuauucaugcuacuuaauucauacuuccuaaugggaaaggacaaggcuaucauuccucucucugaggaagacugguguucugcagauauacggaauuaauuaacuccagccugccaaguuuuagugaugggagagccaggauugaggcaaggguucagcaacaaauaugagacuguccaauauaccaaguuuucuugggaaucugccuagcuuuuacaagaaccuccuguacagaguauuuucauuuguaaaaugaauuuugaugaauucucuuauuuacuuauuuuccacccuaccucccugcuaaccuggcaccuuuuugggaucuuuuaccuauaugaaagggaggauugugucaaucacaguauuugacugauaagaauucuaggaugcaucaaagauguaauuucaggccaggcgcgguagcucacgccuguaaucccagcacuuggggaggccgagguggguggaucgugaggucagaaguucaagaccagccuggccaagauggugaaaccucgucucuacuaaaaauacaaaaauuaaccgggcgcaguggcaggugccuguauucccagcuacucgggaggcugaggcaggagaauugcuugaacccgggggacagagggugcagugagcugagaucgugccacugcacuccagccugggcgacagaaugagacuccgucucaaaaaauauauauauauaauuucagcuaggugugguggcucaugucuauaaucacaacacuuuaggaggcugaggcgggaggauugcuugagcucaggaguuugagaacagcuugagcaacauagcaagaccuuguuugaaaaaaaggaaaugaaacauuacuaguccccaaaagaccccuugugaucccauccagucacugccucuuccaaaaggaaccauuguucugacuucuuaccucguagaguaguuuugcagacugggccagcuuuuaagccuucuuuagcucuucugauaaagcucccaagaaccaaaauaucuuuguuggaagauuggguugaauagggauagugauauaaggaggcggagucacauaauuccucuucacaaugagaggugagggaggacuuacugaggagaggacauaugauacaaauaaguacuuaaugucuaggaagcaaguuugugcuuuuucuauaaagaugcagggaucuuaugaagauuuucaagauuuaagaacaucaagaaauuauugaccuuuuaauaugucugccuccagugaaccuccuuucuuugcuuuucuuuuguucuuuuuuagaccucgagucccauagaagaggacuuugaaggaauacaaggugcauuugcccaaccucaagucucugguaauaagcccuuagggaagauuccuugagaaucacuucccuuaaauuucuucuguuggaucacagauguuuagagcuggggggauccugagggacagccucguccaaaccuuucauuauaugguugagaaaaccaagguucaaugauuucuccucaauagaacaaaucccuuccuccucaccaaccucaugacauccacguguuguauuauuuauaccuccccuugcauuuuuauagcaaauguuguuguagucacugcuuuuucccccuuuggucucucaagcuuucaggcuccuuggugugccacauagcaagugcaguuaucuuugcuaagcugaccugggggauuugcccaagcuacauagcuaguuauuaacauaacaaaauuagaacuagguuuucauguauuucuucuccccagaaggcagugucaccagcauuuuccuuugcuugcuuagcaucuuagcaaagaguuaguaacaguuaacaaugcagauucaacuuaacaucuaccacuugggaggccuuggguucuauauaacuuagcaggggcuuucuuuuagaugagaagguagccuuggaucaguagccagggauguggcaccagacagauauaaguuaacuguuggcuuuguuacauuuuuaaaauuguguacucuuguucuuuuaagguauguacucaucuauuuuaaaaguagaguuauccaccuaccaaccuguguagcuauccauggucaugucucaaccgucuaaacccaaacagcguaguguuaugaacuuacucccuucuuccacugcauacuccagcuuccaacuguaaccuugugaaggccccugccagaguugggagcauuuuaagaagcuguaagcuuuuagaucaacuuuuacuuaaagucucagcauaauauguauuaaaagucuccagagccuugggccacccaccucuuccugcagagccucuuuuuuggaccugccuuguauguggccacuuaacuuguauguggaggugaguugagugggauggaaaaguuuagggcagacaggucagauaaccagagcuaguuuaauacagacacaugaaguaugugaaaaagucucugauuucuacuccauucacuucuuucugccccucucugcccccuuuuccuucuacuguucugauauauauccccuuccacaugagaggacacaacagggguacaggaugcagcaugcuagguuccaagacccauucugccacugacuuuuucugcauaaccuucagcaagucacuucaccccagggcccuacuuuccccugguauaaaguaaaggagagggucggacucuaaagucucuaagcucuaaauguugcuucuuaggaauuaguuuaugcuuucuggauauuuaucauuuuaaaagggucagaggaagaggaacccccaaugucucuccacuggugggguuucagagcuccuugguagcugugaaagguggcauuguucugaugggccuucuuagugucuaccagaccaccuggaccuaaggaaugggaugggggugggggagucauaggcauuuggaaacagggcuggaugcuccaucugcccccuucuuuauuaacuaggacaguacaguggugggaaggaaaauggauacuggcccugccugccuggagcaaagcaucuuacugagaacuggggaggaguaacuucagauaacuugaugccaagaagaacagaagacaguugaauuagcuccucaguacucaagaccccacgcccacgcccacgcccacaccuaguguuugauggccaaguggcauaguuagaguucggggcuguuuaguuaacaaacaguucuuguuuucaacgcccccuggcgucuguugacaggaaccgggucaguuugccuucuuaaaaagacaaaacaacauuugucuucagaaauaacugugguuauaacugaaaggccaguaaauagcuugauuguauucugagugucagaauauaguucugugcucugagcaaggaaaauaaacuuucagagcaaaaaccucuucuacagcacucaauccaaacccaauuagggcagcacuuuguuuauccagauuauuucuaauucuggaccagaccaagggacauucuagggaauggugacaauaauuuggguugacaaagauucaguaaaaaaaaauauauauauauauuuuuaacuuuauucuuucaggugaggaaaaguuccaaaugagaaaaauucuuggaaagaaugcugagauuuugcccaggucucaauuucaaccuguacgaagguaugggcuauuauuaucuuaugcaguuucaaacucauagaugcaauguuaaauggugauaaugcuccguguuuauauauugcuugucuucagauguauuagcuacuaucuuauaaaaguuagcuuugggcagcuuagcuguguuaggacuugugcaguagaauuugagggauugagucaucaccuuuacuuagaucugacucugacuuucuguucaugugaccuugucaagguucucaaccccucuauucuauuuucccaucugugaagcagggauaagaauccuuacugagaauguugacaauaggaacuuaaaguaauaauauaacuccugggcauuuaucccagagagaugaaaauuuacauuuacacagaaauacauacaggaacguuuauaacaaauuuauccauaauaccuccaaacuggaaacccggauguccuucaccaaguaaaugauuaaacagacuuugguacauccauaccauugagugcuugcuacucagcaguaaaaagaaauaaacuauugauacaugcaacaacuuggcuaaauuuccagagaauuaugcugaguaggaaaagcaaucccaaaaaguuauuuacugugugauuccauuaauauaacauucuugaaaugacaaaauuauaaaaauaaagaacagaugagugguugccagggguuaaggaagggguggggaaaggagggaagcaggcauagcuguaaaccagaaauaucuuugugguaguagaaauguucuguaucuugacuguaucaaugucaauauccugguugugauacuguccuauagauuugcaagauguuaccacugggauaaaguggguaaaguguauuuucuuuuucuugagauagaauuucacucuuguugugugaucucagcucacugcaguggcgugaucucagcucacugcaguggcgugaucucagcucacugcaaccuccaccucccggguucaagugauucuccugccccagccucccaaguagcggaauuauaggcaugugccaccacaccuggcuaauuuuguauuuuuaguagagaugggguuucaccauguuggccagguugaucucgaacucuugaccucaggugauccaccugccucggccucccaaagugcugggauuacaggcgugagccaccgcauucagccaguaaaguguauuucuuacaauugcaugugaaucuacaauuaucucaaaagaaaaguuuaaaaaauucauaauuguuauaacguaucuggcacaauaacauucaauuuauuuuauucucucugggccucaguuuccuuaauuauaauuauuguagcuaguauuuccuaaauaucuagcauaugccaggcacucuguuucauugucugauuuaauccacauaacaacccugugaggcacauaccauugccuccauuugccaguaaagaaagcaaaguucagagaguuuaaauauuuuuuucuaaggucacucagcuagucagucaggauagacuagauuaugcuauauauaguaaacaacucccaaauuuuagugguuuaaaacaacaaguuucuucuuugcuccugcuucauguccauggcucauggguuggccaggaauguucugugcuauauugccuucuaucagacuuaggcugagggaggccccauuuuugugcuuccuugauugcuaaggcaggaaaaauggaacacggugaguuguguacuggcuguuaaaguuucugcccagaagugacucaucacuuucacucauauuuuauugguuaaaacaaguucuguggucauuuauguaaaucaagagggccaaaaaguccuguuguauuauuuagaaggagaaacaaacauuuuugguaacagaauuaauaaagucacaacucaaccccaaauccaugaucuuucauuuauaucacuggucucagaggauuuuugcaaggauuaaaaaugugaaggacaggcacaguggcucacaccuguaaucuuagcacuuugggaggccgaggcaggcagaucaccugaggucaggaguuugagaucagccugaccaacauggagaaaccccgucucuacuaaaaauacagaaaauuagccgggcgugguggcgcaugccuguaaugccagcuacuugggaggcugaggcaggagaaucacuugaacccaggaggcgaagguugcagugagcugagaucgcgccauugcacuccagccugggcaacaagagugagacuccaucucaaaaaaaaaaaaaaaaaagugaaaacauggaaggauuuagcaugggaucugccuuauaguuaauguucagugaguacugacauugaaucuuaaauauugguuaaaguagaaacaggucaaguuugucuucacuauucuggccauuuuuugguacaagccucucuggccucuccugguacacuaugccaggaagcuucuuacaggugcugaggccucauggcugugccccuuugcuccaauaucuuaccucccagcaaaguuccugugcucuguugauuuucucaugaauuugcucacagucguauagagucuuuaacugauuucagagcugacccuuagagaguauuuauucaacucuggagagaaaaaugaggcccagacaugucagagaacucgcagcuaguaguacagccagaaccagaacucacacuuuuuuuuuuuuuuuuuuuuuuuuuuggagauggagucucauucuugcugcccaggcuggagugcaauggcgcgaucucagcucacugcaaccuccgccuccuggguucaagcaauuccugucucagccucccgaguagcuggaacuacaggcacgugcuaccaagcccagcuaauuuuuguauuuuuaguagagacgggguuucaccauguuggccaggauggucucgaucuguugaccucgugacccacccgcuuuggccucccaaagugcugggauuacagacgugagccaacgugccuggcacagaacucacacuuucuacuccugagcuuagugcccuuuccucugcgucucacacugggcugaucaacugguuccuuguagcaaguaguuaguguacuuuguucacagaggggauuuauguaauuuucuuacuuucuuucucacaguacugaagaugaacaagaagagacaucaaaggagucaccaaaggaacugaaagagaaagacauguaugaucaccaaagagaaugccuagggaugcuuguguaaagucuugguuuuaagggaauaguauauucuuguuuguaaggaucuuuccauuuuuacguguagacuuaaugugaguaugcugcuucuuucaccaaaaaguuguuaucaaauuggugauaugauuuauaacuaauagcagcuuacacucaaggaaauguagugaugauaauaauaaucauaauaauaauaaguuuacgcuuaagguagauuaaaucuguuuuccacguaaauauccuggaaauauggaauauuucaucuauggaaauaguuuauuuuuagcugcugauauguuuaaaguuacaguaucuagcaaagaaagucucuauggugccaggugugguggcucaugccuguaaucccagcacuuugggaggcugaggugggcggaucaccugagaucaggaguucgugaccagccuggccaacaugguaaaaucccaucucuacuaaaaauacuaaaauuagccaggcaugguggcacacgcuuguagucccagcuacccaggaggcugaggcaggagaaucacuugaacccgggaggcggagguugcagugagccgagaucaugccauugcacuccauccugggugacaagagcaaaacucugucccugccgccaaaaaaaagucucuuugguaauaaaguuacaaucucuuuuaaauauguucucuaauauucucuuuaagauacauaagauguucuaagauauucucuaauucuggccuauugccacauacaaauuuuguuaagauuauacuuaaaaaguaccucucaggaauauauuguuugauuuuucuagucaucuucucaucauuacugugugcucuuaauucuuuagaucauugacggauauucaagaccugucuaguaucuccuaugaaccagacagcucuuuuaaggaagcuucaugcaaaacacccaaaauaaaccaugcaccuaccagugucagcacuccacucagcccagguaaucacagggaagagaaguguuuggggagaaggacuuacagccccagcccauugucucugggaagccaagccgugguaucagagcugguggcuguguugucauagugcaaagguuuuucuuuagggccaaaacuggguaaucccauuguaggccagggggcggggugauggugguggugauuauugggcagccguuaggagguuuugguuagaacugcagugguaaagccaugcaaaugcuacaucuccucuaagcacuacugaauuuaguacaaaaacauugagcuuuguagaguuugcaacuuaaaacaguaccuugugcuuaaacuuuauauaguucuuaaguccugcaaccauaugcaaccagcaucaaauauccucucuuuaguggccuuacuuccaauauauuugugguuuaaaaaaucaccguuuauuuuauuuugguaaaguuuagaggccaaguuuagagacuauuauuuuuuauaccaugaggagcugugucucagaucaaugauuguuucaguaauuuuuuuuuuuuuuuuuuuuaaagacagagucucacucuguugcccaggccggagugcaguggcgcaaucucggcucacugcaagcuccgccucccggguucaugccauucuccugccucagccucccgaguagcugggacuacaggcgcccgccaccgcacccagcuaauguuuuguauuuuuaguagagacaggguuucaccguguuagccaggauggucuugaucuccugaccucgugauccacccaccucggccucccacaaagugcugggauuacaggcgugagccaccguacccggccuuauuucaguuauuaacaauuuggaaaauccuuaguauagguauagguuuguggguuuggauguuuuguuuguuuguuuguuuguuuguuuguuuuaauaauguaaaagauucauuucugcacaucauauuggggcagaaaaaacaaaaacaaagggaaaaaggaaaaaaggagaaauaauauaaaggauucagacaguaaccuuccgcuuuucuccaacaggguccguuucuucagcugccagucaguauaaagacugccuugaaaguaucacauuucagguuaagacagaguuugccucuugcuggaacagucaagaauuuauucaaacuuugucugaugacuuuauaaguguccgagagagagcaaagaaacuggauucucuccuuacuuccucugaaacucccccuucaagacugacuggucuuguaaguauaucaauuccacguuacaaacucauggagucagcccaaagggcccagugacccaaacugccaagauuucuccaaauucauuaagaaagcaagaaauaagcuggguccucuccuggcuugccugggacuccucucuugagucuauauuaugggaggcuuaaguuuugcuuccuccuuaaagccuucccugguuacuucccugagaguuuugaucgaucucuacuguucucugaacuccugaacuaauaaccugcaggaaaaacacuuaaucauauacugccuucuucuccuccucuucuucuacuucuuccuccuuuuuuuuucuuuuccucucccuuucucauauguguacccuagucaggaaaacuacaaguucuggccaggcacaguggcucaagccuauaaucccagcacuuugggagaccgaggcgggcagaucacuugauuucaggaguuugagaccagccugggcagcaugacgaaaccccaucucuacaaaagauacagaaaauuagcugggacauggugccaugugccuguaguuucagcuacacgggaggcugaggugggaggauuaccugagcccaggaggucgagguugcagugaacugugauugcaccacuacacuccagccugggcgacagagugagacccugucuccaaaaaaaaaaaaaaaaagaaaagaaaaguacaaguuccuuuaugaaaaauugauugucaacuuuuuugguauuuggcucaaaaaaggucucacuuugaaguagggagaugacaaggaauuuuauguguucauuuaaccguuaauugggcagauucuaagugccaagcaccaugucaggcccucuucaaggcauccaagugugaauaagaaagacaugaucccugccucaaaggagcucacugucuagugagaaagacaggccugauguaacacagcgguaaguacugagugcugaggaggcagucagggauaaggcuucccaggccagaugcaguggcuuaugccuguaaucccaccacuuugggaagcugaaguggguggaucauuugagaucaggaguuugagaccagccuggccaacaugaugaaaccccgucucuacuaaaaauacagaaaaaaauuuggcugggcguggugguacacaccuguaaucccagcuacuugggaggcugaggcaggagaauugcaugaacccgggaggugaagguugcagugagcugagauugugccacugcacuccagccugggcaacagaguaagacuccaucucaaaaaaaaaaaaaaaaaaaaaaaaaaaggaggcuucccagaggaggugacaugugagugaguuugacuuaaucaacaaaacaacuggaaaugacugagcugcauaugccuuuuuagcucaacacacaugacaguuaccauguuuaucucuuccuuauagaaaagauugucuucauuuauuggggcuggaucccccagccuuguuaaggcaugugacucaucaccaccccaugccacccagagaaggagccugccuaaagguacccuguguuuaauaucaaaauagaaguuuauaaucaaggaggcuuaaauugaugcuuaucaaucuuugaugccacauuagguucagacagaaaugcuguuuuccccaugauuauaaaaguaaaacacacucauuguaggaaacuuggagaauaaauaaaagcuuaacaaagaaggugacuauacacuuuuuuaaccucauguacuuuuuuuuuugcauaucuuuuaaauauuuuuauaaauauauaauaauauguuuuagcauagugagaucauauuguguaucaguucuggacugcuuuauucccuuguuauauuuugaggcuuuucccuuguuauuaaaaauuguucauaaauauauguaguaguuauaguccauucuacauguugcuuaaccauuuucuuauguuuaagauuuauaucauuuuccaauuuuugcucuuuauacauaaauuuuuaucuguaccucugauccuuuccuuaggauagauucuuagaagacaguuuccaaaucacaaggucugagaauauuagcagucuugaggcauauuaccuuuauuacuuuaauuuuaacgucuucugucuuugguauaacucuuggaauuucccucagggggauagggauuuugugaauuauguugagguauuuuggucaauguuauaauugagcacuuggggcaagacccaaagugugguugccucuaaauccccuggccugauaauauuuaguuaaaggccuccuacuuugugcuuuuguucauuuugacugguccagaaccucuguauuccuccagcagcccugguccagauugagccacuuaguaagaauuuguaccuuaccuccuccaaauauccuuaggaagggaggggcauagaucaagcaguaccaggguaagggcugauguaggaaaggaaagggauugggguagaaguggggaguaaaggccauucacauguuaggaggucucuacuggaacuauuauguaagaggcuuccuuccuccuuaguuuguuucaucauugagagaaauccucagucaagucuaugugagagccgagaaaaauucaguucagguccaggaggguguuaagacauuuucccuuuugucuuuuuuaaaaacuaguagaagccuucucacagcaucacauugaugagcugccaccaccaucucaggagcuacuugaugacauugguaagagauguucaauacagaauauacuucucggcccuguuaguuaugucacugaccacaguauggugucuuugucucaagugugaacacuaguauaaaaggcuguaugauggccugguugaauauaggaaggggcaguuuuccaaaauuuaggaaggggcaguuuugcaauaaaaugagccacagccuggccaggaugauuggcuugugucaguugucauuuuguuacuuaaaggacuuauguugaugaaucuaaggggaaguaacauucaagugguuuauuaugaugaauuucuuuuauuaaaggaguucuuaucuccuuuucagaccaaaccagccauuccuuugaggccugaggucuagcuucccaggccaagacaccugugcuuucaguuuugccauuagcuguagguauuaaagguauugaaauugugaauaaauccccuuccuaagaacagggaagucaguggcacaaaaccuacagagaccagaauuuucaggcagagcaguuaccaaccaaauuuuauuugcagcugauuggcuggcccuguccagcuggucugaugcugaaaguaaauguuacauuguuauggaaacuggggcagguggucuguuuuccuaggaaagacuugacugcgccuuucuugacagccuggccaaccagcccuucacccucagaaaaugcaucucaucagacucuggauaguccaguucuuguuaugggaccuauaauuuccugaggggcaccccuugguuuucagggucucugaggucuuggguuucauaaaggaggagguaaaucagaauuuucaggucugacucaauggacagcucucuucagggucauuaucauaacccuuagcuccugucccuuggccugaugaacuuggguggagccagucagugcugucagaccuuccuugguuucuuucuuuuuccauggucauaggaccuuucuugcuucacuuuaccccucccccagugccacaguguuguagagucacaggguuguugggucaggcucuuagagcccacacucccaccccugcuuuccauaucugggauucccuaggcaguccuugcaaauuccuccucuuugguugcucuucuuaaaauaacagaacugcugagaguggaggucaccccacacauguccugcucagguagauucuuaguaucauuuguuccucggucaugauuuaaggcaguauuguaggcuccuuugcaguuugaucauagcugauacuuuuucucuggauccugcugucuucccucuauaguugcuguguaaaccuuccauucaccuccuccauuucagcagcuguguuaccagacuuuguccugggcucuggccuuauggugcugcugcaccccagcacagucugcagaagccuucccucauuucacuuaugggaauuaucuggaccagguuucuagguaaugucugcacuuugagaugggucaguaauuuugcagaaggauaaagggcagagggcacuugaguaguuucuucugauaaugggcuugccugccugauuacuauauaucaucacucuguuguuucccuuaaagagaccuuuggggaguuacuggaacucucaacugcuauuuuggagggcucacauccaaagcucuaggcuccugacaggugccuaaaguggaagguucuuuagaacuaggauacagaugaucauuuaagaucugcgcaggacuacuuuuaacaaggacgaaaauggauuuuuuaaauuucaaauuauauuaaaugaucuuauggggacccuugacacccauggcugccagguaggacugcuuccugcacugcaggaagggagaagaccugcaccagcacagaagaggaccaugccaacgagcucaggguggcuugucuaugcugccucccaacuugcuuugcuuugcagagcacuuugaggauaaagcagcauacugaguuagcagaugcuugucuuagucuagugaguauuccuugccuugccuuuuuccuuuccuuuccuuuuuccuuuccuuugacaggguuucacucuuguugcccaggcuagagugcaauggagugaucucagcucacugcaaccuucaccuccaggguucaagcaauucuccugccucagccucccgaguagcugggauuacaggcaugagccaccaugccuggcuaauuuuuuguauuuuuaguagagaugggguucaccauguuggucaggcugaucucaaacuccugaccucaggugauccaccugccucagccucccaaagugcugggauuacaggugugagccacugcuccuggccaggcugaguauuucuuuaggaacuggaaaugauggauauucuuugcuuucaaucuuuucuuuuucuuuuccuuuuuuuuuuuuuuugagacagagucuuacucugucacccaggcuggagugcaguggcaucaucucggcucacugcaaccuccaccuccuggguucaagcaauucuccugccucagccuccugaguagcugggauuacaggugugugccaccaugcccggcuaauuuuuauuuuuuuaguagagaugggguuucacuauguuggccaggcugggcucgaacuccugaccucaagugaucccccugccucggccucccaaaaugcugggauuacaggcgugagccaccaugcucagccugccuucugucuuuucauaaaccaggaaaaaaguaugaaauauaggugaauagagauggggaaacauuuagauuguuuugauguuacuaacuuuuugagagacuauaaaauagagauuaagagcauaaaccuuagagcuagacugccuggauuuuuaccaauuuuaccacuuacugucugugugauuuuuaggcaaguuucuuaaccuaaauuuccucaucugcuaaauaggaguaacaauaacacagucuauuucagaggguuguugugaagauuaauugugaacauucauccugaauuaauguaugcgagugcuuagaaacagaaccugacaccugggguucugcaaguguuauguaugaucaucaucauuucuauuuugaguguugugugggauuuugucauaccuaaagaauuccuuucaaaccuggaaugcccuaaagcagugguucucaaauuuuaucagacaucagaaucacaugaagggcuaaguaaaacacacauugcuagacccccagaguuucugauucagcaggucugagaugaggccugagaauuugcauuccuaacgaguucccggguuauguuaaugcugcaagucuaaggaucacccuuggagaaccacugcucuagagaacggcaggacacgcaagggaggaaauaaguuuccuuuggcuuuuguguugugacagagcucuugaaacagcagcagggcucauccacgguguugcaugagaacacagcaagugauggaggaggcacugcaaaugguaagugaacuaccuagauuguuuucaucagguucuuuuaacgcuguccuuggcaacacagugguacauauagggaagugugaccuugaggucaggcacaacuccaccucaagucugacuuuauaguuauuuguauggcaagcuguuuuacuguuucugagccucagucgucuuaaucuguaaaauggggacaauaauuucugucucaugaaguacauauuagcuccauguacagagccauguacaaguacuaacauuuucaaauacuuagcaaauguuaguccucuucccuuuauaggacugcuggcaggauggaaugagauagcauauguaaaaugcuuggcauacauuaaaggguacaucccuuccccacccaaauuccuuuccuggagcuccaaguuagaaacaucuaacaagugagaacaagaugguccccaaaguaaauuugugcaauuuguuuucaugguugcuugccuccucuuuuaugugcccuuucuuucuucagcuuccucugucuuccuugagccuuggcacaagcaagguuuccuguagcuucaccuggcacugaaaagcuuccaagaccccagaagcagcugcugcaaaugcagguggccugcagacugccaccuggcccccugcucuccugggaagaggggagcuaaugcauugcacacuucagggaccacugauuggccuuaauuuuugcacucuauuuuaaggcaagcuuucucaauuuuuuuuucguucuaauaaaguuaauucuuucaacuguuuuuagaucaaaggcacuuagaagaacaagaaacugacaguaaaaaagaagauaguaguaugcuuuuguccaaagaaacugaagaucuuggagaggacacagagagguaacaggaaaagcuggacuguugaaaggauuuaaaaaauuguauaguuuauguuagguuuuuuucuaauauugacaaauaagaaagaaaaaaaguggggucuuuuuucauacuauccuaauagccccuauuccuaaaggguuacuuuuuuaaaaagcguugcuuuuuuugcuuuaaaaauguuuaauugugauacaauguauauaacaaaauuuaccaucuuaaccauuuuuaagugcacaguccaauaaccuuaauaaguauauucacauuguugugcaacuaaugucccaaaccuuuucaucuugcaaaacugaaacucuauacccauuuuaaaacuccccauuuucucuucuucccacacccuggccaccaccauuuugcuuuuuguuucuaugaguuugacuacuguugauacuuuacauaagugaaaucauacaguauuugucuuuuugugacuggcuuauuuuaacuuagcguaauguccucaaaguucaucuguguuguagcacgugucagcauuuccuucuuuuuuaaggcugaauaauauguuucauuuauccagucaucuguugauggacauuuagguugcuuccaccuuuuguuauggugaagaauucugcugugaacaugaguguacggauaucucuuugagauccugcuuucaauucuuuuggauauauacccagaaaugguauuacuggaucauaugguaauucuauuuuuaauuuuuugaggaacugccacacuauuuuccauagcagcugccucauuuuacagucccaccaacagugcacaaggguuucaguuucuccacauccuugccaacacuuguuauuuucucucucuuuuuguggggguggaggcuuuuuuuuucuuaaauauaguagccauccuaaugggugugagguggugccucacuguaguuuuaguuuucccuucccuaaugauuaaugauguugaacaucuuuucaugugcuuguuggccauuuguauaucuucuuuggagaaaugucugaguucuuugccgucugugugugugugugugugugugugucuguguguguguauacauauauauguauacauauauguaugaucuauauauauguauacauauauauguaugaucucucucuauauacauacauauguaugaucuugcgcucucucucucucucucucucucucucucucucucucucucucuauauauauauauauauauauauauauauauauauauaaauuagagaugggcuuuauguugcccaggcugaacuugaaguccuaggcucaagugaucuuccugccccauccucccaaguagcugggacuacaggugcaagccaccaugccuggcucuuugccuauuuuuugauaggguuauuuguuguuauuuucucuugaguuguuuuuaggguuuuguuuguuuauuuuuacuucauuuuguuaggcaaacacaaguuucagucucuuucaaaacauuuuaguuaaaggccuuagaagagaaaaugggggcagucuuccagacaauucagucuaaaaguacaagguugccucaagaaaccugacucuguuccugauuuggagcucuuuuugccuguguuguaggguaaacuacuucagcucaccuccucugccucuugacuucucuugaacuaucauuauucggggccaggacuagguuaaggugagcucaggagauagacuccuuggauacaaaauugaagggagcaccaaaaaaacucaguagucaaaauaaguaauauuuuagugcaauuuuuuuuuuuuuugagacagagucucacauuguugcccaggcuggagugcaauagggcaugaacaccacucacugcagccuugaucuccugggcucaagugauccuccugccucagcugccaaguaguugggucuauaggcucaugccaacaugccuggauaauuuuuguauuuuuuguagagaugggguuuugccauguugcccagacuggccuugaacuccugagcucaagugauccacccaacugggacucccaaagugcugacauuacaggggccaggcgcaguggcucacaccuauaaucccaguacuuugggaggccaagguggguggaucacuugaagccaggaguuugaaaccagccuggccaacauggcaaaaccccgucucuacuaaaauuauauauaaaaaaauuagccaggcaugguggcacacaccuguagucccagcuacucaggagguugaggcaggagaaucgcuugaaccugggaggcagagguugcagugagcugagauggugccgcugcacuccagccugggcgacagagcgagacugucucaaaaaaaaaaaagaaaauuaagcucuuuuuacgugaucaaaaguuagcuauuauuauuguugucucuuccucuuccaaaagggccagcagugcuggccacagauagaugccccacagaugcucagucaucucagugcugugaaugaucaaucuaggcaccaagccagaguggaagacauuuuuucagaugagcaggacuuucaggcauucuuaaaauacucuacccugcaucuucuagccuuuucuuggaaaaacauguaggaaagcauguauaguucuagccucagguagaaaacuaacucagugaccuagaauugagacagagucuaccaucagacuuggggaagcagugaucuuaauaggugcuaaggcuuuuugucaagggauuaaaggacuauuuuggugcauauuucuucuuucuuucuuucuucuuuuuuuuugagacagagucuugcucugucacccaggcuagagugcagucgcgugaucucggcucacugcagcugccgccuccuaggcucaagccauucuccugccucagccucccggguggcugggauuacaggcgcacgcgaccacgccggcugauuuuuguauuuguaguagagaugggguuggacuguguuggccaggguggucucaaacuccuaaccucaggugauccacccaccuuggccucccaaagugcugggauuacagaugugagccaccacacccgaccagugcauauuucagucagaucuaagugaccucuaugacuccagacacaaucucacugagcucuuguuuuuucauacauauagugaaagcacagguuuuaaggucccuuucuacucuaaaguguuaugcaucuuugucaagggggaugggaaaugacuguugucuccauucucuucacuuguccuuaaacagagcucacucuacucuggaugaggaccuggaaagauggcugcagccaccugaggagagcguggagcuacaagaccuucccaagggcucugaaagguuauuguuccccaaaggggaauccuuuucuucuuuuucaggaaguggggcuagguuuuagacuucuuggagaaugaaugccugaugauggcauuacauugauuuagauaagccagcccugacuccaccugucugcacucauauuugccccucuuccucugaccacccacaguacucaagauauugauuagcagauucauaucauuauagacagaggcuucuaaguuugcuguaucuuggcccugcuaccuuugacauuuucaucagucaugugaauuaaaucagaaaagguaugcuuaucaaauuuuuagauaacacaaaucuaggaaugaaugcugaugugaugagugauagacugaggauucaaaaucaucuugacagguggaaauguuagauucuguaaaagauaaaggucaaagauccaaaauuacagaaugugugagaccuggucuaacuggagaaguuuucaucagaagcuucugcucacuauaauuuuacugagggcaagaaguaugucuuauuuuuguaugcccaguaaugagccaugcaucuugagacaugaugagaagucaagaaauucuuccugaggaaggcaugggcaaugacucugugaggccuguuugaugaagugcugaaaaggucaaugcagcauugaugcuggauauauaaaaauguacuguccagaugacgguaaugugcuguucagaggaguccuaggacacauguggggcuccauucuggguaucacauuuuaaaagggauauuaacaaacacaagaguguggcuacagaacagucagaggucuggaaaccaugucauaugagaacagcugaaggagcugagaggcucagccugagaaaggcagauggaauggagaauuugauagcugcccucaaauaccugaaauauugcaaagugaagagagucagcuuacuugucugcccuagaagacuaauuagugacuagaaauugcagaguaacagauuuuuauucaauaaagcacaaaccuaauagccacagcuaucugauaaagggaaauagcugccugccuuuacacuuauuuuaguaaugguuacugcugcucaggcaguggcuggaugauucccuguccugggcauuugaacgggggcggaauauaacccaaaggccuccuccaacucuugaaccugugauucuauuagugggaaaauauuaagaggggaaaaaaucucucuucacucuagcuggcuuuauuuucucucucauuuuacguauuuuguuuugacuauccaccaaaugaaaacagaagaaucccuaaacaauguuauuuugguucaaccagcauccaccgagcacugacaauguccaaagcacugugcuaggggcuagagguaccacaaagagggauaagauggcucugccgccuauaaggaguuuccaguugggucggggggaugguuucugcuuaauagauugacaaacauggucuuaaauuuugagguacuuaaauuauuuacauauuucacuuaggagagaguuucgggaaaugaagauaagaugauaaaauaaaugaugguuuugaaagggacaccaaucaaaacuuaaguaaaaugccuuuuuuuuccuuuggagcaguauagcauagugguugaaagcagagucuaaggcagacugagucuaaggucagagucuagcucuaggaauuauuagguguguaauuuaacuucucugugccucgguuuccucauugcuuaauggggauggcagugguaacuaccuuauauaguuaugggaauuaaaugaguuaaauuauagcacuuaaaccaaugccuggugcauagagaacacucuuguuagugcuagcuauuauaugguuuuguuguuguuguuguuguuguuuguuuuuuguuuugaguacaguccuguuuucuuggcuguuguguauacguuuugauuccccaaauaauuguuguuacagggagacaaauaucaaagaucaaaaaguuggugaagagaaaagaaaaagggaagauagcauuacaccagaaagaaggaaaucagaggguguucuagggacuucugaagaagguaugaauuaauguauguuuauaauguagucuguaguccuugggcuuugaugugcuucaaaguuauuuagaaauguuucccagaugcuauacauaauccuccuaccuuugauaauuuauuuuucucugcaguucagcucagguuuucuguuaauugccaaucauagcuuuaucacaaaaacaguaauaacauccaauucuauuuccaaagcaagcuuuugcccagucucaucaucauuaucuugcacguugucuggggagacguuuugcugcuucuuuuuuuuuuagacaguuucacucuuguugcccaggcuggagugcaguggcacgaucucggcucaucgcaaccucugccuccuggguucaagugauuccccugccucagccuccugaguagcugagauuacagguggaugccaccaugcccagcuaauuuuuguauuuuuaguagagacgggguuucaccagguuggccaggauggucucgaucucuugaccucaggugaucugccugccucggccucccaaagugcugggauuacaggugugagccacuguacccggccgauguuuugcuucuaauuguccaacgucuuccaaagaguuuuaaauuuagcucacauagaugcuucaaaauccaguaauaaaucauauuuuauggaauuuaaguggagucuacaaguaaugugaaaauuauaaauuaaccuuaauuuuaaaacuauuuugauagauuuugaaggcuucugauaugcccuuuacaaugacgcucucccauauuuaaguucuuccuacucaggaaaguaagagacuuuaacucuuucagaucaucugguauuccuuucaccucuuccugauuuccuucucauucuccccaucucugcccugcuuugugccccagaaugcugacccuaguggacugcaucuccugggcuuccuguuugccaaugacaggccccagcagaagauuaguggggcuagagagaauuugggguauuacuuugccucacugcuuacuucagcaccuugugccugguagaaguggugucucuccacaagugcggcuucuguaggcaguccauucuucccaauuccagcucucauuaaggucuaguaacugaccucucaucuccaacacucaguuccuucagacuuaggcuucccacugcugcuaaucacuggaugccuugacauuccuuguuuguucccuuaacucuaaauaaaccucuguauguagucacuucacuaaggaucuuuauuugaaccagccguggguacauucuguuuccuccagaacccugacugcacagggcccagaacguguaggcauuuagcuauuaauaguauugauuucacugagaagauaauacagggacuuugugaauuagugucauuagcgcccauugcuguggcagaaaacuauagaauguuaggaggggaagcccauuaauuguguuuuuagaaagagucuaucuggcagaauauaacaaccauuguagguaaaacagucuacucuaaauuagagggagcacuaauaugaauacuggcacccuuugaccuagaaauuaaucauguuguuuuuuccuuccucuuauauuucaucaagaugaacuaaaauccuguuuuuggaagcgacuagguugguccgaaucauccagguaaugaaauaucagauguuuguagaucaaaagucauguuuauagacaacagaagcagacuuaaaaacauuuaccagugucuaaauacacauuaaugacaaagacuccaauuuagacaaaguugcuuaauuuuuaaaauguuaguguuuauaguuaauuaaacuauaaagugaaauuaaugccaacuuugauucaauaagugauagagucagcauaagaacaguuuuaggccaggcacgguggcucauacuuguaaucccagcacuuugggaggccgaggcgggcagaucaccugaggucaggaguucgagaccagccuggccaacauggugaaaccccgucucuacuaaaaauacaaaaauuagccgggcaugguggcaggcaccuguaaucccagcuacucaggaggcugaggcaggacaaucgcuuaaacccggaaggcagagguugcagugagccgaggucgcgccauugcacuccaccugggggauaagagcaagacuccgucucaaaaaaaaaaaaagaacagguuuaauauggagagaauacagaagaugcugcugucaauugcucuguagucauuuugcauuuccaugacacacuguugguuauaaucgcccuugauuauaaagaccaaaauuccuuucccuugaauuuaauugaauagaaagaggaugugguuugugucuuuaaaaaacacacauaccaacucgaaacuuccuuuuuuguucuuuaaaaaacaugugcauaggauaaucgugcuggaucagagugacuugucagacugauuggaauuggaucauagacggacuccuggccugaguuugaguguccugguuguaagcuccuuucuucucuuucugcuucaguugcugucagggcagcaguuccaguucuguaagucucacuuuguucagcugccacaauagacaucaucguuuggcccucucuguuagcagcacauucaaccauuuguuuucagucagauuucugaaaagugagagguaguuuugauaguaaaaauuuuugguugugccuagaauggcuuugguuuuguugauguuaauuuucaaaaacuuuaacucuuguuauauaauaaaauguuuaauuuuaauaacagau

SEQ ID NO: 192296 - RNA, 7025 nt, Homo sapiens
uauuuacuuccugcgggugcacaggcuguggucgucuaucucccuguuguucuucccaucggcgaagauggcccuggagacggugccgaaggaccugcggcaucugcgggccuguuugcuguguucgcuggucaaggugucagucggggaccugguuguagggcccaugggggaccaaggucggggaaagagggcggaauggggcugugggacaguaaagagaaaaguuaagucucagaacucagagguggcagggggagugagaagccgaaggaggccaucguuuaccucguaggaucgcggacaggucuugcagcugagggcaggggcggucuuacaugccuuugaauccucagcucuuagacguucggugaacuuacguuggagccgaaagacacugggagucagaggcggguggggauccgcugcugagugaguagucggaaaggaugccugacccugaguagacuagagaaaggaauagauaaaacggaauugggaacgagagaggaaggagugggagggugggacuuaggaaugaagcuuugagaguaguagguggggaaccuuaggauacacagucaacauagggaaacaagaaauugagcaggucgaaguauugagaaagcuacuuuuucucuuggucuuguucaugcuuaucucuccuuuuccuuuauuuuucuuucacucccagacuauagaccaguuugaauaugaugguugugacaauugugaugcauaucuacaaaugaaggguaaccgagagaugguauaugacugcacuagcucuuccuuugauggguaagccgcuucaguuuccaucauucacuucugcauuacccaaccugcacccagagaaguaaaugcagggcaaguguuaauccuaguugggcccagccauucguuuuuggggguuauuuuguguggguuuuuuuuuuuuuuuuuuuuuuugaaucaggguuuugcucuguggcucaggcuggagugcaguggcaugaucauagcucacugcagcguggaaugauccucugacuucaaccucccagagugcugggauuauagguguaagccacuguguccagccucaacaguuauuuugggacauacuagugcuaugcaucuaauacagugaccacuauccacguguagcuacugagcacuugaaaugugucuaguccaaauuaagacaugcuuuuaaguauaaaauauaccccagauuucaaagacuuaacaugagaagaaagaauguaaucuuaauaauguuuguuaaaugcaugaaaauuuuuuuugaaaaugaagggaagggagguguaguaaugguagaucauugcccaaaagcuguugcuuuuuuuuuuuuuuuuuuuuuggacagacuuuucgcccuugccacucaugcuggagugcaauggugcagucucggcucacugcaaccucugccuccuggguucaagcaauucuccugccucagccucuugaguagcugggauuacaggcacccaccaccacucccagcuaauuuuuauaucuuuaguagagacgggguuucaccauguuggccaggcuggucucaaacuccugaccucaggugaucugcccaccucggccucucauagugcugggauuacaaguaugagucaccaugcccggcccauuuuagccauuuuacuuauuuauuuauuuauuuauuuauuugagauggagucucgcucugucgcccaggcuggagugcaguggcgcaaucucggcucacugcaaccuccgccucccagguucaagcaguucucugccucagccuccugaguagcugggauuacaggcaccugccaccauacccagcuaauuuuuguauuuuuaguagagacgggguuucaccauguuggucagacuggucuugaacugcugaccucgugauccacccgccucggccucccaaagugcugggauuacaggagugagccacagcgcccggcugcaauggcacgaucucagcucacugcaaccuccgccuccuaccucagccuccugaguagcugggauuacaggcgcccaccaccacgcccagcuaauuuuuguacuuuuuuuaguagagacaggguuuugccaugcuggccaggcuggucucgaacuccugaccucaggugauccucccgucucagccucacaaagugcugggauuacaggcaugagccacugugcccggucgccauuucuaaauacacaauucaguggcauuagugcauacucacuguugugcaaccgucaccaccauccaucuccagaacuuuuuucaucuguacccauuaaacacuagcuccucguucucuccucccuccugucccugacaaccaccaugcuuugucucuaugaauuuggccaccuuaggcacccuuagguaccuaugggcucauucaguagcauuuuuuagcuucuuucaccaacauaaugucuucaagguucauucauauuguaguaugcaacagaauuucccuccucuuuugagcugaauaauauucccuuguauguguauagcauguucugcugcccauucauucaucaaugauaucuuggguuguuucucccuuuuggcuauuugugaauaauacugcugugaacauugguauacaaauauguguucaagucccugcuuuucauuauuuucaguacagaugcaccucaacuuccgaggaguuacaaccuaauaagcccaucauaaguugaaaauauaagccaaaagugcauuuaacacacccaaccuacugaauauaauaaguuagccuacuucaaaugugcucagaacgcuuauguuacuguggcugaccagaagcuguggcucauggcugcugcgcagcaucaugacagaauauuguacugaauugcuagccuggaaaagaacaaaauuuaaaauuugaaaacgauuucuauugaaugcaugucacuuuugcaaaaucauaaauuugaaaaaucauaaguugaacuaagguaagucagggaucaucuguauauccacaagugaaauugcuagaucauaugauaguucaguguuuaauuuuuugaggaacugucauacuguuuagcaacugcaccauuuuccauucccaccaacagugcccaaagguucuaauuucuccccauccucaccaacacuuaauuauuuauuaauaauagccauccugaugggugugacuuuggugucccauuucccccaaugaauggugauguugagccucuuaggugcuuauagccauuuguauaucuuuggagaaaugccuauucaaggccuuugcucauuuuugacuucaguuugguuuuuuuguuguuagguuguaggaauuauuuguauaauucuagugcauauuaggucuuaaagagugggcaaauuaaagaucggaagagggcuagaugaccucaaccagaauuggaagagguaguacuuuccucuuaaggcaagaaguuugggauuuuugaggaaguugaggugagagagagagagaacauuccaaauaaagggagugacuagagcaaaggcuuaggaugggaaaaaccaggauguuuuuggagaacagugggaauucuguuuagguuaaaucauaagguugggcuguagggacccuaaggcuaaaaagauagauugcaaaggacagagaagaauauacuuguggucaggaggauggccugcauacaugccuaucucccaucaggcugcagggcugggggcuaguguucugcuugucaccccuggagguagggucgguuccacuuaacagcgcauggcugagaauguaggauuuggaugggaagggaaucuucucaaauaagaauccaagauuguuacugagagaagaggggaggcauauugaggcagucaacaaaugucagugcuuacacccacacaauaggcagucaguaagcauuugauugaaugcguugaaugacaaaaaugcuuacccaucuugcucaagcagcaucuucuagcccuugaauagccuuaccauuccucuggaaucacagcuaccugggaaggacuauuaggauaaugaggagagcuaaugcuuauuuagcaccuacucugugcuagucuuugugcuagguguuuuucauguauuaucucaaccuuugagucucagcuuacugaugagguucugagaagggaaccccacauguauaggucauuagagggguccccauauguauaggucauuaagaggaaaaguuuagccaaguugaacuccuuucuaguaggaggauccguuguuuucacucacccuccucuuugcacuaggcccuagaccccuuguaguuguguuaguuguaacuauuggaccccuuguccuaaagccgucucauuuucuagggaauguuaggcuaaggauguuugugagcugagugagauaaucuuuuggggauggaaacugaccuguggcuggccggccaaggacauaagaaugaagaacuuuugucaguccuagcuuugagucagccucaucccaacaucagaaggcaguuuugccagcuuuccaguggagacucgguacuuggcuuuuuccuagauuccucucucagaauugagcucaggcccagggaggcucaggcugacucuccauuucuuuucccucccuagaaucauugcgaugaugaguccagaggacagcugggucuccaaguggcagcgagucaguaaguguuggccugucuccuuuuggcuuaguuguaguguuguuacuguuccucagguccauuagggagucucaaaucagcaagaugagugaccucagggugggaaagaucggguuguaggaaacacagggaagcaguguccugugccuugucauuuaacacuuguagccaaaagagggaauagcucuucucuuggaguugcaucacuucuuuagcuuaagcuuccauuugaucuugagucuuaacuaacuucacuguaaucuuguaucuuuuuucuucucucucagguaacuuuaagccagguguauaugcggugucagucacuggucgccugccccaagguaauaauaaucauaacagccaauguucauuuacuguaaagcucuguggaaguuuuuuuaucugaauuaaugccaauucucacauucuaugagguucagcauuuuacagauggggggaaccaggcacagagagguuaaaucacuugcuggaggucaccagguaguaaaugaggagccaggauuggaauccaggcauucuggcuccagaauuuuugcuguuucuguuuuuuauuuuuuuuagagacaaggucucacuauguugcccaggcuggacucuaacuccugggcucaugugcuccucccaccucugccuccugaguagcugggacuacaggugcuuggcuuagaaccuuugcuuuugaugacuacauguaucccucuuuuucuucucauucuuaccgaauaccugccugggucuucacuaguaaugagucaacuaagcaggaccuuuuuuuuuuuuuuuuuuuuugagacagagucucugucacccaggcugaaguauaguggcauuaucagagcucacugcagccuugaacucauggauucaagggauccucccgccucagccucccaaauagcuggcacuacaggugcaagccacuacaccuggcuaauuuuuaaaauuuuuuuguagagauggggccuugcucuguagcccaggcuagucuugaacuccugaccucaagugauccaccuugaccucccaaagugcugagauugcaggcaugagccaccgugccuggccaagcagacgauugauaaguagucuaggaacuccaguuugcuuauaguaccccccucaagguggcagcugaguggccuaucuuacccuucugaaucuuaccucacagaacuguuucuuuuccugcuucaggaaucgugcgggagcugaaaagucgaggaguggccuacaaauccagagacacagcuauaaagaccuagcaagaugcaaggcugccagcaucuuugcucuccaccuccugccucugcuuauuucuuguucuggaacuaaaugaacagaacuucaaauacuuccuacccuccaauucagacucagcugacuguugagagagcagcacaucauuuuaucauuuuaucuucuuuggacuacagguggggugggagggauuuggguugguggauuaacagauggaauugaggagagaguaggaugcugauuuuccuacccguggcccaggucugugccuuccccaugccaaggacucuaggucaaaugucaauaaauaugaaccucgagaaaguucugaaggccaugacaccugccuugccucccucuuccauucucuuaggcacaguaauagcuuauuugcccuauaagaaccuucccagagcagcagaggcccuucuacucccucuugacugucucagccucugggauugcagccuuuguagugugcuuccuugcuuccuaucggagggugcugauccagaggcucaguaaccccaucaacuugguggcccuggugucucacacuuguauccuucugcccucgagaccuggcacagcaguaucccuugaagaaauccugaggcuuuguagagugcuccuugaccauguuuaauaauucuucccuccccugcuugucuauuuucuucucuucacggcucuuccuauaccuuaggccagucucaagcacucacuggagacccuugggccuugggcgaccauugaguccuagucucccuuguuugugccccuguaggagguagguccuuuucuccuccggccuaguaggggaccuuggguaacaucccauuuuucggccaaggugaguuguuuuaggauaaaaaaauuuaccacaaauucucauuuaaauuuccacagaaauccuguucguauccccauuuugauuucccuaaguuccuuguucucccucuaaaaagagaaugauugcacccugccuguuuaccucaggauuguugugauuguagaaacgaagcuaugugaaaauuauauaaguauuauaaaggugaaauacuuuugcucuc

SEQ ID NO: 192297 - RNA, 35571 nt, Homo sapiens
aacuuaaccggagcgugcacacccgccugcgaggcugacccgagcgcgucccacccaaggucgcccagccccgcgggcguuuacuuuucaaaggucguguguacacagucugagccggagcugccccuucacuucuggagccucgcccaacuucucacccucggcucgcccgccggcgcagccccugggaguuccgugcggcgagccaggggaacugggaagaugggccgggacaucggccgguugugauccaaccguguuucgggcugagggaccguucgaaccgaauuggggucuggaggucggaggcucaggggcgucucggggggaauuugcauucguagccccugcaggcguguccggagggguggaggccguccagccuggggugucugccgaccucacgcccgggggccccgacggucacguguccggccccgccugcggcccagggcccggggucugcgaucuggagggaccgcgccaguuuugggguuacgaugugcuaggagaggcaguggcuggaugccucgaacgcgggcuuucuggcguucaacucuuuugugcccuagcugaaggucuuccuguuucccuuccagggagggauaggagaagaaaggugcugaucgugguaggcggugcuguggcgacucggaacggcaugggagcccugggcguuucgggaucuuccucuccugggggauguccuggguggcggcgccuuccugccgccguuaacacaaacccgguggacuucgcuccaggugcgagucgaggccucucaagcuggguaggguguaugcgcagggcaauuagugagguuaaccuggguaucuuuccccuacuguagugcgcguuacuucguguuuagauuugucuccagugaaaucuaggcugcuggaccuggugcaacaguaucuguuaguuacugaucaaggaacaccguucacaaaaagcuauuaauucuggcaacuaguagccuuacaagcucuuguaacugcuaaguccuucccaaauuaguaccuuuuuuuuuuuuaacucuuuauuuagaaagcaaagcuuggacucuuagcaccacccauccacuuugcucuuaaagguacagaacaucuuugaaaugaagaaggcugccugacuugaucauuuauauaauuccucugaucuuggcauugaagugguucaccugcugauuauuuaagacccugagcacuggaagcaagugaaguuauguuuugggaaccuuuugacuuguguugaacuuuucuuuaaccucuaacuaguuuuguagguucugcauaauucuuggguguauucucuuugaaauauggcccuagguuagaggagguccucuggauccuacaggcaugcaaaucacuaaagcuugaguccauuacuggauuaauaggcucugucuucaugcauguugucagaugauggcucagaacuugcagguaacagauccuagccaaugagugagacaggucuaauggauuugugucuaggucuaguuccuuguaggaauaucucucccaucucccaguuguuucuaggaaaugcauucucacuuggccacugcagggugacaguggaggugucuguuguaaguggccugcucaggugcugaagucgauaugucuccaguguaagguugcugaacaucaauauuuaaaagcaauuuaucuugcugccugguaacccaaauuauucuugagcuuuggacauaggcuggguugcagccauauuuuaggggaaggcugguguuagccucuacaguauucccuuuuccuguccuaaagacaaauggagaucauauuugugauacuggggacugugauaggugcuuaagcauugcucuuccccucuccucccugaacaaucccugagacugacuuuguuucucuugaauuacuugagugacuugaauucuauuaaaagcaccccucuccuuagccucugacccagaagcuuguuugggaggaaaaacgaauugguuucccuaagcuuugcuggcuagccuccugcucccagccugcaacaugacuugauugugugugcauuucagggcuuugaagagcaggcagcuuguagccaauguacccagagagcuggccguagaguuccccuaggucacuccuuccuaaucuucccugugagucugaaugauugggccuuucuguagcuuggucuguuuuccuauuguggggaagucaguuguuucagguaugaguuaauaccuucagcuugucauucucaggcguuuucuuccacuauggggagguaguagauccugugggcaucuugucccauugaaaucaucucauauacuguuugagaguugcucaucuuuauggugggggguguauuuuaguccuaaaucuugcuucuuagggcaaguucuguuucuuccauguuccuuccugguguaauaccucaggcaguuuucacuuuuaugaucauuuaacauuaaguucccaucacauguggcaucccacugaaggaaccuccuggccuugguaccuaauuugaagcuugggcuguggaaaacaucaucagugagcauguuugaaguaggacagagucuggcuggagaaacagguagugggggagcugggagcuaaacuugagaggaugccucuuucuugauaguuacugugcuaggugaguuaugagcacacuaauccuuuaauccucacaccucugagaacagugagggugaagcuggaggucauucuggauuguuucaguggcugucacacaaauucaaauugagggguagaggaacuaggaagcguggguguggaguuaaaacuagguccucuggauggcuuuugugagaagaaccaaggaauauucuuaaaucccugggcuuuucuccuaaucuuucugcugcuuucuaaguagauuguuaacauuguguguguuaucauucagcauucugagaacuagcuuuccagcaauaaauagcuuucaagguguccuuugccuuaacuuuuucauuuuacuaaauggugcagccuuguccacauucuguccgggucuucaccaucugguuguuuuuccggcuugguuugauaguuugcagcagucagugguaaacauuguguucccuguucuguaaugguggcugguuguguucaccgagccaggugucacuaaggcccaguugcacuugggagcaaagaagggcccugaggugaguccuggaaguaaaaauauguauaaccuagggcugaugaggcuuguuucacugcugggcuuagcugacaagagccugggacuugcugcagcucucagagcugaaaccuggcggugauucuaggcaggcugguuggccuuccagaucuugguuuauucaguggcuaaaagagguuuggucaaaauuaucaguauucagauuaugguccugggagccuuggaguuagaccaaacgugcccaggggccacuggagugauguguuugggcuggggagcacagcucaauggguaguacaugucaaagacuuaaggggaaaaaaaacaacucacuguucaucucaaguucuuagcucuaaggugugcuacuguucuaaauauuuuuuauuuuuaaagauagcuuuauuugccuaaauuuguccuggguguggggaguuuagagcugccuugucuguaggguagcugcuagcugugugacuaauuaaacuuuucaaaguauuuuuaaaaaaauuucuuagugacauuagccacauuucagguucucaguggccucguguagcuaguggcugccguccuggucaguacaggucaagaacauuuuccauaaucgaagaaaguuuuguuggacagcgccggccuagaaaguuuuuuuuucuccaacucuaaaagcuuaauugucucaacuuguaaaucucuaaagcauaacauguuugagcuuagucuuccagaguccauaaacccaacagcuuuggugacaaauuaucuacugguugucuccauggcauacuacaagugaguucuagucugccaguugggaguggacgaacaguuuugaaacaguuugagugaggaccuucagaaaggaccuggggacaggagcgugaagcaaagguccagaugcuaagcccuuagaaagcccuuuugguuugaagccguuuauuaucauaaagaucccugcugguuuguccuuggucuccaaaugucagaugucaacauauuguuacuugguccuucacccaccugaugacuuccuacagaucucagugcggcccuucucuuaaacgagguuguguuuucauucugcuguuuccaguccaccuaaauguuaggggccauucuucacagaagguguugggggagaguggggccacagcguggaugcuaacguguucuguuguggcagggguggggaguucuuuguuuccagaugcccccucuucuaguccugggugugcuuuguuugaacccugcuagauugaccuuugguauauauaaugugagaucucuuuucuuggagccaggcagcauaaaggacacuuacugaugagcaccuacuggcauauuaguggcuuuuuuuuuucugugucauuuuuauucucugucagcccuaugagguuaguacagugauuaguuugugggugaagaaacaagauccgaguagaguaaacuggucccuggacacagcaagggcuggacuggcuuggaccugggcuggggcgugcuccccaccuccuccucugccccugccgccccccaugcucauugguuguugcuuauuuacugccccuuuaucaccacauccucauucaggaaacuaaacuggguuuuacaaagauuaaaaucauugaucccacauauggagucugacuuaaguguguucagccucguuacaacucugugagggagauauucccuauuacagaacaucuucauuuuaugggaaacugaaguacaggauccuacucuuaacucucuugucuuuccaaagccauauuuuaucaucagaauuaugcaaccaucgggugcuuuugaaaugcacaaguaaugacuaugaauaaaaaaagcugugccugagggcucagggaaacugcucugaagacugagcugauugaaaaagacaauccugaagucacuaauuucccgacaccugucagaccucacuuggaggucacagaccaucuccuggcccuccaaaggcugucacccagcaguagcuggccuccugauuagaggaggcaguaagaucuuuucaagcacagccccagcccccaucccuucucuggccugggccuggaugugccuuugugagguugggucgaugacagaucugaaggacaguucagucuucuguacacuccuucuugccccuccuuucugccacucccaagaaaaaggagcaggagugauucucacuuuccugaacugccuuggagggagacccacacucagcugugccuuuagcugucucugggagaaaaggccgugcugcaaauaaccucccugcuuuguccuuuggcuuugguguggcucaccuggccaagcaugugcuggugcuauuuuuagcagguggcauccuuuaggagggccaagugcauguggcugcaguguacgggacagguccuggugccaaagcugcugcugucucugcugccaccgccucgucaggagagagaggagaauaaagccacccuggaagcugccaagggguguguggaggggguggcugcuuaagaggucuccagggcugccuuuucuauucuggaucuguggcaggggcccagccugccuccuggugcaggcaggcaugugacugaggcagcccggggagcuggggagcuggggagcuaggugucagacugcugccuggggagugaggaccccuuguugccccagcaggcaauuuuucaggaaaccacauaaccccauuaaaaacauuauuuauuuauuuauuuauuuauuuagagaugaggucuugcuuugucacccaggcuagaguacaguggcucgaucauagcucacugcugccuugaauuccuggguucaagggauccuccugccucagccucccaaguacccgggacuauaggugcacaucaugaugccuggcuaguuaaaaaaauuuuuuuuguagugauggggucucaucaccuugcccagacccauuucaagacuccuaggcucaagugaucauuccauguuggucucccaaagugcugagauuacaggugugagccaccgugccuggccccauaacuucauuuuugugugaaguugcccagccuaaaggcuggccacuaaauggacacuuaaaaacucucuaauaguguggauuggugggcagucugauuccucuggcuuaaaccaaaaugcaaacaugaaaggaggcauggccauagacccccggugagaauucuuuacugugaugacacagaagcugaagagggaugaaaaagcaguuugaccagcaagcuugcugguucccuaggccacccuuucuucucuccuuuucaguuccuccuucccucuaacuuggagcugcuaacuccagcccaucuaacuguuucugauuaagaaagcuucaagccuuauaaggcccucuguugccuaugguuuauguuggcuggagagcaagguuguuuuuugcaaagucugauucaaagaaguggcaagggcuuacguaggcuguguguguccgccuccuggggcuggacugccuuauuggaacagguuccuuugagggagccugagaguaaggggggcuuauuaucccuuacccuuagugguggcucuguaaggcuaaugugugguguggccacagggcuuccuggcaaguguauucgcugagaacuuaaagguaaaagcaagccccuguuuaccuacacaguguaccugucaugcuaccagccacagaggcauccuguuucaggaaucaagucuggaagcagcuucugcuuauuaauuaagaacuaaagccccuuggcucuucaggcacaucgcuuuccccucuggagaaaguuugguggaccgugucccuugggguucuugcgaguccgacuggccuuccgcgcagugauguuggagagcccuuuuucugagagccaugcucugccucaucuucaccuccccucuugcuaccucuugagucagccaagccuguuccugccuuaggacuuuggcacauguucuuccugccuggaacuuucuccccgcucuccuccugcuuccccccagaucuuggcacaguucucaaguguuccaguucugaugccaccucuuccaagaggcauucccgccucauucugucugcagcuuccccuuccaagugcuccauccagccuuucucauuucaaccacagcacacagaaaaggacuaggugaccguuccucaacucucccagcuggugcccugcuacacgcacagggauauagguaauucaucacaugcaagggcagccuuagggcucaguucucucaaucaguugagagaggcugcaggucuuuauauuuaagucgcggaaucuuugcaguaucuuaccuguaauuugacucucuacccuuccuuccaccuuugcuuccugagggaucucuuugccuuaugugcccagcgaacuuggcucacagugcguguuaaacucuuuguuaaaugacuggcccugagagguccagccaucugaugcuggcuagcccucaaugccuugcuuccagagggaucuaaccugucaauaagcaugcucucuuuuugauauuacuauuaugucagcugggcagcugggggucucugaagcaaaauuggcaucaauuauuauaggaaaauaaggccuuacaaguuuguacacagaugaguugacauuaaugcaaauuuaggaugguuaauaagaaacauaaagcugugugguaauagagcaugcauugcuacuuguauguaucuuaauaacguguuuucuaucaaaacauuacuuguagaaaggauuuggcuuuugacuguguacaaggcuugaaaggacaguccuuugcccacugccccccacccccauuacuuucaauucuuccagcuguccccaccauugucaguaguauuauuuucuuucuuuuuaaggauuauuaucugauuuguuuuucugcugugggagauaggauuuagcucguuccuaugcuuuuuucuucccucaucaucccaguguagagauagcccaaguuuuggucaaguugaucuucagaauauacauuauuauaauaugaaccuuguuuauggcugcaagguuuuuaguuucccauauuucuucuuuuccuucauuuucuucuucuccucuccuaguuaauuuccuuaguuucuuuugcuuaauuuucugucucucucaccaguucccugaccaccucgcagccuccaccauugcuguggaaugccugucauugggggaaaguggcucucacuguggcuccacauaccagguacucgcaacgguuccacguuucuccugggcgcaucccuuuucccuggcucugcuuccccuucagccuuggaauucccucuccccuucucuugucucguuucuggauccagugccccuccuuucuugguugauuuccuugucuugggggagcccaucguucaguagcuugcugagaaggugugcgugguuuguggcccacaagaagccagccgauccaugcagggacaggcaccuuugaaggcauggauugggccuucaguuggguggcugaagucagcagacaacuaggccuguggagcccuuccgccaggccaggccagcagaaggucuggcuucacuuuuuagagaaguuauaaauguggcgaucuggauuuggguaccagggaguggugaaaaugggucccccccaacuuuuuuuuuuuuuuuuuuuuuuuaaagacaggucucacugucccccaggcuggagugcaguaaugccaucauagcucacugcagccuugauuuccugggcucaagugauccucccaccucagccugcucaguagcugggacaagaggcauguacuacuaugcccgacuaauucuuuuaaauuuuuuuuuguagagaugaggucucaccacauugcccaggcuagucucgaacuccugggcucaaguaaucuuccaacuucccaaaguguugggauuacaggugugagccaucgugccuggcugaagaugggucuugaaugaaagucuauauauugaauggggcaucccaacucuccuuggcucccauaaugcuggcauucaggcuuauauucucucauuccuaccccaagauacuagaacauucuagucugaggacacuggcaccccauuuucuguuccuccuucaccccuaacagggcacuuccauguccuauggacaaaacuuucaguuggucaguagcagagaguggcaguaacaggcccacuggagaaaaggucauugcuuguuuuuugagacaaggugucacucuguugcccagguuggagugcaguggugcgaucucggcucacugcaaccucugccuccuggguucaagcaauucucccaccucagccucucgaguaguugggacuacaggugugcgccacuaugccuggguaauuaaaaaaaaauuuuuuuuuuguagauacaaggucucacuauauugcccaggcuggucuugagcuccuggccucaagcaauccucccgaaguguuggggauuguaggcgugagcuaccgugguggccuguuugggcuuuuuuuuuuuuuuuuuuuuucuucugcccuccacuacuccccgccaagacugaaagugccucgagggcagugccuugccugauuaauuugugucccaccaugcuuuucucugugagugccaguaauuauuuguugaauagaaauuaccuucuaugcuuuuaugugauuucugggguggucguaguucacugucugccauuaggaagaucagggucuuaccucuuugguuuugcccaugugaggugcugcgaaggguuucuugcugcacaccaacaucuuuucugaugucuuuacuggcuuuuaagucagguuguugucagauugccauuucauacuuuuugggcaguuuuguguaaugucuucuguggucgugggcgggaacuccauguacccaggaaggcauuccuggcaccuguguugugaccaucuuuagaaaccuggcggaauucacuuguaaagcaagaugguugucaaggccagaggugaggggcaaggugagugugacauagucuucaaaguuuuaaaauccacaccccuacccccaaaaugaagugauuaggaagaccuuuguaggaggugcugaugauuuuuccuucacgaaaagaggcaugugacuuggaccugccauggauuuggccagcagagcaggaaagagacugggcaguucaaccucggguacuaaguuuuccagagcaggaguugguuuaacuuuuaguugggcuggcggagcucuuacuuugaggccauguccagagaugguauuucuggcuuuuggcuugucuugucuuaccuagagcaccugguaguggauucaggguuuucauuuuggccguagaaggcuuugccaagcagguacucagacacuacuggguuaagcuucuggccuuccuucugugaauugggcugggaaagugucccgaguuccugacagcugcucuacguggaagggcagaagcacccacaaagugugcuggucugguggugcuggccccccuggcuucucugugggccaucacaauggagggugggggacaguccuagacaggaccucacaaccccacugugagcuaauuugggaucucuaggguacccacaugaagucauagcuuacugugacuuacacaggccccugaggaugaagguaacaguccugugagcacugaggcugggcugggaccaacaccugagccauggcuccagcacucugauuccuggcccagccaugcugcugagggugcacagcccaggccuaccaucgcccccacccuugguggcagaaccgagcacuacccagcaagguagguguuggcggcugcagcauguauccagcccuccuguucauuggggccuucugggaacacccuuuagagcugcauuguccaguagguagcugccagcugcagguggagaguucaaguuaaccuaaaguagaauucagugcccuagucacacuggucacauuucaagugcucaguaaccucccaugacuaaguggcugccaguauuggauagcagucacucuugagggucaccgagaccuuuaccucuugugaccuacucuacuuuaccauguugcaacugcugcgacuauggcuccuguggcaaaggucaaacucuuugucucgccugaccagcacuucagcuccuaggauuucuuccuguuuuacuuugggacucacuguucccucccaugcccaaagauauuagaaccucaauuuauguccugucccccucccuacccacccacugcagccuaaggaaauccuggcccucuuugagaaagccuuccugggcucccuuugcccacuucucagcugcuuguggcgcaggggugugugugugagugagugagagagauugauucuuccaucagaaucgugugcuucuggugaucagaaucuucugcuuauagcaacuuaaacauauuugaaugaaugagcaaggugaaugacugugaccugaugaggaaauagguaaaugcaucugauacaagccaagaggcgcuuuuggaaucuugcggagaacuccgaguuugugauuuuccucgaccaaacucccauggaagggaguaugccucugccuggccacagacugcugucauucucugaaugcaguggcugaagugcugggcuuuagguucugauucccugcccuuggaagacccccuucaaggggaagagucccucagcaggaacuuaaugagcugggcacucuggagguggagugucuugggcaggcuccuuccuauugguagaacaccuggggacagccuuugucagugugaacacuggaauaauggaagaaauguucaaauuccaguguaaauguucauucagaacgcaaaguggauguggcuucacugaccaggcccaagcccacauugggcuuguugggcacuuggcuccuaagcuguuguuuuuaugguggacuuucccaucaguuacaugcggcucuuuuugcagucacugcagccaaauuggcuuagucacugggaccaacacucucuguaccauugccagggauuuguuuucuuguuuagcagaaggcuguagccugcaguuaccagguuugucagcugaguugagagugaggccauuacuuuucugagggcuguucugagaagcugcagguaccucccuggagaaagaagagauccuuuggaaccuggagugagcagaugaaugcugaggccuguggcuguagcacgugccuaacuucagcucugugugaccacuuggcaacuagccaguaugcaucuauucccaggcaaauggaccugcuaaaaauaagcaggcagcuauuuaauuccaacagauucaaaaugacagaguguccuccccaccaacccuagggcagggcucugcagcauccuucugggaggcuuuucucugacugcagacaggucugcccuuaguccugggccugggggaggagccagccuuugauuagcuugugaguaggaaggcuuuggggacuacugugauaccacuuaaauguugagaaguucagguuuacaaaaaaaaacaccucagggcaaagagagcaacuccgaagagucuggcccagugcaggaaggaagaugucagaagagccuuguaaggcuaaagggguauguguauguaugaaaagagguggcacuaccugggcacucaggaaagccugaugcauuuuauaccaccucuuguagcccugucggaccacguaaauugggcaaaauggcaucuuaccaauuccaagaagucuguuugacugaggugagaguggcucaggggugagggagugaggggcuagcugauuuuuuuuuuuuuuuuuuugagacggagucucacucuguugcccaggcuggacugcaguggugcgaucucagcucacugcaagcuccgccucccagguucaugccauucuccugccucagccucccaaguagcugggacuacaggugcccgccaccaagccccgcuauuuuuuuuuuuuuuguauuuuuaguagaggcgggguuucacuguauuagccaggauggucuugaucugaucucgugaucugcccgccucggccucccaaagugcugggauuacaggcgugagccaccgcaccuagccuagcugauuucuugacuagugggaagugggggcugguagaggggcaucugugaggugucuccuggcaaugggugcccuuagugagacccagccaaggccugcugaucccagggucucuuggcucuguucuuguuggaggaugguucacaucucuaggcacaauucccugguaacaaggaaaaaaacacaucuuccacucugcucuucggggaucugguaaucucuguucucaagugcugguggagcgcuucaagccaggcaguuucuguuccuggaagcaauggugugagaagggcuuuaucuugagccacucacugcauagaagcagugacaccugguuccugauugcucagccuugggucucuggcucuaguccagagugcggggugaaggcuggggagagaugggcacugggaauuuaggugggacauccuggauucuguggguugggugaaauggguagcaguauucagugccuucuaggaggccaucccuggcuuggaaauguuguagaaaccauguuuuccaggcaguaauucuucaguagcuccagugacuauaggggugacucuagaggugguggucugagggcuuagagccucagucucuggggaacaagcugggcagggagggcuaguggugguguccugguaaacuacagagcagcaggcagagauggguguuguggccugcaguggugauucugugcauucugucugaggacugagaacagggcaggugaagugcagggagccuagugacagaaggugcuggggacuggguauggguggcccaggguacaggaccaaagccagggcagaggugcgugcuuugaguguugggucucuaccucacuguaguauagcccccuuaugggaucuugggaggcuggguguggugguguggugugggaccagcaacuaacugcuggagacaggcaggaccccuugggaucaacuuuuaguucuaaagggguggggcuucucccagccaucuugagaggugguuuguguuuugagcagacagccaauuagagucugcggccuugggcccuugauauguaaaauaaggagaacuagcccccggugggguagcuguuaggauuguuuuucuucucuaccccaucccauuuaaucuuuuuccugcgaucagauaauugcuaugggagucacagcuauaaaucugggugaaaugggauugccuaguuaauaaggaaucacaaucuaaauuuacugaccuggccaggcgcgguggcucacgccuauaaucccagcaguuuuugaggccaagguggguggaucacuugaggucaggaguucgagcccagccuggccaacauggugugaaacuccaucucugcuaaaacacacacacacacacacgcacacacacacacacaaacauuagccaggcauggugccgugugccuguaaucccagcuacuugggaggcugaggugggagaaucacuugaaccuaggaggcagagguugcuguaagccgagaucgugcccacugcacuccagcuugggcgacagagcaagacucugucuuaaauaaauaaauaaguaaacaaacaaacaaacugaccggaugaaaaccuggguuuagacuccacuccucuuccugcuggcaugugcccuguuagguaggauuugaaucuuuugacagcaggccacgggcacacuccccuauccauugcagccuuuccucauagccacuuucccgucucaaacuguccuuacucuuuuuuuuuaaauuauuuuuuccagccagaccaacauggagaaacccugucucuacuaaaaauacaaaauuagcugggugugguggcgcaugccuguaaugucagguacucaggaggcugaggcauaagaaucacuugaacccgggaggcggagguugcggugagccaagaucacaccauugcccuccagccuggacaacgagagcaaaacucccgucucaaaaaauuaaauaaaauuauuuuuauugggcagcccccaaacuagaauagguguagggagacuucccugucuuuacucuuuuauuugaaagacaauugaacacaaagcaaauacaaggcaaaucucccaucauuaccacuuuuuugggugugggcggguuauuacagaacagugauucucucuuucuuccccccaggauggggucucacucuguugcaagugcaguggcacgaucucagcucacugcaaccuccgccucccuggcucaagugauccuccugccucagccucuggagcagcuggaauuauaccaccuggcuaauguuuuuuagagacaggguuucacauguugcccaggcuggucucaaacuccuggccucaagcgauuugccgcccccuccaccacccccaacccccgccucccaaagugcugggauuuuggguaugagccaccacaccuggccucagaacagugauucucaaacuugacugcacauuguaaucaccuugguuuuaaaaaaacccugcugcuggggucucacucuaagauucugauuuaauagggcuggugcugccuuggccuugggcuuuuaaaagcuuaccagaugaugcuaaugugaagccaaguuggagaaccgguugugaaagaaauuaaaaaucucuccucccaaaaggaggaaguaagacucuuuaucuguagguaagaaaucccaaggaaaucuacuaaaugguuagaauuagugaguucagcaaguuugcaggauacaagaucaguguguagaaacuuccccucuccuacaacugaauggcuuguuguguguccuucccaguuuuuccaugggauuaugugaacauagacauuccauacacaugguggucuguaccuuuuuguuuuacguauccaggugauuuuuuccaugucggcacaugagaucaacuucuuucgguaacaucgguaugucaguggauuccauaaucuaccuagcagugauuccccugaaauguuuguuaaucccaauuuuguuucaaaugaugccucagccugugcagagguacguggguuaaaaacauuuugaaaaaaaauuuuuuaagggacuagucucacuguguugcccaggcugguggcaacuccuggacuucagcgauccuccugucucugccucuuuaaguagcugggaucacaggugcuuggcuuuguggauuuuucuuuguugugguuuuguuuuuguuuuuuuaauuuaaagaugccaagugugggauuucagaguuguaggaugugguuaugagcuuuuaagagcuaucauaaggcucuccggaaagguaguacagacuuccccuuuucuuggcucauauagcgccucuuccccacaguucuagaauaauggguuccagauuuaaugugggagagaauuuagguacccaucccuuggcuguaugccuugagcuuuuuuuuuuuuuugagucucgcucugucacccagacuggagugcaguggcacuaucuuggcucacugcaaccucugccucccggguucaagugauucucccgcucagccucccgaguagcugggaguacaggcucccgccacaacucccggcucucucucuuuuuuuuuuguauuuuuaguagaaacaggguuuaacauguuaaccaggauggucucaaucuccugaccucgugauccacccgccucagccucugaaagugcuaggauuauaggugugagccaccgcacccagccuccuugagcuauuuuaaccuucaagauaguaauucauuuggcugggcaccguggccugucaucccagcacuuugggaggccggcuggcggaucaccugaggucucgaguuccagucuagccaacauggcgaaaccccgucucuaccaaaaauacaaaaauuagccaagugugguggugggcgccuguagacccagcuacucuggaggcugagacaggagaacugcaugaaccuggaggcagagguuguaaugagccgagaucacaccacugcacuccagccuggacgacagcgagauaaaaggaaaacaaucuagcaagguucuguguuugaaugugaagcaaaacgguagcacuaaauuucuucccugaggaauugauguaaagccuuagcccuggccacugccuagcccugcauugugcuucaaaugcuaucauugcugcugcuucaaauaucagcaagaaaguuuaucuuuaaagauauagggacuuucaaauggaggugaccuucucacuaccacugcccccacuucaucacuucaggggcagaacacaccucuuagcauuccuucacaaacuguaagguccuucucaauccccuagggaucuuguuaaaaugcaagucugaggugagacugggauacugcauuucuagcaagguccuaggcaauauucaggacuucugguacauggaucgcacuuucagaagcagaguccuagaguagugguucccagccuuggcuggaaaguagaaccucucagggaacuuuuaaaaguacugauguucugguucugccagaaaacaauauaagucaaaccaauaugaguuguuaaaacaugugcauuuguuaucucuaaaagaaaacaaacccaaauaagguguaauucagcuugucaguugaaggauuuuugguuuuaaaaagacauuacuuuggcagagagauuuaaaguuugcuggcauaggaagcauugaauguaaguguucuagaauaagcccaucauauaccuuuagugaguguuaacugcuuugcaaagaacuuucuauaucucagcuaauccuuauaccaaccauccauuaagagauguguccccaucuuacagaugaggaaaaauugaguuuucuauccccuuuacaugucuguugccuucuucuaggcccuuacuauuccuccuugcuuagaccuaacugacuuagguuucuagguuccuucugcucgauauacuucacuuuucuuuuuugagauggagucuugaucucggcucacugcaaccuccaccccccuggauucaagcaauucuccugccucagccuccugaguagcugggauuacaggcgccugccaccaugcccagcuaauuuuuguauuuuuaguagagacaggguuucaccguguugcccaggcuagucucaaacuucugaccuuaggugaucugccgagcucugcuucccaaagugcugggauuucaggcuucaggcaugagccacugcgcccagccucgauucacuuuucauccuguucccagaauugccuucuagaaacaauuugaugugugugccuugcagaccuaugcugguucucuguugucugcaggauaaaguccagacuacgcaguggggcccuaggacacccucacugaccccacgaugguacagaugcuccucagcuuacaauggaguuacauccugguagacccauuguaagcugaaaauagcauaaaucgaaaauaaauacaucuaaugcaccuaaccuacugaacaccauaguuuagccuaggcuacuuuacaugagcugagaagacucacagucgucuacaguggggcaaaaucaccuagcaacacgauccacucuggagugcccguuguucacccuugugauagaguggaugacugggagcuagcauugcgagagaguagcgcaucaccuauugguaguccagggaaagaucagaauccaaaauuggaaguauaguuuccacugaauggguauuguuucccaccauuguaaaguugaaaaauucucaguugagccuuggaagaucagggagcgccuguauuugaaucuuccaagucugaccuggaccuucaugcugcaguuugcuguguuggucccucacccuggagcaucuccuuagccauugggaauuuuauuccuccuucauucucacugucucuaauugcugaguaacaaaguuccauuucauugacucaugauuuuauggguagaugugagggaaccaugcacauguggauuccauggggguuugaaaugcucugaugccacuugauagaaaaaaauguucugugaguuuagagaacugagccacacugagcagagcuagccccuuuuuggggaacauagagagaauuuggcaucaugaagugaugaagggagggauuuggguuaaagaauagaaugcucgguuuguuucaagagggugcgugaguuggggagcauggaggggaagaugccucuuccuggccacugacccccaguggaucacacagaggguggacugguacgagcugagaggugugcuccucuuggagggcagggaaggcggaggagauggcuccagcucuacccuguugacugucuugcaugugcgguugccaguauccuccuaccuggcucuguaacaucccuccuccccgcucuccugcucuccccagguguaauuacuucaagccuccaggauggcaauccaguuccguucgcucuuccccuuggcauugccugggaugcuggcgcuccucggcugguggugguuuuucucucguaaaaaaggccaugucagcagccaugaugagcagcagguggaggcuggugcugugcagcugagggcugacccugccaucaaggaaccucuccccguggaagacgucugucccaaaguaguguccacaccccccagugucacagagccuccagaaaaggaacuguccaccgugagcaagcugccugcagagcccccagcauugcuccagacacacccaccuugccgaagaucagaguccucgggcauucuuccuaacaccacagacaugagauugcgaccaggaacacgcagagaugacaguacaaagcuggagcuagcccugacagguggugaagccaaaucgauuccucuagagugcccccuuucauccccaaaggguguacuauucuccagcaaaucagcugagguguguaagcaagauucccccuucagcagggugccaaggaagguccagccaggcuaccccguaguccccgcagagaagcguagcucuggggagagggcaagagagacagguggggccgaagggacuggugaugccguguugggggaaaaggugcuugaagaagcucuguugucucgggagcaugucuuggaauuggagaacagcaagggccccagccuggccucuuuagagggggaagaagauaaggggaagagcagcucaucccaggugguggggccagugcaggaggaagaguauguagcagagaaguugccaaguagguucaucgagucggcucacacagagcuggcaaaggacgaugcggcgccagcacccccagucgcagacgccaaagcccaggauagaggugucgagggagaacugggcaaugaggagagcuuggauagaaaugaggagggcuuggauagaaaugaggagggcuuggauagaaaugaggagagcuuggauagaaaugaggagggcuuggauagaaaugaggagauuaagcgggcugccuuccagauaaucucccaagugaucucagaagcaaccgaacaggugcuggccaccacgguuggcaagguugcaggucgugugugucaggccagucagcuccaagggcagaaggaagagagcugugucccaguucaccagaaaacugucuugggcccagacacugcggagccugccacagcagaggcagcuguugccccgccggaugcuggccuccccuugccaggccuaccagcagagggcucaccaccaccaaagaccuacgugagcugccugaagagccuucuguccagccccaccaaggacaguaagccaaauaucucugcacaccacaucucccuggccuccugccuggcacugaccacccccagugaagaguugccggaccgggcaggcauccugguggaagaugccaccugugucaccugcaugucagacagcagccaaagugucccuuugguggcuucuccaggacacugcucagauucuuucagcacuucagggcuugaagacucuugcacagagaccagcucgagccccagggacaaggccaucaccccgccacugccagaaaguacugugcccuucagcaauggggugcugaagggggaguugucagacuugggggcugaggauggauggaccauggaugcggaagcagaucauucaggagguaggagggucucggguucguuuagaggauggggcgcucccaguauuucuuggagaaaggcugccagucugccucucccuucugcuacuugugcagcaaagucauagugcucuucagcucuuuaucgcaaccugcagaggucuggacacggcguagagcugguggguaacugaggaguuagauugcccugaaaccccaagucaugggagcuguaacuugguuccucaaccggugaccuuccccagugagcccuucccaaggaacuagcgccaaguugggcucgcugauuaacauuagugugccucuuuuucuuuguuuaaaaaaauuauuauuauuuuggugcagauggagucuuccuuuguugcccaggcuggucucgcacuccugggcucaagugauccuuccgcccucggccucccagagugcuggguuuauaggugugagucacuaugcccagcccauuuuuuuuucuuuuuuaaacacuaaccucuuugugugugcguguguguguguguuuuaauggagaggccuccuuagcuuuacuucccuugagugccagguaugggugugaguguuuugaaugguuuuuauuuccuuuuaaucaugugcuuguucccaugucuucaccugcuuuccuucuccagaagcucuuacaggguaagugcccaaagaacggccacagcuuugaauacuugugggaggcuugagcuuccugaguugucgcugucaccuuugcagaaagccucagccauuuucuuucugugcaguugcagcuccacccccgggaaagcggggcacuuugauaacgagguguccuggguuuuucgagugcugaccccagcguagacaguucagaccgcuaacuuacaggucagcagcuccugacccugcuucugcaggcacccugggguguuuucauuuaucucauggagagaggccacgaauaucccgaguggcucucugacuuguuuguccuggagccauucccucccauuucagcuccggguagguugggaaucuuuauugggaauuuuaccacuuucagcagcaucuaguuuguaccacacgcuacauuuugucaccuccaagaugcuguuaagacacuacuguuuuuauguaccuuggaaagaaaaaagugcugccagucaugauuauagaaggcaagauacuauaugaugcauccuaaucucgggauguuuaaauguuucuuaaaauacugcaucugaaaaugggugauuuuuauuuuauuuauuuuuuaagaauaaaggaguuucccuuugcuuacugccccucagcugaauuaacaagccccgcagccuugucugccaacucuagauggauaguaguagcuacucagaccuguugaagucuucugaguuuaggcuugaaccuaagccguggugaugggcagggagguuuagggauggcacguggaaaugagguaauacuguccacgagcaugcggugggugccaagcacgagguuagugccucgcauguaccuucaugucagcccugcuuuguuugugaggaaguugaagcugagaaggggaccagggaccaccccacugagggagcuggaagcuggccuuugagugcagccugcuagaguccgggugugguucugagccacugcugggagccaucgggauggcagguguuagccagucccauucuguggggcagaggcuggauacugugagugagcagagcuccccgcccccucgcccagccccugucagccuguuaugcuucccgcaggcuagccaagcagucuucccccagaagggguacuuuucccugcaugaauccuguucgaagcgccuaguguuaaggggggaagucauuuugaaggugauucuuccuuagcugggagcaggaucucuugggccuuaguucucugcauccaguguauggguuacuuggcaaaggauuauacucaggguuuggagaaaccauguggaagguaaccuaauugguagacucucaggagugaucuauuucuggugauugagucauccauauuuaagccagggccacuucucuugagcugaucuggacccgcuuuuuugugacggucccuuuggcacgcucuugagugagaguggaacagcccaggucgggagcagagucuguucccauuggguuuucuugggcaugagcuuuggcucagucuuuugaccaagggaguauuugagccagaagaguguucagaguugcaugaaucaggccuaagcaaagggaaaggagacucuccuuuuuuaguccacauauggcagaggaacgagcggguccccgcuagguauaagaauggggcccucaggcaggccagugaggacuuugucuagcucugcugggcugaaggccaguaccuaugacccugggacugggcccuggggacaggagacugacccuuggucugaggggguaggauaguuggaagggugucaagguguuugugguccaucggucuggcucucaggaccauguggaccucaagcgugucuccucccccgcccucugggcuccccuucccugggcgcagucugucucuuccaaguucaccacuugugucucugcuccagcagcuguggcugggugcggcugccaauuaagcaagugggacuguaagugacaggcuaaaauuagguguaucgacacccccaguucuccuuucauugggguuguucugagccuucuagacuguaaguugacagucaccugccaagcuugaggagcggguguggggcagggccuccugggaaugugaguuugggaaguucuugguuacuggcugcucugaguggggucugugugugugcgugccugcugcuucuuccccugcagguucugacaggaacagcauggauuccguggauagcuguugcagucucaagaagacugagagcuuccaaaaugcccaggcaggcuccaacccuaagaaggucgaccucaucaucugggagaucgaggugccaaagguaggggcggagucccccaggcugguucugugguaagcccaaagcucccuggggccagggccauuagaccucagggagggagggggcugggagagggacaguaaaccagaaggagcccugggucagccaaaggccgcagggaaaggacacgcuacacuuugccaaggcucagagagcuuccugcaacauggaauuccuccagcugccuccaggagcaucuuauucuuguacuucucaaacucgcaggccugugugucucccuugggggugguucuugcauauucuggggcucagaucuauuuggaaaaaaaacaccaaggccgugggggccagccagaaucccuucacugagcucugcucaagugcuccaaguguauuuuauaauugagcaaagcauaaauccauauuuuagagaacuugaaaaguauagaaauacaugcagaaaauaaaaaucagcucuaauccuacccuugagagugacugugaaagacuuuuauuuccuucucaucuugcacccugugguuuuuaaacaaaacugagauuaugucgcuuuaauuaauacuuuaaauauuuaacaauuuaauuuucguguguuauucuuugaaaauguaacuguaacugcauuauucacuguguggaugucaguuuacuucaucagucccccauuccugagugcuuaagugguuucgagcuucuugcuauuagaacuuacaacauauuagcuugaucuugauguuuaucucuggggcucagaaauaauuugucagaccgcauucucccagggcccugggcucugugcucagguggagacuuggcuuggucugaacucugggucagaguggcuguuuugacccuggguugcgaggucucuuggugguuuccucccuggggggcccuguuauccguccugccugcuuuuccuucagugguuacaaagggcaugaagagaaaggcugugccugaggauggaccauguccccaguagcuccuccgggagggggucguuggcgguugugugggagcccaucuuacguaagggcuaaguuuggcugcuucuaucugccuugaacucuggcgcacugggcacuucugcaugccuccugcucugcaggcuucagccugcugucacuuggcagcgggagcccaggguucuuagaccuucauuuucaaaucgagccccuuuaucuuuggaucugaguagacuugagggagaggggcacgagaaaucgagaaacugugugcuggugaaacuucucagcauggcuuuuagaggagaagaugcugcugccuuugcagcuuuccgggucugggccacauuguugggaugaaaugggaacugcuugguccuggagccagacugccugguucgacuuccugguuagcagcugugugaccuuaagguaguuacuuagccucucugggcuuguuuccccauauacagaauggugauaaaguuaucuguguuucacagguacuaugaguaaauguaagugcuuagaauaguccuggaaaauaaaugcugacaugguaacagcuaauauguuugagcaugaucuuguguaaaacagaaguaggucuuuggguguccagggaauugguuucccuuuaacccucucaucucuuuuugucuuucuggaagcacuuagucggucggcuaauuggcaagcaggggcgcuaugugaguuuucugaagcaaacaucuggugccaagaucuacauuucaacccugccuuacacccagagcguccagaucugccacauagaaggucaguaacaucugcugcuuguauugccucuuaccugaaauauuaaauagaagugaauagcaucugaguuucaauugcuaucuuuuuggaauaggaaacccugcuucucaucccagggaagggagcauuagguaucuucccugcagccuuuuccccauuucaggugccugcgggagacucaggucccucccuacucugaucuuuggccaggagaagugugggugcuugguugggcggggccuggguccuggguucauagugcccaccaccccauaaaggcuucucucaaagcagaagugcccugugugcaauucccccuuggcauuuucacagcugccugccucuucuguugcauugaaagcauggaucauaauggcagagguaucauuugaaaggcuuagaugccuuucuuccuaaagcagagcuuaaguguuuuguuaccucaaagaugcacuugaacucuaugcaaaguccaguggaguggggucuguggcuguguuuuugugagugugggugugaguuuccucuuacagugauuguauguccugcccccauccgcuauuuaggcucucaacaucauguagacaaagcgcugaacuugauugggaagaaguucaaagagcugaaccucaccaauaucuacgcucccccauugccuucacuggcacugccuucucugccgaugacauccugggugagcgugcuacugggugauccggacuucuugccacuuucccccaaaccuaccccaaacaagaaacuccccagaccucaggcuaagaaggccaagugcacaugagugccugcgcccucucuucucuggccucugcuggucgguucugcuaugggacuguguucuggggacagggcuuagguggugauagcgcuggcaggaaaccagaggccucuugguccccacaugggaggacuacuuuuccuggcucucccccugggcaccuuuuaaguuuucuaggcguuugcuuagaaaggaugguguaguucggacaggagauuggguguguccagggucgccguucaccaccugagaccugggugggacuagaaucauggguuuggauggcgcuuguucuuucuucugguugagucaggccuuaacaguggcccuggugaaggaucuccuuccccuuccccuccccaggaggugccuaaauuacaaagaagaaugaauacuccccaccaggcccggaaguccagugacucuugggagguugccccaggaguuuggcagagggaagagcugcuaucuccagggccccugugugcugcugacugcagggucucucagggccguggcccauauccugccgugugccucuggcccugguugggucuuaucucacugggaguagaauugcagaauucugugggccaacgacuguugacuacguuuuacacagauggacagaugggcugacuauagcuccaaggaaauuguccuccuucguguuuuuuuuuuguuuuuuuguuuuuuuauggaugguaggcauuucaguuuugugucuuccccuuugcaaaggcccuugggcuggagggaaaggauugggauaucuuuuuccuguggauaugugagaguaggcugaauaccacuuuaugcuuuacuccugaaucaagaguuuuuucccaggaggcucggucguagacucacucucuuuuuuuuuuuuuuuuuuuuuuuuuugagacagagucucacucuguugcccagucuggaguguaguggcaugaucuuggcucacugcaaccucugcccaccagguucaaacgauuauccugccccagccuccugaguagcugggauuacaggugugcuccaccaugcccagcuaauuuguauguuuuuaguagagaugggauuucaccauguuugccaggcuggucuugaacuccugaccucaggaggguaagcaguaggagggagagcaaauaggaagcagacucugcuagaccuugaccauggaccugaccugaggccacugcuugcucuugggagggcagcguagaugcugucagaccauaggcuccugggguugucugccaguccacaggaguuggcuaaagggccuggggccugccuacugcuuauuuucaggagucuuguucucagcggccaccucauuccuguguugcccucccugggucuuauagauucaucaacagaagugggagggagggcacugcugguagguggacccugcccaggccugugcaaggcccagcacuaccuccgcaguugcuucuugguugcccagugucugugggacccucccugccuggcccugaggugagacugccccuaauggcugcucgugguauugcaggacaacagccacaggggugucgaacacuuucuguuguuaaaguaguccuucaaccucuaccuucugggugccauguugucuugaguugcccuuuucaaagauaugcuagcccagagacuugcccuugggucucgggacuuauucaaagaugagauaagaaggauuguuucagugaccgcucccccuuccccucuacagcucaugcugccugauggcaucaccguggaggucauuguggucaaccaggucaaugccgggcaccuguucgugcagcagcacacacacccuaccuuccacgcgcugcgcagccucgaccagcagauguaccucuguuacucucagccuggaauccccaccuugcccaccccaguggaaaguaagcagugcccugaggggucgggaagggggaccccugggguugccuguucugcccuggauccugaucaggaggaggcuguucugcgauccuucauggaagcagcauccuucaauucuugccauuguuauggagcugggguggguuuccuggcaaggcagagcugggguuuccacuggcuggcagagugauggguguuggaguagaguuuugacacagggauucagaucccagcucugccacuaauuuuuuuuuuuaauuuuuucuuuuuuuuuucccucaaagccagugucauaguaucugccaccuauuuauuaucuguuaaagggggugauacccacuuguuccaggaauuaguguugaauacuguauguauuacauauaaagcacuuaugcauauaaugguuaccacaaaaaaauccccaaguccaacaagccugugcagcguguugggucaucuccauuuaacagaugagaaaacugggccucaggugacuugcccaagugagcaggaucuggggucugagcccagccuuugucauuauuaucuuuguuguccuuaucacagaggauggaaugucagaacaucacccauuccucaccaggggauggcagggucacucagugcaguagaaaaccuucugaagugaucucuguagccuuuuguguggauuuuuuccuuuuggaaggauaaggacuuaguuuucauuggcuucucuaaaguugccuuaacccagcaguaaagacugaacuggagccugagggguaacugccagggguucucuccaagggucaggacccagcacagucagccucaugucacagguccucauccuggccagcgugggcagcuguuggggugcugcugggaacguuuaccuccuggucucgucugccucugacccacaguggguuagugacuccuugauccuggguggcugcccaggugcugucagcaccuuccagaggcaaaggcuagaagaaggggguuuaggcccaggaggccccuucuggucaagcucuccagcugaguugugggcuggagcacacccuagguaugaggaugcugagaucugcugcacuugauuucuucagggacuuucuuuuaaauguaaggcuggcccuggcccccauuccccgagugcuauauuuacuugguuuauuccuauucaucugugucccucuugggucccagaaguuuuggaguaauggaucuagacugaaugcuucucagucuggauggccucgggggcggcacacuugcuaggcugaacuucucacauccagguuuuucccucggcuggucuugggcuugggggaggcuuugcuuggggccgguugcuguuccuguccccugcacuguggagguugcaggccucugagagguaacgcagggagguggguaguggccagguggcccuuggugcccugcccuggcccaggcguuccacgcacucugcucccuacccugcaguaacggucaucugugccgccccuggugcggacggggccugguggcgagcccaagugguugccuccuacgaggagaccaacgaaguggagauucgauacguggacuacggcggauauaagagggugaaaguagacgugcuccggcaaaucaggugagcggagaugccucaggcaggccuacgcccugcuuguucugggaugcgugaucucugcguggcuggcucaguugugccagggcuugggugaggguuacuucuucccuccugcugccuacuguguuuuagcagagucugauagaaacaaacucgauuacucgcuuagccaaacugagcuagaaggccuguauuguggaagaauccccagcaucauccuucaaaagugaagcugggccaggcgugguggccugcugcaaaucccagcgcuuugggagggucacuugagugcaggaguucaagaccagaccgggcaguauagcgagaccucaucucuacaacaucaacaaaaaaggaaaaaagugaagcaggcuccuuuuuaggaauuugucauaggaagucccucugaggucaggcuugcagcagggucggcuggcuguguuugggugugcugugagccguggccuccugcaaaguacgaacccucugcuuugcugcaucccagguuaugggcgucacuguacaaagaugaauacuggcuuggaguggagucagccuucauguccacauuaaacuuguuccuuucuugccuucccaggucugacuuugucacccugccguuucagggagcagaaguccuucuggacagugugaugccccugucagguaacagcugaggccuuuggcuugggggauuguuggggacaguuguugagaguaggucuuucucagagccuccguucucaccuggaggauuuaugcuaacauaaguugcuaccacucaagaguuucugacugaauaggucugggcuuaggcccaggaacuuacauugcuaucaaguucccaggugagaccagugcugcugauccuuugagauccacugcucuagacuguacucagaccucaggcaucaaggggcuuccaacaaaggcacuuuccagauuauaguccagacccagagucuuagccccggugguugagggcgugcuggucacugauacugcucagccaggccauagcuccauagggcacaguggggacacccuaucuggugucuuagacuaugaaagcauugucagagggaagaggacuggcaaaaucuuggguaaaugacuuagccucaauuuucaccccagaacaugggaaugguaccugucuuugaugcuggcugugagaauuacauaaaccuaagaucugguguguagaggguggcgaaauggcagcuguuuauggcuaggaauuuuauauuuguaggugauaguucaucccaucccacucccuccccagguuugccccuucugaucuccuucuugcuugucuuaagcgauuugcaugcguuagaaauacuacagucuagcuggagucggcuuagagggagcacuggggcaagaucuuuguuuugcuucuuuuauugcuguugccccuccuuccucucugcuucuguccaucuaagcgaucuguccagacccagcugaaacuuucuccuucguaagauuuucccggaucuuccuugguaaaccccugucucucccauccuugccacugcuugccuuggguaugguguucuauguaacuuuuguaauccagcaaagcugaaugcugccgcagcgccuugcccacucugaguggcuggccuuauugggcuguguggccaacugccuggguuugauucccaccuucaccacuugggagcugguugaccuucaggaauccaccuuugccucaguguucucuccuguaaaguggggauagcacuugguguuacuaauuuuguggaagaacacauaugcucugcacugccagcauccgaguugguggggguggggguggugcugcugcuggugguauugguggugguguuaguggugaaguuucuguccaucuguugucugugcugcaccagugggcaacaugcaguagcggcccuuaguuuauccacugggagucauauggaggccuaggcucugucucugaccuggguggaucuccccagugcaguucucaaguuccacagcaucugaagcauucuacuuggaaugcaccugaaacuuguguacaugacaagggugccuugccucagugagagccuaaaugccgcuuuuccuuuuccuccugaagacgaugaccaguuuucaccggaagcagaugccgccaugagcgagaugacggggaauacagcacugcuugcucaggugugugguuggcaggggugggggaggcaggcuggcuggguucuugggaacugaccuuucaaugccuucuuuccuguggcuuggcccuggauugaccagcaguauuuaaggaaaggugcaugaaguagcuaauacuugauauuagucuguucucacauugcuguaaagaaauaccugggacugaauaaucuauaaaggaaagagguguaauugacucacaauucugcgggccuggggagaccucaggaaacuuacaaucauggcagaaagggaagaggcacgucuuacaugaugggcaggcaagagacaguaugugaaggaggaacugucagauacuuauaaaaccaucagaucucaugagaacucacuaugacgagaacagcaugggcacaccgccucaugauccaaucaccucccaccaggucucucccucgacacauggggauuauggagaugacaauucaagaugauauuugaguggggacacaaaaccuaaccauauuauucuuuccaccccccuucuucaggugacaaguuacaguccaacuggucuuccucugauucagcuguggagugugguuggagaugaaguaaguucugcccuucuuuuccuucuguguugcuggcccgaaguaauggauugauuaggagcugguccugggauuuguuuccucuugaguuaaucagaggauauaacuguagacaagcaccuccuagggaacacuuuggauguccugauuggcaguggugaugucaguguccucuaguggguagaggccaaggaugccacuaaacaucccauaguauucaggacagccccccacagcaaauaauuauccaaccgcaaaugucaauagcgccaagguggagaaacccugugcgagacuuucugggaccuucugucuguugaguuuuucuguccucuaucuuaugguaugaaagcuuagauuucuucagcauauuaaaaagccuauccuggccagguacaguggcucaccccuguaaucccagcacuuugggaggccgagacgggcagaucacuugaggucaggaguuugagaccagccuggccaacauggcgaaacccccaucucuacuaaaaaugcaaaaaucugcuggguguggugaugcacaccugugaucccagcugcuugggaggcugaggcaggagaaucacuugaaccugggagacggagguugcagugaaccaacauugugccacugcacuccagccugggugacagagcaagacucugucucaaaaaacaaaaacaaaaacaaaaaaacccuauccuuaugccacagcagccaacagaauacuuaaauaaauguuccuguuggcuagagcauaagccaugucccccacccuguuacucuuuuuuuuuuuuuuuuuuuugagacagucuugcucuuguuauccaggcuggagugcaguggcgugaucuuggcucacuguaaccuccgccuccgggguucaagcgauucugcuucagccucaguaacugggauuacaggugccugccaccacaccuggcuaauuuuuguauguuuaauagagacgggguuucaccauguuggccaggcuggucucgaacuccugaccucaggugauccaccugccucagccucccaaaaugcuaggauuacaggcaugagccacugcgucuggccuacacuguuacucucauacaucuguugccugcaguggcaaccggggaggggagaacucauguuggcuagggagauggccccaggaugccauggacaaaagcuuuaagggaacuuucuuuucuaggugguguugauaaaccggucccugguggagcgaggccuugcccaguggguagacagcuacuacacaagccuuugacccccaugcugcuuccugagagucuuuuuuugcacuguugaaauugggcuuggcacucaagucaaagaugaacaucggaauaacaaacauuguccucuccagaaaguccuuucuuucuccauacuguaguccuauugagaagacauuucgucucugagaaaaaaggauggaacuauggguucucuucgcaaagccaaaggauaguguuuaacaagccagcuggcuuaugcugguucucagcuguuuaaaaaaaaaaaaaaaaaggaauagaaacaguuucaaccagauuguccuauucccccuguuccauuccccucuucuuccuucuaucuccuuccccggcaaaaaccaaacaaacuggcagacaggccagggauguauguugcuugcuugagaggguuucuuuuacuucaaaaucuuucuucagggagcaagacaugaacugacuaauugguauccacuacuuguacagcuuacauaaaugaguugaugauauuuaaccaguuuuuauaaacuucauuuaggucucuaaacacagacuuuuuaaauugcaacuguaaauaugaaauggucaucacaucugaccuuggucaguggggaggggaacugguauccugccaagccugguuguaauuuguaaccauuuucuauuugugcaaacucuguaaauauguguuuaaacaaauguaauauuuuguacaagauacacuggagaacaaagggaacucaagauucuuccagccacaugucaccuguagguagaaguaaacucugcagugcagcuucugcucuuggccccucuggccagggccccuguggcuuccugcacacuggacaggugacuguaugguagagacugugaucugggaacuuuuugcuguacaaaucuguuuaaaaaaaaaaaaaaguaacucauugaauuaacuugcagugguguguuugauucuuuuuuagacuggcuucagcauugugcaguuuaaaaauaaguaaguaacuuacauaaaucuucaauuguaugaa

SEQ ID NO: 192298 - RNA, 26140 nt, Homo sapiens
guuuccucggcggccucggagcgcgggugcagcaguugugucccgaccccugggagcgccauggcagagcugugcccccuggccgaggagcugucgugcuccaucugccuggagcccuucaaggagccggucaccacuccgugcggccacaacuucugcgggucgugccugaaugagacgugggcaguccagggcucgccauaccugugcccgcagugccgcgccgucuaccaggcgcgaccgcagcugcacaagaacacggugcugugcaacgugguggagcaguuccugcaggccgaccuggcccgggagccacccgccgacgucuggacgccgcccgcccgcgccucugcacccagcccgaaugcccagguggccugcgaccacugccugaaggaggccgccgugaagacgugcuuggugugcauggccuccuucugucaggagcaccugcagccgcacuucgacagccccgccuuccaggaccacccgcugcagccgcccguucgcgaccuguugcgccgcaaauguucccagcacaaucggcugcgggaauuuuucugccccgagcacagcgagugcaucugccacaucugccugguggagcauaagaccugcucucccgcgucccugagccaggccagcgccgaccuggagguagggaacggccugcugggugcagagggcagccuggccugauggguggugcagaggggccaccgggggccucucugccacacucuggacgcccuggggagaugggccugaauucgaggccggggcaucuccaaugucagaguagaaaggggaugggagauuauauagucccuucccaucauccaugaagacagguuagguugcuugccauaauccugucauugucugaugguguuuauuuuuauuuuuuugagacagggucucgucccucucacccaagcuggagugcaguggcggaaucacagcucacugcagccucgacuucccgggcuuaagggauccuccuaccucagccucaagaguagcugggaccacagccucccaaguagcugggaccacaggcucgcuaauuuuuuguagagaugagguuucgccauguugcccaggcuggucucgaauuccugagcucaagcgaucugcccaccucgaccuccuaaagugcuaggaggucuuuaaaggcgugcaccacugcgccccaccaucugaugguguuuaguagaggguuuugaaugucaacuaugaacguuggagguuaccucuguucccucacgaaguccugguggcacccaggagguggauaugauuuaguuucauuuuacuguugaggauacugagguccagagaaaugaacuuagccugaccuaaugcaguaaauagccacgcaggcauugugacccggguugguucgauuucauaguuugcauuucuucccauggaccagccucguauccagguccguagaguccggagcaccaaacaguccaggaagcuugaggucauguaagcaaaagccuuuggugggccggagaguuccugugaucaggaaggguuguuauuagaggccuaagagggagggugggcagcgucccaguaaucacuggaucagagccacagggagagccaacacucuugcaccauaguguccuccguccuggccgugugacuuugagcaugggguuuggccccuggaccuggguccucaccaguauagugaggcugugggacuagguggauuccuaagggccuuucaggucugcaauguuuuuaggugguuuggggaucauaccuuccccuuguggccucaaagcagaggcugaaaucaaaccaccuuuuguuacaucagccuaagauccaaagcauggccugauuucauuucauucucacagcaccuucagggagaacaagacccgucuucguguugucagaggagacaguagccugagcaaggucagaguugggggucugcauccagcuuuguguagcauauaaacuuggcuuuuuuuuucuuuucuuuuagagacagggucuugcuauguugccuaggauguucuugaacuuccggccucaagggauccucccaucucagccuccugaguagcugggacuacaggugugccaccgugccuggcucuaaacuuggcuuuuuuuuuucuucuuuuagagacaggaucuuacucugucacccaggcuggaguacaguggggugaucauagcucacuguaaucucaaacuccugggcucaggugauccacuugccucagccuccugaguagguaguacuacaaaugugagccaccacaccuggcuaaguuuuaaaaaauucuuuuguaaagaugggaucucacuauguugcucaggcuggucuugaacuccuggccucaauccuucucccaucuuagccuccugaguagcuggaacuacaggugugcuaccauggggccuggcuauaaaaucagaauuuuuuuuuuuuuuugaguuggagucuuguucugucgccaggcuggagugcaguggugcggucucggcucacugcaaccuccaccucccgaguucaagcgauucuccugccucaaccucccgagcagcugggacuacaggccugcgccaccaugcccagcuaauuuuuguauuuuuaguagagacugaguuucaccauguuggccaggcuggucucgaauuccugcccuugugauccacccgccucggccucccaaagugcugggauuacaagcgugagccaccacgcccggcccauauauauauauuuuuuaaucuuuucuuuuagagacagguuuucacucagucacccaggcuggacuacaguagcaugaucauagcucacuauaaccuuaaacccuggacucaggugauccuccugccucagccuccugaguagcuaggacuacaagcacgcaccaccacacccagcuaauauuuuaaaacauuuuuuguagagacgggaucucacuauguuguccaggcuggucuugaacucccaaccucaagggauccucccacuucagccuccugaagugcugggauuacaggcgugagccaggagccuggccuaaacucugcuguuuaauccuaacaacaggccuuccucugccaacaccuaccccccuguccugacuugcugaguccuauaacaggucugcuuuuugagcccugcuacugcugcucaucacuguuggcagagccagucucagcugggcaaugcccuuagccucgggggcuggguugccuuggccacugguggggucggacuugagacucuggugccucccauguggaagacccaagucucuagucugugaagggauccucaggauuucaaaaaguccuuugccuuugauuaggggauuauugcugcuaccaaaguuuuugggucacuuuccuuuggucuggagucgugugggcaccauucaugaugaggguacugccgcauguguuugauuaaugguguaucaaaucuuucaaaauauagggcucaggguguagugcuaugagcagcucuugaaagugaagcaguuggcagccuugggguguucugaggucucuucuugcucugaggccagcaaggccggauguauguaggccuggucuuuggcccacaccuuaucuuggccacuguuagaggccaggucgaagggcagugucacagaggucaaguuugaaacaucaugagcagcuugggcuuuucggauugaguuaguguggccuuggucccugccuccaaccccuacaugugacugucacuggguuguucaaaucuagauucaagaucagguuccgcccagaauaucuuggguggaguugaagagucugggaaguggaagagagagccagaguauguugagccugcuaguuacgggaaggaaauuuuuuuuuucuagaaaucuccagcaugcucaguuugggcaugugucuaugauuuuaauaucgggaucuuagcugugccaguuacuaguaguguagcuggggcaagucacuuaauuguucugugccucaguguccuugucuguaaaggcuggguaauuccuaccucauaguguuguucuuagcuuuaaguaaguuaauacagguaaagcacuagaacagugccuggcauacaguaagugcauaauaaauacuggcugcugcuguuauggugguggugauuuuccuucccauuucugugcaguauucaucugagcagggagguaggagacucagauauugauuaugaaaauuaauugaaaucagaugaggauauuagcuuccuucauauacaguuugccuuuguuucuggagguggcuaggacugagcagauuugcaccugggcuucagccccugugagcuacuucaucuuuuuuuuuuuuuuuuugagacagggucucacuuugucacccaggcuggagugcagugaugccaucucagcucacugcaggcucaaccucccggaaucaagcgauccuccugccucagcccccuaaguagcugggacuacaggugugcaccaccacaccuggcuaauuuuuguauuuuuaguagagacaggguuuugccauguugcccaagcuggucucgaacuccugagagcaaaugauccaccugccugggccuccuaaagugcuaggauuacaggcaugagccacugcgccuggcuggcugauucaucuuauucccagcccuugguggucccagucugcagugagccuuggacucugauuucugucucccugcccugugaggcugacaaaggcucccagccuuguucugggauuggcagaugccucuggagagaacauccuagauaucaggcuuaucucucugggcccccuucccccuucuccuggaccuugacuucuuaauccucugcuugauuggcucuccagcaucuuuuagcagaucuccccgcugccccauuauuuggacugcuuuccuggcuguuugcagugggaggauuggucugaguggccccaccugccauuaccgaagcagcugucccagcucguucuguuccugugugagcuuggccaccuuucuguccuccuugcuugaguuucauuggcuguaaaauggguaauuagagaaaaacucauaauaauauaagcuggcauuuaguauguuuuuccuaagauccaggcauugggcugaguacuuacauuguuucaauuaauccucccaauagcccugugagcuggggacaguuguaucuauuuuguguccaagaaaacugaggugaaggacacaguugcacagcugggaguugggacuggaacccuggucuguacuguccucugaaaaggaugaagggaaguaguaaguauuagaaugcuucaaaaagcuccaagcaggcaagacucgggugacaggacuugggguggcaagacuuggguggaguggaagaggaaggaaucuauccugugggauaguuccagggauggcuucugguggggcugggcugaagaggugcauucucaaccucauuuguuuucccugcaggccacccugaggcacaaacuaacugucauguacagucagaucaacggggcgucgagagcacuggaugaugugagaaacaggcagcaggaugugcgggugaguggcagggcucuccaaggccagcccugcccuguggcuucgcucagcuuccacgcgggaugggcguggcucugaccaugacaaggcugguguugggugcacucacagugucaggaugaaacaucaaccuugcaaagcaugcagacagcugugugucugagagagauccuuugcaaacccaaaccaaaaauuaccuauaagcccaacugugggggaaaucauuauaaauuaggauuaaaaaguaguaauucagaaaaaugguuaugauauaaagugggagaaaaagaggaagcaaaaguauauagcucauaggguugcaucuauuuacaaaaaggaaguauauuaguuucauagggcuacugugacaaauugccagaaacuugguggcuuacaacaacagaaauguauucuggcagaguucuggaggccagaaguccaaaaucaagauguuggcguggccacacucccgaagucucuaggggagaacccuucuuugcuucuuacaguuucugguggcucaggcauuccuuggcuuuugacugcaucacucugaucucugccucugucuucacauaccugucucuucuucccuuagugucuuccaucuccaauaagaacccuugucauuggauuuagggagcaccuagguaaucuaugaugaucgaaucucaagaucuuuaauugcaucugcaaagaccucuuuccuaaguaagauuacagucacagguucugguauauggacaugucuuuugggggcccagcauucaacccauuacagagagcauggaaagaaacugaaagggaauauuauagaaggaucauaguggaaguguuggagugguaaauuaggaaugguuuuguucccccuguuuuucagauuuucgauacguuuaaauugcuuuuaaauggaaagaucagauuuuuacccuuuuucagagcugcagcaccaguuuuauugcagcaguuaugguuucauuagaugagaucuagguuagaauaccagcucugucacauacuaguuuauguugcuuuggucauguugacagaucuuugaaccuucguuucccaauuugcacaauggaaucacaaguucuuucugaagaugacugugagacaaaugaaagaaugcacgugaaaguaccuguauuuguuagagggcaggcuauacugcuguaacaaagauacaccagaauucagaggcuuaaauaugauugaaguuuauuuuaccaacugacaguccaaacccacacaugaguaacccagacuaaggguucaugugaucauucagggauuaaggguucucccuucuuauuacccuacuauuccacaagguauugucccagccucuuugguugaagcuggguuaccauuacaucuuuguucuagccugugacaaagggacaaaaaggagguggaggacaacaagcaauuuuccuuuacacaagugacacaguguugcacauaucacuccugggcaugggucacuggaaggaguuuugucacaucgccuagucuagcugcaggggaggcugggaaauguagucugaguagccacacgcccagaugaaacuccagggauguucucuuaccaaaaggaaaaaagggaaaaugaacacugggggacacuuguagucacauuagaaguugcacagugaaagauuggcaaagaaggcugggcgcaauggcucacgccuguaaucccagcacuuugggaggccgagacgcauggaucaccugaggucagcaguucaagaccagccuggccaacauggcgaaaccccaucucuacuaaaaauacaaaaaauuagccgggcgugguggugcaugccuauaguuccagcuacucaggaggcugagguaggauaauuacuugaacccgggaggcagagguugcagugagccgaggucaugucauugcacuucagccugggugacaagagugaaacuucaucucaaaaaaaaaaaauauuggcgaagaaauacuugaauuccucuuuuccagucuacuguccuucuuguguguuuuucucuuuguuauguuugauucugagcuauugucuuagucuguuuucugcugcuauaacggaauaccacagacuggguauuugcaaagaagagaaguuuauuuggcucaaaguucuggagccugagagguccaagagcaugcuuccagcaucuggugaggaucauccauagcggaaggauggaaggcaggagagcgggacaggaagaaggaggucaaacccugugauaagaauaugaauccauucaugagggcagagcccucgugaucuaaucaccucaguggcaauuaaaucucagcaugagcuuuggaggagacauucaaaccauagcagcuauugaggcuacccaagaugugaaacaaaauugcagcuacuaaagcagugcuguccagcagaaauacaguaggagugcagaugucauuuuaaguuaauuugaauaguacaugagauuuauuguauuuuauuuaucuaucuuuuuuaggacaggucucacucuaucacccaggcuggagugcaguggaacaaucauagcucacugcagcuuugaacuccugggcucaaguaaucuuccugacugagccuacuccccuucaccacccccacucuccaggaauacaguccaucuaauuuuuuuauuuuuauuuuuguagagaaacagucugucuauguugcccaggcuggucuugaacuccuggccucaagcgauccuccugccucggucucccaaggugcugggauuaugagcaugaaucacugcacuugacugagauuaauuuuaauauuauaguuuauuuaauuugguauaucuuaaauauuauucuuucaacauaucaucaauuuaaaaguuuuaagauauuuuacauuccuuuuuuuggugugaaacccuugaaagccaguauguauuuuacacucauggcaagucucaguuuggacuaaccacauuucaagugcucaguagccacauguagcaaguggcuauguuauuggaaaguacaauccuagagcaugauauucucuagaaauuuuccagagcugcauccugacuuuuuguuuuguuuuauuuuauuuuauuuuuuugagauagcgucucgcugugucucccaggcuggagugcaguggcacgaucucggcucacuguaaccucugccuccuggguucaagcgauucuccucccucagccuccugaguagcugggacuacaggugcgcgcugccacaaccagcuaauuuuuguauuuuuaguagagaugggguuucaccauguuggccagaauggucuugaucucuugcugacuuuuauuuuuaaaaauugcccaugaaccaccuuuagcuuaagaaauaaaauaucaucgaugcagccccucccaucuguuucucccuuauucuaucccucuuccucucuuccagaaguaaccacucuccugaauuuauuuauucauucccaugcguuucuuugugcauauagccauucuguuuguuucuaagcuuuauugaaagagcaucauaugguggaucuucuucugcaaguuguuuuucucucauggagauuuauccaggcauagcuccaguuuauuaauuuucauaacuguuuaauauuccauccuaugaauagcucccagucuuugcuucaagucuucuucugauggauguucagguugauuccagguuuuugcuacuucagacaaugcugccugugaacauucuuaugcaugucucaggggcagguggcugcaauuuuuuguagcacauauuccuaggacuggaguugccgagucauagccuaugagcaccuccaaauuuauuagauauugccaaguugcuccccacagugguuuguucucccacaaaguacagguaagaguuccuggaacuccacaucucacccaugcuuggggcugcagccuuagcacuuuugccccuuugacgggcauccucuuaccuuggcccucucagaugacugcaaacagaaagguggagcagcuacaacaagaauacacggaaaugaaggcucucuuggacgccucagagaccaccucgacaaggaagauaaaggaagaggagaagagggucaacagcaaguuugacaccauuuaucagauucuccucaagaagaagagugagauccagaccuugaaggaggagauugaacagagccugaccaagagggaugaguucgaguuucuggagguaggucgccacaaggcauuguugaauguuuuuuuuuuuuuuuugccugaugucaugcuguugaugauagggcccucaaggagcgggagacuggaagaggucacuggaagcaucccugagacacacgcuguauuaguuuucugagcugggcaacaacuuaccacaaauguaggggcuucaaaaaacacauauuuauucucucagaguuucucuggcucaggaaucuggacauggcuuuauggguggccugcauagggucucaccaggcuacagucugcgagggauggccaggcuguuuccuuuggagcucaggguugucuuccaggcucaugugguuguuggcagaauuuaguuccuuaugguuguaggacugaggccccccgcaauuuccugcuggcugucucucagauugauagcugacuucuucaaggccagcaugagaauuucuccucuagaaagaugcaaucccucuuuuaaggucuuuuaccugauuaagucaggcccaccccagauaauugcccuuugaugaacucaaaaucaauugauuugagaugcuaauuacaccagcaauauuccacccccuuugccacaugacauaaccuaaucacaggagugauauccuauuucauucaccguccugccgauacugaaggggagggcauacuauaggguauguacaucagucggggucgggggcuugagggccaucuuagaacguugccugccacucacacuccaccucuuccucccauccuuccuccagcagcuccuggaaguguguguuaguagucccuuuugcauugcuauaaaggaguaccuaagacugaguuauuuauuuauuuuauguauuuauuuugagauggaguuucacucuuguugcucaggcuggaguguaguggugugaucuugcucacugaaaccucugcccccaggcucaagugauccuccugccucagccuccugaguagcugggauuacaggcgcacgccaccaugcccagcuaauuuuguauuuuuaguagagacgagauuucaccauguuggccaggcuggucucgaacuccugaccucaggugauccacccaccucggccucccaaagugcugagauuacaggugugagccacugcgcccaaccagacugaguaauuuauaaagaaaagagguuuauuuggcucacaguucuacagguuguacaagcauggcaccagcaucuguuuggcuuuuaguuaggccuuuggugaggaaggaagcuuuuacucauggcagaaggugaagcugggagcaggcaugucacaggguuagagagggaacaagagacagaggaggaagugccagccuccguuaaacaaccaguuugugcaagaacucaccuguuaccauggggagggcaccaagcggugcauggggaauccacccccacgacacgaacaccucccacccugccccaccuccaacacugggaaucacauuccaacaugagauuuggaggggacaaacauccagacuguaucaaaguaucugucuaaagcaugggcccccugcuguuucuggccucaugucccuuaacauggccugcaggguccuaggugacugggccccgccugugccagcagucucaucucauaucauccaucccuggcucaugcccuaugcacucacuguuccccagacacagugggugugggugggaugccaugcugggcauucuugccuagugagucguauccuuccagggccuuggaucccauugccaugccguaucgguguucccaagcaugccacacuguuucuacaguaacauugggugauguuguuucagaugugcauuuuuucauggcuguuuugacuguaagcccaucucuuauuacccccauucauccuccugccaaucugaccagcacauagcagagugcuuggcauauaguggugugccccauugauugagugaccugcagcuauaccugaaagacccagauuccuuguucagaucaggggguggggagacagugcaggagugaaugggaaccuugucucugugcacugaggccugaugcgugccuagucuggauggcguuaaguuucaucccaaguguucauuccugucuguuggagcagcugccccgagcucucgaaggaucugagugcacaucuaggcuucuugauacuguacaacccuauuuuucucaaaguuugggacuuccaggaagacccucccuucccauaagauauucccuggcugcaauccacaucccuugagaugucccugucuguuaccagaaugugugauuagagcuguuccccuaggauuggggugguccugaguuuccugugcuuuuccaccuuuagcuggaaaaguggaaagaacauuguccugggggaucggaagaucucagucccagcugugucugugccccuagcugguggaguuccugccaugucuagaccucaguuuccccaucuguaagaugagugaccucugggguccccuccagcuccagauuacugugucuucaagugucauuuaaacuccuggugaccucuggccuguaauuugagaaggccaauuggacuuagcacucuugggcauaggggagagccuccugggguuggugaggacugagcccagguccccguuucaccagagcugccugcacuaacccccuggcauguuccagaaagcaucaaaacugcgaggaaucucaacaaagccagucuacauccccgagguggaacugaaccacaagcugauaaaaggcauccaccagagcaccauagaccucaaaaacgagcugaagcagugcaucgggcggcuccaggagcccacccccaguucaggugaccuuagcagcccccuaugcugcccccuguggaacccugcaacccgauggguccccuaaauguuuugggaugggagauuggggcgugaucccgagcacuggggccugaguuucagggcuccugaaacauccgcccucugucuggaggcugguggggagucugcuucauccugacauuuuaggaucuuuccuaaagcauuuuuggggacuugauguuaaugcuuggacuuucuggacagauaggcucuuuuggccugugaucuugaggccaacuuggauggguuuugaauaagcuagggcuuguuauuguguuuggugggggaauggcccguuugggggagaaaucuagaauuccucuuugacacccccuuuucaucaccccauauccaauccauugccaaauuucacuucuuucaaucuccugacucagucugcugauccuagcacugcuugccuguucuccauugccaucaccugucgccccaugacuguagcagcuuccuaaacccucugcaucugccgcugcagccagagagggauuuucaugaugcagagcucauguccugggaccuauucugcuuugcccucucacuaggcuuccuauuacucccugaugcagaccaaacccuugacccuggucuagaugccaggucaagcccuguuggucucucuccagccccaaggcgccccccacucuccucuggugcaucucucugcauucaguuccucaaauaugcaaaacuuccugcuacagggccuuuguguuugcucuuccccacucuccagaaggcuugaacuccaccgucuucacuaauuaacuccucucacccuucaaagaucagcaaaacauuacauuuauagccagccuccccugccacugcucccacuccucagacugggcccaggguccuugucauccucuugggacucuugcauggguaguaucgcauucuuccuugggauccccguauaucucccucauuagguugugaucucugugaggucaggggcugcggcuuauuuauuuauuuauucaggaucuugcucugucgcccaggccggaaugcaauggcgugauuauaguucacuguaaccucaaacuccugggauuaagugaucccucugccucagccucccgacuagcuaggacuauagauacacaccaucaugcccggcuaauuaaaaaaaaauuuuuuuuuuuuugagacggagucucgcucugucacccaggcuggagugcaauggcccaaucucugcucacugcaaccucugccacccagguucaagcauuucuccugccucagccuccugaguagcugggauuacaggcaugugccaccacaccuggcuaauuuuuguauuuuuaauagagacaugguuucacuacuuuggucaggcuagucuugaacucucgaccucaaguaaucugccugccucagccucccaaaaugcugggauuacaggcgugagccaccgggcccagccuaaaaaauuuuuuuuguagagccagggucucgcuaaguuguccagacugaucuugagcuccuggcuucaagugaugcuccugccuuggccucccaaaucauugggauuacaggcuugagccacugugccuggccugucugauuuuucuucaacgcuauuucccuagugccuagcacagagccuggcccauaguaaaucucuguuguguaguccaagauugggcuugaaucucagcuuggccugccgaguguccuugcagaagggcuucugaaaucgguggcggugcagccccauuguggaagugcugcgugggggcaaagcuauagguggcugguaugugggaggaggggagagaaagaauagugggaaaggaacaaguguugacccagccuccgcuacaugaccuugaucucauucaggagucacaucaaccaugagcaaggugaagucauccccauugugugcucgaagaaaccaaagcucagagaagucucagaggccacagagcugggugcugguggaaaaaagacuuggcccuugcuacauuuuaaaaagucagagaaaaaagggaauacaccaaacugguucuuagaucaccuuguuuguagcucuuguaagcgaugggauggggaaggucggaggaaauggcugucuguguaaacccucugccugcccaccgacccauggcaaagcuggcugcuagggucagugagaggagccgcacacacugagcccuucuucucugacacaggugacccuggagagcaugacccagcguccacacacaaauccacacgcccugugaagaaggucuccaguaaguagccccaccccugucuccauggcaacagcauggcuguggccuccccaggcucuggccaagucacuuccggcccaucccgagucacuguggggccuggaccucagugggaaagaaguugguggcaguccccacugcggggggcuguagggcuguggcagaagcuccgcuguccaucagcauugcacguuugggcugccuggaacagcaagaugccugaggcuggcuuguuuugagaaauauuuacuauacccaaguccuugggcagagccuugggcaaggagacugauggcgguccaggaaggguggaggcuaaaccuccuuggcaucucagcaguguuaagucucuggguuguaaugggcuucugcuauuaccauguuucucaacuguuuuuuuuuuuuugguuucucacuguuacccuccuccugcucauccccagaaccauuugagaaaauuuuuuuccuaauuacaacccaugaaauuuuaauaccacccaucuacugcauaacuguuuauguuugugcuuuuacacauaaaaagaguaaucuuuuuuacucccccucccccaaggauccauuuuugcccuccuagggguacuaucccccucauugggcaggcaccugccauugacauggggguugaggagaagagugguccuguucugcaaauguggacaauagugauaucgaggccacaggaugauucugagugaugaggggacacugauugugagagcucuuuaugagccauauaccacugagauguccauauaccacugagauguccauauaccacugagauguccauauaccgcugacauguccauauaccgcugagauguucauauacugcugacauguccauauaccgcugagauguccauauacugcugacauguccauauaccgcugacauguucauauaucgcugagauguccauauaccgcugacaugcccauauaccgcugacauguucauauaccacugacauguccauauaccacugaaauguuagcugucauugcuucccugaaaaguuggugugaacccaggagggcuggcugcacacugcugguguuggggggaugagagagccagggcuugcucuuuguuguuguugcuugugcuuaguguucaggucaccuguagcaggcagagugugguaucgguccccgaauggaacagagucagggcugggaugccuggugcagauggaggagggagcccuuagcugggccggaaaaccucgaaggguacuuugugugaaaagaggagugaaagaggaaguggaaagguacuguugaccuguguccuuccccagucaccuuccucugaaagcuccucccuuaguaugaaugagguagggaugccggccagcaggcagguguguuccccagugaggugagguccucaugucacagcagaaugacacccuggagaauaaaguucgggaaugaaucaaggcuccucuaggcugaaauggggaaauaggggaggggguauggaguagucccagugcagagagaugucuaaggguaggugaugagggaggugccugugcccuagauugaugucacagccugggccucccaagaugcugguccacagggagugggugggaaaguggcagaaggggaggaaaugggagagugagcgacugugagugaugugacuucgaaguaggagaagcgguagcaagggggcuuuguggugugaugggggucugggggagggagaggguaauaggagagagcagggcuuaucuguaaugucagguguccugcaggugggcagggauaugauuucaaaaacgccccuuuuuguuccaguguuguggaagguggcaaagaaggaagcugggaucuucuagcccacuugaguggacuuuggacucaccuggagggcuuguacaucacagauugcugggucucacccccagccuuuaugauucaguggcucuggcuuggggcccaagaauuugcauuuacuauuuuuuaagagacagagucucgcucuuuugccuaggcuggagugcaguggugcgaacagaacucauugcagccucgaacuccugggcucaagugauccuccuaccuuagccucuugaggaguuaggacuguaggcaugugccacuaagccaggcuaauuaaaacaauuuuuuuuuuuuuguagagacaggauauugauauguuguccaggcugaucuugaacuccuggccucaagcaauccuccuaccucagccucccaaauugcugggauuacaggaguaagcuacagugccugaccaauaauuugcauuucuuagggguucucuggugaugucacugcagcuggcuugggcaccagacuuugagaacgacuauuuuagccaaacucaguuccuguagguagacacuccagauauuuuuaaaagacuuggcaagcauuuuuuuuuuuuuuugagacagggucucauuuuguugcugaggcuggagugcaguggcaagaacacagcucacugcagccucauccuccugggcucaagcaauucuucugccucaccucccaaguagcugggacuacaggugugugccacuaggccuggcuaguuuuuucuuuuuuuuuuuuuuuguaauuuuguagagaugggguuuccccauguugcccaugcuaguuucuaacgcuugagaucaagugguuccugcaccuuggccucccaaauugcugggauuccaggcaugagccaccaugcgcccagcccuuggcaagcauuuuuuuuuuucugauucccuauuugguuuuuguguuuuuuccuuuauggaaauauaauuuaccugcaguaaaucucuuuuuucccugcaguaaaucuuaaaugugcaguuagaucuauuuugacaaaugcauacauguguuaccauuguucaaaucaagauaaagaauuucccuuucuccagaaaauuccuucaugcuccuuauuagucaguccccgcccccacgaccgcucaugcugguuucuaucacuauagauucauuuugccugcugacuccuucuguuuuucaaauuaaaacauccuuuuauuugucugggucaaauucaugcacaugaauguuauuauuuugaaaaugucauuguguugugccuuaaaagaaauuaaaucugaaaacuuucuuuugcagaagaggaaaagaaauccaagaaaccucguaaguuaugcauuucugcaacuguucguuucuugagacugcccgagcacagaacuaaaugcugguagugagagucgaccucucucaucaggguucugugauggguucuauaugauuccauucuguaauggcagcaggccugaggcuggaggggaggacaagcauaagugagaugaauaaggugacuuuagccuugucuguuuuccccuguguuguccugcuguucaggcguguguuuguagaaguggcucuuaaucaguguggaagggaguagaggccaucccguugcucuguaucauauuucccuuuccuuacccccagccccugucccugccuuacccagcaagcuucccacguuuggagccccggaacaguuaguggauuuaaaacaagcuggcuuggaggguaaguuaucaugggcaaggagcuuugggguguccacucugaguuuguucugcaaaucacucucuguuuccucucccagcugcagccaaagccaccagcucacauccgaacucaacaucucucaaggccaaggugcuggagaccuuccuggccaaguccagaccugagcuccuggagugugaguagcuucggggcuggugcgcgguuccacugguucugucucuccugcgccgcucugugcagcucucugugaggccagcuggccggcuauaucagccacuccccuucacuuguccucuacuuuguugcucccuuauuuucucccagucaucagugccuuucuuuacuuuuccuaacuagcucagauuucacaaucgguccuuugacucucccucuugccgucuagucuggcccaauugagcucaccuuucucugugggucggcgccugcauguccucugcagagaaggcagggcgauugcggucaccggccuucaccgggcgucccguugccggcaugccugcccugcaucuccugucuccuccccaccacucuccagagccaccauucccaagacuucccacuggccauagcuccauccuucucccugucccgcccaccuucugcuucacgaaaaagacagacacuguagaaggggcucccccugcucuguuauugacaucgcaucugcaucuacugugcccccuuccucgccuccuggccccuuucccaagacccccuggcccugggcucuggagucugcuccccacacgcucucuggaaucuucugcucucucuuaggccuuuccauucccaucucuucacccucagcaucucuaccuaggcuugccuaucuguagcacguuuacaucucuccaaaucacaaaaacaaaccuagcaaaacugucucagcugcagcucuguuuccugccucccuuucacccgaaugcuuguuaaaaauacaaauuacuagcugggugcgguggcucaugccuguaaucccagcacuuugggagcccgaggcagguggaucaccugaggucaggaguucaagaccagccuggccaacauggcaaaaccccaucucuacuaaaaauacaaaaaauuagccgggcgugguggcacaugccuauaaucccagcuacuugggaggcugaggcacgagaaucacuugaacuugggagguggagguugcagugagccgagauugugccacugcacuccagucugggcaacagagcgagacucugucuuaaaaaacaaacaaacaaacaaaaaaccccaaaaaccaaauuccugggcccuguucuagcccuacaagaucagacucaggcaagcacggaaagcuguauguuuagcucauuuccuccaugauccuuuugaggacaguuggggaaaagcagcucugcagauuuucuacauugguggcucucaacuguggcugcguguuggaauccuggggagcuuuuuaaaauccccgaugcccaggcugucccccagacugguucauucagaauguugguguuuggcugcccaggguugcaauguggggccgaggugggagccugaagucuaauccucgugccacugcauucugaccucuguccugcccuugacccaggcagcucugaggucaucaggguacuccgugucacaaaauccagggacgccuuucagcuuuuauuuagcuucaccugucaguggcauuccuccuccuucugacacucucuccccuugccgcuugagcugcuauaccccccuggguuuccauccaccccuccuuugcaagcucguccaaccuggaaguggguggaguuccguugucaaggccaggccuagggcccucccacuuuccgucuucuuguuucuucugcacccacgugcaacacuccaggcagcaccugccagugguacccacuuccauguggaggccaaagccaaucacugaaaaauauagcccuuccuuuaucauaagcagcugcagcaggcuugguggggaucugugggucccuugcuuuuucagggcuggccuucuuguagcccuccgcugucccugccccccaagagaggcccagaccagcccugggcugcagcuaacucuugcccaagcugcuagcggcggugcugagccacgucuuucaggagcugcugugcacucuguggcagccgcauaaacagggaaaguaaaauucuaucaacuuagggccuuuuccacccccagcuuauucauuuugccuugggggaaacucgggcuccagugaaaagugucaugcccugagccaccuagcaaaugagugccucgcuuggcucccugcugcccaccaguuaaagucuagccuccuaagcccuucccuuucuagccccaacauguuucccuucuccugcugcaucuguguucccagccacccagcuuccccgaucccagcacaugcgaauccccuuggcacuccguggcuucacucucacuguucccucugucuggaacagcuuuucucucucuguucuccucugucuaguucucaucuucuguuacuuggcuccaauuccagccugccagugaaauguuccccaacuguagcaucaguugccuugucucugugucccuacagugugugcuuacccuuuuggcagagugugagucucaugguguuguuacugauggacuugccuugcuuguuggagugugaacuccaugaggcccggcaccuugucucucugguucaugguugugcaucuugugccagaaucuggugucagucaggugccugguaaaugguuuuggauggaugaauggacagacauacggaugacugauagaugauagauggcuggcuggcuggacagaauggauggaugaauggauggauagaugagcugaugaauaauggauggguggauagauggguggauggauaaauggacagauggauagauaaguggauagauuaaugaaugaaugaauggauaaauggaaaggcagaaggauggauagauaaguggauagauggaugaauggaagaauggauagauagguagauagauggguauauggauacauggguagauggauagauggauggauggauacauggauggauugauggauacauggauagacagauagauggaugaauagacagacagauggauagaugaguggauggauggaccaauggguagaugggugcauggauggauaaaacuagugaauaaauaguaccacuuuggcaaaggucuaaaagagcacuuugggccccuuguaauuaauuccuuggggugauguuuucucagauuacauuaaagucauccuggacuacaacaccgcccacaacaaaguggcucugucagagugcuauacaguagcuucuguggcugagaugccucagaacuaccggccgcauccccagagguucacauacugcucucaggugcugggccugcacugcuacaagaaggggauccacuacugggagguggagcugcagaagaacaacuucugugggguaggcaucugcuacggaagcaugaaccggcagggcccagaaagcaggcucggccgcaacagcgccuccuggugcguggagugguucaacaccaagaucucugccuggcacaauaacguggagaaaacccugcccuccaccaaggccacgcgggugggcgugcuucucaacugugaccacggcuuugucaucuucuucgcuguugccgacaagguccaccugauguauaaguucaggguggacuuuacugaggcuuuguacccggcuuucuggguauuuucugcuggugccacacucuccaucugcucccccaaguaggcaggcuguaggcacuugggcugacugccugcagaagucccaagacccuagugaaaauacagcaggcagaacucuccuuggauaauuccccaagaggucccaaggauugggagcaugggaggggagcuggcgggagggugggaggugggauuuagccaggaaaggggugagagugauuguguugugggcgaggaggcguuuccacccccuggugccuaucagggcagggugaccuacuccccauuguucuggaaaucuccaggcugcugggcagcugggcagagcucugggaagugaagucaugagugcccgauuccucuuagagaaaauccauagcuacuguagguucugucuugggccacuuggaucugaaggcugccccuuugcucucugggguagccuucagaucuugguguuuugaauucuuacuauagauguuuuuaaaguuccaaagucauugaguuucaauguuacauaaacuccauuacccgcauguuggggcuugaucuccugguuauuaucugugcuugaggaaacacccacagcagucucuacccagaacaguuuccuaaagaggcauacccucuuccuccacuggaaaauagugcguucccuuccuacccugcacacccaucgcccccacauugaugguuuucaaacagcaaacuuuucagcuaaagcuucaaaccaugauuggaaucagccuguguuggauuugugauucagggucauggugacccugauccaguuuggguggaaauccuuccuaaguaucauaagaagcaucuuggcagagaugcuuugguggcagccaugagcuuugcuggaggccuugcuucccauagccuuggcuguggggcaaggaacucugccaggcgagggggaugcugcccuggaucaacagaagccugguggguuugcucguguuagaguguccugccuucuuacugacaacucuucucggugauagccucucuucccuggauugugacauauggaaugacagugcagguaccaccgaggcuagcacagucaagccuccagcuaagcuggaucccugaagccugcuaucaugcagacaggcuaugcggcugccucggaccaugcuaggccacuugcuggggugucaaccuaccaccaaaggggucuuuuagcaaaccucauggggaacaggaacauuccuguucaucccuggccacaggcugcagacccagcacuggcccuugcgugagucagagccuggggcuggcccuagccccuucuacugacuuccucauuuaagccaauuauauaagcucacauugaucagggagggagggaaagagcuaaagagggucacacaaguggcuauuuucccugcaguguuucuguguggugaaaauaacccaguccacuaaggggcgggagugaauggauggcuggauuuuccccaagcuccuuauagccuaauguugucaggaugugaguaugaggaauuuagccucuuauagugaaaugaguccaacucugggcuuugcuuagaggagagcuccugucaggcuuccuauaauaugaaaagaagucaccauuggggaacuagagaccccagaccuuuucauauggauauuugagaauguaaugcaucucaggccucgugcuggaacucuagggcacucuaggcaggcucagaacacuugauauuccugacagcuacacaccugacaugcagguacauaccugaucggugucaucuccuaacaaggauuuucaguuccucgggagagcaauaaucuuuguaggaaagacaucccugcaauaggugauaugugguccuuagaaguuuuauuccuuuacuacuuggaagaaaaguucuuuggugauucuucucugcuuuugaagaugaucaaaagcaucuucauugauuuucugaaacgaaagccuugucugaaaccaauuaauacuugggaaacagcugggcuuggaggaguagaaugccagagauaaauccauggcuccugcucuggcucucuucugcagaaaugagggcaacagugaggccacuucccuggcaaaugugcagcucaggauagggaagcauaagacccucuguuuaaaagagagucaaguagguaaccaaagccaagcucugugcaaggugcuuuggaguuguaaauugaggagugcauccuugcugucuugaaccauucuguuugcaauggugagaccuuacauaaccuagccuugcagggccgccacacaacccuggaguccuagaguuggaggaaccuuuguauccaucugacuucucauuuugcagaauaugaugagaaaguagaggaucgcucuguucaccacucuugcuauuccauuaguggggagaugccugcuagcaugugugaggggaacacucugauacacugggaaguaucggaaauucccagaaacacaaacauaaaauaacucuccuagacccagguacuggggacugucucaguccguguggcaugauaaauaaaagguuaggaucaagucuuuguauuuuucaagaugugguagcugauuauuccuguuuuaaguacucugaaauugaucugugaucaauaauacuaauauguuaucuuuuaccguauucugccucucacuauugauuuuaauuaguuaggaguauuugagcuguuauuucuugagcuuaauauuuuuuuagaguuaacucuuuaaggagauaaucauggcuguagacaaggccagggcuggcugacgugccuuagaagguuugaaugcaauaaagcgguguuuggcguucuccugcauuguagugcggguacaaaaugcuauuuguucgucauacuguugucagcagaugagccgcccacuacagacggcuacugcccagggaccugcccaggccccacccaagggcucccaaggguugagauuucugcagaccuauagccagcacacuuaguccugcccuauauagaguuccucuucgggaagcuuuugauaaggaauucucagaccgauaggaugucugucugggcuuugcugcgggacagucuaacugugggggcuaggggaaagcaggagaguaucgaucaaagaguaagccacacacggauaaucaguuacuagggauggaggugugaggguucauuauauuauucauuuuacuguuguauauguuugaaaaugucuauaauaaaaagcuuuaaaaaaaaaaaagaaacaaaaauaguucaggccagcaaugggcccuccauguucaguggauuuuauccuuguuucaauugggguaggaguuccaggagguguggauuggagguugucuaaagaauugaacuggccuuugucccugcuuccugggagggagacuuucaguccuugacauuuccaggguaauaggagugucuuuguuauuugugaggccaugggaucacaccugagcuuaugcuaaaaggugggaugacucagagcuggggcuggucaccagacagacugaccaugugauuagagguuugaggcuuugagucagccugaccuauggggcgggggacuggaggcugaguuuaaucaucuggccagugcuuuaaucaguacaucaugaaacccuaauaaaaacucuggacacuaaagcucagcauagcuuccuggguggugaagcuguggcuaugccggcagggcagugugcccuaauuccacgaagagggggcaugggagcacugugcucaagacccuuccagaccuuucccugugucuuccuuggcuuguggagcugauuuguauccuuuauaauaaaacuaaucauaaguaua
